United States Patent 7,745,391 (HUMAN THROMBOSPONDIN POLYPEPTIDE) - sequence listing, part 237

SEQ ID NO: 643800 - DNA, 483 bp, Homo sapiens
  misc_feature (8)..(8): n is a, c, g, or t
  misc_feature (19)..(19): n is a, c, g, or t
  misc_feature (21)..(22): n is a, c, g, or t
  misc_feature (45)..(45): n is a, c, g, or t
  misc_feature (50)..(50): n is a, c, g, or t
  misc_feature (54)..(54): n is a, c, g, or t
  misc_feature (58)..(58): n is a, c, g, or t
  misc_feature (88)..(88): n is a, c, g, or t
  misc_feature (166)..(166): n is a, c, g, or t
  misc_feature (181)..(181): n is a, c, g, or t
  misc_feature (203)..(203): n is a, c, g, or t
  misc_feature (216)..(216): n is a, c, g, or t
cacgaggnctcgtgccggnannttcatgatagtgaactgccgtgncggcnagancaanattctgcaccagcaggctcagtatcacaangaccgcgagcgccgctttcagtggccacgccaggataggaacggagcgcatagcagttctcattttaatgcatccggntcctcggggcttganctgcatcaaacctctgtctganttccaccattgantgcgccaaccggcggctgaatgccccgccggtgcaactccatcggttggaacatctctgcggcccatgagtttcactttacactttgcggtcaggccgctcttgatctacatcaaagggatcgcggatcgataacgggggaaagccatcggcctgctgccgccggccttcgggatagaaggctactcgatgtcgtgcgcccaccacgggccgaagcgcttgagctgctccttttgttccttggggaggactccttcgagcttgtcgt

SEQ ID NO: 643801 - DNA, 95 bp, Homo sapiens
gttaggttccgctgttgctgctcgtgttggatctaggaccgtaggcaggcatggggctgggggcggacaaagatgcttacccgatcccgagagtc

SEQ ID NO: 643802 - DNA, 826 bp, Homo sapiens
tacccgggtttcattaaaatctttcccgatattaccagcgaggaaaacaaaagcaatctccccacagcccacccccaaaattgtgacaaccaaattaatcactttggcaccaaaattgggataatacgaggggtggctggccacagatttttagggaacatgataaagtcttcctcccttctggcagagagctgatatggagaccatcttcgccagggggatcctagtggggcaatggaatgagccctgccctgaccacggtcccacgccgggtatgtccggtcacgcggctaactggacctgggcggggtctaagggaaagtcaacttccaggaagaaccgacacggggcactcttagaggccagtcattctccgttcttgaaaggtgtgtgtgtaaaattatagcatgtgtctatatgccacatgccagtggatacctgcaggtgaatactgcgtggcgtaaagctacatataacacaaatgagctcatatacatctccggagccacacaggcacgagtcacaggaggcgtgggcggaacacctactggccaaacgcgggaagcaccatcgacgcccctggacatcaggaacgggctaaaacacccacgctcgccaaaccaagaaagaaacaaaaaaaaccaatgtcagcagcaccagcgaaaaacctgcaactcccagagggcacgaggaccggaccaacaattccaacgccgcataactcccactaaacaacaggacacacagtcagcccagagacaaaacaccatcgaaccaggcacaactgacagacccacaacagcgaccaaccaccgcagaggcacac

SEQ ID NO: 643803 - DNA, 390 bp, Homo sapiens
  misc_feature (214)..(214): n is a, c, g, or t
  misc_feature (217)..(217): n is a, c, g, or t
  misc_feature (313)..(313): n is a, c, g, or t
cttttacccctggcacacgggccgcgactaccagcaactgtgcagccaacaggacctggccattctgccctgggtgcgggagttcaacaagtttgacctttacaccaagtgcccggacctgccggacgtggacaaacttcggccctactaccagggggtcatttacaagtactgccctggcatcctgaggtggtgaccctcctgccacccaaantgntgctggacctaggcctggccctccgcctgcctggaaaggcctggccctgggcaaacaaccgccatcagggtttacctcggtgggggacccccctcncccccttagggttgccccccctcccggcaacttgtgcctggggtcaataaaaacctggaaggatgttgtgcttttta

SEQ ID NO: 643804 - DNA, 455 bp, Homo sapiens
  misc_feature (329)..(329): n is a, c, g, or t
cccatactgcacggaatgatttattccaggaaaaagatggcacaaaaccaagaaaaggaatacatagaatagatgaaataggagatctaatataggagaaaggtaaagggaaatattctgggatagaaagggtatcctaggagtacagggccactggttgatataggagcaaatcaggtactccaggagaattttcttcctgaagatgaaattgatgggaataaacatcttgaaaggagatgtggacaaatggcagtaaatctgaggttaaattacattaagtacaaagaaaactaaggaacaacaataacaaaaacttattaatctgngaaaaacagaaagactcaggaaaataaaagtaacatgtctctaacgctctagtagcatttgtagtcataaaaaatgtaactctgaatcgatttaaccaaaattaaaattaaattacatcaagaaaa

SEQ ID NO: 643805 - DNA, 363 bp, Homo sapiens
tacaggatctttatgcctgaagagtattgggctgtgatagtatgttgagtctgtagtaggagagtgatatttgatcaggagaacgtgttactagcaagagagtctccagtaggtaatagtgggggtaggcgaggtagcgaggttgtagaagtcatcaaaaagctattagtggagtagagtttgaggtcttgagagaggattatgatgcgaactgtaagtggttcggtagtttgggttttgctaggcagaatagtaattgaggatgtaggcccgtggggcgattattgataaatgacttgtcctgtgttgaagcttcaggggggttttggagtgagaaattggcttgttaactctctctgggca

SEQ ID NO: 643806 - DNA, 464 bp, Homo sapiens
  misc_feature (12)..(12): n is a, c, g, or t
  misc_feature (43)..(43): n is a, c, g, or t
ttccctgttatncaaacttcaggaacctcatggatgattgttnagcagtccttgaaaattgaaaagttagccctctgtctctctaaaccagtaaacatatcttaccaaattaaaatgacttttaggctgggtgcagtggctcacacctgtaatcccagcactttgggagggcaaggcgagcggatcatgaggtcagaagatctagaacagcctggtcaacatggtgaaaccccgtctctactaaaaatacaaaaattagccaggcttagtggcgggcatctgtagtcccagctactcaggaggctgaggcaggagaatcacttgaaccctggaggtggaggttgcagtgagccgagatcatgccactgcactgcactccagcctgggtgacaaagcaagactgtgtctcaaaataaataaataaaataaaataaaatgacgtacagagattctatattctaaaa

SEQ ID NO: 643807 - DNA, 186 bp, Homo sapiens
atctgtcttctgctgctgctcatctcctcctgaagggttgtgtggcttcttgggactctggcccgcccctgccgggcacgaggacacacggcaacagctactgtagtcactgcagctatgcaggctctgtgctagccctgggcaggcctggacgttcaggtctgctgtgccgggggtaggccccag

SEQ ID NO: 643808 - DNA, 305 bp, Homo sapiens
tagagaggtttgactaaatttgggtcaatatttttggcaaaaatacttcatagaggccaggtgcgctggctcatgtctgtaatcccagcactttgagaggctgaggcagatggattgctagagcccaggagttcaagaccagcctggacaatttggcaaaaccctgtctctattttaaaaaaagaaaaaaaaatgctgggtttggtggcctgcgcctgtagtcccagctacttgggaggttgagacaggaggatggcttgagccagagaggtggaggctgcagtgagccgacatcctgctgctgt

SEQ ID NO: 643809 - DNA, 1085 bp, Homo sapiens
atctccctgtgacgaactcatcaggaagcgcggggcggtggggatagtgacggcttaatgcctagaccgggagttggcaggtgtccgatctctgagttgggatccgagcaaggccttctcagccagtcaatacgcgacagacgaccttccaggcagcagatttgattgccctgtgtgcgaagatttgggctctcagcatgcccgtgctcaaactggggagtcaatgtgatgccctgggagggaagctttagtgcgagagaagatgccctgatttcagaatcacaaggtgcaaagttgcagggatgcccatgagcagcatgtatgagagctctctgccaatgcagccagtaccagctggtggcccacagaaggcccctgccatggtttgcttgattgcccggtgtgaagaatggatcagctatgacagagcgcagttccaccttgcgtgcctttcgataaagcccagccgatatggggacaatgtgaccgccgtggctctgaaagctacagcaaagaccagtccaggttaccacgagcagaacagccatggcacgcacttgatcggccatccttgccggaagtggcgaactcaatgtaggtcaataaaccaccagggccaaaccagaactttatatgaccctggcatgaccgattgatgactggcactacgccttcctgatactactacacccaggatagaaggtaggggcgggccatcaggtgcgggcatttcctcgcaccacaaatgagcatggcgctaacgcgagctcccacaggggtacccaatgtaccaaaggagacctatcacatcataaccaaacgatgcgctcccgaacatgcatgcgtacaccagcatcatgaagggtacaccgatgcgtaataatcagcgacagaaagaaggttttgactgaccatggttcccggaacaccggttgtgtaaccacgcgggaaaatcgtccgcgctaataggtgtgcacctttccgtagcccagtttactagcacccactgttaaagacacacaaaatgaaaggaggtagaatagttctcacctacaggatctatctcggtggacatgatagagaca

SEQ ID NO: 643810 - DNA, 617 bp, Homo sapiens
aaagggaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaacaacgatgaatgaaaacctaaccaggtcctgaaaggattcttaaggaatgccaacttgcaaccaacaaaaggttaaaacttgggattcaaggcccaaattcccgaagccaaggcccaaggcccgggacctttatgatgatgacctgaagttagcccttttaagccaatctgccaggccccgaagcccatggggcaagctagatccctatgattcctctgaggatgacatggagtatgtgggctttgcaaccttccccaaccaagtccaccgaaagtccgtgaagagaggctttgactttaccctcatggtgccagggagagtctgccctgggcatatccacacttgtcaatagcctcttccttactgatctgtaccgggacccggaaacttttttggtgct

SEQ ID NO: 643811 - DNA, 120 bp, Homo sapiens
gaaggcagcaggcataccacaaccacgaagagccagtcaaggacgatgagctcagcgtaggcctcatggttccccgggaggtcggggctgagaccacggagcagtaatacacaccacggt

SEQ ID NO: 643812 - DNA, 772 bp, Homo sapiens
ttccacgcccaaaaacgaaatctcccgtgtctccgcagggcgttcgatccctagagggaggagcctgtccaaacggacgctaacggcctacctccccctcaggaatgacatactataccaaagacactgtgtcgcacaaggatttggcattttgggaggggcccattaacgtccgtactccaccaacacccacagggaaaaattttcccagatttcgattaactttaccattacaccaagggaacttggaggcacattttccgccatacgtgctaagaccgctgccagtgcacaaggacttttggggcaaacccggggggattaacaaaaagcaatgatcgtcccgcgtcccaaagaccagaggagcagcgctaagcctgccgaaaacagggatttttgccccgaagacagccaagtacgccccaagctcgaagccggaacgctgagtcagatttgcccggaattttagatatcccccagagggaagaggagggggaagcccccccaccatttgagggacatggactaggtggcattccacacaccaccgaatgttgatgagattcccccgacaggggacacaatattgaggagacgagcgcgcgagggaagggggggatttatcacaaccgacccagacacaagttattcccctgaggagaaggcgggtgcacagggaaacacccacagcccacacccgagtttttgtgggacacaaaagagcgcccaaagaacacaacagggaacgaccagccacgtgcgagaatacatc

SEQ ID NO: 643813 - DNA, 225 bp, Homo sapiens
cagcatgcccccccccacggaaagaggaagaccgccagaaaacagaaaatgttccaacgcgcgcaagagctgcggcggcgagcagaggactaccacaaaggcaaaacccccccttcggcaagaaaggctctgggcaacggggccaaaagggcggcagcggagcaccgtcatccctcaggagggccctacgggccctacctcacagcggaaactttaaaaaacagg

SEQ ID NO: 643814 - DNA, 398 bp, Homo sapiens
  misc_feature (31)..(31): n is a, c, g, or t
  misc_feature (35)..(35): n is a, c, g, or t
  misc_feature (51)..(51): n is a, c, g, or t
  misc_feature (68)..(68): n is a, c, g, or t
  misc_feature (102)..(102): n is a, c, g, or t
  misc_feature (123)..(123): n is a, c, g, or t
  misc_feature (155)..(155): n is a, c, g, or t
  misc_feature (157)..(157): n is a, c, g, or t
  misc_feature (177)..(177): n is a, c, g, or t
  misc_feature (185)..(185): n is a, c, g, or t
  misc_feature (218)..(219): n is a, c, g, or t
  misc_feature (238)..(238): n is a, c, g, or t
  misc_feature (246)..(246): n is a, c, g, or t
  misc_feature (255)..(255): n is a, c, g, or t
  misc_feature (258)..(258): n is a, c, g, or t
  misc_feature (277)..(277): n is a, c, g, or t
  misc_feature (281)..(281): n is a, c, g, or t
  misc_feature (284)..(284): n is a, c, g, or t
  misc_feature (287)..(287): n is a, c, g, or t
  misc_feature (289)..(289): n is a, c, g, or t
  misc_feature (295)..(295): n is a, c, g, or t
  misc_feature (301)..(301): n is a, c, g, or t
  misc_feature (307)..(307): n is a, c, g, or t
  misc_feature (332)..(332): n is a, c, g, or t
  misc_feature (334)..(334): n is a, c, g, or t
  misc_feature (341)..(341): n is a, c, g, or t
  misc_feature (343)..(343): n is a, c, g, or t
  misc_feature (359)..(359): n is a, c, g, or t
  misc_feature (372)..(372): n is a, c, g, or t
  misc_feature (374)..(374): n is a, c, g, or t
  misc_feature (380)..(380): n is a, c, g, or t
  misc_feature (397)..(397): n is a, c, g, or t
tctattggtttgtttttttcgcaggggttgnactnggcggggaggtgggcngctagtggtcaccagcnggtagtggtttaggagcttgaagttgttcgggtncatccgaagcttgtgtgcgtncaggttgttcagggtggacagcgcgttgggcntntcgtccacgtgcgctacggngttggtcngcgctttggtcacctttttgccgtggtccttannctgggtagagccgtggttnaggtcgangtgcgggangtnggttttggtggtggggaangatnggnatntncttttnagggcntccgcnccatactcgccagcgtgcgcgccgncnttatccnangtgggtttgaggtttnttttgttgggagnanatagtnccatggtgggttctttnt

SEQ ID NO: 643815 - DNA, 628 bp, Homo sapiens
  misc_feature (56)..(56): n is a, c, g, or t
  misc_feature (66)..(66): n is a, c, g, or t
  misc_feature (81)..(81): n is a, c, g, or t
  misc_feature (143)..(143): n is a, c, g, or t
  misc_feature (628)..(628): n is a, c, g, or t
cgtgtgtcagccgatggcaccgggtggtcagtgagggacacactttggagaactgntgctaccagngtaagagtgcggggntatgcaggctcctgggtgtccatctgcacctgctctgggctcagaggcttggtggtcctgancccagagagaagctatatcctggagcagcggcctggggaccttcaggggtcctcccattatttcgcgaatccaagatctccacctgtgcagggcacacctgtgtccctgtagcgtggggggaatctgtgtcacactcagacagccaccagagacaccccctgggacagcgccacattctgccggaggcgggatgttggtaaccgagacccagactgtgggagttggtgatatgtggggtgatccactcggatgcccagaaattaccgggactttccagcacctggtaaaacggacactggaagttgggcctctttgcttggacacatctcttcccgggccccttgaattgtgaccgaagttggccactaagttggggcgcttggaaaggcgcttggaaccccaagccgttgaaccttggttgggagagtcaaagcgccaaaaaaccaaaggcttgttcaaacccttccgaaaaaaactttttctn

SEQ ID NO: 643816 - DNA, 448 bp, Homo sapiens
aacgttcgacagagctctaattctagcaaccaacgcagtgccaagagaaaacacagaggactgtgttaatacgcaccttgggaaatgcaatcagcaaagttcaaacgagggaagttatggaacaaacaagcggctttggtcaacaaataaactgcagtatttaggccgggcgcagtggctcatgtctgtaatcccagcactttgggaggccgaggcaggaggatcacttgaggtcaggagtttgagaccagcctggggaacatggtgaaatcccatctctactaaaaatagaaaagattagccaggtgtggtggcacgcacctataatcccagctactcaggaggctgaggcaggagagtcgcttgaaccaggaggtggaggttgcagcgagctgagattgtgccactgcactgcagcctgggcaacagagtgagactccatctcaag

SEQ ID NO: 643817 - DNA, 149 bp, Homo sapiens
aacgggtgcggttcttgacgttactttttttgtttgtgtgtttttttgtttttcggtttttgttttcagacagcgcctcactctgtcgcccaggctggagtgcagtggtgcgatcttggctcactgcaaccgcatcacccgttcgggta

SEQ ID NO: 643818 - DNA, 260 bp, Homo sapiens
  misc_feature (56)..(56): n is a, c, g, or t
  misc_feature (66)..(66): n is a, c, g, or t
  misc_feature (81)..(81): n is a, c, g, or t
  misc_feature (143)..(143): n is a, c, g, or t
cgtgtgtcagccgatggcaccgggtggtcagtgagggacacactttggagaactgntgctaccagngtaagagtgcggggntatgcaggctcctgggtgtccatctgcacctgctctgggctcagaggcttggtggtcctgancccagagagaagctatacccggggagggggaggcagacagattactagaccccaggagtttgagaccagcctgggcaacacggtgagatcccgtctctgctaaaaatacaaaattag

SEQ ID NO: 643819 - DNA, 734 bp, Homo sapiens
  misc_feature (724)..(724): n is a, c, g, or t
  misc_feature (727)..(727): n is a, c, g, or t
ttttttttactttacattctttttaataaaacaaacttgtgccacagctccaatatatgacccgcatgtcagtctttccgcaggggaacagtttcctccctgatgccctctttggtcacgatgcagatcctgagagcatctccagtatacacatccctctcggctgcagaaatgaagacatctttcaccagcctcatggctctgtccagcgtcagggggacgtgctctacattctgcatatttttgaagccaacctggttgtcgagcagaggctgcagcatggcacttgctgagcctcccgccttgaaagagtctctctgggtaagagcccactgggtcaaagctgtacacagctccctttccttcttcatcaagtcctccaatgatgttgtaaacatagtaagggaagaagcgccgtgagtacaggatggtagacagcattgcagcaatcgcccccgttgtcatggccttgttattggaatgcttgtacatctttaatcttgcttcaataatctttgtcaaagtgagacaatctccatggaaaccactgcagccaattactgtcttgtctgtcagtttgtagcatttggggctatctcgggtatgaattgaaaatccttcactcaatcgagtgtctgaagcgacgatggaaaaatcttctccagcaattgccaatacagtacctccgttgaaggcataaggcgaaaaccgcagctgcacaggngcncggagcc

SEQ ID NO: 643820 - DNA, 183 bp, Homo sapiens
  misc_feature (57)..(57): n is a, c, g, or t
  misc_feature (60)..(60): n is a, c, g, or t
aagctaaaagctcttattttttttaaggttttaacccgcttaggtctatttggatgnaanggtccacattcctttcatccacatacctgtgtatatttaaagacccaattgctcctctggagcttgtactttcaagaatgattaatctgtgtaataaactggttactccagtccttccatata

SEQ ID NO: 643821 - DNA, 151 bp, Homo sapiens
ggtaaatttaagagtgtaggcacggatcaatatgtcacgagacactcttttggcgtaggtggagaggagacctgaccttgtgtgatttcccactaggttccaggcactgtgtcacataggcacacacgctaacatattaagagagaatgga

SEQ ID NO: 643822 - DNA, 652 bp, Homo sapiens
  misc_feature (22)..(22): n is a, c, g, or t
  misc_feature (287)..(287): n is a, c, g, or t
  misc_feature (380)..(380): n is a, c, g, or t
  misc_feature (382)..(382): n is a, c, g, or t
  misc_feature (396)..(396): n is a, c, g, or t
  misc_feature (417)..(417): n is a, c, g, or t
  misc_feature (424)..(424): n is a, c, g, or t
  misc_feature (431)..(431): n is a, c, g, or t
  misc_feature (433)..(434): n is a, c, g, or t
  misc_feature (452)..(452): n is a, c, g, or t
  misc_feature (463)..(463): n is a, c, g, or t
  misc_feature (465)..(466): n is a, c, g, or t
  misc_feature (475)..(475): n is a, c, g, or t
  misc_feature (481)..(481): n is a, c, g, or t
  misc_feature (527)..(527): n is a, c, g, or t
  misc_feature (582)..(582): n is a, c, g, or t
  misc_feature (586)..(586): n is a, c, g, or t
  misc_feature (591)..(591): n is a, c, g, or t
  misc_feature (651)..(651): n is a, c, g, or t
acaatatttacatacaattagntggttttgacagtgttacttttgagtagaccttaaatgaatccacaaagttaatatattaaaaataaaatatacacagtaaaacaacaggcatccagatgttcagaatcatgcagataggagtggtttggttggtgttatcactgggtaccttgcctatttaactcgccagcaaataccacttcttctgtttctcattcccatataattcatcaaaatcagagagttctaaacatatacaaaataaacctcttttaaagccacantcagtaaaaaatttcaattaataaggttatcatcaaaccaagaattccactgatcatttgatcagcccattactaggaaacaggcaatatcancncccgatctaaaggnaagcctatttcatttattaanacaccantaatgananntttaatcatatcaaatgnatactattaanannatgttattntttatntaatgacacttgagagaaaagtaaaaataatacataaatatctatntcttactgagctcaggatattatactcatggacttacagatacatgagtttctanctgncaaanaagtgctttaaatattttttctaggaaaaaataaaaaataacacaaatattattagaagnt

SEQ ID NO: 643823 - DNA, 1282 bp, Homo sapiens
caagcctccgagagcgcacgtcggcagtcggctccctcgttgaccgcaatcaccgcacctctctcccccagctgtcatttcccaacaatgtctgctattctcacaccaagctgcacgctggacaagcttggcacgttcaacagggcacagctgggtctgttcatgcagcagtcgactatcaatgtttcctcatgaagaacaaccagataacaaacaaccagaggattaaggctgctgtcccaagcatcaaattctgacttggacaatggagccacagtcggtagtccttatagagccaccataggccggcctgatggtgtgcccatgcctgacaagatactacctataaagaccagttgctagtaagaactacaaatctactagctgaggcacgggatgttactagttcttgaagtgactagtagtcagagcccagaaagttggagaaatgccatgatgccaaaacacagaatgactgaggatctgatcatcacatgaatgagagaatacatccgaatatacaatgatggagagaacgaaagggaagaggacaaaagatgaattcatggagaaacataggataaaaagaccagagcacagaacaagaatagcaagctaaaccagaagacattcactataaccacaagactaaggaggatagtacataatgaccaatcgatagacctataacggcacactagatacacagaaagaccccacagcaaccaatgggaaagagagtcacaaacttgacaaaccagcacaaggcctgagaggaatttcatcagacacgacaagaaagcgacactagaacaatacaatatagcagaaacgcgccttgcacaccagaccccaacaagacgcacaccataccatggtccaacacccatgagcaagacagacataaagaagcacagaacacaggaatcacacacactacacatcagtactcgatgcacacacaggagcacaaagaccacgagcacaatagaaagaccgaacaggcaaaaaccagacacaaaaagggcctaacagaaatgaagaacaggcacacaacacagaaaaaacaaacaagcacacaagcacagatccagcaaacaatataaataaataaataaaaacaaataaaaacaactatcacacaatgaattaacaataatcaacatatacaaaagaagatcaaacacaaaaatatcacactaaaaatacacaaaacaaacaaccacaaaacaaaaaataacaaaatgaaacacatataatacatacaccataaaaacataac

SEQ ID NO: 643824 - DNA, 250 bp, Homo sapiens
gcccccactcccacagaacgctgtaattaaatcagacagtagaaagactgggctgctgcctcaaagccacagcccttggatgttcttttgcgagagcagaggtctaggctacagggaggggagattggctccctgagtcaggcttgttttgggcttgggcctgggattgggaaaggggatgggcagactttgtagcatatctaggttccgtagtccttagatttagtagaacctatacagttttaatttt

SEQ ID NO: 643825 - DNA, 1241 bp, Homo sapiens
  misc_feature (182)..(182): n is a, c, g, or t
ttttcctagcaggttgagacggtttgcacaatgtcggaaatggctgagttgtccgagctgtatgaagagagcagtgacctgcagatggatgtgatgcctggcgagggtgaccttccgcagatggaggtaggcagcgggagccgggagctatccctgcgtccctcccgcagcggggcccaacnagctcgaggaggaaggcccaatggaggaggaggaggcccagccaatggctggcgccagcaggggaacacggagccttgcataacgggcccaacgctggcggagccagcccaggccaggtggcagggcgcagcacttcgagcagcgcaggacgaggtgctgatggaatttgatgcctgggaggacgactacagactatcccgaaggagtgagcatgctcagtggttgccggctacagagtatcaaggccgctcttgaagaagccgacaagatgttctgagaacacagagaacagccctggatggcgggtatcagatgcatcatgagaagaacccagactgatcagataagctttcatcgaagagcatttatcactgatggttgtcaactcgtctgaccgaagaactcggatgtgactgacgatctatatgactcgaagagtacgtagatggctgtcacaacgagcgagggcacctactcgacggagggaccaaaatgtacaggatatctaagtggagatcatccaaacaagaacgggcccctctgcacacaccaggaacctccaaccacacaatacgaaacaacaagaggtagaaccacacaaacaggccacgtcgagtggccacagatgtgacaacacgcacgccaacactacgaaagcgacaaggaaaccacacaacgagacacacgaacgaagcaacacaagacactacccggacaccgcaagcaaggaacgaaagaataggagaacgagaagaaagagagaaggagacaacagccgcacactgaagacgagcgagataagcagagcgacaaaaacggggagaaacaaaagcaaggaaggagcacgaagacaaagcgagacaacgacgacagacagacaagcagaaagaagagaggaggatactgataaacagagagcacgaagacacaaaaagaagacgaacgagaagataacgagcaacgaacgagactgcacgacacagagagaaacaacaacagaacctgatccgcctaaagcatacgacacgacaagagaccagatacaagagaagaaaaca

SEQ ID NO: 643826 - DNA, 1258 bp, Homo sapiens
  misc_feature (304)..(304): n is a, c, g, or t
ggggccgtcctgagcgacagagaaccgcccccagcaggagcaccgagcacggctttgagcaaagaatcccagactcaccgcccgaggaaggcagccgttaccatggagattcttccaggttcattctaactacttatattctccggttggccccaaaccagtccacagacgctgctcgtgctcgctcgtaactacgaaggagactcaaaagagtgggatgagttatgaatgatcatttctagcacacgcagcaggcaggccatgtcaagtagacgtatgcacaactttgccatggaacatgctnacacgaccttccttgtcatgatccagggcaattaactcccatgctaaaccgaatctgatattaaaatgtaggtgttctcatattctcgaggaggattctattgagtgtcaattaagacatgcatttctcaatggacatcccttcatagtctgtggatgtcactcctgagacggaacgtgaggtgagatccttagtatgacaatgagtctacaaactggctgtctctggagcccattacggtcttggtcgccttcaccgctgagcgacaatgtcatttaaactaaattttctcgaaggtcgtgtgtaactgcacagaaggtattcagaaactacgaagagccatccaggagcatcctgtcgttctgctgcctgagatcatcgaagttacattgacttcctcatgtctgtcttttcttctataacaattatgatttgcctgtgccagttatatgtagcggggattgtgactttccgtgcactgaacactggttggtgaagcaggtaacgacaggtcgggtggcatctttcatgcggcgtacctttggtgtgcataagctctactgtgctcggattctctgcattttttaaaactagtttcgacacggtatggcccgcggttgcactacccccaaaggggcaaaaaagccggttagccacaacaatgcgccctaggtgggctccgacaacggggcgagagacctctccaagacaacagaaggaacaccatgtctccccctagaccctcatgatacgaaccgccggaagacacaacaggaggagcctgccagacgacacaaaaacagaaaacgacggcgccgcgacagaaagcgcacaaagagcaacgtcggaaacgatcactacccacgagcgacgacacccaccacaccagcgacgaccagcagacgaaacatactatcgagcccgtcgcgtccagcgcatcacctccccccgcca

SEQ ID NO: 643827 - DNA, 456 bp, Homo sapiens
cccggtactctccctactgtatcctacctgtggagctttgaaagatgcagatgcctggccaggcgcggtggctcatgcctgtaattccagcactgctggaggccgagatgggcggatcacgaggtcaggagatagagaccatcctggctaacacagtgaaaccctctctctactaaaaatacaaaaaaattagccgggcgtggtggcaggcacatgtggtcccagctactggggaggctgaggcgggagaatggcgtgaacctgggaggtggagctttcagtgagccgagatcacaccactgcactccagcctgggcgactgagtgagactctgtctcaaaaaaaaaaaaaaaaaagatgcagatgccagctttaaaaatggagctatgatttatttactctggatacagatttatgcggtccggggatccctaaggatacagtagggagagggga

SEQ ID NO: 643828 - DNA, 276 bp, Homo sapiens
  misc_feature (182)..(182): n is a, c, g, or t
  misc_feature (227)..(227): n is a, c, g, or t
  misc_feature (246)..(246): n is a, c, g, or t
ttttcctagcaggttgagacggtttgcacaatgtcggaaatggctgagttgtccgagctgtatgaagagagcagtgacctgcagatggatgtgatgcctggcgagggtgaccttccgcagatggaggtaggcagcgggagccgggagctatccctgcgtccctcccgcagcggggcccaacnagctcgaggaggaaggcccaatggaggaggaggaggccagcaatngcggcgcagaggggaaacngagccttctatcggccaacgctctggagca

SEQ ID NO: 643829 - DNA, 362 bp, Homo sapiens
  misc_feature (123)..(123): n is a, c, g, or t
  misc_feature (172)..(172): n is a, c, g, or t
  misc_feature (188)..(188): n is a, c, g, or t
  misc_feature (195)..(196): n is a, c, g, or t
  misc_feature (230)..(230): n is a, c, g, or t
  misc_feature (257)..(257): n is a, c, g, or t
  misc_feature (327)..(327): n is a, c, g, or t
gccgatttcctcctccttggtcgccgcgtccttggctggcgtgggatgacggatgatgtcacctgtgtggactcagctgccaccatgggattgtggtggcggcgggtctgtctggcagctcanttccatctccaccagtgtcacctccacaccaccatcgccaagcagcttntggaaaggcccccgcnacccggnntgacctgctgctgtgtctgacccggttagtcttnctggctgcctctaaccttgctgctttncattcatgcatgtcctaggaggccaaagcaaaatgaggagcgggaaggcctcctgcacccttggagaccngtgtgggaagacaagcacaagtatgaggaggccga

SEQ ID NO: 643830 - DNA, 666 bp, Homo sapiens
  misc_feature (9)..(9): n is a, c, g, or t
  misc_feature (16)..(16): n is a, c, g, or t
  misc_feature (25)..(25): n is a, c, g, or t
  misc_feature (28)..(28): n is a, c, g, or t
  misc_feature (30)..(30): n is a, c, g, or t
  misc_feature (32)..(32): n is a, c, g, or t
  misc_feature (34)..(34): n is a, c, g, or t
  misc_feature (46)..(46): n is a, c, g, or t
  misc_feature (55)..(55): n is a, c, g, or t
  misc_feature (59)..(60): n is a, c, g, or t
  misc_feature (62)..(62): n is a, c, g, or t
  misc_feature (80)..(80): n is a, c, g, or t
  misc_feature (87)..(87): n is a, c, g, or t
  misc_feature (89)..(89): n is a, c, g, or t
  misc_feature (95)..(95): n is a, c, g, or t
  misc_feature (101)..(101): n is a, c, g, or t
  misc_feature (113)..(113): n is a, c, g, or t
  misc_feature (134)..(134): n is a, c, g, or t
  misc_feature (136)..(136): n is a, c, g, or t
  misc_feature (138)..(138): n is a, c, g, or t
  misc_feature (143)..(143): n is a, c, g, or t
  misc_feature (146)..(146): n is a, c, g, or t
  misc_feature (159)..(159): n is a, c, g, or t
  misc_feature (161)..(161): n is a, c, g, or t
  misc_feature (174)..(174): n is a, c, g, or t
  misc_feature (176)..(176): n is a, c, g, or t
  misc_feature (178)..(178): n is a, c, g, or t
  misc_feature (193)..(193): n is a, c, g, or t
  misc_feature (195)..(195): n is a, c, g, or t
  misc_feature (232)..(232): n is a, c, g, or t
  misc_feature (236)..(236): n is a, c, g, or t
  misc_feature (277)..(277): n is a, c, g, or t
  misc_feature (301)..(301): n is a, c, g, or t
  misc_feature (304)..(304): n is a, c, g, or t
  misc_feature (306)..(306): n is a, c, g, or t
  misc_feature (319)..(319): n is a, c, g, or t
  misc_feature (359)..(359): n is a, c, g, or t
  misc_feature (387)..(387): n is a, c, g, or t
  misc_feature (445)..(445): n is a, c, g, or t
  misc_feature (473)..(473): n is a, c, g, or t
  misc_feature (480)..(480): n is a, c, g, or t
  misc_feature (487)..(487): n is a, c, g, or t
  misc_feature (564)..(564): n is a, c, g, or t
  misc_feature (588)..(588): n is a, c, g, or t
  misc_feature (602)..(602): n is a, c, g, or t
  misc_feature (658)..(658): n is a, c, g, or t
taaagcaanaacgggnctgtttaangananancngggtctggttanaaaaaacanaaannanaaaaggaggacggggggntgcacanangaggangaggangaagaagaggangaggatgggccaggaggggananancaggngcnaaagcagcaaaananccttgaagacgananangtgaccaaggggcananacggggggcccccctggcaagcctgacgcagaagaanaganagggccgactgccggccaggaggagggggggggggggaaanccctcggccctcggagctgagggngananccaggcatgtggncccgccgacctgctgcccagcagcccggatcccctggggntgccctggtggccaaggcagggggagcnagcggtcgaggtttctggactgaggcccctcccccagtgcggtcatcccacccaaaanttcgctctgcccctgcccattctagganagccggngagtaanttcctctgagggagttgggggagcccactcctttctgcctggaagtggaattcaggaatgtggggagctggtctganaaggggctgggctttgccgccaanccgggttgccccanccctgcccctccaggcccaggtcctctgcgctgctgtgggatttcctctttgccanaacactct

SEQ ID NO: 643831 - DNA, 864 bp, Homo sapiens
gctttaactgctacctcaacggtccaactgtatctcacttcaaagcactgataattgtgatgcccgttgaagcagtgacgcgcgacatgaccatgagtaagactgagaaggtaccctatgcgagtcttataatttattaatgctaacagtacctaacaaacccacaggtcccattaaaagcgtacgcaaacactctgcattcaaaaatttgcggttggagtgcgcgagctctggagacgagaatcccaacctccgagctaagtactatgctaagacttcaccagtctaaatggcgaatctactatactcaattgatccaataacttgaccaacggaacaagttaccctagggataacagtgcaatcctattctagagtccatatcaatgaatagtggtttacaagacctcgtatgttggtatcaggacatcccaagtggtgcacgtccgcatattgaaggttcgtttgttcaacgattaatcgtcctacgtgatctgagttcagaccggagtaatccaggtcggtttctatctacttcaaattcctccctgtacgataggacaacgagaaataaggtctacttcacaaagcgccttctgccgtaatgatatcatctcacacttagtattatacccgacaccaccaagaacagggttgttccgatctatgaattcgaaagataaccccgaattctgttggagccattgcttccaaatagcttttaaaaacttctttggggccggcctagtgaatgaatgtggcatacgttcaggcacacgtggcctcaagggggtccacaaaaaagccggggccgggttggaaaaccaaaggttgggtccgggctcacaaggcacggactaaacg

SEQ ID NO: 643832 - DNA, 847 bp, Homo sapiens
gaatgaacagagaacccaaaggatataggagaagcatcctcaaaggaccatctccaaggcctaaatcctggctgagccaacataaatacgcaaggtagagtgggcggcagagagaatactactgttcctcaagtgagtgcacaatgtgacgcacctgtcttcagcgggtctgtcctggtagtcggcctgaatcgacacggcagggagccgtggcgggtaggccatgggctcgtgaggacgagagagacacgagggaagagaggcttcctgagccaagcagaaggaacgatctggagaagtcccactcggcgcgcacgagaataaagaagcagcagcatccaatccgagcaaacaacaaagcgtaaacacccaggctgacagagaagagaaaagctctagggcagagttccggggagaaatctaagaagcgcaagaaacgaaaaggcgaggagaagaatcaagtcatcaggcccagcagattctgaacgaggacccaaagcagaagcccctgggagtgggcagtcccgcggcagcaagaagcaaggcggagagctcgagatgactcccagcggagatccctcccagctgaagaggggacgcaagttggcaacaacaggcgtgcagggggggcgacgctcaggaggctaccaaagaaccagtggagcggagggaaacaacaccaggtcgaagtgcccctcttagcaattcctggcgagccgagataggggggccccaaaagggtagcagccggcgctaggccatcggcagccaaagccacgtgactagggcccgaggagccggcacgtgggtggccggcaacacggggggagaccaccaggccacagca

SEQ ID NO: 643833 - DNA, 267 bp, Homo sapiens
caaaatatcctaagactaccaaaggcagctgggtttgagcccaccccttttaaacggtgccctttagggccaacttcccctctaactggacagccttttttgtcccaagtctccagagagaaatcgggcctgatgagggggaattcctggaccctggcccccccccttggggggggggcctttggaaggcatggggggggtcctagctgttagggccctttcccagctgttggttgcggtttaaaatagaaataaaattgaggccta

SEQ ID NO: 643834 - DNA, 788 bp, Homo sapiens
  misc_feature (2)..(2): n is a, c, g, or t
  misc_feature (206)..(206): n is a, c, g, or t
  misc_feature (208)..(208): n is a, c, g, or t
  misc_feature (251)..(251): n is a, c, g, or t
  misc_feature (358)..(358): n is a, c, g, or t
  misc_feature (380)..(380): n is a, c, g, or t
  misc_feature (388)..(388): n is a, c, g, or t
  misc_feature (400)..(400): n is a, c, g, or t
  misc_feature (430)..(430): n is a, c, g, or t
  misc_feature (439)..(439): n is a, c, g, or t
  misc_feature (474)..(474): n is a, c, g, or t
  misc_feature (476)..(476): n is a, c, g, or t
  misc_feature (485)..(485): n is a, c, g, or t
  misc_feature (487)..(487): n is a, c, g, or t
  misc_feature (501)..(501): n is a, c, g, or t
  misc_feature (547)..(547): n is a, c, g, or t
  misc_feature (549)..(549): n is a, c, g, or t
  misc_feature (625)..(625): n is a, c, g, or t
  misc_feature (640)..(640): n is a, c, g, or t
  misc_feature (653)..(653): n is a, c, g, or t
  misc_feature (670)..(670): n is a, c, g, or t
  misc_feature (689)..(689): n is a, c, g, or t
  misc_feature (713)..(713): n is a, c, g, or t
  misc_feature (716)..(716): n is a, c, g, or t
  misc_feature (723)..(723): n is a, c, g, or t
  misc_feature (756)..(756): n is a, c, g, or t
gnaagagggtgaggagggaaagagggactgtggctcaaggccagtttgggtccacagccctgggtaggggagaaggttgagaagctgaaacttcattgtgcaaaaaacaaccaaaaataaattaaaaaattaaatagttttttttttaaaaaaaaaaaaaaaaggaaaacgagaagaaccaggctccccttccctgaaggtgtttntntccccccatcttgagtggcgaggggttaccaatcccatcaganagccaatccatccacacaccccaagacccagcagaggatgcttcaaagaactggaattaccagaaaattaaaaggtatttttaaaactttttttttttttttttaanaaatggcttccagagacctgcncgagtttnatggggtgggcnttcagggacacccagcaaatttatggaatnttttctganttccccttggaatagatgcagggcctgacccttantntggaaagananagggcttggatggngggtctggcgcccaggagggatggatggagcaggccccaggatgcnanatttcagttagaatccaaaacacaaggggctccccaaagaagttgaaagcagggaaggaaaaaaagggaaaaaatnctaagggggtttgcnaggcccagttttntggccaaccgggaagtnacttcacccccaccctctntaggggagccctcccaccttgaanatnttcccanaatattccggaaggttctttagaattgctgaancagtttagtaggatctctgggctcactgggta

SEQ ID NO: 643835 - DNA, 452 bp, Homo sapiens
ttaaaggcatttatcccagaccctgctcaggcagtctggccaaatgagtgcaaagtctgtttaccccaccaacttagctctcggaaagatgtgctggagtggaccctcttgttaatgaaggttactgccagtgccgggcgcggtggctcacacctgtaatacccagcacttatgggaggccggaggcgggcggatcacaaggtcaggagttcgatgaccatcctgtctaacacgtgtgaaagcccatctctactaaaaatacacaacacaattatgtcggacatggtggcaggcacctgtagtcccagctactcgggaggctgaggcaggagcaatggcgtgaacccaggaggctggagctatgcagttgagccaagcatcgctgccactgcactccatgcctggtgcgacatgagttgagactccgtctacaccaccaaacaacacaaggt

SEQ ID NO: 643836 - DNA, 421 bp, Homo sapiens
gttaaaggtcggggggtaagggaggctagcgaggtatgtagacgtccatccacaagctattagtgggagtagagtgtgaagtccttgagagcaggattgtgatgcgacatgtgagtgcgctcgtagttggagttgctaggcagaatagtaatgaggatgtaagcccgtgggcgattatgagaatgactgcgccggtaaagcttccgggggtttggatgcgactggctgttactacgacgagctactgtggctgacttgacgagtatgcacactgacgcgatttacggtcttgttagtcgtacggcagactggacgctagttactacattactgcctcatacgggactagtacaatggacacggggtatggcatatgatgtattggtcacgggaggtttgcgacactgacgtgttgacgggc

SEQ ID NO: 643837 - DNA, 472 bp, Homo sapiens
  misc_feature (1)..(1): n is a, c, g, or t
  misc_feature (13)..(13): n is a, c, g, or t
  misc_feature (52)..(52): n is a, c, g, or t
  misc_feature (81)..(81): n is a, c, g, or t
  misc_feature (212)..(212): n is a, c, g, or t
  misc_feature (413)..(413): n is a, c, g, or t
  misc_feature (466)..(467): n is a, c, g, or t
ncagtagcctacnctgtagaccttatggtaatggaagttaggttaggttgcnttcagaaccctcaaaagtcaagcctatcncccatatttgagaagaaactcacagtatttgatatacccttagtggatttgaaaacaacatccttatgttacaaaaaaatagcattttaaaaattgggtggggcactgtggatcactcctgtaatcccaanacttggggaggccagggtgggcagatcacttgaggccaggatttcgagactagcctggccaacatgataaagccccatctctattaaaactacaaaaattagctgggcatggtggtgcacgcctgtagtaccagccactcaggtggttgagacatgagaattgctttaacccgggaggcagaggttgcagtgaaccaaagntcatgccactgcactctaacctgggcgacagagcaaggctctgtctcaaaatnnaaaaa

SEQ ID NO: 643838 - DNA, 211 bp, Homo sapiens
aacaattgtttgccaacaaattagataacctagataaaatcagcaaatgcctagaaagacacaaattactgaaactgacccaagaaaaatggaggccaggcatggtgggtcacacctgtaatcccagagctttgggggtgctgaggcaggaggattgcttgagaccaggagtttgagaccagcctgggcaacacagcaatacattatctct

SEQ ID NO: 643839 - DNA, 468 bp, Homo sapiens
  misc_feature (82)..(82): n is a, c, g, or t
  misc_feature (113)..(113): n is a, c, g, or t
  misc_feature (120)..(120): n is a, c, g, or t
  misc_feature (122)..(122): n is a, c, g, or t
  misc_feature (127)..(127): n is a, c, g, or t
  misc_feature (161)..(161): n is a, c, g, or t
  misc_feature (231)..(231): n is a, c, g, or t
  misc_feature (236)..(236): n is a, c, g, or t
  misc_feature (245)..(245): n is a, c, g, or t
  misc_feature (274)..(274): n is a, c, g, or t
  misc_feature (285)..(285): n is a, c, g, or t
  misc_feature (288)..(288): n is a, c, g, or t
  misc_feature (304)..(304): n is a, c, g, or t
  misc_feature (327)..(327): n is a, c, g, or t
  misc_feature (331)..(331): n is a, c, g, or t
  misc_feature (414)..(414): n is a, c, g, or t
ttgtatatggtccggcaagcccagggggttgagcttctcagacatcccccctggggtcgtttgctggtgtgatattagcaancagttcgggggggggctaccaacagggggcnaaaaggntnctggngctggccagggccccagtttggcccgaaaggtcngaagggttaaaggattttttcccttaaacccgccccccccctttttatcaggggggggaggacgggttcnaaacnggttggttncattgggccctttaggtttgggggaaaangcggggttatnatnaccaaggcttggtaancccttcaaagggaaggggaatgntttnggggcccccttgggttttttttttggggggggggggttttaggtttttggtttttaaaaccgggcttttttatggggaccccntggcccaaaatttggtcccgaatttttgggcccctttaaaaaggttaatgggga

SEQ ID NO: 643840 - DNA, 337 bp, Homo sapiens
  misc_feature (9)..(9): n is a, c, g, or t
  misc_feature (84)..(84): n is a, c, g, or t
  misc_feature (184)..(184): n is a, c, g, or t
  misc_feature (308)..(308): n is a, c, g, or t
  misc_feature (319)..(319): n is a, c, g, or t
gaaaagttncaagctagcagatgttgcttcatgaggtttaaggaaagaagccatccatattatataaaactgcaaggtgaagangcaagagtggatacagaagctatagcaagttatccagaagatctagctaagatcactgatgaaggtggctacactaaacaacagactttcaatgtagganaaaaagtcttctaatgaaagaaggtgctacctagaactttcatagataaagaggaaaagtcacttcaaaggacaggctgactctcttgttagggaacttatgggacctgggtcactttgaagtnggaagccactngccttaattgacccttac

SEQ ID NO: 643841 - DNA, 122 bp, Homo sapiens
gtagctagtgggtagactatattttctggagagacgtggattgtctggaggacatggtcttgtgttggagagacgtggagtatacgtttcgggatagacactgattgactggaagaccatgg

SEQ ID NO: 643842 - DNA, 108 bp, Homo sapiens
ggttgctctagaggattccccccagcgcggctattgcgcggtgacttctgcagctcgggcagagcaatggattcgggcgactcggcaagggcctcgcgcaggccggcg

SEQ ID NO: 643843 - DNA, 176 bp, Homo sapiens
  misc_feature (11)..(11): n is a, c, g, or t
  misc_feature (51)..(51): n is a, c, g, or t
  misc_feature (89)..(89): n is a, c, g, or t
  misc_feature (153)..(153): n is a, c, g, or t
attgaattggnagatacagattcagagaattcctcctcagagaagaaattnaaaacatgataaatacaaagggaaaacaaaaagctacnaaagtagccttacaaaaaaaaaaaattgtttagtgaatacagaggaaaggaaaaacaagtattnaaggcacatgaaaccagggcctg

SEQ ID NO: 643844 - DNA, 703 bp, Homo sapiens
aatctcaatgtctttatagttgctgagctaactaatgtgattattgagttcacagatttaaaaattgtcactgttagagtatctactgttttctcatgaagtcaagagcttatgctgcctcagaaatccctgggtactgaaatggtaacatggaagtgacagaggtcactttgaaatatggtgagtcacaagagattagagaaaaggatcagtttgcagatactcagaaaaggttattgaaataattactgaacagcacatttgctctctaaaaagtagtttcatatgggtgtattgttaagatcagattatcattgtgatattggtcaagaatttgtaccttaggttacttagagccagatttaacatcatgaacattatgtggcttgtctttactacagatatgtggaactgtaaccaaatatgtgtctctaaaacttgttgattgcaaaatacagtgtctataagacaataacaccatatgtgactatctcaaatgttgacattgctgcggaaggtctgggcagattcataactatagcatttaagttgagtctgtattggacaaataagcaccatgctttttcaatgattcaccaattacttcatgtgctcttgattgtgaggtggttggaattttttgaattaggtaactcccttaaactgtgccggtccctggccatcacctggggctatggaggac

SEQ ID NO: 643845 - DNA, 393 bp, Homo sapiens
gaagctcctttgtctccaacattataccttggtattcagatgatgtctccatatgccaagcaaactttacggtctctaggctcgatgtcttgtccacaagctctttgtatttggcaatttgttcagcacttggctcaacaacttcattgttgatccatactcctgggtactgagcctgaactttggacagaagttcaagatcaatttcgcctgcacttccgcctatgcttagcatcgtaatgtcagattttgtgtctccaatccgtcccattatgcctgacaacctcctgtccatgcattcctgcatgcgctgatgctccgtagcatggttcacaaacctcggcaaagattcatcatctttgacgtggtcacagaccgagctcctcatggaag

SEQ ID NO: 643846 - DNA, 352 bp, Homo sapiens
cttttggggtctttgctacagaataatacacacagttgtgtgtgcatataaaatacatatttacgccaggcgtggtggctcacgcctgtaatcccagcactttgggaggccgaggcaggcggatcacctgaggtcaggagtttgagaccagcctgacatggtgaaaccccatctctacgaaaaatacaaaaattagctgggcatagtggcgggtacctataatcccagctactcgggaggctgaggcacgagaatcacttgaagccgggaggtgggggttgcagtgagccgagatcacaccactgcactccagcctgtgcaacaagagcaaagaccccagggtaccgagctc

SEQ ID NO: 643847 - DNA, 512 bp, Homo sapiens
ctatctggcaggagtttctgagaaggaacagaaaatggaataaggaagtcattgatactatatggaaattcaccactgttgctgccgtgactgaagaggcaacgtgagttctatgccataagaatcataatgtaaaataggttaagcataaaacaaaataatataagcacctacccacaaaaattaaaatttatggaagattcggcagaaacagctgagagtggtgcttaataaatcccaggccttgtgctaaagccttgggttatgaagataacatacattctgttgcctgtgaaatctgaaggggtctgtaactgcatgaactgcaaagacaccctcacattcacaggctgtgtgtggacatacgtgtgtgtgtgtgtgcatgtacgtgtgtgtgtgtgtgtgtgtgtgtgtgggggaggatactcataaaatcaaagatatcatgccatccttcctttttcctggagctctcttgcagtttgtgtcagcacaaagagtgacccaataat

SEQ ID NO: 643848 - DNA, 704 bp, Homo sapiens
tttcccttgagatagtctcgctgtgttgcctacgttggagtgcgatggcgcgcttggctaactgcaaactctgcctcccaggttaagtgattcttgtgcctcggtcacccaagtgtctgggattacatgtgtgtgccaccatgcccggccaatttttgtatttttagtggagacggagttttgccacatttgccaggctagtcttgaactcttgacttcaaacgatccacctgcctcagcctcccaaagtgcaggcatgagccactgcacctggctattttggtttttaaaagcagtatgataccatttttttttttttggagatggagtttcgctttgggggctcaggctggagtgcaagggcatgatctgggctcactgaacctccacctccggggttcaagcgattctcctgcctcagcctcctgagttgctggcattacaggtgcctgccaccatgcccagccaatttgggttattttagtagagatgaggtttaccatgtgtggccaggcgggtctcgagctccctgactgtaggtgatccacccactttggcccccaaagtgtggggattacagccatataaacaccgaaccgaaagatactttttttaaacataactttaacttataatatacacattaagtcccttgggtataatagccgcaaaattgtgtttaaaccagacgtgttttattttgg

SEQ ID NO: 643849 - DNA, 551 bp, Homo sapiens
taaaaaaaaactttttctctttattccggctggggatacaattgtccagtggggatgatgaaaatgaggcaagttacggggaagacaatgggcgggcctcctccttgtttggctcccaaataaacctccaatgggaagagaaagaacgctaaacgggttgggggagggttccgggctcatacggcatcatagctttactcaaattctacacgctgggatacttcgggacacaggatttccgtgtgccccagtgtgattgacacggttcacacagaaggggcacaaaatgtgaaaaattttcaaccgtgtgttattccgcagtgtggcagtcgtgagtgttctcacagaagtgtctctcataaaaatctcgtgtatttggggctcagaaagccgggggcagtgtgacaactcggggggtggcgtgggcccccaattttccgtgcctccccagtgggcgctcgccgagaatctccgtgcaatatggctgtgcctttgggcagggggaaacagctaagcatttacaacactcgcggggggggcattggtggtgg

SEQ ID NO: 643850 - DNA, 134 bp, Homo sapiens
cctcctcgtcggtcctggctgccggatgaggcgaaatacgctatgggcagcaggataaagtgactcgtccgtgccaaggtatgtgtcaaccaaagaccgggactcgactcacatcagaacaagatgcgtcctac

SEQ ID NO: 643851 - DNA, 263 bp, Homo sapiens
gtctgtaaacaccccccctatggtggcaggcgccaaatcgaattcggctttaatccggcctgtcacgactcagccacgtgctgtttcagcgattcagaagccctgaacagggagtgttagattgagtcttgtatacgtacgcctgcggaatgtgctgcgcggtgatttgtctcggtgtttgtccaacttgatggcgtgctcctcggaacccaagacaggacaccgtggcctgccatggatggtggtttcaccactttggcgct

SEQ ID NO: 643852 - DNA, 323 bp, Homo sapiens
tacaaaaatactacttcttacccacccgtcttaggtatgtatgggctactaaaatcagttctgtggaactgggattttgaagtctcagcaattcattcttcttgcatacatttctaggcagtacaagtttgggtgatgaacatgtgtactgtgcattaatataatccaattctgctgagcaatgccctgaaatttatcactgctatagagggtgggcagaagaggcgacagatcatatttcacacatataacaacattggctgcttctctacaacacatacagaagcaagtgtaaccatcagggaaagtttcatgcaatccca

SEQ ID NO: 643853 - DNA, 270 bp, Homo sapiens
acgtaagctcgggttgcggtgggccaagattgcgccactgcgctccagcctgggtgacagagcaagactctgtgtttaagaaaaaaaaaaaaaaagtcctaaatcaggggattctgccgataaactaccatctgggacggaatgaacctgagggccaatagtttaaaggctcaccccccgactggagagaaagagagagagagagagagaaacagagtgtgtgtgtgtgtgtgtgtgtgtgtgcgcgtgcttgtgtctacgacgggtgta

SEQ ID NO: 643854 - DNA, 116 bp, Homo sapiens
gttataggttgcccttctgccccctacattcatatgttgccgtactaacccccaatacctcagactgtggccttacttggccacagggaattgcagaagcgatttagttaagcatg

SEQ ID NO: 643855 - DNA, 333 bp, Homo sapiens
cgaggacttgggccccaatatggggcgtctgtctactcgccgccagcctgtcgtcgccatggagggacatgcggcggaccaccgccgccgggctcttcggcctttctcagaggaccgcgtactcctgattgttatttgaactgtcctgactttgcgttcgactctgtgacggtgactgcttaccgaggccgactcatcgtcaatttcacaccggtactctccggactcctcgagctggacagcgggcagcaccacgtcggcggacagtgtcctccttctgcaagaacagcgcgcggctcttccaacatctcctctccatcgttggcccagctg

SEQ ID NO: 643856 - DNA, 220 bp, Homo sapiens
caggggtcctggaaaaacatatgcgtgcagctgcctggaaacagattttggcgagaaggtagcaggcctgtggttgggtttggagttgagcagctgaatcacagaccgactctggtgtaaaacagctcccaaaacaatggttctcaactgcacctggctaatttttttgtattttcagtagagacggtgtttcaccgtgttagccaggatggtctcgatc

SEQ ID NO: 643857 - DNA, 535 bp, Homo sapiens
cagttgattctagaggatcccttgggctcattcaggtgcactgtggtcttgccccttggcactggccaagagaatgaagcacccagtctcgtaccattttgagccctccagcactatttatttcccccaccttggccttgctgtggcgggaagagcgggctcatacccccaagggacactttcagcgacagctatggacagcatggtaccagggagttaagtggaggctttttccagcttcctcgggtacattggatggctggataaggcctcaggatctcagcatggcacaagtgcctcagggaagccttggagggtatcacacagacacccccaccttcctccagccggtgcgcacctgccctctttgcagcccagcacacctgcaggtgtacgggacgatgggagtttcttcccagagagtctgtcccagaaggactgtggcttgtgtgtgtccatctcgcctgtgggctcagtgcttcatcccatttgcagagcctcagacacgtcttggtggtgaggtcagttacccttg

SEQ ID NO: 643858 - DNA, 280 bp, Homo sapiens
tctagaggatccctcacgtgcgaatattttcaggggaaaaaatacataaggcaacaattttcaaatgttataccatctacataaacaattacactagcagaatttacaaattaatatactagagcagacagaaatattatacatccttttgcgcaatccagtcaacaactttcacaaattcatacagggacaacacaagataagtctctctatacaaatctacctatttacatagctttttccaccacagatatttggtacgtggagggtaccgagctcg

SEQ ID NO: 643859 - DNA, 315 bp, Homo sapiens
agcgagcacagtgcttcctccactcgcgcgtggttgcaatgtctgattctccgtgccgtcgatgtcctccctggtctgggattacaggcgtgagccagtgtgcccagcctgtattcatttcttttgaacatatacctcagagtggaattgtgaggtcacagggtaggtatatattagatttagagaactaataggggctgggattacaggcacgagccaccatgcccagcccatttgttgtcgtaatactcttatcccccaaccccgaacctctctgagtttctttcatgttactctgtgttacgtctaggtcgg

SEQ ID NO: 643860 - DNA, 258 bp, Homo sapiens
  misc_feature (9)..(9): n is a, c, g, or t
  misc_feature (23)..(23): n is a, c, g, or t
  misc_feature (76)..(76): n is a, c, g, or t
  misc_feature (108)..(108): n is a, c, g, or t
  misc_feature (155)..(155): n is a, c, g, or t
  misc_feature (159)..(159): n is a, c, g, or t
  misc_feature (182)..(182): n is a, c, g, or t
  misc_feature (217)..(217): n is a, c, g, or t
cctgtccgngggagacatcctgnaggtgatcctggaaggggaggatggctggtggactgtggagaggaacgggtangtggttcgtccctggttcctacctggagaagntttgaggaaggccaggagcccttggacctgcctgccagtggagccangagngccccagcactgtcccaccttgntaggcccagaaccaagcgtcccccagcccgacgangagcctgtcgtctcccagggaataaaggagtgcgttctgtt

SEQ ID NO: 643861 - DNA, 381 bp, Homo sapiens
gggtaaacaggaggccagggggtccccagggttaaggtggggaccctttttcggggaaagcctgcccccccccaatgaatcccccctgttccattgggggcctttcccaggtttcagctttgggtggggaacagtggccgctaccgacagggcatgtcccgtttttatccaatttttccaggccccccctccctgcccccctcccctttataaagcaggggagtgaaggggtatgtcaggcggggaaggggccaaggacacgtctttgtaccctgagggtccccagggagtggaaatggggaagggggcctggaaaggggaggcaggggcccctgtgctttttgaacaagttgaaagtccaaataaaacttccctgttcca

SEQ ID NO: 643862 - DNA, 536 bp, Homo sapiens
tgcttactaaaaggctttcagtgttggctactcttggcccttccaccatcagatgacacggcaaaaaggtcctctccaaatgccaatcacctggatatgggattgcccagcctccagaactataactttctgttcttgtataaattacccagtctcaggtatccggtcatagcagaacaacatggactaagacaaattcatacaggaaagccaggattggctggatcctgacaaataaagggcttgccctttattggtcagtgttcaaggcaaggagtgggtatcttataattcttcaaaggtggtcagttctgttttaatatcatggtgaagttatgtagtgaaaggtgatatgtgatgggttgcattcccatgcagtgtagatccttatggaggtgcaaggtttcccatcttcagtcagggacagccacttcaaggagtaaagttaggttggtcaggactctagtcatcattgaaagctaactggccatcaggtatgacaagatgttccaagtcaatcttatacactttctacc

SEQ ID NO: 643863 - DNA, 131 bp, Homo sapiens
aggctagttactaatcaaagaaccttataccaggaagaaatagtaccacccttagactagtgactgctgattgaagtctatcatcttctccacctctcttgtgcctctacttctggtcgggctagtcgggg

SEQ ID NO: 643864 - DNA, 291 bp, Homo sapiens
ccacccatgtttatcactttggcatttgttattgggttatggctggcggttattattcttgatgattgttgtgatgacaatttactggcccctaatcatgagccagacacctgctatgatctaggcgataacatggttaggctctacggaggctccagggtgcgagctagttccctgctcacgtagggtagactgttcaaccctgttcctgctccggcctccactatagcagatgctagcaggagtaggatagagggaggtaccagtcagaagcttatgttgtctttactg

SEQ ID NO: 643865 - DNA, 113 bp, Homo sapiens
aaatgatcccagtgttcccaatcagaatgcaacagacagctataacgaagaaatgctgcgaaaataaatacgtcttacatgtcatggagagaaaatatattttcaccataatt

SEQ ID NO: 643866 - DNA, 501 bp, Homo sapiens
  misc_feature (50)..(50): n is a, c, g, or t
  misc_feature (66)..(66): n is a, c, g, or t
  misc_feature (109)..(109): n is a, c, g, or t
  misc_feature (366)..(366): n is a, c, g, or t
  misc_feature (396)..(396): n is a, c, g, or t
atccccgggctgcaggaattcggttcgagcaagaatggcaccaaaccatntacgagggatcttccncgacaaccagaacccctcctaccaggctccacctcagcatggngcaccacacgggccccacctcagcatcacacgggcctcacctcagcaccacacgggccccacctcagcaccacacgggccccacctcagcatcacacgggcctcacctcagcatcacacgggccccacctcagcaccacacgggccccacctcagcatcacacgggccccacctcagcaccacacgggccccacttcagcaccacacgggccccacctcagcatgaggcatcccagtttaacatcaggcttggtggngccaaagaaaccatatccaaattacagcanactaggatagggattaactgtagactttaataagtgcagtttacaagttctaaggacatatcgtaggaatagaaactggccaggcgcggtggctcacgcctgtaa

SEQ ID NO: 643867 - DNA, 315 bp, Homo sapiens
cccccccccccagggttttcttcctgttttctcccctccaagggggggggaggggcccccctgggggtgggccccccccccccccccttgggggccccccccacccccggggggggggggggcccccggggggggggcccccccccaaattggggccctttaccccaaggggggcccccccgggtccggtttttttttttttttcccggtttttttttaccccctttccccccccctaaaaaaagtttttttttttccccccccttaagggggggccccccaaggaaagggattttttgttggggttttttttta

SEQ ID NO: 643868 - DNA, 143 bp, Homo sapiens
ggtcacagtcttcctgaaccaggtggaattcagagagctggtgcgaataagatctgcaaaattttctcaagaaggagaataagaatgaaaaggtcttataacacatcatggaggagctggacacaaatgcagacaagcagctg

SEQ ID NO: 643869 - DNA, 245 bp, Homo sapiens
tgcagatccctggtgagattccaggctagcatcagcactcctctcccgcacgcaccacagctaaagcacacaagggcaccgctgaacgccaccactcccagctgccagagtgccgcatccgtcggcaaggaaaatggggacccttccatagaaaacaggcaaagactgaacagacattcacaatggccccaaacaaatggaaagaagtcacgccctccaaaaaccaaagaaatgcaaattcacac

SEQ ID NO: 643870 - DNA, 263 bp, Homo sapiens
  misc_feature (252)..(252): n is a, c, g, or t
ctctacaggatccctgtggtacaaatgaaaaactagtcttgcatgcacttagagatgtcccaccaaaactgatgaccccaggggatcctgcactggtgactggcagactgccaaaaacggcaggttgaggacagtgctaggtggctgcttggtggtgctactagaggtggtggttgcagatggatgtcacagtggggctcctgtgttgcttccgctaacacctgtgggggggcatgtaaaatgtaaaccctngagggcacgcc

SEQ ID NO: 643871 - DNA, 405 bp, Homo sapiens
cctctggagtgagaggctccacccactacagcacaggcgggaatagcacaactgccctcccatgctccctacctgtcccctcacagggaggggagcagggtagggaaagaaaccaggcatttggtcaaaccagcagatcaaaaaagccaatagagctggtgcagaggcaggaagcaggggccctcctggtacctcctttgactggtgagaggttgcgcactgatagagggacccctaaaggagggactagaaaccttagttcccttatttttcccctttcacaaaaatacctctgtaagttagctttccccattccaccttatttttgtggttggtttttttggtggcctcccctaacccccttttaattgggcgcggctttaattttttaaagtttaaaaaaag

SEQ ID NO: 643872 - DNA, 784 bp, Homo sapiens
  misc_feature (711)..(711): n is a, c, g, or t
tgatgtgaaggtcaatgtatgcagtgcgcactttacgacgcgggtcgctgtcgttcctgtcagtggataatgcagccgattccagagcaactctccgctaaaaccgccgatcttaaaaatctgctcgccgactttccggttgaggaatggtgcgcgccggtgtcaggcccggaacaagggtttcgtaataaagccaaaatggtggtgagtggtagcgttgaaaaaccactgctcggtatgctgcatcgcgatggcacaccagaagacctttgtgactgcccgctttatcctgcctcatttgcgcccgtttttgcggcgctaaaaccgtttatcgcccgagcggggttaacgccctacaacgtggcgcgtaagtggcgaactgaaatacattctgctgactgaaagccagagtgatggaggcatgatgctgcgctttgtactgcgttctgataccaagctggcgcaactgcgtaaggcgctgccgtggttacacgaacaactaccgcagctgaaagttattaccgtcaatattcagccggtacatatggcgattatggaaggggagacggagatctacctgaccgaacaacaggcactggcggaggttttaatgacgtaccgctgtggatccgtccgcaaagtttcttccagactaatccggcggtcgccagccagttgtacgccaccgcgcgcgactgggtacgacagctnccggttaaacatatgtgggactgttctgcggtgtggggggcccggaccaattcgcctatagtgagtcgattaa

SEQ ID NO: 643873 - DNA, 266 bp, Homo sapiens
atagtacatccattgttaatgggaaaacactctgctttcctgatcatgtgttgtgtgcttggacacgcttctgcaacaaactcttaagtcctccagctcctctaggggtgtaaagactggaagggctcaaataaatcacctactcattgcatggtccttcctaaagagcctagaatatggtttctcctgctgggtgtggtgtctcacgcctgtaatcccagcattttgggaagctgaggcggtcggatcatgcataactgatctat

SEQ ID NO: 643874 - DNA, 683 bp, Homo sapiens
  misc_feature (99)..(99): n is a, c, g, or t
  misc_feature (158)..(158): n is a, c, g, or t
  misc_feature (400)..(401): n is a, c, g, or t
  misc_feature (414)..(414): n is a, c, g, or t
  misc_feature (648)..(648): n is a, c, g, or t
  misc_feature (657)..(657): n is a, c, g, or t
ttgcctcagtcccacttctgtgtggcccactcttacaaccaacactgctttgagagttactcgaatagtgatgctgactgcccacttgccctccctganaaccggaaggtcatggatatgatccgggcccaggaacagaaacgagatctccatgatcnattccagcatcagctcaagtgctccaatgacagcttttctgtgattgctgactactttggcagaggtgttttcaacaaattgactctgctgaccgaccctcccacagccagactgacctccagcctggaggctgggctgcaacgcgacctactcatgcactccaggaggggcacttaagcagcctggaggaagatgtgggcaacagtggaggaccaagagaacagacacaatgggacctggnngggcgttacacanaaggctggctgacatgcccagggctccactctcatctaatgtcacagccctcagaactaaagcggactttctttccctgccttcttatttagtcagcttgccatccctcctcttcactagcagtgtagatcattccagatcagtgggggagggcacctcagcaacctctgagtgtggacaatagctgctttcttctctatccaagagcaccaggctgtgcttgggtccttgctntcagagtcnataaataaaagaatataatgaaaaaa

SEQ ID NO: 643875 - DNA, 338 bp, Homo sapiens
tttgcttttgcaaattgtgctgctataaatatgtgtgtgcaagtatctttttcgtacaatgacttcttgtcctctgggtagatacccagtagtgggattgctggatcaagtggtagttcagcttttagttctttaaggaatctgttttccatagcggctatactagtttacattcccatcagcagtgtagaagtgttccctgttcaccgtatccatgccaacatctactgttttttgattttttgattatggctattcttgcaggaatgaggtggtatcatattgtggttttgagcaaagccattatatgatctaactaaccatattataaaagagtc

SEQ ID NO: 643876 - DNA, 172 bp, Homo sapiens
gatacccggcacgctatccggttcaatgtgtataatgttgtagtcatcgagatgatatacgattgtggtctgaatcagaaaatggcgcattgtgttggagaagatggatggattcaagagatatgtaaaagctggaatcagcaagacttccttgattgaaccggatagcttg

SEQ ID NO: 643877 - DNA, 151 bp, Homo sapiens
tgcttgagaacttcctccagagcgaagggcttaagaacatgcaaagacgaactctgagctgggtctgctaacatcactccaggcttaggatggatctatgtgctgagagacatgcttgttcctctggtattggacacgatgatttactctc

SEQ ID NO: 643878 - DNA, 465 bp, Homo sapiens
agtaaattttattggttagttttaagaggggaaccctttttattgcaatggtgacataaagaaattggcctaccacatttacaaaaagccagtttaaggcgggggcttacaagccaatgtgatgtttggaagtaaagggaaatattaattggcggatgaagcacttggtgaggaaagtttatcctataatgacgtgaagcccgcggaaccctgtggctacaaaaaatgttgagccggacatcccgtccgaaatggtgaagggagacttggagtcctttgaggcttgtaggagggtcaaagagagacccttttaaattgtaataagcagtgcttgaattatttgggtttgggtgttttctattaacactttggggagctcaggggaatgaacctcctcgtgcaagtaatacggatgtgtttaagagtggtaattctacgggaattaggcggggtgatgccttttgg

SEQ ID NO: 643879 - DNA, 267 bp, Homo sapiens
attcatcaagattatggtgcgactggggccgagggcgctcctcgcgggcatgagagttcgcctacgacggcaaggattcacatcgccctgaacgaggactgagctcctggaccgcggcggacaccgcggttcagatcacccagcgcaagtgggaggcggccggtgtggcggagcagttgagagcctacctggagggcctgtgcgtggagtggctccgcagatacctggagaccgggaaggagacgctgcagcgcgcggacccccaaa

SEQ ID NO: 643880 - DNA, 326 bp, Homo sapiens
aaatctggtggtattaaaataaataaaaggggctgggtatggtggatcaccaccctgtatcccggactttggggagaccgaggcaggtggatcatttgagttcagaagttcaagaccagcctggccaacatggtgaaaccctgtctccactaaaaacacaaaaattggctggtggtagtggcacacctctgtaatccccggtactcaggaggctgaggcaggaaaattgcttgagcctgggaggcggaagttgcggtaagccaagatcgtgccactgcactccagcctgggtgacagcgagattccgtctcaaaaaacaaaaaaac

SEQ ID NO: 643881 - DNA, 326 bp, Homo sapiens
agactctagacggatccccttcattaggcgactcactacaccatagagtcatttatgtgctctctaaggttggagaaaggcaataataaacgagtgaatgtgaactgtcaggtcattggattatgtatatctttgctcctctcacctggaaagcaattaggtcttcctttggctatttgaatcatgagattagctctcaaacatgtacttccgtatgccttctatagcccacttagtatgctctctccaccccgtagtttcccatttgccatccatcagtttataacctattttgcctctatgattcatttaggctaatttaatgt

SEQ ID NO: 643882 - DNA, 335 bp, Homo sapiens
  misc_feature (141)..(141): n is a, c, g, or t
gtcaaaagcaatggaaatctgcatggtcctctttctgttcaggaaattgaattaattaccggagaacctacctaccaagaaaactcctgcaaatatacatggtttcctggtgaattctatcaaacattcaaagaagaaatnacattattcttacacaaactctttcagaaaataaaagaggagggggaacgggtgctgtggctcccacgtgtaatcccagcactttgggaggctgaggcaggaggatcacctgaggccaggagttcgagaccagcctggacaatatagtgagaccctgtgtacaaaaaaaattatacttgtagccccagctactt

SEQ ID NO: 643883 - DNA, 488 bp, Homo sapiens
  misc_feature (83)..(83): n is a, c, g, or t
  misc_feature (86)..(86): n is a, c, g, or t
  misc_feature (88)..(88): n is a, c, g, or t
  misc_feature (126)..(127): n is a, c, g, or t
gtgattacatcatgatgtaaaatcagaggttgatctgatgctgagcaatgggtgctcagatggtatagagagagagagaagangtnanggcactaagcattcatccccagctctacctgggacagnnggggagactggaggccaggagaggacaggcaacatgaggagagggctctgcagccagagaggggcctgaggactgtgggaccgagagctagcagacgcactttagtgcttatagctcttcctgctggaggaggaggtggtggtgtacttgatggtggaactgccgcctccaacagagctgaggccacccccaatggctctgccactgctggaactgaagccacctccaacgccatagaccactgcctataggagtagctgcttccaccaacacaggcctaaagccgcgtgccggagcactatgtggctaccaccagtagctcacgggagatcggtggactgtgcagagccagagatgtatc

SEQ ID NO: 643884 - DNA, 174 bp, Homo sapiens
tcccacagctagaggagcatgtcgagcaggaggccagagagaaggcggccaccaatgtcgctgaagcagaaagacaagaagctgagtgaaatcttgctgcagtgtggcggacgagcgcaagatgtgccgagcagtacaaggagcagtgcagagaaaggcaatgccagggtcaag

SEQ ID NO: 643885 - DNA, 496 bp, Homo sapiens
ctatccccaggctgcgctgccgccgcggttggcggctgctggtccaccccgtcctggccgcgctgtgccccagcgtggggctaacgggcgccttgtctgtgtatttctattttgcagcagtaccatcccactgatatcacgggccgtcaacctctcagatccctcggtcagcaccgtggtgtgaggcccccggaggcgccacctgcccagttagcccggcagagacactgatgggtcctgctgctcgggaaggcctgagggaagcccacccgcccagagactgcccacccatggacctcccgtccgtacggccgcccacaccgctgcctggaggacaagcccatgtgaaccaaacgtgcgagaccgcacgcggcctgaaaaacgagggcaaaagccagagaccggacagagcacggaccgaaaggagcgcaccaggaagaagagcacagcgccatggaggacatcagaccagcgaaagagggagagcaaatagccc

SEQ ID NO: 643886 - DNA, 497 bp, Homo sapiens
  misc_feature (83)..(83): n is a, c, g, or t
  misc_feature (86)..(86): n is a, c, g, or t
  misc_feature (88)..(88): n is a, c, g, or t
  misc_feature (126)..(127): n is a, c, g, or t
gtgattacatcatgatgtaaaatcagaggttgatctgatgctgagcaatgggtgctcagatggtatagagagagagagaagangtnanggcactaagcattcatccccagctctacctgggacagnnggggagactggaggccaggagaggacaggcaacatgaggagagggctctgcagccagagaggggcctgaggactgtgggaccgagagctagcagacgcactttagtgcttatagctcttcctgctggaggaggaggtggtggtgtacttgatggtggaactgccgcctccaacagagctgaggccacccccaatggctctgccactgctggaactgaagccacctccaacgccatagaccactgcctataggagtaggatgctgcctcacacccaggcgtgagtcactcggtcatccgagttggaccgtccataggccctgggccgtgtcagtgcactatagaatgtgcctttcggagaagaggggattg

SEQ ID NO: 643887 - DNA, 587 bp, Homo sapiens
atagaggtggctgctcttctggagccgcacggcagtccacgctgccatgtgcccgcgatggctggggggcagcagctccgttgacatgttggatgctgaatgaagaagcctgcctgtcactgttgcccacatgccccaaagcctgctgctgccccgcagggaaggagagtgaggcagtggaagcagtgagacccccctgagtgaggctttgcgcaggccagtcccgcctcgtgacaatgtgtggcttgggcgccacggacgttgcctgacgaccgtttccgtggtgaatgatggccaagccgctgcgtccacttttccgtcccatgacccggttcaccgccagctcacaacagtgctcgcgagtgaaggtacctgacaatagttgatctcaagattacaaccaaatatggacacacatttgttagacataaaataatgtgtgtatagtagaaagaaaagataaagaaattagagaaagatataatgataaaataaaagaaaaaatgatataaaatagccaagggtgaaaaacgaatggaaagaggataaagaagatattatttgagataaagaatgagtggataagc

SEQ ID NO: 643888 - DNA, 827 bp, Homo sapiens
gatttttgaataccttattctgaactgtcttgaatacatgttgggaagaatcggtgtcttaaacagtctccagtgtccacagcggtgactggccgtggtgtgactccagtcgggcgtctcagcaggttctccagtggtccacgcgctgacatgccgtgtgtgacatctcagtcggtgtctcagcgacgtcgtaccacgctgttgccatctgcgttggacgtgcacgggtgtgattgccagtcgggggtcgtcacacagtctgcgcggtgtccacgcgttggactgccgtgtgtgactccagtcggcgtactcaacagtctccggtgtccatgcgattgagtgccgtcgtgtgactccaggtcggcgtgtgcgagcaagtctggcggtgtcgcacgcggttgtactgctcgtgtgatgaatcgcagtgcggagttctcagtcagtcgtcgcgggtggtcccacgcggtggagcctgcgcgtgtgtgacgtccaagtactggcgtcatcatgcgagtcgtccggatgtagcacgcgtggacgtgcagggatgtgacttccagtctggtgtctcaggagacctccggtgttccaggcgttgagtgccgtgtggtgagtccagatgggccgtgctcgaaacaggtgtccggtgtacaacgggtagacgtggccgttgtgtgaggtccagtcggggtctcaaggagcactccgggtgtccacgccgtttggacttgccgtgggtgtgattcccagacaggaggtctggaaacagttctgcggagttgccatcagattgactggcgaagtgggaaacccgtgaggggtttaca

SEQ ID NO: 643889 - DNA, 308 bp, Homo sapiens
  misc_feature (83)..(83): n is a, c, g, or t
  misc_feature (86)..(86): n is a, c, g, or t
  misc_feature (88)..(88): n is a, c, g, or t
  misc_feature (126)..(127): n is a, c, g, or t
gtgattacatcatgatgtaaaatcagaggttgatctgatgctgagcaatgggtgctcagatggtatagagagagagagaagangtnanggcactaagcattcatccccagctctacctgggacagnnggggagactggaggccaggagaggacaggcaacatgaggagagggctctgcagccagagaggggcctgaggactgtgggaccgagagctagcagacgcactttagtgcttatagctcttcctgctctgttggaggcggcagttcccatcaagtacaccaccacctcctcctctgttcacca

SEQ ID NO: 643890 - DNA, 456 bp, Homo sapiens
  misc_feature (1)..(1): n is a, c, g, or t
  misc_feature (262)..(262): n is a, c, g, or t
  misc_feature (278)..(278): n is a, c, g, or t
  misc_feature (439)..(439): n is a, c, g, or t
ncatatgcacagctaaaaaaaccccacataaattggactagagcaaaaaaaaaaaatgctatgcatacagagacattgtcaagagcaagaaaacaccatacagcatggcttctagtatcagaatatataaagaactcttagaccaggtgaggtggctctcacctgtaatcccagcactttggaaggctgagatgggtggatcgcttgagcccaggagtttgaggcctgcctgggcaacatggcgaaaaccatgtctctacangaaacaaacaaacaanaaacaacaacaacaaaaaacaaaggtagccaggcatagtgacccatgcctgtggtcccagctactcaggaggctgaggcagaaggattgtttgagcctgggaggtcaaggctgcagtggggcgtgatgtaccattgcactccagcctgggcaacagagagngactctgtttcttaaaa

SEQ ID NO: 643891 - DNA, 209 bp, Homo sapiens
agtcaggaacgtttagctgactgtgggaggaagactgctgatagatcaacttctgtgtagtgctccagtctgacctcttgtagactttcagtactcactcttcttgcttaggctctctgtgtgttgaaaccatcccgtgttgcatgtgttgttaaatttttctgtgatacttgcaatttatgtttgagaagaagtgaaaagtttgcttt

SEQ ID NO: 643892 - DNA, 350 bp, Homo sapiens
  misc_feature (2)..(2): n is a, c, g, or t
  misc_feature (15)..(15): n is a, c, g, or t
  misc_feature (68)..(68): n is a, c, g, or t
  misc_feature (92)..(92): n is a, c, g, or t
  misc_feature (97)..(97): n is a, c, g, or t
  misc_feature (162)..(162): n is a, c, g, or t
  misc_feature (179)..(179): n is a, c, g, or t
  misc_feature (249)..(249): n is a, c, g, or t
tnctgctccgtattnaatttactgatccagcaagaccaaatcattgtatcagattatttttaagtttncccgtagttttgataaaagatttncctanccttggtctgtcagagacctaataagtgctactttccattaaggcagactagggtcatgcttttnccctttaaaaaaattgnaaagtctagttcctactttttctttgatttcgacgtttacttagccatctcaagcaactttcgacgtttnctagccatctcaagcaagtttaatcaatgtcatctcacgctgatcattggtcctactcaacaaaaggaagggtggtcagaagtacattaaagatttctgct

SEQ ID NO: 643893 - DNA, 1113 bp, Homo sapiens
acactgcgccgcggactgcgcaagtacacgggaggcttttaattccattgtggagaggacggcgttattatcttattaacttggacggcgacggagagctgcaggctgatgcggcgggacccacccaggacctccatccgaggagtattgaacaatcgggacaggatgggattccatggagatgcgcggcgagatggatacacgggccagctacgcggagatgggtaagcacgggcttcacagtgaggagcagagagggttacccagggacaagtacggcacacttccattggcgggggcatacattggcacgtcaatatagggagtttaggcattcaaagacaagtgcagaacaatcacccggcggggaattccttgacggcagccaccacaagcatccccaagaaaagacaaaccaaagtcaacgcaaccaaacaaacctaatggggggggacgaccttggttcagccatagggcaggccttcgaacccagaagggttctccaacgagacagcttaagggaaggcgactggcttgacacgcgagagcggaaacagtccacaagtgctggtcaacatccaaagggaaccattcccaggtattttacttcacaacacaacggaattggtaacaaggcacggaagacacaagggacccaagaacaacaaccagggatgaaccggttaccttaaccattccaagacacgccaaaggtacgcccgcggaccctgacgctggaccccaacccaattgtgtcaacccgtggaaggtgaaagacccaaaagaggcaaagggaacacacctaaacgtgggttcacacacaacggggactaacaaacagggcgccaaaagggccacaggaaacattctcccaagggaacattcccaacaggcccaagggaaagggaaagccccaatgagtgcacattatttgcaaaaacacctttcccatcggcgacctggtgacccaatgtgcgaagcaaagggtttgccaaatcccattcttcccccaaagggtcaagaagaacccgtaacataaatccggtgtactcaccacttgcattagttgactggctatacacggaacagtacttaactcaccttgacagagaa

SEQ ID NO: 643894 - DNA, 350 bp, Homo sapiens
  misc_feature (62)..(62): n is a, c, g, or t
  misc_feature (120)..(120): n is a, c, g, or t
gtgtgggccttaaaccctggccaaactttaggggtttgtccttaacaaatgggaaatgcccntggggagctcccccctggggccccagccccagcccaattttttttccgaaaggattantgccttgggccccccctccgggggggccccatccccttttttgtttcccccctggggtaaacagggggaaaacggggtggggggaaccttgatttgggcccagtcccctttcccccttggggggaaaagcccctttaaaaaaaacccgccccccccgccccctttttttttttgggaattttttgggggtgggaccccaaaaaaaaaaaaaaaaatcctttttttttcca

SEQ ID NO: 643895 - DNA, 244 bp, Homo sapiens
aggaatcccccacaggcacgaggcctggacggcccggcccctcactcatccacgcagcgtcctccgctgctggcagggtggagccgttgatcacacaggcccgccctttttctggcagtcctttccccagtacccgggggcccaggaccattcatagagtccatcgtccatgctcacgcacgtcccgttgttccgcacagggggccgaggagcagcgccctaacatctctatcacggagctccc

SEQ ID NO: 643896 - DNA, 449 bp, Homo sapiens
acattacaatattacaaaaattcatattgcttatgaacattaacaaagatattagcttaagctaaaacccaacagcatgttgtgaaaaaatgtcataatcaagtaatgtttattgaaagtaatcgagttatgtttattgcaagttatctagttatgcttactgccttctacagaagcttcttcttattgcattgttttgcttcatttttaaatacatataaacattagttctttgttagttattttgctttataaatatttttcccattttctggtcatttatcttttttactcttgcgtgatttttcactgaaaagttgtctattttagtatagtggtatttttccatccttttcttttctttttttgagatgcagtttctctcttgtcgtccaggctggagtgcaatggtgcgatcttggctcactgccatgtccaccttccatgtt

SEQ ID NO: 643897 - DNA, 121 bp, Homo sapiens
agatagtatggatgggagggagaggtgtcttaagctgtaggctaaacttgatacgcatttatagagatatagctttaatattatattagagatgtaaaacattctgctttcttagtcttac

SEQ ID NO: 643898 - DNA, 384 bp, Homo sapiens
cggttagcaccccccaatcccagaggcaacaatagatgacacaggctgggttggtctgcccctcagtcaggccccctataccacaaccgaccgagcacccaaggccgccgagcgccatcaccccacaacagggggacaaacacccataacttgacagcgatactcagcttgacggagatggggggcaggtcatgcccaggggcaggcagacatcacgactactcgtggcagcgagcggcacgaagccaaaggcactaccaaagagcggctggtgcagccaaggctccgccaaacgcaaacagaagggcctaacccctaggcagccccaccccatcacaccaccccacagaccctagacggcgtcacccaaggccaagcccacca

SEQ ID NO: 643899 - DNA, 594 bp, Homo sapiens
acgatgacgcaagcgtaactacgctgcttgcggctataatctgcctattaccaccaactagttcaactgattggccattgcgatgaactttaaggtactcatacataactggagctagtgccactctaccagttaaccgacgagcatctgtagctttgaaatccgctctgtacgaccacagtctgctgcagataatgcgacaacataagtagacacgctgtatgagcgaaccagcttcctgtcaaacgctgatatcagactactgagtctttcacgtgacatgaatgagacagtggctgattgcacgtcgtacgacaacattctgctaacagatgaactggcccacgattggcagcatcttgctcgaatggtcatctgatgtaccagatactcatcctgacacgatgccttgtatccagtgagccgcattggatacgacttacaaggcatgcacgattgatgaaattgaagcacaaatggatcgccgattctgactacagttctcatcaggcacgtaagtattgaaatctgatgaactgacattgcgctacacttatcataaagcccatgctggcagagccaatttatactatc

SEQ ID NO: 643900 - DNA, 284 bp, Homo sapiens
acgacttgaatagtaaatatggttattatgaaggcaaactcaagttgttaccaggtttacagagatatagtacacgaagacatggtctaggaaagagatgtcctccattatttgaacgtcatatgctagaaagaaaaaagacatttactttcaaaactaggatgtatcatctttcttaaagatcgcctgcctagtttctcgaaaaaagatggtaatactgttaaatgctcatattttatcttcctactattccacatctacttttacaaatgtcgatgtgagaa

SEQ ID NO: 643901 - DNA, 442 bp, Homo sapiens
  misc_feature (7)..(7): n is a, c, g, or t
  misc_feature (23)..(23): n is a, c, g, or t
  misc_feature (40)..(40): n is a, c, g, or t
  misc_feature (50)..(50): n is a, c, g, or t
  misc_feature (299)..(299): n is a, c, g, or t
  misc_feature (440)..(441): n is a, c, g, or t
tgggacntctctaaccttttccnatgcaggatggccccgnaagcgggganagactgtgaagctcccagaaaacatgacaaggggggactttccctgcctcttgggagatcagaggggggaaatggcagcagaaagcgcagctctgcgggcctactttcaagtgacacagatgtttttcagatcctgaattcccagcaaaagagctattgccaaccagtttgaagaccgcccccccgcctctccccaagaggaactgaatcagcatgaaaatgcagtttcttcatctcaccatcctgtantcttcaaccagtgatcccccacctcggtcactccaactcccttaaaatacctagacctaaacggctcagacaggcagatttgaggtttccccctgtctccttattcggcagccttatgattaaacttccttctctgcttannt

SEQ ID NO: 643902 - DNA, 253 bp, Homo sapiens
catctttctaaaggaaacgaatatcccttcttccttcggagagctgtcactgtacctttttcatctcacttattttatttgttttatgattattttttttacgaaacggagtcttgctctgttgcccaggctgtagtgcagtggtttgaactcctgggctcaagcaatcctcccatcttgggctctcgaagtgctgggattacaggtgtgagccacaaggcctggcttgcctctcactaattttgatggtgat

SEQ ID NO: 643903 - DNA, 301 bp, Homo sapiens
ggcacgaggagaagcattttcagttcgagcgccaagatcgttaagcccaattgcgagaagcgcacgagttcgagtccgcattttccaggtttttttgagcggagagaactcgacctagggttagttaggagctattttacgcagcaaggaattagttggggggccgaaacttaaattttttcctcccatctaatttccaaaaccaggcctcaaccatttggaaaataagggagattgttttctcaaggattaccacaccgaaccgaaatagaacccccggctttttaaaaaatgacacccc

SEQ ID NO: 643904 - DNA, 130 bp, Homo sapiens
agaggtcaaggccgcagtgaggcataattacaccactgcattccagcctgggtgacagagcaagaccctgtctcagaaaaaaaaaaaattgtgacagagatgcgcggggttgggggaaccgagctcgaat

SEQ ID NO: 643905 - DNA, 221 bp, Homo sapiens
ctgaaccacaggcggtgtaagatttgccgagttccttttactttttttaacctttccttatgagcatgcctgtgttggggggagagttattataataatgacttgacgcttgattgaagatattgtactgttaattgtcagttcagtgatttaatctgacgcaggcttatgcggaggagaatgttttcatgttacttatactaacattagttcttctatag

SEQ ID NO: 643906 - DNA, 198 bp, Homo sapiens
  misc_feature (188)..(188): n is a, c, g, or t
ggtcgatctctagcacggatcccccacacttcgatcgcggagaatgggggatacgtgtataacattagggtgttttctcgtgtgacatagggttttatgttgttaatgtggtgtcgtgagtgagccccacttgtgttcgtggttaaatatgtacgagagagtatagcggctgtgactagatatgttgnagtctctgta

SEQ ID NO: 643907 - DNA, 955 bp, Homo sapiens
gggagactgcacggagcatatttcacctccgtcaccataatcagtcgctatccccaccggcgtcgatagactatttagcgtgactcgccgacacatccacggaagcaatatgaaatgatctgcgtggagtgctctgagccctaggattcatcttgcttttcaccgtatgatggccgtgactggcattagtattagccaaactcatcgctagacatcgaactacacgacaggtactacgtccgttaggctcacttccactaatgtccgtatctggttacggggctgtatttgccatcatacggcacggcttcattcactgatttcccctattcgtcgagagcgtactaccctagactcaaattcgtacagccagaatccagtttcgctatcatatgcatcgggcgtaaatctaacttgcttcccagccaacactttctcggactatccggaatgccccgacgttactcggagctaccccgatagcatacaccacatgaaatagtcctgatcgatctggtaggctcattcatttctctaacagcagtccaatattgaataatttggcatgattggagaacgtcttcgcattcgaagcgaaaagttctaatagtagaagaagcctccataaacctggagtgagtacatggatgccgcggcacctaacacagatgccgaagaacccgtataccgttacattctagacgaaaagatggcagggaattcgaagcccgccataggcctggtgtcaaggccaagcccatgggcggccatggacgttttctaagccgaagaacgacgcgttgggtggagaaaagggggggggccaagaacctcccggggggccaaatagggacactggtcgggaaggggccaggaggggataaaacaagggcgcggggaaaccccccccggaaacggcgcggctgggagccccccgggggacggaaccccgggg

SEQ ID NO: 643908 - DNA, 917 bp, Homo sapiens
  misc_feature (14)..(14): n is a, c, g, or t
  misc_feature (27)..(27): n is a, c, g, or t
  misc_feature (30)..(30): n is a, c, g, or t
  misc_feature (37)..(37): n is a, c, g, or t
  misc_feature (41)..(41): n is a, c, g, or t
  misc_feature (70)..(70): n is a, c, g, or t
  misc_feature (78)..(78): n is a, c, g, or t
  misc_feature (83)..(83): n is a, c, g, or t
  misc_feature (86)..(86): n is a, c, g, or t
  misc_feature (89)..(89): n is a, c, g, or t
  misc_feature (95)..(95): n is a, c, g, or t
  misc_feature (101)..(101): n is a, c, g, or t
  misc_feature (107)..(107): n is a, c, g, or t
  misc_feature (119)..(119): n is a, c, g, or t
  misc_feature (128)..(128): n is a, c, g, or t
  misc_feature (141)..(141): n is a, c, g, or t
  misc_feature (146)..(146): n is a, c, g, or t
  misc_feature (156)..(156): n is a, c, g, or t
  misc_feature (163)..(163): n is a, c, g, or t
  misc_feature (171)..(173): n is a, c, g, or t
  misc_feature (176)..(176): n is a, c, g, or t
  misc_feature (183)..(183): n is a, c, g, or t
  misc_feature (193)..(193): n is a, c, g, or t
  misc_feature (195)..(195): n is a, c, g, or t
  misc_feature (197)..(197): n is a, c, g, or t
  misc_feature (199)..(199): n is a, c, g, or t
  misc_feature (207)..(207): n is a, c, g, or t
  misc_feature (210)..(210): n is a, c, g, or t
  misc_feature (215)..(215): n is a, c, g, or t
  misc_feature (220)..(220): n is a, c, g, or t
  misc_feature (222)..(222): n is a, c, g, or t
  misc_feature (237)..(237): n is a, c, g, or t
  misc_feature (243)..(243): n is a, c, g, or t
  misc_feature (258)..(258): n is a, c, g, or t
  misc_feature (260)..(260): n is a, c, g, or t
  misc_feature (269)..(269): n is a, c, g, or t
  misc_feature (271)..(271): n is a, c, g, or t
  misc_feature (333)..(333): n is a, c, g, or t
  misc_feature (348)..(348): n is a, c, g, or t
  misc_feature (356)..(357): n is a, c, g, or t
  misc_feature (363)..(363): n is a, c, g, or t
  misc_feature (369)..(369): n is a, c, g, or t
  misc_feature (378)..(378): n is a, c, g, or t
  misc_feature (381)..(381): n is a, c, g, or t
  misc_feature (384)..(384): n is a, c, g, or t
  misc_feature (401)..(401): n is a, c, g, or t
  misc_feature (410)..(410): n is a, c, g, or t
  misc_feature (420)..(420): n is a, c, g, or t
  misc_feature (432)..(433): n is a, c, g, or t
  misc_feature (454)..(454): n is a, c, g, or t
  misc_feature (469)..(469): n is a, c, g, or t
  misc_feature (491)..(491): n is a, c, g, or t
  misc_feature (544)..(544): n is a, c, g, or t
  misc_feature (551)..(551): n is a, c, g, or t
  misc_feature (589)..(590): n is a, c, g, or t
  misc_feature (917)..(917): n is a, c, g, or t
tttgagagaaggcngtgacggcagggntcngggcgcnaggnggcgtccagggagtgatgggaagcctgtnaggcttancggtnctngcnactganagtgantgggcngacgtgcaagtncccccagcnttgggcgtcatancgccntctgtgcganagcagtncaagtgtnnnggntcctgtngctgggacancngngnccccaaangcngtgcngaaantngagccccagtggatnaacgtnctccaggaggactcngngactctganangccgggggactcacagccctgagagcgactcctattcagtggttccgacagactgggaagtntcatgtcccacccanacgcagcnnagcaanaggttnaaggcgaanaanaangacagcggggagtacangtgccacantgggcagagnagccttagcgannctgtgcatctgaatgtgcttnctgagtggctggtgntccagacccctcacctggagtnccaggagggagaaaccatcgtgcgtgaggtgccacagctggaaggacatagcntctggtnaaggtcacattcttccagaatggaaaatccaagaaatnntcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagccaatcccactaatcctgatgaggctgacaaagttggggctgagaacacaatcacctattcacttctcatgcacccggatgctctggan

SEQ ID NO: 643909 - DNA, 215 bp, Homo sapiens
gataacagtctaggtttcctttgatctcactagttgttcctactcagtctcctggacttcttaaactaaagaggctcagggttcacatcttaaaacttttcactttttctttttttttttttttttattaaatggtggtctgggttgggaataaggggggtcaccgagctcgatttcgatactcagggctcattaggcgtgttcccgggggtgaa

SEQ ID NO: 643910 - DNA, 182 bp, Homo sapiens
tggaggccgtcatgcgccagttcgaagccagcctggtcaaggccagggccggatctgtagaaaagctggcaaatcaaaaaaggtccttcagtcgcaaggaggctgaggctccctttaggagtttggtgaggacgcatgaaaaatatggttggcacaccccccccgtgcccgccggccttaat

SEQ ID NO: 643911 - DNA, 258 bp, Homo sapiens
cgccctgacaggaggatctttttagcttgggaggcggtgggtctggtgacccgagatagcttcggttcactttagcctgggcaacaacagcaaaactctgtctcataaaaaaaaaaaaaagtaatgaaatagatactaaggccgggtgtggtggctcatgctgtaatcccagcactttgtgaggccaaggtaggcagatcacttgaggtccggagttcgagaccagcctggccaacatagtgaaacttgtctctacca

SEQ ID NO: 643912 - DNA, 95 bp, Homo sapiens
attcagatcaactactaatactgcatcgcgactactgtggcacaacccagcgatcaatcggataaggaaagagagagaagtcggaataataagaa

SEQ ID NO: 643913 - DNA, 749 bp, Homo sapiens
  misc_feature (351)..(351): n is a, c, g, or t
catggcgcttttggtgggctactactctttctcggcaatgtttttttcttcccctaatttggggcttctttctgttttttttttcctctctttggctttgtctgtgtccttttctccttcgttggattcctccccctttgcttctttctggtccactgtggtggtgcgtgtacatcgttgttgatgtgcatctgctctcccatcggctcaccattatgttgggcgctttcgcgcttttaaatttgggtgatctgtttcaacgctagtgttttgggcgtctattttttggtgtcctttatacagtggagtctctccacttatgtgggtctccctcctcggagacagcatgtngtcaaagtgttgaagatgtaaggaggttttctctcgttgcttatctacacgacaccctccggggagcacacactttcttgagatctgtttaagagatataaggtgagaagcgcgctcaggggttgttgtgtcacgcagagcaaggcttgtggggaggcaccaatgtttgatgtggcttctcatgtcgttgggacctgagataggctctcactaatggggcaatccagcctatggttggttttcacctggagagactgcctccctggtcatcgttctacccacatgtagttctcgtctatgttcccaaccatcagctgctttttaaataagatctctttgtaccatcctgttaattgtgtaaccatctagtaatggcatcagcacgtttacccaaacca

SEQ ID NO: 643914 - DNA, 726 bp, Homo sapiens
gggagatccgagaacgagaaggtgttgcccagcccaaggagcttccaagtctcggctctgatccgtggccgacgtagaggaaacctccacacacgcccctataagtgctaatggtgcagtttgtggtccccctctgcccatcactgtgctgtgcttgttcctgcctctgtgccttcgcactatactgctcggacaggtccccgtttcgtctcctctacccagctaagcccttatgatccagcggggcccaggctgtcccaaaccacccgagcccacagtcctcggttcctgctcacgaacaggtccggtgtgagcacctgcaccaagaactgcgtgctgtcccatggacgctccagtcatcttccgtgtgtgtcttgagtccctaactagacagttagcttcctgagggcaagggactgtcatttcctcttgagtcctaccagggtctagcacaggactgggctcctaactctcaggaaacacttagtcggctgactaggtgcctcaagcgcataggagcttcgtcggtgtgccggtaatgggcagtgcacgtagggagagggatatgtgagttaactaaagggtgccttttcttgggctgtgggctggctcacactgggtcaaaagtggatgtcggaggcctcaggatcttacctccttggggcagtgggagcatcatgggaccccgacccccacaccggctctgcaggagtgcacaggaagtgg

SEQ ID NO: 643915 - DNA, 162 bp, Homo sapiens
tgatctagaggatccttgcctccacttggttgccagacggatcatgtacagcttcagctcaaagggggccgacctcagtgagctcacgttgcggtggtctgtcttcttatacacatggtgccggaatgatatgtagtcgtcctggttttgggaagggtgatg

SEQ ID NO: 643916 - DNA, 727 bp, Homo sapiens
gagaacaaggagaggaaacagaaatagcagagtgagaatacaagttggtagcgatagtataatttttggctaacaggaaacaccttacaaagtttcttaattataatttcagtaaaatgagtaagtagagattccccagataggaagtacaaattctaatgttcttaaaagtcatagtaagagctgttgccttagagcaagggaattaaggaaattaaacgttttgtgatgcagggagttatataaagtccatctgtaaatcttcaaaaggtccctggagctgtggttcctgtccatgtcccacatttacagttcgtccaggattataaaatattgcaggtggaacataccctggggacatcatctgctactcaaataaaattccccaccagtgttggcccagaggagttttcaaggtttactgtgatggatcatagcctagaaatttttcatcaagctccaattcagactggagaggccaaacagcagtcttggtatctccattgcccatctgataggagggaacattgggtttcttccaatatcttattttactgtggtaaaatatacataacataaaatttactatattaaccatcttttaagtcatacagttcagaatacattgaaatacattcatatcggtactgcaggcaccaacaccatccatctccagaactctttacatcttgcaaactgaaactctgtccacactgaacatagctca

SEQ ID NO: 643917 - DNA, 366 bp, Homo sapiens
cgaggatgtagcgcgcgcatctcaggaggggcagattagctttaggtgcgaacatgcccgagtcaggaaactaaaataactcttagtctaaatagacacttgcactgaataaagtaaaggcctttcctacagggtgggagaaggcctccgcagtcatttcttcccttctgtcagacgtaattcctcagtgtagccttcccacctctataccgtctgataacagatgagcctttattagtcaaatcaccaagcagtttttcaggctcttagtattcagtgaaacctttatatcccttacggtcctccttcttcaagaaaggtagaatggactaaaggtcttttaaaaacacacctcaccaagctcag

SEQ ID NO: 643918 - DNA, 951 bp, Homo sapiens
gaattttacgggcggttggctttgtattggtgtgagctctgttaagtcgtccctgatgtgtggacgtggttggtgattggcatggcatcgctgggttatcacgctatacctagggtgcaatagaactgtctaagtactcttgcgttgagataaccacttaccggtcacagaccattgcgacccttgaggctgtgacgtcccagtgtacaccaatcgaaaatatgtcgaatcgtcgctgtgatccaggcactacagtgataggggcatttgctccccgatccatgccatgatgggttccgttctttttggcaaggggcaagcaagtgtggcgaagttgtggcgtgtatcttctttctcgtagatctcagcagaatatccaatcatgggaagtgcggagcacttgccagactgagttcgcttggagtcttgaagaatgttggtaatgccatgagtcgttcgatgagacatcgctcgtgaatcggggagacgatgcattgaagcccttgggagagctgtgaatgccctacgtgtgacatcactatcggccaaagattgtcgactgggcccacggattccacgggattccatagaaagggttttccgctgcacccgcatgccgataagaagggcttccatcgtttttgctgggctaactcagggatggatagaactggaccagatcctcttcttgttagacgtacaaaaaggtccgagtaaaagggaagtccgagcctcttgtccccttggatccgtggcggctctgaggacaggtagggtctggcactcatcttgactggttattggagccttttgcagcggagcgtctaaccgatgctacttcgtttaacagggctgggtaagttcaaaattcgtaggcacagtccgaaaaggacttgatacccgcgaccacagattccaagcgaatccatcggaaaaggcagattcccatgc

SEQ ID NO: 643919 - DNA, 679 bp, Homo sapiens
cgaatgtactgtaagaagactataaatagtagcagatgagataggaacagacacgattgggcggatttgttaaaagtcgagctccgagtcgggcgtattattcaggccgaagtctttgagcaggctacgtagcccgcttatattttacatgtcgactttggccatgaaattggcattaagaaatcgagtgcgcagattactgagcgttatcaacctgaactgttattgggtaaatcggtggtggcagtggttaactttccaaacaaacaaattggtcccatccagtctgagtgcttagtgactggctttcatgattcagacgcaggcgtggtactttgtgtgcctgatacagatgttccagtaggtaccaagctactataattgaaaaagaaaaacccaagctcagcttgggtttttctttggaacagtctgatccaacaatagcaactatcgacgagacttaaacgatacatcgactttacgtgacgatagatccagaccaagatcagtaaaaaaactgagaaacctaaaattggccagtcacttaaacgggtatatagcgtttgaccttgcatagcaggcagttcgccgcgaagacaggtagccacatcttgtgggggcagttttacgatatgcccttgatggtcaaataacgcagttccgctgtttggtggcacga

SEQ ID NO: 643920 - DNA, 164 bp, Homo sapiens
atgtatggagttgtaggagtgaagatagtcgcgtagtggtgtatgtaggttagtacatggtggcaattgattgatggtaagggaggggtcgttgactcgtctgtatatgtaaaggatgcgtacggatgggagggcgatgaggactaggatgatggcgggcagga

SEQ ID NO: 643921 - DNA, 215 bp, Homo sapiens
tgggggtgttctagaggatcccagatcacacccgagcacgagaccagagctggtgttagaagtcaggctgtgaatctagctcttctgctatgacctcagaaaacttgtttaatatctcacacctgatgttccttgtctgtaatatgtggtcgtgataccatgtacctcaccatgctatgaggattaaatattcttcaacgcagaacgcgcctaat

SEQ ID NO: 643922 - DNA, 183 bp, Homo sapiens
tgggttttccccgtctctagagtattccctgtctcacatgtatgctctgacgggatgcggagctcacacggtaactgctgtgacgggatgcggagttcacacggtaattgctctgacgtgatgcggagcttcacaccgtaatgctctggcgggatgcggagtctcacacggtaatgctgtgac

SEQ ID NO: 643923 - DNA, 145 bp, Homo sapiens
gagcctgaatcatctattggtgcaaccaagcatcgttgatgttctttaataggaacatctggtggaacccatgatggggtcttcatccgccttaagctggccacaaccatctgatatgcagctatctggagtgggctgatggtcc

SEQ ID NO: 643924 - DNA, 116 bp, Homo sapiens
tcactcaggcctcagcaatgaggctacttattggaagctattctgacatcactttccagactgtctcactgtcttggtaccaggcatggcgaggcaaagtgtggcgaatcttcttg

SEQ ID NO: 643925 - DNA, 515 bp, Homo sapiens
  misc_feature (217)..(217): n is a, c, g, or t
aaaagacctttaaaaaaaatttattaataattaagaaatctccatgaccttaagcccagtcaccggtttttttttatcaaaaagaaaaaaagtttgaataaaaaaaaagaatagggcctaaaaatcctgtggattaattccaacggttctaccatatgttttttttaaggtccagaaaaaagaaaagaacccgattgaagtagaaaaagtttttaanaaaatattgcctgaaaagccaggcccattggctcccccctataatttcagccctttgggaagccaaaatggaaggatttctttagcccaggagttcgggaccagcttgggcaaaaaaacaaaacccagttttttcaaaaaatttaaaaattttgcccggcttggtggtgtgtacttttagtcccccctcctcaggagattgaggcaggaggttccttttagcccagggggtcaaggttttattaacccgttattgtccccctcccccccaccctgggtaataagtaaaatccttttcc

SEQ ID NO: 643926 - DNA, 298 bp, Homo sapiens
  misc_feature (217)..(217): n is a, c, g, or t
  misc_feature (220)..(220): n is a, c, g, or t
tgagaccgtgtctcactccgtcgcccaggccggacagggattctcaactcactacaacctccacctcctgggctccagcaattctcctgcctcagcctccagggtagtggggactataggcacgcaccaccatgcccagctaattttgtatttttagtagagatgggttttcaccatgttggccaggctgggctcgaactcctgacctcaggtgganccncccgcctcggcctcccaaaatgctgggattacaggtataagccaccacggcccagccaaaataaattcattttttaaa

SEQ ID NO: 643927 - DNA, 139 bp, Homo sapiens
  misc_feature (126)..(126): n is a, c, g, or t
acgcgagatcgggcatactcatatatagcagttgttcatgtgcagttctgtatagtgtttcattttaagaatacacaattttgccaggcgcggtggctcatgcctgtaatcccagcactttggganggctgaggcaggt

SEQ ID NO: 643928 - DNA, 217 bp, Homo sapiens
  misc_feature (210)..(210): n is a, c, g, or t
ccgcgtggactgcccctctcacatcttccatggggtgctagccaaacgttcccacttctccttggctaggtctaccccctaacagctccccctcctataagcagtacactggctcatcatatctcaagcatcgcaacactttctctccaatgtgcatcctggtgtaggccaacttccaagacagactcccgttgaaggtattttttttcnttaaaaa

SEQ ID NO: 643929 - DNA, 259 bp, Homo sapiens
catttgcaatattttatccaacccagtgaagctctttcccagtcatggattaattatgttgagttctttgggcccaaacccttttgtttagagttgttcattgtttgggatggcatgtttccttccttcaactgtgttctccctggcattcagaaaggagggaaaggaggaaaaggaaggggagggaagcttcccaaaagtagcctcaacctgtgcttctgtgcattattttgagaataaatttctgtttccagctgta

SEQ ID NO: 643930 - DNA, 213 bp, Homo sapiens
taggtggtccggaaggaggttcgtcggttacttgctcaatgaggcgctggcagtactcgaaggcacctcccgaagccgctcccggggcggcagcaggcggcggcagaggaggtggcggagtatcattctgttgcccaggctggactgcagtggcacgatctcggctcactacaagctccgcctcgtaggttcacgccattctcctgcctgccg

SEQ ID NO: 643931 - DNA, 364 bp, Homo sapiens
tttttttgggatggagtttcgctcttgttgcccaggctggagtgcaacagtgcgatcttagctcaccacaatctccacctcccaggttcaagagattctcccgccccagcctcccgagtagctgggattacaggcatttgccaccacacccagctaattttgtattttttaatagagatggggtttctccatgttggtcaggctgatctcaaactcccaacctcaggtgatcagtccgccttggtctcccaaagtgctgggactacaggcgtgacgacatatgcccggcctacttttttatttttgtagataattttgtatgtcttgttatgttgcccaggctggtctcaaactcctgggttca

SEQ ID NO: 643932 - DNA, 807 bp, Homo sapiens
atcgcaaagtcagggaatcaaactaaatgtccatcagtggtagaaaggataaagaaaatgtggtggcagggagtggtggctcatgtctgtaatcccagcactttgggaggctgaggcgggtggttcacctgaggtcaggagtttgagaccagcctggccaacatggcgaaactccgtctccgctaaaaatacgaaaattagccaggcgtggtggcgagcacctgtcatcccagctacttgggaggcctaggcgtgagaatcgcttgaacctggaaggtggtggttgcagtggagccggagatccttgccattgaattccagcctggggcaaccaagcgagactctgccttaaaaaaacaaaaaaagaaaatgtgggcccttttaccccagggaatactatgcagccataaaaaagactggggaccatgtcctggtgcagcaacgtggatggagctggaagccattatcctaaatgaactcactcagaaacagaaaaccaaataccacatgtgttctcacttatacgtagaagctaaacatttggagtcacacgtggataccaaagaggggaacccgcagacactgggggcctactgaaggtcggagcattggaagcgagggtgaggatcaaacaattacctactctgggtacactaggacattaaattctggcatgattgacaataattctgtaacacaaaaccctgggttaacatgcagattaccctattatgcaagggcgtacattggtgccgcttgaacctaaacacaagggtaacacaacacgcgtcgagattaattccctta

SEQ ID NO: 643933 - DNA, 182 bp, Homo sapiens
ccacccactctgctttcttgctttggaggaaattaagccaggagccctcagttgttgccttatgggagataaaggagtaatcgttggtcctattttcgatcaggagagtgcgaggggattgggagaagcctgaggattgaaggggatggggaagtcactgagacaggagcattataaaaatt

SEQ ID NO: 643934 - DNA, 449 bp, Homo sapiens
gggtttaggtaaaagagggtaacagtatactacttgataacataatgggctaacatctctaataattatttttgctagtgactttaaactgctaataaagaatattgttcccataggttagatttttattctttttaaaatttaaacttatttctcttaatttttgtggatacatagtatgtgtatatctttatgccatgtatggcatattttgatacaggcatataattttatgtattaatcacatcagggcaaaagatgtatccatcaactccagcatttctcctttgtattacaaaccaattctgcacttttagatactttagaatgtacagtcgttactacagggtcattttatggttataataaaaattatatacaagtataaataaaccatgagaaaattctgagttctgaataaacatttaaaaaaatgttaaaaaaaaaaa

SEQ ID NO: 643935 - DNA, 166 bp, Homo sapiens
tgcgcatgcttccatcaagtctgcatgtttctcagctctgatgtcagtgcggccctgttcccccacgatgctgtcatgctgcctcctgagtgttgttgatgtacttgctcgtgtgtgatctctatgtgtctgaccgtgcatgtgcatgcaatgcttgtgcacgtgg

SEQ ID NO: 643936 - DNA, 249 bp, Homo sapiens
  misc_feature (4)..(4): n is a, c, g, or t
gtantgttgtctgtcggccggttagcgtatgatgggcagtgaggggcgcatatgctcctaggctatatatcgcggatatacgtagcggtacgttaaaacgtacctctagaactatagctagcatgcgcaaattaaagcgctgatatcgatcgcgcgcagatctgtcatgatgatcattgcaattggatccatatatagggcccgggtcatcataacctcaggtcgacgtcccagggccattcgaattcg

SEQ ID NO: 643937 - DNA, 108 bp, Homo sapiens
tggcagttcaggcctctctcataagcgtagctccaaatgctaggtgatattctcttagtgaccctagaatacacaactgttgtttttttggagacagtggtctttctc

SEQ ID NO: 643938 - DNA, 114 bp, Homo sapiens
cctggcttgctcaggtctggggtagggtataggaactggggatcaggcatgtagcgatggggctcatgagacgcagaccctgtccccagctgtcccagacctgagcaagccagg

SEQ ID NO: 643939 - DNA, 374 bp, Homo sapiens
agttaaactactttaaaacccattcatttttaaaaaaaatgtttgttttaacataaataaccaaatcgtatcagtgtttgtgaataaaatcaaaaatattgttaatgattggtgctctaaggaggggtgggaggagaggggctctctataaatttttatccaaaacgtatatcccaatttgtcctgtagtaatagattaatattcatagattgttggtgtttaaaaatttgaagtgtgagtaaaatgtattcacctgtttaacatgtagtttaaatattcaaaagtatgcatgtaaaatttaaaaaatatgttaaaaattattaattttaatattttgtttggaaaagcatgttataatataatgttttcccta

SEQ ID NO: 643940 - DNA, 339 bp, Homo sapiens
gccgggcgcgatggctcacgcctgtaatcccagcactttgggaggccgaggtgggcagatcacgaggtcaggagttcgagaccagcctgggcaacatggcgaaaccttgtctctactaaaaatacaaaaattagctgggtgtggtggcaggcgcctgtaatcccagctactcaggaggctgaggcaggagaatcgcttgaacccgggaggcagaggtggcaatgagccaagatcatgccacgtgcactccagccttgctcgacagagcaggaactccattctcaaaattaccctacactccaactaacaaccaaaaaacaaacaccaaacaacctaaaa

SEQ ID NO: 643941 - DNA, 289 bp, Homo sapiens
gtgtctgacctgctgacgttaccttggaggagaacatattagatgtccccattttagtttaacttattggacacactaatttcacccgaatgtccttatagaaatagttattggttaagaccgtatgagcgtgtgtaatgcatagcacgggtgcttgaacgtgactgccctaactaaatcctttgctctgcaccgagacaatctactagcactggttctgctggcacacaatcaggattctgctgttgctgtccatattcagcaccgcccatacataaatgtaatggga

SEQ ID NO: 643942 - DNA, 181 bp, Homo sapiens
ataatcttcgctattggaatttctgcagaagtttgagaggaacttccttgctcaggatccttacgaaaatcgcacgtgtctttgagactttggacattggcgtggcagctactccgagatcttccccagaagaaatgctagaagagaatccctcgagagcaccctcagacgaattttaccc

SEQ ID NO: 643943 - DNA, 605 bp, Homo sapiens
  misc_feature (223)..(223): n is a, c, g, or t
ccaacctttgcgtcgctcattgggccctttggaaggattcttcgcaagtggattcaaccgagcctttaaaatcaaaggctttgccaataccattcctggccatggaggcatcatggatcgctttgcccgccagtatttgatggccacctttgtcaatgtatacatcgccagttttatcaaaggccctaacccaagcaaactgattcagcagttcctgactttncggccagatcagcagctccacattttcaacacgctggggtttcatttgatcgacaaagggatgttgacatcccccccaaaggacgagtaggggccccccagggccaggagaacaggaacaaaattgagcaggggcaggtttccaaggcaagcccagctggtgtgacttagacaaagacgagggttcaaccccctgtctttttttttttttggaggggattttttatttgtgggttcaaaaaatccggaaaccacgtctatgggtttaaaatttgtgttgtaagtaaactacagctttgagttggaaaaaagtcccgggttgtaaaaccatttggatttttttaaaacaaaagtattaataatttggaagacagggttgccca

SEQ ID NO: 643944 - DNA, 895 bp, Homo sapiens
cggcatccgtttgctcgtccggttaattggtatggccctggtgtcgcgctgccatgtcctctcgactcgtgagacccgtcatccgccatggacaactacgcagatctttcggataccgagctgaccaccttgctgcgccggtacaatatcccgcacgggcctgtagtaggatcaatctgcgtagtgctttacgagaagaagatcttcggagatacgaggacaccagaagggcggcggacttctcgtgcaccgcccagactctgtccgccgtctccatcgttcatagtcattctctgaacgttgatgttcgatgtagaggggcatgctgatgtgtatgtatccttcccgagtgaaagacgacggcttttagtctgactcagaagtcaagggcttacaatgatcggacatactaatggatccaggagcttactgcttgccacacagagagcttatggggagcaccgaggatctagccgggccgtcccaggggcgagtgctcggccagctcagatgacgttcatttccgcaggatagtcgggagcgaatattactcatacaactcagggtgcatgattgaacgattctagagtcttctttctgaaagagagaggttgctggagatacttggagacgctccatgtacggcacggggacagtgcctatctagagcattcacgcactgaaccgcctgtatcacggtctccaggaagctccgcctggactctgtcctattatgctattcctcctgcacctctttttattgttgctcctcggttgatcttctgcttcatggtcacccagctgtgcgcttccggctgaaaagccgggttcctgggggctgggcttgggcccagaatcggcggtcccgctcttggggggccagcgtgttttcctg

SEQ ID NO: 643945 - DNA, 493 bp, Homo sapiens
acgcccgcggtgagtaggagcgttctctttctgatttagtattatctgctgggcgaacttctctaactacatatcttctggaagtcgattctgatgtttgcagtcgatggcctgggcgtcgttatacaactgctcctccgttatactttgaaaggcaaatttttaaagacatattccctttcggcctgaacaaatgagaaggcagaattaagaaaagtgaggtaaaaacacatgtagcaataacattagagtatgcaaagcctttgcagattttcccaaaatgctaagtagttcaaaatgaaaacaggggtaactgatatccatcttcagtttataagctcataagccagagcactgccctcaaagcagatgccaaaccactgttactggggaacacatactaatgatgcctttaaagagagaaaccgtgcaaactagctcctgaaaaaaaccttccttaaagagctatacacccagactgtctcataagtcc

SEQ ID NO: 643946 - DNA, 954 bp, Homo sapiens
  misc_feature (178)..(178): n is a, c, g, or t
gttgacggcaggtggctgcgccagagccgtagcggtgtcgtgcttctgtgtgaaggacgccgaagcattgtggtgagactgttagtccagggtgcgtgttgtgtgacaagaagtgacttgcttagggcacccccagtgcgtggaattactcgggaagagaacggtgttggaacatacnccccgcgatggtttacagagaattggtgctgatcgtcccgcgtgacaccccagttggttgccgccgcggtcatgacgtgtttgcacaaggggcgcccgtccgcgccccaattccggacgatatgttgtgcggcaccgtcatggtttgtgtggagaactatgctgctcccagccgtgcccagggtattggttttgggttttcgttgtagaaggggttcctccttggggtgccctaagtaaaaaggagttgtgcgccaccgcatcctatgaagaggccaataatgtgggtgttctcttcgctcaagagagcggttctccccggctgaagggggttgtgttgtatccgcgaaaccacaaaattatatgcctgtattactactggtgctgtatgaggcaatgttcttgagaagtgtccctagttgtcttggaggggcgccccccttaaggttgtagtctttctcaggtgctctactttcttgttgaacaagttgcgacgcagcgggttgctttccgcggtgcgcgcacacaagctttgggatgtggcacgattcggggagggtatgaattcgatggcgcccactccaccaccacacgcctcatcaatattgtcctgtttcgatgagtggtgccagaagtccagttttgtgtcaggtgacggaatactcgcggtggagcagagcgcccactttagtccgcgcacgacaaccagggggtatgttcatgagcatggtagacaagtctaaaatgtgaaatccctgtcccgcccacatagcagaa

SEQ ID NO: 643947 - DNA, 970 bp, Homo sapiens
  misc_feature (970)..(970): n is a, c, g, or t
atccaagatatgaaatctgcgcttttgaataaataaaatgctctctgtcttagcaggagaatggcccaaacctgacatggacaagcatgttgggaaagtacaagaagcaatacggggtaacatgtcacttgcgctgaaaaatgagtctgtatcaccattgattacagttataatttcggagtgatcttacaaatcatgtgcttgtgccagagttcttaggttaacactagggactgcgtccatgttcactagtataacagcttgggttggctagcaattgggcccatttgattataatgacaacttcattgtcacatgttactcagttccctaataggatggtgctctcttgtggacccctgtactagatatcgctctatctttgaaacctacatatttgatccgtgccactagaaccaggcataaatttggggcgttgcgtgaacttgaccgcactggataccttctgtcatctggtgaagtctggcaccggtaacccttgtggcacccattgtgcatcttattccttaggaggggacaacactcctcttgccaaaactaatacactgcttcataggaccaactgagttctagtttgttattcacacttagcaaaatactctaaaggagagatgcgaggaacctgcaattcccctttaagcaaaaatggaaacgcgggacaatactggtcgcatcagaccgacgacctttgatcgacggatggggtcatgcgagctaccatcaataaaccgtcacggacagctcccaggagaagcagactggcacccgggctggaattacagcgaacatacctattggcgcctagagcataatcaacggacataaaagaacttccacaagggtgagacgcatagggcagacacaccacaagtcgggaggaaacgagcggacacgcaaacgcacgcgaacaaatcaacactctcaactttctacatacatctcttcttgn

SEQ ID NO: 643948 - DNA, 480 bp, Homo sapiens
  misc_feature (433)..(434): n is a, c, g, or t
tgctaggattacgaggtgtgtgagccaccgggctgggcctaaactatttcttaagggaacagattagatacatacaaaagttgaatttagtatgctttgtgtaagtcaatataaggatggggacattttggttttcttagctatgctttataacaaaatagttctagttactttctttgaggagggtcactaaagtaatacctggcttttaaaaaacatagtataactatggagggtagactatgaagagtaggcggaggtttcattttaaattatctcctctttcggacagggaagagtttacttcccctgatgtgcttatggtattgaaagcccatggtggggtgttggtattgaaagaaagcttagtttggctgcgtaacctaaagggagagggaagaaagattttgaaaagtgaaaatccattgatttnntgttggctggagaaggattggatactatatcggaggtgagactaga

SEQ ID NO: 643949 - DNA, 1506 bp, Homo sapiens
gctccctggctgctgacttccgctcctgcgcggcttgttctctgcgagcagcgcttcttttatctccgtccgccttctctcctacctaagctgcgctgccgccaacccgactggaccgacttcgactggcaccctgcgcacactgagccccctgcaggccccagcaacctactcctcctcccggccgctgcaacctaacacggcccgaccaacacgcactcactcacctctcaacgcgctggcactcactgcactcgacccactgcaccccacccaagctcactcctccaacgcaacccgcgcccacgccccccacgcgcgccccctggcccgccccccacgccgcactgcaacgcctcgccaccacctccgcctccgcacacgccaccgacgccgccacacacgcccacctccacccgccacacgcgcccagcgccccccaaccctccacaagcgctcaaccacacctggcgccaacaaccatcttctggcacaccaccacctggccttcctctgcctcaaccacaggcccccacacccggcgcgctccccacccacgtgctgcgcgcgcccgcacaccctccgcaccacacctcaacaccccacccaagcctcaacgcgggcccctccctctcaaaccgcgcccctgcacacgcctcgctgccactcctccgaagcgcgcctcccacgcctgcccacttactttacgcctgcgcacccccgcccaccctctcacgctcacccccttgcctccgcatccccaccgccactgccacccaccctccccgcacacccacctgcacaccacgcgcacccgccccgcccccctgctcgccaccctccctccccccacaaccgcctaacccaacctcccctgcgccacacacgcgcccgcgcacccatcagccccacccctgccccacgcccgccgggccccaccccacccgcgcccctccacaccacgcacaacccaacacggctaccacacccccgccccagccctgacctcgcacccgcccgacccctcaccccgcagctcccctcgacctgcgaccacccccgcgacctcgactcgcatttccacccccctctcctccgacccgacctcccccccccacactctcccgactcgcacctccaccgcacacacctcttccacccacaacaacacgccgcgcccacctctccacacgcaacactccctcatcaccccacccatcaaccgccccacccccaccaacattcgtccccaccaatcgttcccaccttcaccacctcgtctccccacacacccttcccaccacacttcactcctaccccccaaggacgctcaaacgcccccacaacactcctctccccccgacaacccccgcgaacacacctctcccaaacacccccaacacacggccgccctcctcctcccaccacctctactccaccacactctccccctcttttacacagcgcccccaatacgcccgcccccacctgccttacccccccacg

SEQ ID NO: 643950 - DNA, 325 bp, Homo sapiens
taagttcgcggccgcgtcgacccgctcttccttggcgccggtgtattcggtctccagcaccgccaccagcttgtcgccctcgcgatagaccttttccagcatcatgtcgccggtcatgatcacttctttcgggtacatgctgcggtagtaggtcgggaacgacgtaccgccaatcgccacacccggcttgatgtcgtcggtgacgatctcaacctggctgcccttgtcagcgaggaagtcggcgaccgacatgccggtgaactcgcagatggtgtcgtagaccggcacgttcttgcccggtgcgaccttgccatcgagcacgtcc

SEQ ID NO: 643951 - DNA, 281 bp, Homo sapiens
attcaggatcttagaggacaaggagggattctttcgtagggcagatttgagagctgaagaccgggcatatttgagacaagttttctagatgagagtgacgattagcatggtccagggtcggggttatctccagaagctaggtctgaatagcacctgcgatgacagtatcctcgtcaagacagtgtgcggggtgctgtccaggaggcccgcacagctgtgcggcgcaggcatggcctgcggctgcggactcgatccgcgagaacagaggactggaccgtctg

SEQ ID NO: 643952 - DNA, 205 bp, Homo sapiens
cgccaacacacaaatggtgttataaatatttaaaataacaataaggcgggtgcagtggctcatgcctgtatacaatcccagcattttgggaggcaaggcgtgcagatcacttgaggccaggagttcaagaccagcctagccaacatggtgaacacccgtttctactaaaaataccgaaaaattagccgggtgttggggataacat

SEQ ID NO: 643953 - DNA, 328 bp, Homo sapiens
  misc_feature (186)..(186): n is a, c, g, or t
  misc_feature (287)..(287): n is a, c, g, or t
ggttccaagatggccgaataggaacagctccagtctacagctcccagtgtgagcaacacagaagatgggtgacttctgcatttccaactgaggtatcaggttcatctcactggggttcatcggacagtgggggtaggacagtgggtgcagaccactgagcatgagctaaagcagggcaaggcattnactcacccaggaagtgcaaggggtcagggaattcccttccctagccaagggaaggggtgacagatggcacctggaaaatcgggtcactcccaccgtactanttgcacttttccaatggtcttagcaaatggaacaccagggg

SEQ ID NO: 643954 - DNA, 755 bp, Homo sapiens
  misc_feature (670)..(670): n is a, c, g, or t
  misc_feature (721)..(721): n is a, c, g, or t
gggggctctgtaattttcagagcggaagggcgcgttgattctttataaccaggcgtcatataaacacggtctatcccctatgccttctgcataaggattcctctagcaagcccgttgcatggagagccaaaactaggaccacggacaccatacgagctacctcagagcagctcctagatcacacgcgagtgtgtatcatactttcaggcaatatctatagtgtcgagtgcctcgcacctacgccatccttggtgatagcttgtgtgtccaagcatccattattggcttactgacaaatctgcccactgcaccgtgtaaacaccctagtgcatcaaactgtcaggacacagaggagcacctctatgaacactagaaaaaaaccttgacaagacagcttcaagatctagccccaatctctgcccaaaactcagccacaattgatgatgctgaacattttagctaccatgtccgtccttgagactaatgaaaatcctataattgagagtttggcctggtcaactgcctattgacccagggacgttcaccgggtccacacttatgcactgctcaaagatctggaccccactcgtaaccttatacacatctggagacttttcgcactcttaggttccttttgcttacaggtgaccgacctggagaccaatggggngacccaagactagccctctcaaacccacggctttttttaaaaatagccaangcgaaacggccctcccctaaaccccttcccaccc

SEQ ID NO: 643955 - DNA, 124 bp, Homo sapiens
cgcgtatcatcggcaccttgttattcatcgagcatcagacttgccctccaatggatcctcgtttaaaggatttaaacgtgggatccattggagtggcaagtctgtgtgcctgataaattagcga

SEQ ID NO: 643956 - DNA, 339 bp, Homo sapiens
agcgggagtcaccaccgtccagttccctgagtctggactctctgaccctgcaggtgatctgccaagccttggcctccaaggggtcctcggaattgcaaggcgcgggagccaccgtatgtcaccgggcacaaggacgtgtatctatgactcgagcgcacaacaaggactcgctagcaattgtagacaaaccgtactttatcatctaccgaacatgggctggatgcgatgttatgcctctacattttcatttcctcgggatgaaaagtggggattattgccaagcggtatagtgcctgattgacgttgaatgatcgccatacgcatggcgttttgctccaa

SEQ ID NO: 643957 - DNA, 707 bp, Homo sapiens
cgtttacgcctctccgttttggtcaccccggccacttcttaacctgggggccacatgtactctgggaaaaagggtccgccactgattctctttctgggctcccctccacgtggtttaagaggcacccctggttcctcttggttgcactgcccccagagctattttccctccatccttagtttgtctgcacgcccaattctctccctctagcttcgatgagactcgtgtttatttccccctttgaaaccctacctatcctcgaatggtcatgtacattgtctcgcccttaagatacctctcctcctctttttcctccctctatttcttctaaataaatcgatggggctaacattataccccaagctccacctttaccaaataatttccctcccgtactttgcaggaaaccccccacctaaatgcccattttgtaaaaaggctgtatttttttttttagaatcgtaagctcctcacagagcacgggaccatgttttctcgtatgttctattgtgcctagtacactgtaaatgctccataaatattgcatgatgggaggccgtgagtcttgatgataagggtgagaaactggaatccccaaccctgttttgtttgcttgttttattatgacccccgatttaattggggaatattggcccttttggataattgtccccaatattacattccaatataaagtgccatggaga

SEQ ID NO: 643958 - DNA, 129 bp, Homo sapiens
ttcagcacatatagtgtctatacttctccggtttcccattggccagggcaacatggatccctctcccaacataattctaaacaccactcattaaaacataatctctccagtgcaaatttgtgggtccca

SEQ ID NO: 643959 - DNA, 378 bp, Homo sapiens
  misc_feature (1)..(1): n is a, c, g, or t
  misc_feature (72)..(72): n is a, c, g, or t
  misc_feature (92)..(92): n is a, c, g, or t
  misc_feature (360)..(361): n is a, c, g, or t
nccctaaactggcattaggcgtctcctcaaccctcaccctgacctttctcctgtccttttcttggctggaanaaagttggcctccctgggantgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtgcacatgcctgtaatcccagctacccggggaggctgaggcaggagaattgcttgaactcagaaggcggaggctgcagtgagccgagaanngccactgcactccagcc

SEQ ID NO: 643960 - DNA, 555 bp, Homo sapiens
  misc_feature (32)..(32): n is a, c, g, or t
  misc_feature (537)..(537): n is a, c, g, or t
ctgatacgggggaagcatggtggggagcctcngaagctgacaatcacggcagaaggcgaaggggaagcaggcacgtttctggccatggtggagcaggagagacagagagagtgaagcaggaggtgctgcatgcttctaaacaaccagatcccatgagcgctcactcactatcacgagaccagcaagggggacgtcagccgccatgagccaatcatctcccaccaggtccctccctcaacactgggaattgcaattggacatgagatttggttggggatacagagctgaaccatatcaagggtagttcaaccactgagattgattgattgactgagatggggtcctgctctgttacctaggctggagtgcagtggcacaatctcggctcactgcaacctccgcctcccaggttcaagcaattctcctgcctcagcctccctagtagctgggactacagcacacgccaccacacctggccaatttccgcattttcagtagagacggggtttcaccatgtttgcccggctggtcttgaantcctgacctcgtgatcac

SEQ ID NO: 643961 - DNA, 562 bp, Homo sapiens
  misc_feature (95)..(95): n is a, c, g, or t
  misc_feature (102)..(102): n is a, c, g, or t
  misc_feature (115)..(116): n is a, c, g, or t
  misc_feature (124)..(124): n is a, c, g, or t
  misc_feature (161)..(161): n is a, c, g, or t
  misc_feature (172)..(174): n is a, c, g, or t
  misc_feature (196)..(196): n is a, c, g, or t
  misc_feature (203)..(203): n is a, c, g, or t
agagtcacgagtgcctgatgggcaggtgatcccatcgcgaatggaaagttcccgcggcccaaagaccctgttccaccaccccttcatcgggatgnagtttgntggcatccatganncccctccnccagcatcatgaagtgtgatattcacatcaggaaggncctctatgctnnnaatgtcctatcagggggccccnctatgtnccctggcattgccgaccgaatgcagaaggagatcccggccctagcccccagccccatgaagatcaagatcattgcccctccggagcgcaaatatctgtttggatcgggggccccatcctggcctcttcgtcccccttcccagcaattttggatcagcaaacaggaatacgatgaagccgggccttccattgtcccccgcaaatgcttttaaaaccctttcctgctcctttctgtttttagcccccaactgtgaatgtcctgtggaattatcccttcagtttttttccaaatcattcctagccaaagctttgactcgttccctatgtgttttttaataaatctgaaataggctactggta

SEQ ID NO: 643962 - DNA, 349 bp, Homo sapiens
cacgaggtgctgttccagcaggcgatgcagtgggtcacgctgggttccgacgccggtggcttcgtgcatgtcggttcgatcagcatcggtttcttcgccaccgcgatcgcggtacgcctgctggcgcggcgcgtcatcgccaacgagtcgctggcgcgcgagcgtggccgcgatctggccgagcaggtgcgggtgaacgagcgggtgatccgcgacatggacgacggcgtgctggtggtcgacacgctcggccacgtgcggcaggccaacccgcaggcgcgtcgtctgctcgacccgctgatgccgcgcccggtcatgctggccgactattcgccggcgcttgccgcgg

SEQ ID NO: 643963 - DNA, 779 bp, Homo sapiens
gtcttggctcattctcacataaccgtggatctaagattggaaagctgtggcaccctggtagggtgtcccatctaccctgtgtcctgttactgcagatggcttgtcaagcttcattttaagcctgctcggtgtacttatctgccttatatcctaatagacttctctcggtggttattacacagtggtctctttggctctaatatttcattcatttagccagtttgtcagtaccgttatcagagggacaaggaaggaataacacaccagttgaccattgtagtgtctcgtgagaaatctgagcaatacggagatccttgtgtattaggtaaaacatgatatcattactcatacgtacaagggcgtatacgacttttaataatgtaatccatcattgcttgccatatttggagtgaaaaccgaagttgaatgagtcttcgtgaattcacatggctatgtatagaccacaacatgcatgacttcaggctgagcatagagacatgtctgcatcctgagcctctatctttatagaggggcaaccacttgtataccctcatggtgggacaacatacctccttcatccgactccagaggcagtccggtggatactattccgtaaagtggccccttccatacatgatgcacttgaccaggcgattggagccgtgcttgctggtgacagacgccccgttacatagcttacagtaaactgtaggttctggcaagcagggatcccagacaacatactataggtggactagagtatcagatgactagtgtag

SEQ ID NO: 643964 - DNA, 771 bp, Homo sapiens
  misc_feature (15)..(15): n is a, c, g, or t
  misc_feature (67)..(67): n is a, c, g, or t
  misc_feature (72)..(72): n is a, c, g, or t
  misc_feature (85)..(85): n is a, c, g, or t
  misc_feature (111)..(111): n is a, c, g, or t
  misc_feature (114)..(114): n is a, c, g, or t
  misc_feature (118)..(118): n is a, c, g, or t
  misc_feature (216)..(216): n is a, c, g, or t
  misc_feature (218)..(218): n is a, c, g, or t
  misc_feature (265)..(265): n is a, c, g, or t
  misc_feature (280)..(280): n is a, c, g, or t
  misc_feature (282)..(282): n is a, c, g, or t
  misc_feature (297)..(297): n is a, c, g, or t
  misc_feature (305)..(305): n is a, c, g, or t
  misc_feature (327)..(327): n is a, c, g, or t
  misc_feature (336)..(336): n is a, c, g, or t
  misc_feature (338)..(338): n is a, c, g, or t
  misc_feature (346)..(346): n is a, c, g, or t
  misc_feature (356)..(356): n is a, c, g, or t
  misc_feature (362)..(362): n is a, c, g, or t
  misc_feature (379)..(379): n is a, c, g, or t
  misc_feature (381)..(381): n is a, c, g, or t
  misc_feature (418)..(418): n is a, c, g, or t
  misc_feature (426)..(426): n is a, c, g, or t
  misc_feature (430)..(430): n is a, c, g, or t
  misc_feature (458)..(458): n is a, c, g, or t
  misc_feature (466)..(466): n is a, c, g, or t
  misc_feature (468)..(468): n is a, c, g, or t
  misc_feature (475)..(475): n is a, c, g, or t
  misc_feature (479)..(479): n is a, c, g, or t
  misc_feature (501)..(501): n is a, c, g, or t
  misc_feature (531)..(531): n is a, c, g, or t
  misc_feature (539)..(539): n is a, c, g, or t
  misc_feature (550)..(550): n is a, c, g, or t
  misc_feature (554)..(554): n is a, c, g, or t
  misc_feature (558)..(558): n is a, c, g, or t
  misc_feature (560)..(560): n is a, c, g, or t
  misc_feature (580)..(580): n is a, c, g, or t
  misc_feature (584)..(584): n is a, c, g, or t
  misc_feature (601)..(601): n is a, c, g, or t
  misc_feature (603)..(603): n is a, c, g, or t
  misc_feature (618)..(618): n is a, c, g, or t
  misc_feature (620)..(620): n is a, c, g, or t
  misc_feature (632)..(632): n is a, c, g, or t
  misc_feature (639)..(639): n is a, c, g, or t
  misc_feature (646)..(646): n is a, c, g, or t
  misc_feature (770)..(770): n is a, c, g, or t
ccccgcttcccgggnaagaatcagacttcagtagaaattccccacaccctaaccagccttttctggnttctnctggaccagagtngggggaaaggtgtgggcttcagaganaancatngagtattctcacctccattccctacccaacccatgccatgagagaatggtgatgatatggcctaacacggggctgcagcagccatcatggcacattgngncccactgacgttgtcacctacccattatgatgttcatcaaagtaccnaatgggctaaaaaangngttacacagtattgnggccaacntggctacctactgttgccaagnattccaaanangaatttgncttatcaccngtatgnggggggccaatgaagantntcactgaaatgttttcaccatcacactcatatggccnatcgtagntggnggccatctaatactcatgcagtggtatntagctaanantatccancaangtagcagttctctcagtacccngtgggccttccaatatatgtgatccttggnggttatcnatagtaccccntggnttancnccattcccacttagacattngttntcactagtaagttatantnccacaccagatgttnancaatgggttatnttaagtnttactanttggttcaggccccaagagcttcgtggtgtgagctccagccatacccaccaccatgttcccaacccctgctaggatgcattaagcaaagagcgggaatagaggccctggtagtagactccaggng

SEQ ID NO: 643965 - DNA, 252 bp, Homo sapiens
  misc_feature (9)..(9): n is a, c, g, or t
  misc_feature (214)..(214): n is a, c, g, or t
  misc_feature (251)..(251): n is a, c, g, or t
ggatgtganggcgatctggctgcgacatctgtcaccccattgatcgccagggttgattcggctgatctggctggctaggcgggtgtccccttcctccctcaccgctccatgtgcgtccctcccgaagctgcgcgctcggtcgaagaggacgaccatccccgatagaggaggaccggtcttcggtcaaggtatacgagtagctgcgctcccctgntagaacctccaaacaagctctcaaggtcacaagaggng

SEQ ID NO: 643966 - DNA, 1142 bp, Homo sapiens
ccgaggttaacccacttttgacgcatggccccaggatggacacctaatgatccgttcgcaaatataggggaaagaattttgttgccccaaccgactgggtctgcctggcaccgacaaaagaggcccgatcaagttggcccagcggcatatccagaggggcaaaacgagcccgtgggccccccaaggagggaacaatgaagaaccaacacaagtggagtcaaaacaatcataaggtaactgaattggaccagtattgctgagtttcctagattagtttcggccatgaacaaagaaggaaggcgagaaaatagcgtgctttccaatgttgccacacaacatgaggccatacagataaaagagctagccaaagtctagttgttgctggatgctagtagttctctgtgctaagagcgaaggaaactgtctcgcataggagcctatatataatataaacatatatagcgtgcactcttacagatatggcctgtcataccatgagaacatttctgttcttggatggggatgcttacccttgcgttcataccaaaattgattcttggaactgtaaagattacaacccaaagtctcccaggaagctgtgtgggagaccagaggatcaagctgaagtgaagccagtgaagagcccacctgtggaaggacatgacggggcgaggcacagccagtgcattccggcctgcgaacaggccctcccagcagctttgccgcctctgccatcgtctcagggcccttgctcagaatagctagtgggactgaatttcacagacaaagaatactaatttccatagtgctctatgcttgcctcttcttggagttctttgctctatctgagtgtcttcggtggcgtagataacagtcagattacgggtccgtctagccattacagagtctgatgcttgaaaacttgagtcttcctgagtaatgaatatcaactatcagaatttgactgaactgaagaggaaatcgtattgtttgggggacaaaaaacatcagtttgatttctactaggcggttacttttatgatgatgttttagctaagtggtgtgccaggttttcagtgacataccaaatggaaataagaggatattgatcacgagtataactgctgagtacctttctgcaa

SEQ ID NO: 643967 - DNA, 150 bp, Homo sapiens
  misc_feature (46)..(46): n is a, c, g, or t
  misc_feature (144)..(144): n is a, c, g, or t
tctcgctccgacgcgctgtctccccgtcgcagacgccaccgtcgcngcctctctcgtcggagacgggagcaaaacacagagaatcgggctacaaagcaggtgggcaggtttggacggctcaaaccggcagtgccgcggtttagncgtctc

SEQ ID NO: 643968 - DNA, 211 bp, Homo sapiens
tagcatgactacggattcagctggcggttcttctatagcctctatgccatccaggagattgaagagatctcgcagaagatcgattccagagcggagaccatcctgaacgcgatagaggctaagaagagacggcttcaaagcttctgagcaagtccaggctgtgagggccccagctccacccaggctttgggaccaccttcggtagctgctc

SEQ ID NO: 643969 - DNA, 1007 bp, Homo sapiens
gctcagcgacttccactgccagtcctcataccagagccaacagtcatctccacgagagagaaagcgtgccggagtccggagagccggggtgtggtcatcgatgggctgtgattgtgttgcactccttggatccatggcagggtgctagggcgcgtaggtccctcgtatttcgctctataaagaagggcaagcatgccgtgcaggcgctcacgggaagcaggacgatcacggctgtccccttgttcttcgtacatgtagcgaaccttgttagctttgaacacggttaagctgcagcataagactcccgagaacgaagatggctgcctccttgcacggggccactacaggccgtgttgagcagcgaagggagcgtcccgcgggcaagaaacactatgcgggaagcaaggaaagattacctttcggaattcctggaagcgtccattttcacgcccactgctaaattacaaccttttccaggcgttcccaccttttctcctgtaggcccttgggtaacgcaagtttccgccctagacgttcaccacgttgtaccattcaatccttactttgtccgttcatccataggcccatatgaagtaccactttccaccataaacgcgggggaaccttaggcaacgcaaggcaaactggccccatttccccttggtcgttcaaccccgcgttcagagcccccttttgggccgagaccaaaccaccaccacacacgttctctgatcacaacggaaaggcggatgaggccaccaagcccattggacgagggttttcacaggggaacacccccctctgggcaagcggggcacaacgccagttgccaaaccgtttgatgggaggacacccccatgttgtgtccaaaaggggggccacaccaccggggagcagttgagatagcttaccaacggacgggtgaaaaccccacgaagtgtttagccacaaaactcctaacactaccacaaagtttgcgtgttacaccgaaagccaggatttcgcgg

SEQ ID NO: 643970 - DNA, 134 bp, Homo sapiens
aagtccctcgataggcaaatactgggaagatttataggtagaggcgacaaacctaccgagcctggtttcgggggtcttagctttggctctccttgcaaagttatttctagttaattcgtttggcccttatcgag

SEQ ID NO: 643971 - DNA, 842 bp, Homo sapiens
aaaggctgtacgcccgggtacgggatcccgagcctgttagacgcagctgcaccggtgagactgagagaggaataggatatgagtgaagctgcgtgcccatagtgactagcatgtagtcgaagcaagcgtgtatccttcccgccaggcaagtgcccttagaaacctgggccccgcccccttcctggcctgcattctccatcccactctcccggggcggaggtgaggacctcctatggttcctttggttctgtcatgtgagccccttccttggccatgaagctcgtgaggaagaacatcgagaaggacaatgcgggcaggtgaccctggtccccgaggagcctgaggacatgtggcacacttacaacctcgatagcaggtgggcagacagactgacgcgcactccaaccaatccagcaaggtacagacagaagtccatcccacgggcacgcgatgggacatgcaaaccggagatccgacacttacacctcactctctgacgtggagagacatcgaacatatcgatctctacaaagccatgaccagacatgacgggattaacatggagggaccaaacactcccaacgaggacatgagttcatgtcaagaatggggggcctaaccaacaaccagtcagagacatggacgacccaaaacgacagctatcaaacccatgaggccaacgaaagccaaggggagaataagacgaaagatacgacagacaacgccatcgaagccagggcccagatgaacccaagcatggaagacagcagaaagacgagaggcctgacagaccaatacagcgaaagagccatcgaacacaaatcagccaagaacaccacaca

SEQ ID NO: 643972 - DNA, 425 bp, Homo sapiens
  misc_feature (117)..(117): n is a, c, g, or t
  misc_feature (127)..(127): n is a, c, g, or t
  misc_feature (166)..(167): n is a, c, g, or t
  misc_feature (186)..(186): n is a, c, g, or t
ggaaacttataatcgtggcggaaggtgaggggaaaggaagcacgtcttagcacagcgaagcaagagagatagagccagaaagcgcaagtgcgcatgtgcgatgggggatgtgccacnacactttaanaacacccatgatcttggccatggcgctggtggctcacgnncctgtaatcccgagcactnttgggaacggctgaggaggtgtggatcagcgaggtcgaggagcttcgagaccagctctggccaaggatggtgaaacccctgactccatctaaagaatacaaaatattagccagtgcgtggtggcatggcgctctataatcccatgctactcggagaggcagagtgttgcatgtgagctgaagatcacgccacgtgcactccatgcctggtgcgacagatgtgagacccctgtctcccag

SEQ ID NO: 643973 - DNA, 473 bp, Homo sapiens
tatatcaagtactctctcagaccaccttggaataaaattggaaatcaactccaaaaggaatcttcaaaatcacatgaatacatggaaattaaataacctgttcctgaatgatcattggatcaacaatgaaatcaagatggaaatttaaaaatttctcacactgaaggacaatagtgacacaagctatcaaaacttctaggatacagcaaagatggtactaagaggaaagttcatagccttaaatgccttcatcaaaaagtctgaaagagcacaaatagacaatctaaggccacacctcaaggaactagacaaacaagaacaaatcaaacccaaacccagcataagaaaggaaataaccaagatcagagcagaactaaatgaaattgagataaaaaaatacaaaagataaacgaaacaaaatctggttctttgaaaagacaaataagattgatagaccattaggaaaattaacc

SEQ ID NO: 643974 - DNA, 678 bp, Homo sapiens
  misc_feature (248)..(248): n is a, c, g, or t
  misc_feature (256)..(256): n is a, c, g, or t
  misc_feature (363)..(363): n is a, c, g, or t
  misc_feature (383)..(383): n is a, c, g, or t
  misc_feature (661)..(661): n is a, c, g, or t
ttccccagcaacgtcatctgcaaaaccttccactccgatggcctacgggcacatagggcggaagtaccagctcaatagtagatggaagttgaatctcttcaagttaacacccttcatggtcaattccgtccgttgtctgtaagggaagggtggattcaattaaggagcctatacgcttgtgtgttaatgatctcatagaaaatacattcatttgcgcgtcggcctgatcgtagagagtcgtgactcanttggatcnatcgttgcacgtactttggctgtgatgaactaggtcctagaggtggatccagagtaggctcgaatcgtggtttggtagggcaaggtatgatgtatacatagagcttngacattgggtgctccattgntagaagactgacgccctgcgcattcgtggtggattaacagtagtccgggaacgcttcggaggtgaatggtgccgacagagaagaaggctgcagccatgtagttggatcgtgcagtgtaccgtgactttagcgtttgaaatagcgttcgtgagcagccctgaagtcgaatgtccggttctgggcttgggccattcatgtatttggaccgccaccattccctttctggttggggactggcaggtgtcccccagggaaacttgtcgatcctagccaatgcntgattgcagtgggacat

SEQ ID NO: 643975 - DNA, 319 bp, Homo sapiens
tgcagcctgctgagtagctgggactgtaggcacgcgcccccatgccagcttatttttgtatttttagcagggacggggttttgccgtgttggctaggctggtcttgaattcctgacctcaggtgatctgcccacctcagccttccaaagttctgggattacaggcgtgagccactgtgcctggcacacagtatctcttatagtacctagtgcagtgtgacaagttcatttttctaattctttaaacctttcttggttggttgaattgttaagaatggtagatctcagatgctgcagtctacctaggaattcatcccagg

SEQ ID NO: 643976 - DNA, 474 bp, Homo sapiens
  misc_feature (194)..(194): n is a, c, g, or t
  misc_feature (208)..(208): n is a, c, g, or t
  misc_feature (227)..(227): n is a, c, g, or t
ggaaaaactacatacatattgttatctttctttgttttgtttgctcttaaataatatcaaaacaaatatttctatattagcttaatgttgagttataaggttaggtgtgatggattccatcacattcaaaagtttatatctttaatataaagtttaaatcatattttaaaagttttataactttaatgcctcangcttttggcaagtngtaattcaggaaggcaganaaatcaattttaatatgaaaaaccaaagtatttgacagccaagataataagcatttatgcaaactgaaaattacttgcccgccaaaataaccatttatgaagatttaaggaaaatgtaggaaaatgttatgactgtttatagggttaaaattagttgcatctaccttggaatccatagtatatatttttgggcttattgttgctttttaaaaatctatgacatagcaactatatttaaaattagttt

SEQ ID NO: 643977 - DNA, 224 bp, Homo sapiens
ccaggaactaaccaggtagacctcccaggtagacctaacccaggtagacctaacctttttattctatttttctttatttttctctgtcttattttagagagccagtattcaagttctgagattctttccttagcttggttattctcatgttaatacttgtgattacactgtgaaattcttgtattgtgttattcagctctgtcagacccgttaggtctacctgg

SEQ ID NO: 643978 - DNA, 840 bp, Homo sapiens
gatcctttccctagacagtgctatatttccgtggacacatgagcaggaatcaagtgcacttgctgaatcctgatcataataccgccgtgttatcggaaccagggtcgcagcaccttctaggccctagccctttggatgctggtgcgtctgaaattgcaggaactttcctccttgggtcgggaaccgatgaactaggctacttagaacggacgcaagtgcacaacctatcagagcccagcttgtgccagctccctcctttgaatatggtcgatccactttcaggtcacgaggagctgacctgtgtagactgatgcgaaatgaagtggccaaggcccagcaggcaactcatgtggggagcagccccaaccatcttctcccggatcctggacacgagcctcccagctgacagttctctatgaggaccagcaggatggggtgctcttaggacctatccccttaggaatgttgtagataccatccaacctgttgaagtaacgtggcctctggcctgtcacttcccccagtgtcttgtgttccgtgatgtggcccctcaggctcctgtgcacttcctggtcattcctaagaagcccattcctcggattagccaggctgaagaagtaagaccagcagcttgctaggactacctacttccttgtggccaagcagacagcaaaggtctgagggcctgggtagatggataccgacttgtgatcaacgatgggaagctgggtgcacaatctgtgtatcatctgcacattcatgtacttgggggccggcagctccagtggcctccaggttgaacctgcctactgattaaagatacccgatggggatgcttgg

SEQ ID NO: 643979 - DNA, 885 bp, Homo sapiens
gcccctgacgtcatccaccagaagcgtcaaccctgagggtaggtagacagaaacctggggccaggcccacacgagtccctgcccgggagtagcccctcactgcacttgggaagctcctgtacctcttagatgggatgctgtatgggcaggtgaacagtgttatagctagccactccagcctgctgctgcagcagccaccctggatgtggctgttcggagtaggcctggtcccacggagcccagtaggctgctgtgcgtggccctgggtacagctggtaccggcctcctagaccgtcgccctatgtacgggtaggtagtctgtggctgatactatcaggggcttaggtaggcggctgccctatcctatgttcctatgtctcctacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcatatgcttcgggggctggcagggggccgtagtcctggcccctccctggtaggtagatactcctactacccctagctagcagggatcctggcccgggtgctgatatggtagtaggctacctcctagcctaggcccttcctctgtggcctccccagtaggtacgtccaggcctgtatgtacctgtagtagggcagctggagcctctagtggtatagtatgtgtgctagtgcctatcctctacctggtggcttgaatatcggccataggtgggagcatttacccgcagaaattacctgtacgctgcgaattctgcctgctctaggtatccctcgagggattagcctacgtactgctt

SEQ ID NO: 643980 - DNA, 154 bp, Homo sapiens
tagatcgagccggtacccgtcggtcgacctgtttctgtctctccctacctctatctcagctccactctgaagtcccttccatgtccggctcacgtctgtgagtctggtcctttcccacccactagccctctttctctctgtgtggcacacattt

SEQ ID NO: 643981 - DNA, 697 bp, Homo sapiens
atataggattgaagatctctcagttaagtctacatgaaaagggatggtttcttggagcttccagcgaaagcttaaaaccatgaaacatctattattgctacgtatcgtggtgttttgctagttaagtcccaaggtgtcaacgacaatgaggagggtgacttcagtgcccgtggtcatcgaccccgttgacaatgaagagagaagaggctccgcagcctgaggacctgtcaccatcgtgccatcagtggtaggtggctatcgggctcgtccagccaagagcagctgtcgactcaaatagaacagtacgaagagaagaagcccctgatgctggaggctggtcggttcacgctgtatcccagacctggagggctgtggtgtcctaacaggatgtcagttgcaacgaggcttgggtacggacatggaaaggccgatcagaacgtagtgttgactgagttacaataacaatgtggaagctgtatcccagacctcggtgttgttccgtttgagtacatgtattgtgctgaaagactgtggcgaaaagaggcagaagcaaggtaagacgataatgaagattgtagtcaagtgagtagtcctcagaattggaaaagcaccaatcatatatagaatgagactgtgaagtagcaatattcccaaataactttagtggtggttcgttcaatcctgggaaaactgagga

SEQ ID NO: 643982 - DNA, 317 bp, Homo sapiens
  misc_feature (11)..(11): n is a, c, g, or t
  misc_feature (259)..(259): n is a, c, g, or t
  misc_feature (283)..(283): n is a, c, g, or t
  misc_feature (306)..(306): n is a, c, g, or t
  misc_feature (312)..(312): n is a, c, g, or t
tgcgctaactntgactcatttgaggatcccctgagagaggtatagctgagctgaagagagctgaactgaagctgagactgagctgagctgaaactgagctaagggtgaggctgaactgagctgaggttgaggcagactggagctaaagttgaggctgaaccggactgaggttgaggctggaactggagttaaggttgcctggaagtggagctgaggttgaggctggaactgaagctgaggttgaaggtggaagtggagncgaactagaggtggaactgagctnaagactgtcttgctgatcctgtncctgtntcttg

SEQ ID NO: 643983 - DNA, 225 bp, Homo sapiens
actagagtcatctctagccatcaagtttactgcttcagcagagatatcttatagatgcatcctgtaatgaccagatcctgtagtcatacatagagcagggtcatgaccagtgctcagaacacaagtacctgctgatctatgtcactataaggatcactatgtcaatatgttacttaattcatatgctaaggtgtactcaatttctttaatcacattgacatctat

SEQ ID NO: 643984 - DNA, 225 bp, Homo sapiens
ataagtgaatcataaggattatgcatatgttatatgcggactgacccacctctcccccccagccttgcctctgggttgtgtgctgctttccccttacttggctacatttctatagttaagtgggttttactggaatgattcatgtttagggggaaaatgaaaatcgtcccttaaaattggtttcaactccgtccggcgaaataaaataaatgaagtggcagatgt

SEQ ID NO: 643985 - DNA, 100 bp, Homo sapiens
  misc_feature (71)..(71): n is a, c, g, or t
aggtacacgatccctttttgctgcagtcattttgattaccgcagttatggcaggataaagctgtgtcaggncacttaccacctgagaagtgactggattc

SEQ ID NO: 643986 - DNA, 918 bp, Homo sapiens
  misc_feature (8)..(8): n is a, c, g, or t
  misc_feature (69)..(69): n is a, c, g, or t
  misc_feature (89)..(89): n is a, c, g, or t
  misc_feature (95)..(95): n is a, c, g, or t
  misc_feature (185)..(185): n is a, c, g, or t
  misc_feature (199)..(199): n is a, c, g, or t
  misc_feature (213)..(213): n is a, c, g, or t
  misc_feature (224)..(224): n is a, c, g, or t
  misc_feature (288)..(288): n is a, c, g, or t
  misc_feature (329)..(329): n is a, c, g, or t
  misc_feature (338)..(338): n is a, c, g, or t
  misc_feature (340)..(340): n is a, c, g, or t
  misc_feature (379)..(379): n is a, c, g, or t
  misc_feature (403)..(405): n is a, c, g, or t
  misc_feature (416)..(416): n is a, c, g, or t
  misc_feature (432)..(432): n is a, c, g, or t
  misc_feature (442)..(442): n is a, c, g, or t
  misc_feature (444)..(444): n is a, c, g, or t
  misc_feature (450)..(450): n is a, c, g, or t
  misc_feature (453)..(453): n is a, c, g, or t
  misc_feature (456)..(456): n is a, c, g, or t
  misc_feature (459)..(459): n is a, c, g, or t
  misc_feature (462)..(462): n is a, c, g, or t
  misc_feature (465)..(465): n is a, c, g, or t
  misc_feature (467)..(467): n is a, c, g, or t
  misc_feature (470)..(470): n is a, c, g, or t
  misc_feature (475)..(475): n is a, c, g, or t
  misc_feature (479)..(479): n is a, c, g, or t
  misc_feature (488)..(488): n is a, c, g, or t
  misc_feature (490)..(490): n is a, c, g, or t
  misc_feature (498)..(498): n is a, c, g, or t
  misc_feature (506)..(506): n is a, c, g, or t
  misc_feature (518)..(518): n is a, c, g, or t
  misc_feature (520)..(520): n is a, c, g, or t
  misc_feature (524)..(524): n is a, c, g, or t
  misc_feature (527)..(527): n is a, c, g, or t
  misc_feature (549)..(549): n is a, c, g, or t
  misc_feature (551)..(551): n is a, c, g, or t
  misc_feature (559)..(560): n is a, c, g, or t
  misc_feature (571)..(571): n is a, c, g, or t
  misc_feature (579)..(579): n is a, c, g, or t
  misc_feature (587)..(587): n is a, c, g, or t
  misc_feature (594)..(595): n is a, c, g, or t
  misc_feature (607)..(607): n is a, c, g, or t
  misc_feature (610)..(610): n is a, c, g, or t
  misc_feature (613)..(613): n is a, c, g, or t
  misc_feature (620)..(620): n is a, c, g, or t
  misc_feature (629)..(630): n is a, c, g, or t
  misc_feature (637)..(637): n is a, c, g, or t
  misc_feature (639)..(639): n is a, c, g, or t
  misc_feature (643)..(643): n is a, c, g, or t
  misc_feature (658)..(658): n is a, c, g, or t
  misc_feature (660)..(660): n is a, c, g, or t
  misc_feature (664)..(665): n is a, c, g, or t
  misc_feature (669)..(669): n is a, c, g, or t
  misc_feature (676)..(677): n is a, c, g, or t
  misc_feature (702)..(702): n is a, c, g, or t
  misc_feature (742)..(742): n is a, c, g, or t
  misc_feature (790)..(790): n is a, c, g, or t
  misc_feature (917)..(917): n is a, c, g, or t
aatagcancatttctttaaagaaaaacaaagttcaatatgcccaataataattatgtttaacacttggnacacatataaatagacaaanggctgnggagaacactggatttaaataaaggtgttatgggtataattaactataatttattttatgaataaataggaaaaaagtccctggctatanaggatagtggaggnttatttcccaatantcttccatttnccctgaccccctgccaactaagcagacatcccactattacaccaaaacccctgctctccctgcnagccattacaatacatgacaccactaggcccaatggctcanagggaagantngcctgtggctcttcaatctttatccaaacctggttctancttcaggggcctttggtcacctgnnnctttttttttnttaatttttttggganggagtattgntntgtggnccnggntgnttntgngntcntgggntcangcggttctncngcctgggnctcccagnttgttgggtttncnggcntgngccaccacacgcagccacctgngnttttttanncagcaccagcncttctggntggtttgnaccttanntgccaccacccnccngtnaggaggntctcactannttctaantntttnatttaattacttttnanttgnnaaanaaaacanncagaagatacttattagaataaggncacctaggaatgttcttaacttttccattcagcttttggntgatatatgaaaatacaaataaatacatcctttccccaggtgcaaggntaaaccagcagctccaagggcttggtctacagtgctcagaaagacacactgccttaaaagtcaggctagtgccctagctccggtggcctctgcaaatgaggccttgacagtcgtcagtgggcagacnc

SEQ ID NO: 643987 - DNA, 258 bp, Homo sapiens
  misc_feature (11)..(11): n is a, c, g, or t
  misc_feature (45)..(45): n is a, c, g, or t
  misc_feature (63)..(63): n is a, c, g, or t
  misc_feature (75)..(75): n is a, c, g, or t
  misc_feature (77)..(78): n is a, c, g, or t
  misc_feature (85)..(85): n is a, c, g, or t
  misc_feature (87)..(87): n is a, c, g, or t
  misc_feature (98)..(98): n is a, c, g, or t
  misc_feature (111)..(111): n is a, c, g, or t
  misc_feature (130)..(130): n is a, c, g, or t
  misc_feature (139)..(139): n is a, c, g, or t
  misc_feature (141)..(141): n is a, c, g, or t
  misc_feature (184)..(184): n is a, c, g, or t
  misc_feature (192)..(192): n is a, c, g, or t
  misc_feature (204)..(204): n is a, c, g, or t
  misc_feature (227)..(227): n is a, c, g, or t
  misc_feature (231)..(231): n is a, c, g, or t
  misc_feature (247)..(247): n is a, c, g, or t
cctacaagccncagagtacttcgagtctcccttcaccatttccgncggcatctacggctcaanattttttttacngnnggcttcngnggacttcacgncattattggctcnactttcctcactatctgcntcatccgcngnctaatatttcactttacatccaaacatcactttggcttcgaanccgccgcnggatactggcgntttgtagatggtggtttttgacnattnctgtatgtcgcgggcnattgatgaggg

SEQ ID NO: 643988 - DNA, 425 bp, Homo sapiens
  misc_feature (50)..(50): n is a, c, g, or t
agtatttgagtagtgggggtaaaccaaaaggcgactggttatattttacntcctaaatgtgtgctgaagtgcctcttgttcaaaaaattcttgatatttagagcttcaaagttaccacatttaaaagtaaaagacttggcacggtggcacacacctataatcttagcactttgggaggccgaagtggatggatcatatgcagtcaggaatttgagaccagcctggccaacatggtgaaacctcatctttactaaaaatacaaaaattagccgggcgttgtgacgcacacccatagtcccagctaactccggaggctaagacaagagaatcacttgaacttgggagacagaggttgcagtaatctgagatcactccgctgcactccagcctgagtgagagtgagactgtgtctcaaacaaacaaac

SEQ ID NO: 643989 - DNA, 739 bp, Homo sapiens
tatgccagcttggacatcagtgtggtgggatccgttgaccaatttgcaccagttttatccataatgatggattaacagcatgacaaaaattattttttttttggtcctggagggagattaagatgccttgaattggtcatagggggtccgggtaccttagaaggtaacgagctctaagtacctttcctacattttccttttttctataaaccagatatctccagttatattcgcaagagaccatttaaactggtggtacaatcatgtccggggggttggatggttcacagggatttcccaacaataaagggactctgagaagatttccatggacggaataattggccataatatgatgcaacactggtgctctctctatgataattacaatacaaagtgttccatttcagtgcagcatatacaataatgtaattaagtcataacacagttgaccctatttttgggacacttaactttgttcaacaaataccactgtggaacaacacagaaagccctatatattgctatcatgtgtgccacctagagaagcttctctgtcataccaaagcgtcctatcaggacaggacagggataggaattcctcaacatatttataattccccaataagtggcccctctttaagccagaattccattcaacggggtccaattgtggaatcacctttacatttaagattttttcccatattttggggcttggctaaactcagattattgc

SEQ ID NO: 643990 - DNA, 266 bp, Homo sapiens
  misc_feature (26)..(26): n is a, c, g, or t
  misc_feature (101)..(101): n is a, c, g, or t
  misc_feature (120)..(120): n is a, c, g, or t
  misc_feature (144)..(144): n is a, c, g, or t
  misc_feature (208)..(208): n is a, c, g, or t
gcctcaaggcgctgcggctcaagagnaacctaagcaagctgccacaggtggtcacagatgtgggcgtgcacctgcagaagctgtccaccaatacgacccgntctacaccaagctcatcgncctcaacagtctcaagaagatggngaacctgactgagctggagctgatccgctgtgacctggagcgcatcccccactccatcttcagnctccacaacctgcaggagattgacctcaaggacaacaacctcaagaccatcgaggaga

SEQ ID NO: 643991 - DNA, 450 bp, Homo sapiens
agagaaaacaaagatcccatttcttcctctacctcaaaaaaaaagcacaccaaacaatccaatcctattgtagtgtcacatcgaacccaggcctgaaacaatatatcatgctagtttcctgctatatgccgcagacacactttagtacatttccattattgcgcaatctatttaacagcctagaatcatcctagtgcttccatcagcagaaggcttgcaacaaaaggcgtgagcagcggcgactgcgagtgggaccatcaaagactctcccccgactctcctcttcatcatcttcatctgattcatccatatctgctgactcatcatcctcgtcttcctcctcttcctcctcctcctcttcttccatctcttcatattcatcaggccccatatccaatcgggatatcgagaccctgaaggtgggacatgccaaacagagaatccaagagg

SEQ ID NO: 643992 - DNA, 253 bp, Homo sapiens
gcatcatagaacctccaacacacacatacacacactatttgctcacacacgtataccacgcacccacattcatactgactcttgacacacgcacacacaaactcacatacaatcaccatatacgctgctgctactctgtttatcacacatcctggtgcctagtcaccttacccctatacatatctaaccataccactccagtgtccctgcacatgtcgacgcggccgcgaatttagtagtagtaggcggccgc

SEQ ID NO: 643993 - DNA, 172 bp, Homo sapiens
tgtccagaaaggaggatgtgggcaggcacggggtacagaggatagtgtgggccattcaacgcctccgcgttgaatggcccggaagcgttgaatggcccctctccacccttatcacaacacaagaacacctctgattactcctgccatcatgacccttggccattcaacgcct

SEQ ID NO: 643994 - DNA, 376 bp, Homo sapiens
tcgactgaaactgaaccaaactctagcatgagagtcggcatcccaggccagcagccaaaacaagtggtgacacttggccaggcacggtggctcatgcctgtaatccctgcactttgggagtccgaggcgggtggatcacaaggtcaggagtttgaaaccagcctggccaacatagtgaaaccccatctctactaaaaatacaaaaaattagctgggcgtggtggcgggcacctgtaatcccagctactcgggaggctgaggcaagagaattgcttgaatccaggaggtggaggttgcagtgagctgagatcgcggcattgcattccagcctgggtgacacggcaagtctctttcttaaaaagtcgacgcggccgga

SEQ ID NO: 643995 - DNA, 419 bp, Homo sapiens
ctagtatctagagatcctttttgcggtgccttccatgctgtgtgctgttggaagtatgtagactggggtatgtgccaatgaatctcgtgcgactgaagagccgggagcggggcttgctggctgtgcactcatttacccgggacagggagaggctcttctgcgtgtagtggttgtgcagagcttaatgcatcacggagaatgagaagacgttcccctgctgccacctgctcttgtccacggtgagcttgcaatacgagggaagaaaggagccgtcggagtcccaagcacggaaggccgtggccttgtagttgtcctccggctgccccatttgctctcccactccatggcgatgtccctgggatagaatgcctttgaccaaggcaaggtcaagggctgacctggtcctgtggcatctcctc

SEQ ID NO: 643996 - DNA, 1773 bp, Homo sapiens
  misc_feature (314)..(314): n is a, c, g, or t
  misc_feature (339)..(339): n is a, c, g, or t
ggttgacggctgtcttcagagtttaccatgcgcttccggagtgctgtggcgccaacatagtgagggcctagtaacgaaaaatgaatcaggcgacatatgaccatcactgagaagcttgagccgaggagtcactgccaaggtacttactacagatagctggtgagatccatggacactgggtaggagtcgtgctcgggctgactctgtgcgtactagatgtttgggctataagagaacgtctaacgcaggcttcgtgcaaatgacaggacacgacggtgtctgcatgaatgatccgtgtcgcacgtgtatgcggnctatgtgatatctgtattaccacgngggtacctcatacaactcgagccgaggaaaacaaacgtgcgcaagtgtctcatgtccatcatccatttccgtgggggagtgaccatggacgagagacgcagtatggagcaccccatccacagccatgcgcgaggaaaaatgactctccccacgctttcgatgcttggctcgagaacggaaaggaacatagacgtaggaacctgggttgaatctagcgacgtgcatcaattacgtgtcgcaggacccgatttccgtggacgccaatgaggggaacgttcggtcggatcgtaggttaaattgagaccgccttccgaccctttcctcgctccaaagacacaacgcatacttgtgggaggacacttttcagcaataaaggcggctcgtgccgaggagggtaaataggaggggagacttgggaggctattgtcacctcacagccctgggcccatatgctaggtaattaccatgcaacaataagtggtaatttcatcggagttgacgcttttccacattctacaaaacattcacaaagtttccgttggatggaatcaaacgataacatatgttgacagggaaatttaaaatccaatgccatagttccgtttccccattgggccatacacccaacccccatggggtagcgttgagaagacgctatgaacgggtagagtggccccattgggtgacggaaggttggcccgcgataaggtgggcgcaagtcgcccctcatggatgggtcctcatggggcctggcacgtgtgtagcacagcaaagacgcattgtgagcggtcattcccaagggtttcgagcacaatttgcacatttatgggccctgagaacagacattgtgggcggcttatcccaactacggtgtgcgccccatgtgatcaatacaacaagtaatgtgcaccattatggtgggtctcatccacgcacccgttgcgtgacacaagtagggagggctttcaccgagaacatgaatggtatatctgcgattaaaacatttacactgtgcttcgcagctcacacctgttatccacgttacctgagtttccgcggcacattggtgagcacacataaagacgggaaatcagaaaacttcgtcttcatatacggacctcatgatacacccctagtcgcccccaaaaagtccatactgtccaccacaacacggggggccttggcacccgggatccacaaagggacgcgccaaaccggggcagacacttgactggagaaaccccattataggaaaggggggggcaccaagaggaaacggtgaataccgcgagaacaatcgcgacaagaacagagcacccagatacagacagcagacagcaaggagcactgcaaccgagcaacgcaaagacgaagaccacacacaaaacagcggaagaaaaagaagtagcatgaggaagcaagaaacaaaggagg

SEQ ID NO: 643997 - DNA, 382 bp, Homo sapiens
ctctctgagttcgacgtgtagattagcattagggaggacgtgtacccgaggatcgtgtggctcccggagaaagttcagaaggactcactgaggcccgaggctgcgcggtacctgtgtagcggctaatcaagctggtgccggagaaatgggcttcaacctcccccagagaggactcagtgaaaacatcaaacgcgatcatgaagaagcgtgagccttctgtgccatcgacttcaatcaagaacctgaacgaggacacgaccttcctgcccttcacgcgtccagtgagctatggacgggctccccgaggcacgtttctgaactccgctggtagaagatggaggcacggcaagttgaatggtcacccctcaagtacccccgattc

SEQ ID NO: 643998 - DNA, 1715 bp, Homo sapiens
tgtaagcgaggcacggcaagacatatgcttgctgagacaaaggtgctcatcctgcaacactactggatggtacacacgcaactctccacttgcacacttgcacagcagtacctcggcatactgcaggctacacgcaacaaaccaagctactacactctggcaaggaaatggccaccgcacacagctgcggcatgacaccgcgccacacgcaccatgcctctcttcacctcacgcgcaaccaacggcaccactcacgccctacctctacacacgcacaagccaacttcctacggactaccctattctcatctacacacgcgccacacgcacgctgccaccctcgccgcgcgcctcactctctctcctctcctcccctcttgcccgcgcacacaacgcccgcgctctgcagccactgcacccactgcgcccctcgcgcacccacccgggcgcgcaaaccacccagctggctaacgcctccggcctcgctgccgcacaactccacgcctgccacaccctctgcgcgcactcaccacaccacactatctcccaccacccccacaccccagcacactcctctctcctctcacctcccagcaacacgcagacccccacccttcccaccgcgcaccacaattctcccctgcgcaaacccccaccaacgctccttctctcacaacgcacgctctccctttccctgcagagcgccacaccaatatatcctcccactactggcttacccccttgcctctcgcccccgcctcacttcctcctccggcacctcctttttccccccacgcggcacccccaccacctactctgcggcgccccaccaccttgtctcggacccacctggcacccttcctccgcgcgcgccatctacccaccgcgcgccacgcccacccttctaccgcgcttgccgccccccaccctcccccacccttcccccacccggcgtgcacctcccggccccccccacgtgcgcgctcacccacacgtcacttggcgcaacctccatcacgcggcctgccggtctcctttcgccgccacacgcgctcctggccacgcgccttgcgtccgcccacgcgccagcccccgaccccgcttctcccagcacgtcctcgccgcgcgccacactcctcgcacccttcggcttcccctctccgccgtggcacacgcgcggcctccatctcgttctctccacgctgtctcacgcgccccacatcccgtcttacactctggaccgcaccctgtgcgcccttccccgctccctccgcgtccccaccgccttggccgccttcgctcccttctcggctgccgacctgtctgccgccccgtctccctgcccccacgcccggtcccgcgcgccaccgcgctccctcgcgcctcgccaatctcctcctccacgccgctctggatctgaccaatgaccgtccacgcacactcgacctggccattcctctcctcgcccaccacctcgcggctcatctcaacgccccacgcgtcccgcctcctctctcgcctctcataccaacagggctctcctaccactcgaacggcctgcttctgcttatgcgctctacaagcgcaacagcccctccgtcgacccacccggccatcgcatcgtgccagcgccgtcaccaccccgtacttccgcgcgacgcgccgccctcgctccgccccgcggtcctgtctccgcccagtcaaagtcaaccata

SEQ ID NO: 643999 - DNA, 986 bp, Homo sapiens
  misc_feature (984)..(984): n is a, c, g, or t
  misc_feature (986)..(986): n is a, c, g, or t
ggtgagacttcctgctcatctgccgctcgctttgccgcgccgttagcccgggactggaacccaggctctcccctagccgaatcaaccggccccggctccacgaggcccgggtccgccagcccgtctcgccgccgccatggggaccctaaatacgccgatcttcccgcgatgccaggaatgcagccacatgttgatgaatagtagtcgagctagcctgaggatgatcaagcggagttcgatgcggagctggaggagctgacaagcacaagtgtggaacaatcattgtcaatcctaatgctgcctatgacaagtgcaaggacaagagagtgtggacgaaagggacttgatttctcagatcgtatggaaaaaccaagaggacaggatatgaatctggagaatatgagatgttggagagggtctcgggagatgaacgggggaacggactacgtgaaagagtatgcatccgtcgtagctgaattgagggaccatcgagggggaccaggattggcgtctggaaagtcattgaggagtgatgtgcggtaatccagcgggatgagggaagaagctgactggtgtgtggggtgggctagaggagcagggacgccctgtaactacgcagtgggtgtgctcgcagctggcaaagagtgttgggagggaacggcaggatgaatttgagtgacccgagatggaagctgtgactaggggggtacgtaaatggagttggacgcatcaagactggtccgtcggagccgcaaaacgtggaggactaagaatgctgcgttataaacatgactgagaagaagaaatgtgccaaggcgatttcggatgcaagggggaacacagcaaggtctgtgccaggtcaaccatgggtaaggagagaagcaagaatgtaaatgacggataagcagaggctaacagggatccagtcaggtgcgagtagtaagcgtacagagtctcttgtttctgtcctctattcacttgtangn

SEQ ID NO: 644000 - DNA, 335 bp, Homo sapiens
gctgctgcggtgactctacaggatctccaaagtgctgggattacaggtgtagccaccgtgcctggctgcatttcagttatttttcagtaaaactggtcaaccatccacctcactgcactaccgtggaatgactttaaaatattgcgagagccatttgggccccacaggtcacccggcttgctagaaagcagtatggggattgccttgggtcccaaagggtccacgatttattaaaagtaagaacactgggcgaaggcctaaggacggggtaccggagcctcgaaattcggtaattcataggggtcattagcttgttttccttgtggttgaaattt

SEQ ID NO: 644001 - DNA, 152 bp, Homo sapiens
gtacctgccctagaacagcacttgaaggaggtcggctgtgcccaggaccgtgtggccgagctgcatcgcctgtcagccttcagggagagcaggccaggaggcgcctggatgcacagggggtttcttggggggcacacaggggggatccctct

SEQ ID NO: 644002 - DNA, 122 bp, Homo sapiens
caagcgaatatgcgggcagctgccctgtgtgacaatgcattccaatgctctttgaagagcctgagtgaccccagtaacctgctcattcttctcggaaatcatctcctccgtgtcctgacgtg

SEQ ID NO: 644003 - DNA, 365 bp, Homo sapiens
tcggccgggttatgctgcagtgcactccagcctgagcaagaaatattacatgcaaattaaaagaacaagacctttgtgccaggtgtggtggctcacgcctgtaatcccagcacttctggagtgccgaggtgagcagatcacgaggtgaggaggtcgagaccatcctggccaacatggtgaaaccctgtctctactgaaaattcaaaaattagctgggcatggtggtgcatgcttttaatcacagctactcgggaggctgaggcaggagaattacttgaacctgggaggcggaggttacagtgagccaagatcgcaccattgcactccagcttagatgacaagagtgaaactccatctcaaaaaaa

SEQ ID NO: 644004 - DNA, 327 bp, Homo sapiens
gtctgttacccccctaactgtcactgaataaatatacaggagcaggacatgatctacagaagaaggttcagctttcaacagaatttagagaaaatttaagaaattatttcttggtctcaaagggccaagttacaaaaaaagaaaagaaaagaaaacaaaaaaaattggaaaaaaagcctttgaatacccctattgaccctaagaaaaaggcagggaaagttggccaacgtgaacccaagcacccgaagcaaaaagaccctggagaatgaccaaagccccgagggaggagtaaaagggcccaaatcccattctcagggacccggactg

SEQ ID NO: 644005 - DNA, 362 bp, Homo sapiens
ggcacgcgaggggtgtttcgtgacaccaagcgtgccgggcacgcattgcacagctcgactgtgcacgaaacaccgctacacgagagttcgggtctagaatagggagacggagatgggacagggcatggactgtggtgggacagcctcgagtggcaatttggtaacgggagacttatggaagtgccagtagccactcttcaatggtccttgaggacgaactttttgggatcggactgtgagagctacttttttagcacaagtgttacgtctaagaagagtgcggatactatctagtttctgaacccagacatcagtctgtgtacaggcgcacttatgtgagggcttgccctgatctcttcccg

SEQ ID NO: 644006 - DNA, 639 bp, Homo sapiens
  misc_feature (23)..(23): n is a, c, g, or t
  misc_feature (28)..(28): n is a, c, g, or t
  misc_feature (32)..(32): n is a, c, g, or t
  misc_feature (36)..(36): n is a, c, g, or t
  misc_feature (41)..(42): n is a, c, g, or t
  misc_feature (53)..(53): n is a, c, g, or t
  misc_feature (69)..(69): n is a, c, g, or t
  misc_feature (76)..(76): n is a, c, g, or t
  misc_feature (96)..(96): n is a, c, g, or t
  misc_feature (137)..(137): n is a, c, g, or t
  misc_feature (148)..(148): n is a, c, g, or t
  misc_feature (152)..(152): n is a, c, g, or t
  misc_feature (154)..(154): n is a, c, g, or t
  misc_feature (157)..(157): n is a, c, g, or t
  misc_feature (178)..(178): n is a, c, g, or t
  misc_feature (180)..(180): n is a, c, g, or t
  misc_feature (195)..(195): n is a, c, g, or t
  misc_feature (202)..(202): n is a, c, g, or t
  misc_feature (204)..(204): n is a, c, g, or t
  misc_feature (208)..(208): n is a, c, g, or t
  misc_feature (212)..(212): n is a, c, g, or t
  misc_feature (218)..(218): n is a, c, g, or t
  misc_feature (220)..(220): n is a, c, g, or t
  misc_feature (222)..(222): n is a, c, g, or t
  misc_feature (224)..(224): n is a, c, g, or t
  misc_feature (226)..(226): n is a, c, g, or t
  misc_feature (232)..(232): n is a, c, g, or t
  misc_feature (236)..(236): n is a, c, g, or t
  misc_feature (244)..(244): n is a, c, g, or t
  misc_feature (246)..(246): n is a, c, g, or t
  misc_feature (250)..(250): n is a, c, g, or t
  misc_feature (254)..(254): n is a, c, g, or t
  misc_feature (263)..(264): n is a, c, g, or t
  misc_feature (266)..(266): n is a, c, g, or t
  misc_feature (270)..(271): n is a, c, g, or t
  misc_feature (286)..(286): n is a, c, g, or t
  misc_feature (302)..(302): n is a, c, g, or t
  misc_feature (304)..(304): n is a, c, g, or t
  misc_feature (311)..(311): n is a, c, g, or t
  misc_feature (317)..(317): n is a, c, g, or t
  misc_feature (337)..(337): n is a, c, g, or t
  misc_feature (341)..(341): n is a, c, g, or t
  misc_feature (346)..(346): n is a, c, g, or t
  misc_feature (349)..(349): n is a, c, g, or t
  misc_feature (363)..(363): n is a, c, g, or t
  misc_feature (365)..(365): n is a, c, g, or t
  misc_feature (371)..(371): n is a, c, g, or t
  misc_feature (376)..(376): n is a, c, g, or t
  misc_feature (404)..(405): n is a, c, g, or t
  misc_feature (409)..(410): n is a, c, g, or t
  misc_feature (413)..(414): n is a, c, g, or t
  misc_feature (431)..(431): n is a, c, g, or t
  misc_feature (440)..(440): n is a, c, g, or t
  misc_feature (450)..(450): n is a, c, g, or t
  misc_feature (465)..(465): n is a, c, g, or t
  misc_feature (482)..(482): n is a, c, g, or t
  misc_feature (491)..(491): n is a, c, g, or t
  misc_feature (510)..(510): n is a, c, g, or t
  misc_feature (577)..(577): n is a, c, g, or t
  misc_feature (636)..(636): n is a, c, g, or t
tcagtttctcccttttccaattnatttnaaantttnaaaannaaaaaaaaagnaaaattttcccggcanaagtaanacttgtttaaaaaagggggngggggggggacgcgcaagtgcgcgaatttttctattttatnaaaaaaaaaanaaananaantgtacaggttttttctcccancncccgggtgtgaaacnaagtacnancccnaaanatgtanananananaaaaanacanatgcacananatcnagcnctgtaaaannanttannaaatcccaaatcgantgcagtaagttttaananccacggnccgccnaatccccctccccctcccgnagcnaaaantanttaaaaaaaaggantnaaaaanagatngggaggttttaagtggccgcagccccannaaannaannaaaaaaacctcttgtanaggaggaanaaaaatccanaggaaaaaaaaagtnttcctaggaaaaaatcnatcgattgngtggaaaaacctaagtttnaaaagggcacactgaggcacttggctgactccccacccttcccctgaagttttcactccggtttaanaagagaatttgctgaagccaaaaagatcccccaatggctacatcctagctgactggganaaa

SEQ ID NO: 644007 - DNA, 360 bp, Homo sapiens
gcgtgagtgagtgtacgcaccgctggccttgcctgcataggggcgcgtggtacgtcttcctgggctttcatgccgccaatgggattgccagtttgtaagggcgcgcccattcagtggtcagccggtaccttgcaaataatgcaggtgatcgatatcgctgcggtgttgatcatcggcccgaacgtgtagcgcaccttctgcctgcacttggtcagctccaacatgcattactacggcgatgtgcaactgggcaatgtgatgcagcagaccccagtgctgaacccttggtggctgtggccgttgcaggcgtactgcttcaacttcggcagcacccacggcatacatcactttgtggtgaaa

SEQ ID NO: 644008 - DNA, 488 bp, Homo sapiens
attgagaacaaatacatatcatggacaaggaaattcgcatttagcattataggagaagacttaactaggcgtcaacagaaaggtagaatcacagctcctgtatgtatgttcacacacataatctccttaataacatgtaaagtgcttagaatcaaatcagcaatcccccctccccaaggattgccacaatttctctaaagcagtgagttcacaaatcagacctaaacatctgtatcaaccatgtaaggtcctcatggtgcagattccccagtgaccttcccgacaacaagctaagtccggatatctgagtctaggtttgggcgtctgtaatttaattgtattgtataacctctgagagatggttctgatgagtcagccaaccatagggaaacatcaactctacagaaactgtgagcacgtaaagacctgcgtcttaggctccgtctttccctggattctcctctagcagccgattctggggatcctct

SEQ ID NO: 644009 - DNA, 279 bp, Homo sapiens
  misc_feature (83)..(83): n is a, c, g, or t
  misc_feature (87)..(87): n is a, c, g, or t
  misc_feature (89)..(89): n is a, c, g, or t
  misc_feature (92)..(92): n is a, c, g, or t
  misc_feature (96)..(96): n is a, c, g, or t
  misc_feature (101)..(101): n is a, c, g, or t
  misc_feature (105)..(105): n is a, c, g, or t
  misc_feature (113)..(113): n is a, c, g, or t
  misc_feature (126)..(126): n is a, c, g, or t
  misc_feature (128)..(128): n is a, c, g, or t
  misc_feature (246)..(246): n is a, c, g, or t
  misc_feature (257)..(257): n is a, c, g, or t
  misc_feature (263)..(263): n is a, c, g, or t
caaaggagaaaaaaacccttgtaaaaaaagcaaaaatgcccccagaaaaccctttttattccgggcattccagtaactttttngggnanggnctanccggnccanaaaggagntggtttgtatgananggttaaaaaggccaaaaataaaaggtttctttttttttccttttttgtctaagaaggtgcggtttattttttttggcctgtttgaggtatgggtgaaacaatgttgtcccccaataancaggaattttnttttgntgggttgttttaccca

SEQ ID NO: 644010 - DNA, 229 bp, Homo sapiens
tcggtcactaaacatctgttgatttccacatgcgagtcacaggaacgggggacacaacactatgtacggggcagtccctgtactgtgcttagagtctagttgcgaccacaaacaaccccggcacttaaacactacccgtgtgggtacaactgcacggacgacgacgggacacgtactacacggggaaactggggcgcacgtgacacacacgggtcacgacagccacggc

SEQ ID NO: 644011 - DNA, 101 bp, Homo sapiens
ccccccccgcccaccaccacccacccgaggcagaactgtatacatatatggcccgatgcgcttaagcgaacggaccgagcgcaggagctaggagcgaggaa

SEQ ID NO: 644012 - DNA, 320 bp, Homo sapiens
cctacggtgtgttgcgtgcggcagtgggaggtggtgaagagcagtgactactgcgagtacctccgcccccccatcgacagctacagcaccctggactttggcaagttcaacgagatctccgaagtgggctaccagcacgggcgcacggtgtttgacatctggggccgcagcggcgtcttgtagaagatcttgccgcccagcagggcccgaccaagagcccccgagtcggtctctacatttccacggtcttttagggactttccgaatttgtttgtgattcccccccacgcccctatgtgatagattttactacagagtta

SEQ ID NO: 644013 - DNA, 386 bp, Homo sapiens
  misc_feature (140)..(140): n is a, c, g, or t
tcagaaatcccaaagctccccgcagtttcatcccctcctgggggggtttggtttaatttccccggcccagaattagtcattcagtttgctcaggggacagtccgcctctgcttgtccgggttccgggccttggaaattgntttgccccccggacctgtgtggatccccggcgacgtttttttggggggggatgtgaccgttttttcccccggggacattaaaaacggggccccagtggggttggggggggcttgcccttccggaaggggccttggaaggggcgagaccccgcaggggcagttccccgggggcccccccggttatgggcctgggccccggggagcaaagctagggcttctccgttaaaatcccattttttcctttta

SEQ ID NO: 644014 - DNA, 305 bp, Homo sapiens
atttcaaaacccccccccccctgtttgtgtcctgagggcctctttttttttttaaacaaccccccctgtccccaaacaggtgtgccccgggggacattttttttttcctcccttggcccagaggtgtttccccccccccaaccgcaaaaaagcctttcccttttccccgggtatttaatttgcccgccgcccacccccccccccccggggtttttccgttcccccaagaaaatttccccgtgccccttttttattttttcccggccccccccttgggatttaaacccccccccccccccttggca

SEQ ID NO: 644015 - DNA, 256 bp, Homo sapiens
  misc_feature (51)..(51): n is a, c, g, or t
gcgggtgatctagaggatccgaaaacgacatagaggcaaggtctggctctngtgcccaagctggagtggaagtggcatgatttcacctcactgcaacctccgcctcccaggttcaagtaattctcctgcctcaacctcctgagtagctgggactacaggcgtgtgtcaccagacccagctaatttttgtatttttacaaatggggtttcaccatgttggccaggctggtcttgaactcctgacctcaagtgttcct

SEQ ID NO: 644016 - DNA, 104 bp, Homo sapiens
atgcaacgagtaacagactaccacctacctccctcacctagaccctgcaaaccagtaccgcctcaccaagatcctgcaaaccagtaccgctgcaaaccaggaga

SEQ ID NO: 644017 - DNA, 250 bp, Homo sapiens
ggagcgcgggtacagctttttcgctgactacattcagcccgtctggttaacttgtccagattgaatatgcttggctgctgtagctggcaggcagcacagtccgtggcaattaaagctgcaaatggctgtgctattagcaactgagcaaaaaacagcaaattcattctgtatgatgcagcgcagctgttacacaaagctagcaaccaatttaccaagccatatagccttttgctgttacagctgccatggg

SEQ ID NO: 644018 - DNA, 282 bp, Homo sapiens
cgatctagaggatctgaagaagacgacagaagggtatagctctgagtaatgttgactaaagagggagatctgaactgtataagttactttaagtaaaattcctttaaatggactagatattaatagattcctcttaccaagtttttcttaaatttcaaaggttagtttaggctgaataccttatacattatgggaggcattagaatgtttacgtgatcggcaatatacttcgtaattatacatagtgagtatcggaaatacaatgagaaacaattgcattga

SEQ ID NO: 644019 - DNA, 113 bp, Homo sapiens
gacatatagtgagagcgtgcttttggagctcttctcaaccattctggggagctgggaccaagactgcccagaatgtgggcttccgaagtctggaaaacatccgcagcaggctc

SEQ ID NO: 644020 - DNA, 327 bp, Homo sapiens
ggatgtctgcccctcctacccctgtctgcctgctggaatgagagaaagcaacagcccagatttggctcaatcccatgaaatgcaaatgtctaacacaggctttctactatcatcttcacgtttacattatgcaccttaaagaagtgaaaactagctgggtgcagtggaatgaccatggagccccaggttacttgggaggctgagcgaggcggattatttgagcccaggagtttgcatttagccagtgcaccacagtcaagaccgtatttctaaaaaccacaacgcagtaaacactcatatattggaaggtgtcgccactctcctttg

SEQ ID NO: 644021 - DNA, 231 bp, Homo sapiens
ctctggactgtgtgtcttctgttgtcctctttttttctctgtctgctctcgctctcttggtcatgtaacctgtctgctgagaactctcaaatgtccatctagacctttctccagatcctccagactctgcatccctctgccttctcaacatcaccacttggatatctaataaatcaccatacccatagttgagctcctgggctcaagggatccccctgcctccgtctcctg

SEQ ID NO: 644022 - DNA, 301 bp, Homo sapiens
  misc_feature (136)..(136): n is a, c, g, or t
ttgtgaggctacttgaggatcccattggatagcggataggggcactacacagaaggcgcgagctggtgactcggtgctgatgttgtgagacaggaggctgagagctgtgactgctgcaggtttccagctgaccacntcctgggtgggggactgtgtctgcgatgggtacctcctcatcagcaagatccgggaggagtacccagacaggatcatgaacacgtttaggttgtggtgccttcgcccaaagtgtcagacacagtggtggaggcctacaaagccggcctcattcggttaatcaaat

SEQ ID NO: 644023 - DNA, 946 bp, Homo sapiens
  misc_feature (314)..(314): n is a, c, g, or t
tgttttctggaggaggcgggagagagagaccagcggtgacatggccccttttcgtttaagcggggcgatattatccctcacctgggttctccgtagatttccttgtgcagccagaaccattccgggtttgcgacacctggccctttccatagagggttccatttagaccgggagggcctgacaccggtatcaagcccctcgtttccacccgggctgtgaacgggcctggcacgtgttttctgtaactctggacaacttgggagagaaagctttttcgcggagttttaaactaccttggcgcgcaaaggtttttncctctccatccgggattaaacttaactggaatgttgacaaaattgcaagcagacaaatttggtaataagcagggagccccccaaatcttcccctccaatggaggaatcttttttttaaacctggggacgtttgttaaaacaattcttttttaaatggggaaggagctttctttgaaagcacccctcctctgcccgaatcctgtgctgagacctgtggagaccgcgctctctgccttgggctaaccccgaaacgtggggaatgggggcccccaagacaacatcaggaacatttgagtccagctgccaaacaatggtgtcccactcggaggcagcgccttttggtcccccaattctgtataacagcgtgtgtgtgtgttcgaagatttttatatttttgctaatccaacgcccattccccgaaagcacatccaatactctggctctgagggcagctccctcctttcaaaccgggcagcctggcctttcctgccacagacacttgcggtgcccagcattccccagaccagggacaggcccaacgggagggggttttaatttttttcaaaccaggaaaacaaccttattttttcttcaaaaccaaaaaggaacccaaaaagaacagcctttgatga

SEQ ID NO: 644024 - DNA, 93 bp, Homo sapiens
  misc_feature (11)..(11): n is a, c, g, or t
  misc_feature (30)..(30): n is a, c, g, or t
aaaacccttanaaccagtaagaggaactcngtgcaggcaacaactgccctcttgggttagggggtgttccttcacggaatccatgcctgaatc

SEQ ID NO: 644025 - DNA, 1709 bp, Homo sapiens
  misc_feature (1096)..(1096): n is a, c, g, or t
  misc_feature (1115)..(1115): n is a, c, g, or t
  misc_feature (1385)..(1385): n is a, c, g, or t
cggcgagctgtgggttgggggtacgaggtgctgtgggagcgaggtgtgggtgggcgggagggggtgtgtgggcgtgctgggtggggtgtgcggcggctgggtctctcgtcggcgggtgtgtatgtctgctcggcgtggtgggtgggaagaaggtgtgtggcggcgcgctgaggccgagtaatccggggactgggaggaggcgactggtggtggtgggcgcgccgcgcgtgatggggcgctggaggtgcgcagggtggggggcggccgctgtgtgtgtctgctgcggcgggcgtttcgcgggggaaggcgggtgtgtgctggcgcgcgcggggaggtgtagaggccccgccgaaggggggcggttggcagaagggtggggtgcggagaggaaaaccgagaggaggggagcaccaggtagggcagggtgacacacagggggagagaagaaaggggaggggccctttgtaagaaggggattgggccgccgctgcccgcgggggcacaggaagtaaagccttgcgtgagcggggggccgcagaaaaagggggggtgcggaagtggtgagaagaacccgcgcgtgtaagggaggaacgcacgggggggaaagagaagtgttagttggaacgaccaccgaaggagggtgttgaatcgtcgtcttaagaggcgccgtggtgcctccgtagatagaacggaggggagttttcttgttggggcgggcccgccagcggagaaggcttcgcacggcggagattggggggtggtgttgttttagtcaacgctgggtgcgtgggccccacgaggttgtgagccgccgcccccatagttggggggagggggcctcgttgtgtggagcaagagcttaagaagtgtgttgttggtggggttttcggacgtggggggtataataacgccacggagcccaccggcgtgtgttttattggggagactcggggtatagattcccccacaccacgcgggaggactctttatgacccacgcagaaattgggggtttatatagagatatgcccacccgtcacgcccacagatattgcgcgagaggggtataaatgtgtgtgccccgcacagatagatgngcacgccacagaatggggntattatggagacgccccccacaccacgcggcacatatatgcgacatatatgcgcctcgcggtatgactgggcacaggctggcgacacgcctatatgtagatgtggtggtatgaatcgcacacagtggcgcacacacacagggagatattttcctcgcgcacatataagagactgtttatagagagaggatatatatggtagagagatgtttgtgtgttttctcatatagatatgcgtctttttatatatatgtggtggtttttatatctngcacacacagagatatagatttatattttaagagaacacacataggggaatatcgctcagaaaaataggcctcgctcagatgccacgccacgatgtaatattataggtggccacatattttctcgctgatattaagattggagtaatattctcttaccatatccctggacaccaatatttttaggtgtttttttgtgacttaggaaatagccaggccacgtggttttccaccacaaagtgaaatagtgcaccacgtggatttgaaatacaccacataaatgaaggccaagcatggccttcccataaaaaatatttgaagactga

SEQ ID NO: 644026 - DNA, 531 bp, Homo sapiens
tgagagaccgtgtcgcaatgtgtcaaacttgtcctttcttttaatggccgatgcatataccattgtatgtatgtgtaacagtgtagtggagtaatttacccgttgatggaaacttgggttagttccacttttgggctgttgtgaataatgctgctgtgaacatggatttgcaaatatctattccagaccttgcttctggtcctcttgggtaggtatccagaagtgaaattgctggatctcatggtattttgctgctttccacagcagctacaccatttggtagcccaccagtaacttgcagagtcccagttccttcgtgtccttaccaaggttgttatttcctgttttggtttgggctttgctaattttattgagacagagtctcattcctgtcacccaggctggggtgcagtggtgcgctctcggctcactgcaacctccgcctcccggattcaatccattcccctgcctcagtctcccaagtagctgggactacaggcttgttccagcatgcccgactcttatctttat

SEQ ID NO: 644027 - DNA, 448 bp, Homo sapiens
  misc_feature (57)..(57): n is a, c, g, or t
  misc_feature (60)..(60): n is a, c, g, or t
  misc_feature (322)..(322): n is a, c, g, or t
  misc_feature (408)..(408): n is a, c, g, or t
  misc_feature (422)..(422): n is a, c, g, or t
agataaacccctctaaaacaggtctccctctggtgcccaggttggagtgcagtggcngantagtagctctctataaccttgaactcttgggctcaagcgatcctcccacttcagtctcctgagtagctgggaatacaggcacatgccatcacatctgctaatttatttttgccatggggtctcactttgttgcctaggacggtcttgaactcctgggcctcaaacaatcctcttgtcttggcctcccaatgtattgggatcataggcatgagctactgaggccgtcccaagctatttaaaatactttcagaattactttatnaccaaaggcaaggcaatcttaggagattcttacaagtctacaaatttaaaagatcttggaagagtttccacagttttccagccttngagttcttgttctnagttccagattgtggggttcatgacc

SEQ ID NO: 644028 - DNA, 124 bp, Homo sapiens
aggagcagcttcctgagaggctgggactacaggtgcatgccacgatgtccagctatttttacaacatggtgattggtggtagagacaaggtcttactatgttgcccagactggtcttgaacttc

SEQ ID NO: 644029 - DNA, 251 bp, Homo sapiens
agtctgtgacattttaccaatgtaaacgatagcttatcttcacaggcatgggacagaaagtcatccctccgctcacctgagacaaatacttatctgattgttttctgatatgattgggctctgtgtccccacccaaatctcatcttgaattataatccccacgtgatgaaggaggggcctggagggagatgactggagcatggggcagatttctcccttgctgttctcatgatagtgagtgagttctcacg

SEQ ID NO: 644030 - DNA, 141 bp, Homo sapiens
ttcatgattccatcagtcgaggatggacctgtcatcttcatccttaccaagctgcccgtggtgagtgtgggcagagccaggatgggaaccactactctagacacgcagtgtcaaggcctggcctcctcaggaaggccctgg

SEQ ID NO: 644031 - DNA, 927 bp, Homo sapiens
agcggggggcagtgcccgccactcccactgagattgagagacgcggcgaaggaggccagcctgtgtgaggaactgtgaaaggataagagaactctccagatgtgcttccagtaatgtcgacacgttttggtatccccaggtgtctaccaagggaaactaaccaactggcttgccccgcgactagcgttccgaatgacctggaaggcgatcttactggaaggcagctgtgcttgaaagatatacataaccatctgctatcgaagcttaaacacgtgcacaggagtggctcttctacccttgtcgcatcacatcccatgctcttgacgacacagagaagtattactcagaaatatccaatgggcgatcactagaaaccgttgagtcgtccaacgccatcctagtggacgccgacatggttgggaaggcaaatcttcggttcattgacgattgtcttatctcgccacaggaaaaagatcccagcgtcggatgtatcgtaggaggagtgtttcgtgactaagatcgggacgcatctctgcggaaccgtgtgcaatttttccataatattgtagattccaggggaatagcgagtcgggaccataggactagactagtttggtcgacttgagggcaacctccgtgacccggtagaagacagacaaagctttaacaagattcgctcatgtctacggcttcttttgccgagacttgtgcgacatcaataccttattagaactcgagatcctctgttgaaagagtatacatcggaaaacctgcgcatttcagacccagggggataccatttccgaacgaagtttccagggtcactcgcgcatacaaaagctcgagccaagaacttccggaagggtttcgcgagacttccaagtttaattccccgtaaggtcgtgtcttgcaagggaagaaaacccc

SEQ ID NO: 644032 - DNA, 913 bp, Homo sapiens
  misc_feature (544)..(544): n is a, c, g, or t
  misc_feature (559)..(559): n is a, c, g, or t
  misc_feature (913)..(913): n is a, c, g, or t
ggtagttcggcggtcacgcggctgtgtcttattgcttcatgagtgtttgggtggaaaagatcagtggactctctttcagccttggagcgacctccgatgtatcctcatccgatatgtgtccatcgcgggaacctatcttcatcgggcagtctattgcttctgagacctgcatcagcgatttggtggttagcatccttcattgatgagcgaaccatgagctcactagattcttcagaattattccaccgtggtgctaggcgtccggtccatgagaccggggtcattattggtacctgtcatggtcctgcctacatcgtaccatcatacttcatggagttgtctacttataagtagactggtgactcgatgtgtgctcatggcaacggcgttgagccctcgttggcttgcgacagatgctcggccggaaggaagagatgctggcgaccgggctcaaagagacgctcgtcgctgcacagagtgacgaaaagaggtcaagagtatgcgcggtgtgctgtcgtcttctctcttgtcacaggggaaccanttcatacgatggggnccaaggctgacacgatgtgacccctgtgggagtacacatacacctcaagaagctgctcacctgtatatacagctttgaccatgtggacgccatggaaagacaaaacagccttgaaaccaaaggaccactatatatgagatcgttcagtgcccctgtggtttcttgccacgacaacggtacccccaacaatctcttgtgaactgtcctggagaactcacattccctagatgaaggacagtgacagcttattcacacgcaagatgaggtgaaccaaccatgaaacaaggcttccaagcagtgctgggtgggccaggaagagccttggcggctggggcagacgatatcgtccttcgn

SEQ ID NO: 644033 - DNA, 146 bp, Homo sapiens
tactggtttgcaggatactggttgcagcggtttgcagcggggtttgcagcggaatcgggggtatgctgttcgaattcataagaacaggtgaggttagaagcaggttcttggtgaggagggtcttggtgaggggggtcttggtgagg

SEQ ID NO: 644034 - DNA, 365 bp, Homo sapiens
ggtggagacgggggtctcatcggtggcccaggctgtagtggcaggggcgcgatctcggctcacggcaagctccgccccccggattcaagtgattcttctggcctcagtctcctgagtagctaggactacaggcacgtgccactacaccgggctaattttggtatctttagatacaaaatttagagacgggatttcaccatatgggccaggcgggtctcgaagtaccgacctcgggttctgcccgcctgggcctcccaattggctgggattacaggcatgagctacggcaccgggcgggttgtcttaatacacctcaaactgggtatatctgagatagagctccggagacccggtctccacagggt

SEQ ID NO: 644035 - DNA, 298 bp, Homo sapiens
tctaagattccccgtgtgtcatcctagtcagctatcacttggctcgctcactacacttacttgtcatggaagaatcagttcacctcatcccgccctgttccatcatgtctatggatcgcaagtcgatcagaactaacacgttcgcacggcgattctctcaaatcgacccgattgcctgcgcgtctgacacttgttcctattatttacatatcgtctctgtgcttgtaaaacccctgtgcggtacaggactaggaagcagataaggaaaatgattatgatggcgtgatcatgaaaggtg

SEQ ID NO: 644036 - DNA, 284 bp, Homo sapiens
cctcccggagccttaccctgtgaggcagaggttgagtgagctgagatcatgccactacactccagcctggcagcctgggcgacaagagcaaaactctgactcaaaaaaaaaaaaaaaccttctttaaacgaagttttgcccctttttttataacttggccccaaatttttttttccataaagggttttaaatgacccttggctctgatttaaaacccctttccggggggggggggcccatctctcttaaagggccaccaaaatgttgctctcgcttagaattac

SEQ ID NO: 644037 - DNA, 455 bp, Homo sapiens
gtatcagttttccagttaatgctacattgaatatcttagtacaacatatctcatgcatagtgctaatatttctgcaaggcagagtagccagaagtgaaatttctagatcagaactatgtgtattttaaatttgaatacgcactactaaactattctcctcctgaaaaggatgtccgcatatggattaccgtgtaccttctccaacactgggaatggatcagtcttttaattttaccagcgtggtagtgtcaatgttagtttagtcaacaataggtctgatttaattcaaaaaatctttttgaaatacaaatgctggctctacaccctatctctgcggccatgtgcattccacctgcgagaagctatgtgtcctcatgtttcgtgtctggtgctcagtagcactgcagaaccagcttgttctcttcctgtgtccttcacctactgtgggtcctgtg

SEQ ID NO: 644038 - DNA, 453 bp, Homo sapiens
ctccctcagccactttctccttagtgtgaataaaaaccaatgtgccatctctcccagggaattttgcacattaagccttttgctaattattcatcacagaatgagcatctccccgcacctcaccatcaagaaagttcaggttcaggtaatcaatgggtggggcatctttaacctttgcacttataattgccccacctgtctacttcctgagtgaattatgccaatggattatcactccatttggcatgtcatctgccaacttgccccacttaatttctagtaacacagaaatttttaggaagactagttaaggtctatattttttggaaatgttactactatatatgcttcttagaaatattagagtaattctgagcaatcttttagcttcaaggagattacggtatcttccacactatgttcagagctgtttgtcttacaagagttagtaaa

SEQ ID NO: 644039 - DNA, 102 bp, Homo sapiens
tctagagttatccccgtctctccactcgtccccgtgcgctgaggctacgtgggggaacaagatcggctatgccccacacttgtcccttgacagaggtgcact

SEQ ID NO: 644040 - DNA, 604 bp, Homo sapiens
  misc_feature (12)..(12): n is a, c, g, or t
  misc_feature (167)..(168): n is a, c, g, or t
  misc_feature (177)..(177): n is a, c, g, or t
  misc_feature (188)..(188): n is a, c, g, or t
  misc_feature (194)..(194): n is a, c, g, or t
  misc_feature (196)..(196): n is a, c, g, or t
  misc_feature (201)..(201): n is a, c, g, or t
  misc_feature (206)..(206): n is a, c, g, or t
  misc_feature (210)..(210): n is a, c, g, or t
  misc_feature (220)..(220): n is a, c, g, or t
  misc_feature (228)..(228): n is a, c, g, or t
  misc_feature (235)..(235): n is a, c, g, or t
  misc_feature (237)..(237): n is a, c, g, or t
  misc_feature (258)..(258): n is a, c, g, or t
  misc_feature (263)..(263): n is a, c, g, or t
  misc_feature (265)..(265): n is a, c, g, or t
  misc_feature (288)..(288): n is a, c, g, or t
  misc_feature (294)..(294): n is a, c, g, or t
  misc_feature (296)..(297): n is a, c, g, or t
  misc_feature (300)..(300): n is a, c, g, or t
  misc_feature (305)..(306): n is a, c, g, or t
  misc_feature (309)..(309): n is a, c, g, or t
  misc_feature (323)..(324): n is a, c, g, or t
  misc_feature (330)..(330): n is a, c, g, or t
  misc_feature (345)..(345): n is a, c, g, or t
  misc_feature (364)..(364): n is a, c, g, or t
  misc_feature (384)..(384): n is a, c, g, or t
  misc_feature (388)..(388): n is a, c, g, or t
  misc_feature (390)..(390): n is a, c, g, or t
  misc_feature (398)..(398): n is a, c, g, or t
  misc_feature (418)..(419): n is a, c, g, or t
  misc_feature (431)..(431): n is a, c, g, or t
  misc_feature (456)..(456): n is a, c, g, or t
  misc_feature (461)..(461): n is a, c, g, or t
  misc_feature (463)..(463): n is a, c, g, or t
  misc_feature (465)..(465): n is a, c, g, or t
  misc_feature (473)..(474): n is a, c, g, or t
  misc_feature (485)..(485): n is a, c, g, or t
  misc_feature (490)..(490): n is a, c, g, or t
  misc_feature (496)..(496): n is a, c, g, or t
  misc_feature (603)..(603): n is a, c, g, or t
tatatgcctcgngttacacagctgttgagtacataaagcaaagattcataaaaatttattagcaaaaacaattgtactaacaaagtttcacataaccttattggtttttaatgaatataattggccaaaattagataacacatgaatctgaacaatataattgaccnnactgagttnactacccggcncatcangntttcngttcncccnccagagacgntatcttcntcttaantnttcgtgacaccccccccaacnctggncntgctctaggccacactaaaagcnttttananngtnttggnngcngatgtgttatgggnnacattntgtgttcttggtggngtaaaacaagaaaacaaanctatttttaaacatagggtnggtngnttcgctgngtttcgaagcgctcttttgnnggggtgggatgntgtattgtggagcggggtggggtgnggtgngntnagacaagnntaaacaaaganggaanaatcanatgttgaggatgtggccaacgctatatccagaagtacatttgcgttaataagtatgctattatagaaaatataaagagaatataaatcaagtattcagtataaaaant

SEQ ID NO: 644041 - DNA, 315 bp, Homo sapiens
  misc_feature (66)..(66): n is a, c, g, or t
  misc_feature (94)..(94): n is a, c, g, or t
  misc_feature (105)..(105): n is a, c, g, or t
  misc_feature (124)..(124): n is a, c, g, or t
  misc_feature (209)..(209): n is a, c, g, or t
  misc_feature (233)..(233): n is a, c, g, or t
  misc_feature (311)..(311): n is a, c, g, or t
gtgttggcccgagttgattttctaaggcctctctccttggcttgcagaaggccattttctccctgnatcttcacacagtctttcctctctaggngtcatctgggnctaatctcctcttaatatnagggatctagtcaaatcagattgggcccatcctaatgggcttcattttaaggtaattatttctttaaaggtgctatgtccaaatngtcacattcttcagagagtagganttagaagtcacccatgaatttgggaaggaccaagattaagcccataccagaaatcatggtatactttattttcaatancaga

SEQ ID NO: 644042 - DNA, 124 bp, Homo sapiens
tcgtctctagaggtatccccgctcacgcccactacgcactcccagactgaggcatcgcgccttgctgatccccacagctcacaggtaagaggctgctccttcctctcctagcactggaatcagc

SEQ ID NO: 644043 - DNA, 434 bp, Homo sapiens
cctggctgctcatgtctggctgtgattgcaatatattagctggtattacaggtatgtgccaccacgcccggctgatttttgtatttttagtagagacggggtttcatcgtgttggccgggatggtcttgcaactcttgacctcaggcaatccgcctgccttggcctcccaaagtgctcagattacaggcaccatgcctggcctaaaagattagttttttcaagaaatggtacaagaagagttagacatcctttcctttttttcagttatttgagacagagctctggctctgtggcctgggctgtagtatattgccgtgatcatggctcgctgcggccttaacttcttgggctcaggtaatcctccctgcctcagcctccaaagtacttgggatggctggcttttgccatcttgccctggtaataggcttccatt

SEQ ID NO: 644044 - DNA, 1025 bp, Homo sapiens
  misc_feature (159)..(159): n is a, c, g, or t
agcggactccggagtgttggacgcgcctatgggactcacgtgatgaacctgctgccacgtgtcgtcaggcaagtgcgtgagggctgaagagcgagcgcagggtatcctcccgccggctgcgcggccctcgcggtcatggagctccagcccggtgactcnagtgtccccccgcggttcctaccgctcgtgcggctcgtgccagccaccgctgggcgcgctcacaggcatgagctgcgtcattggggcacagatgttgccgtccggcaaagcgggcccgagtggacgctgcagcgcgcccaggggatggacgcgggcgtccccaggaggcataccctgcttgaccgcctcgcgggggccgatcttcgcccgggaaacaccagccacgcgacaggctctcggctcggcaggttcaccccttaaaatgtgcagggcgtagggatcgcttgtgggccgtctatcgaggccgcgggtaagccgaccttggggcagcaaccgctattcgaggagaataaaacctttgtagagggtccctttccagacgttgaccggaagggggcggccccggctcaaaggggttccaatgcccatgagaacaaaccgcgtgtcggaaggggtaccgcccaggggtccttcgggctgccattcaagcgacccggggggggacgttggcgccatcgttgccggagcgctagaggtcgcggcctttcttgctgagttcgataggggcctccccttgcacgattctttgacaccttggtgacgcttcggccatttttgccattgccttcgcctcggttgcctttggttggacgaattggaaaaggaaaaagcaaagggtttaacgcaagaccggacattataccccatcaggttcccaccaagagggcccccttcctgccaggccttttccaacatggcatttgcccttccgcgaacgtgggtgcaaggcggagcaaataaggacaactatctgttccaacccgtaaattcgggggctccccgagatatcaaccagacgaaccccg

SEQ ID NO: 644045 - DNA, 198 bp, Homo sapiens
caatgcttatctggttatttaacttttcttttctctgcttgtcatgatgagagttacattttatttttacatttgctaagctgctcctgagtctgcttcttgaaatccttctatggggaaagctgtggggcagattccttaatgccgaccctttgggtacaactctttatcagggatggagctgaactgcttcatttc

SEQ ID NO: 644046 - DNA, 220 bp, Homo sapiens
accccctagtttagaagtttcaatagcatgacactgtcaatgtcggtgatgtggcaataatcatgtcaccctgtgagtcgtcgtatgttaatttagacatattttcctaatacctgctgtctaattgagttgcatcttcctgcgcatattggcaggaagccatctatggacagcatcgggatcatgaatgctttctatccagtatggtgtctacaggatg

SEQ ID NO: 644047 - DNA, 227 bp, Homo sapiens
cccccatggggattccaaagggcgggggtgtttaaccattttccctgcctttccaggatttccctttccctttatttcctcctccaggattggagtccacttcctccccaaagaaagtgctgttgctgccagtggggaaagcgagttgggatttccagggcactgacgtttcctccaacccttgtggcatgggggttcatccaggcagcttgagggagttaggcgca

SEQ ID NO: 644048 - DNA, 210 bp, Homo sapiens
tttttcttttttaaaaaaatgagaattgaagccttaccccggcagataagttttttcatgaacccgggggggaaatttttggaattaattgagccaaagggattaggcctttttcatctattttagttagccctttggttcgttaaaaccagtttccaaaacagggaaaactgggagctataaaccttttgggcccttaaagctctccca

SEQ ID NO: 644049 - DNA, 188 bp, Homo sapiens
tgtgtgcggtaagagggtgttcaggtgataggggcttccctatctgagacgggatagtgtcttcactgcccgtttctggggttctgggggcacgcagagcctcatgcatcacggagcatgaggctctgcccaaacactacacacaggattctgggggcacacaggtgtacccgaagtctcgaaattcg

SEQ ID NO: 644050 - DNA, 402 bp, Homo sapiens
tgcatagctgactcctgagggtaaaacgccggccagggagtcggagcaatgatcaaacctttttcctgagttaaaaataccgtcaaggaagtcctagcagtctactcacccgggggccggggcatgacaagaagatggagtccttgtcgcagctggagccttgcctagctggggatcacacagcctggcctgtacctgcaccccattggatgggggtacatgggggcagaaacaggaccacacccagttaaggccagaccaggctgagtgtgacccctgaggtaaacactccactaagctgtgtcttgttcatgccccctgctcagcgaaaggtgagtcccgagaccagttgggtacctttttatgcgaaccagagacatttctggatccaggccaggtgaa

SEQ ID NO: 644051 - DNA, 294 bp, Homo sapiens
ttaaaaggactaatttaattttcctcttcggggagagtatccaaaatgaaattagaaaacaagtatttttccttttggggggttttctgttccagaggttcgcaaaaggggttttacctattttttttttcaagcccccagcccaatttttttttttattttgggttcatggcttccaagttgtattttttgtttcagtcaaagggtaatattttaccagttattttcaaagcaagagaaaatatttggaactaaacatgaaaacataaatgttttgagcaaggctccttttca

SEQ ID NO: 644052 - DNA, 234 bp, Homo sapiens
ggcgtcctcaaggataagatgtgccgtcacttattccagctactcagcatagagcgagtaaagctttatgctgcttccctgcgagtatgcgtcctacggtaagagaggatgagagagcacctcacgttccaaagggagatgtacatcaaaaagctcatggatatcatcagtgtggagaaccccaagatgccttatgagatgaaggagatggcactggaggccattgtgcagctc

SEQ ID NO: 644053 - DNA, 216 bp, Homo sapiens
ttggggctccattcaggcaacaagagcaaaactccatctcaaaaaaaaaaaaacgaaaagaacctttattgggaaaattggggctccctatttctggaataaccccattggtagacaaacacggggataattgaccagcacccttcatatctcattaagggaaaaaaaggcggggtttatctccctcataaatacacataaacccctcaattacat

SEQ ID NO: 644054 - DNA, 576 bp, Homo sapiens
ggggtggggcggatgggctctggcaggaggccccacgtgcattcccgcgaggggctcgggggccgcagtggaaaagaatgggtagaaggagctgggacctggaatcccagcacctgaggacatcctgcggaccaggggcactgtgacaccatgctgagatgagtgcccaggatggtggatggctgatggaactggcacatgctgcagtgctgctacaatctggagctcctgaggcagctgtagggtaggggcaggatgctgtgcgtgcggtcagtggccagggcagcctcggagtcaaagcctggaatccagcagcagctacaactcagagactccatcgaccccagatgacgtcctcaacttccttgagcacctcctgcccacggggccggtcctccgtgtggggcccacagatgcctgtcgagggggacctccgtgatgtggccagatcgggggtggcctctctacccactgccagattgccagaaccaggagtcctgggccgaccgaggacccagtcaggaccctcgctgggcacctcaagcctgaaggaaccagagccctcaaggaggttgg

SEQ ID NO: 644055 - DNA, 167 bp, Homo sapiens
cctagagcgcaacgtggctagacgaaaaataactggcatctgctatttgaacaaggaaagtcaagcaagcagaaacactgtacactgagatctcactcgtgcacatgaaagggagtttggttctgtagattgatgaaaataaacccatctgatgcatgctgaagaaa

SEQ ID NO: 644056 - DNA, 108 bp, Homo sapiens
ttggacatccggaaggacctttacgccaacacggtattttcgggcgggtcaccaccatatacccagggaattgccacacagattgcagaggtgagatcaccgccttgg

SEQ ID NO: 644057 - DNA, 198 bp, Homo sapiens
ctcgatcagtgtgcatcagtgaaataacagaaaattcattcattcatggccttagcacagctttattattaagctatgagcatcctgtttgaggctagtttatactagcggtctatgtgcacatttgtgccgcaaataaaagaagtttactcacttccctctgtccccatgttctaactagaaggtgagcgttttttt

SEQ ID NO: 644058 - DNA, 845 bp, Homo sapiens
  misc_feature (1)..(1): n is a, c, g, or t
  misc_feature (260)..(260): n is a, c, g, or t
  misc_feature (275)..(275): n is a, c, g, or t
  misc_feature (324)..(324): n is a, c, g, or t
  misc_feature (341)..(341): n is a, c, g, or t
  misc_feature (355)..(355): n is a, c, g, or t
  misc_feature (362)..(362): n is a, c, g, or t
  misc_feature (377)..(377): n is a, c, g, or t
  misc_feature (380)..(381): n is a, c, g, or t
  misc_feature (383)..(383): n is a, c, g, or t
  misc_feature (388)..(388): n is a, c, g, or t
  misc_feature (391)..(392): n is a, c, g, or t
  misc_feature (399)..(399): n is a, c, g, or t
  misc_feature (401)..(402): n is a, c, g, or t
  misc_feature (409)..(409): n is a, c, g, or t
  misc_feature (416)..(416): n is a, c, g, or t
  misc_feature (424)..(424): n is a, c, g, or t
  misc_feature (429)..(429): n is a, c, g, or t
  misc_feature (433)..(433): n is a, c, g, or t
  misc_feature (436)..(436): n is a, c, g, or t
  misc_feature (491)..(492): n is a, c, g, or t
  misc_feature (519)..(519): n is a, c, g, or t
  misc_feature (542)..(542): n is a, c, g, or t
  misc_feature (551)..(551): n is a, c, g, or t
  misc_feature (575)..(575): n is a, c, g, or t
  misc_feature (578)..(578): n is a, c, g, or t
  misc_feature (584)..(584): n is a, c, g, or t
  misc_feature (592)..(592): n is a, c, g, or t
  misc_feature (604)..(604): n is a, c, g, or t
  misc_feature (628)..(628): n is a, c, g, or t
  misc_feature (655)..(655): n is a, c, g, or t
  misc_feature (663)..(664): n is a, c, g, or t
  misc_feature (670)..(670): n is a, c, g, or t
  misc_feature (676)..(676): n is a, c, g, or t
  misc_feature (679)..(679): n is a, c, g, or t
  misc_feature (690)..(690): n is a, c, g, or t
  misc_feature (733)..(733): n is a, c, g, or t
  misc_feature (757)..(757): n is a, c, g, or t
  misc_feature (762)..(762): n is a, c, g, or t
  misc_feature (773)..(773): n is a, c, g, or t
  misc_feature (782)..(783): n is a, c, g, or t
  misc_feature (833)..(833): n is a, c, g, or t
ngcataatccttgctcactctggacacacacacctaaaacagttaaaagtgattcctcaatttgcaataacaaagtaggaaaaaaagaatacgttctcaagctgtagttcaatttttctgtcctcttttccaaaaaatgttactttgctaccaagcctcccaccaatgataaggaaagacaatttttcaaaaagccaacaaaacccagaaaaaggaacaggtatcaattcaaaattatcacccagaacactgctgttgcnaagaaagagtatgangccaaattcccatagcttgttagagaagatctttaaaaataattcaganagttaggcctggccctnctgtcgtatagccnggttatnctgtcactatatgcntanncngtggnaanngcagatntnnttcaggngcattcngcttgggnatatnttangcnttctcctattccagcagaggaaataaaaacatgtgttcctggaattaatattaanntcatccttacaaacagaaggtagggcnaaggtaaagagagagaatgtggnacaaaagtngcaagacaagccattttgaatctnggntctaanacccaggnaagctgaatagnacttaaattcttctgagccagtancactaaattctagatttggcctgaaancagtggannaaaaanaccacnaanaaatatcaagngccccacagtgtttgtggtattaaaacatatatttatattatnaatttccattctgaaaagcagatnaaaangacactggacnaccagtcanntatggagtaatgggcttcctccaaagagaactgacttggcagaaatttanggttggtaggaa

SEQ ID NO: 644059 - DNA, 1243 bp, Homo sapiens
  misc_feature (1)..(1): n is a, c, g, or t
  misc_feature (789)..(789): n is a, c, g, or t
ntgatcaatagtacgttgcttagttgttgttgtgcttcttttatgattttggttttttttctctgcatttttttttctcacacatctttgacagccacgtgcttatgtcttggtttttttagcgttttgatgctggtgtcgctttcaactaattattaatttttcctccgtgttgtatctccgctccagcaccaccaaccacccttttggagacacctgtggaataaacatattgggggtactctcctctagtgaactgtctcttatccccccatggggcgtcctttattttgtcgcgcgtgtttgctcccccccacaggggaattttgtccgacaagcatacagtggtgacaaccggtcgctcaaactttatcttgctgcgcgcccattggtataaaaaagggtaaccattcttgatctggagataatcctggattgttggttaggaaaacccacgactttgttatattacccggcctttgtgtcttaccaggtttgccccagagtcagtattaaaggtggctcaccaagcttctgagaaccaccggattttcactcttgaatctatcgtgcacccctttattaccccagtgtgcttaacacaggaatcacttgatgtaaacgttatcgcccttatagttcgataataactttgttgggaaatggagcaccagtaagctcgccccacttttgctttagaggacgccaggctcttgagaacttatagcaccatttaaaggaggatagccccaatatagaccaccaagaccctgcccaaagaatggaacntccaaagaggccagccgaatcgtgtatctttccaccccaaggggagaagaatgcaccacttattaatggcgtcacaagagaaagatgaagatccacatgccttttgctgtctttgggatccaagaccccgaaaagaaaattatttgagataccacagtggaggcctggagagaatgcacatttgtttggaaggttttcttgtcttcacacctggtcttcttgacacagccctcttgagctgagaatgtaatccctgcttggccacctatgcacgcacagcatcataattatgacggactggctgcaccctttcctgagaagccacgagcttccacctgatggaagagctgaaaacacccagcccacggaggtgcagagcacctgccctaaattgcttcctgagaattcccatattaataaagaagaaaattatctgcccttttttcctactata

SEQ ID NO: 644060 - DNA, 659 bp, Homo sapiens
ggaaggccgacgtgcagaagggttccagtgtgagtagctataatgaacagcgatagtatcatcctgtctagaatactagtatatcgctcaacctcgatatccaccctactatgcctagcaggaataagtatatcgcgtgtatcagttggataggctacgtcgtctataaccctcgaagcgagcgcccactccctcgttagccgaagtgattgtgccttattgccattacttgggtcgttggccgccctgcgaaggcgagcggggggcctagtccctactagtctcaaggctccgaacacatatggcctagacctacgtacataagcgtaaacctacctccaatgcataaaaactagtcggtcccaaccaataatattactacccactgacattgacttgccggggaacagcatcaatttgaatcaggcacaaccacccacagcctaattattatgcatcggtccccctactattgatattaaccaaatcaacaatctaacctatgacagcggtagcccccaaaccttttcctccgaagcccctaacaaaccccctcgtaatatctaactaccgtgagtgcctaccctcacaatcagtgggccgccaaccgccacttggtcctgtgaaccactatcggcgaaaaaaacctggctttctag

SEQ ID NO: 644061 - DNA, 697 bp, Homo sapiens
  misc_feature (48)..(51): n is a, c, g, or t
  misc_feature (54)..(54): n is a, c, g, or t
  misc_feature (58)..(58): n is a, c, g, or t
  misc_feature (64)..(64): n is a, c, g, or t
  misc_feature (70)..(70): n is a, c, g, or t
  misc_feature (84)..(84): n is a, c, g, or t
  misc_feature (127)..(127): n is a, c, g, or t
  misc_feature (129)..(129): n is a, c, g, or t
  misc_feature (131)..(131): n is a, c, g, or t
  misc_feature (134)..(136): n is a, c, g, or t
  misc_feature (149)..(149): n is a, c, g, or t
  misc_feature (158)..(158): n is a, c, g, or t
  misc_feature (178)..(178): n is a, c, g, or t
  misc_feature (272)..(272): n is a, c, g, or t
  misc_feature (282)..(288): n is a, c, g, or t
  misc_feature (452)..(452): n is a, c, g, or t
  misc_feature (480)..(480): n is a, c, g, or t
  misc_feature (490)..(490): n is a, c, g, or t
  misc_feature (511)..(511): n is a, c, g, or t
  misc_feature (514)..(514): n is a, c, g, or t
  misc_feature (535)..(535): n is a, c, g, or t
  misc_feature (537)..(539): n is a, c, g, or t
  misc_feature (545)..(545): n is a, c, g, or t
  misc_feature (549)..(549): n is a, c, g, or t
  misc_feature (560)..(560): n is a, c, g, or t
  misc_feature (566)..(567): n is a, c, g, or t
  misc_feature (572)..(572): n is a, c, g, or t
  misc_feature (575)..(575): n is a, c, g, or t
  misc_feature (578)..(578): n is a, c, g, or t
  misc_feature (583)..(583): n is a, c, g, or t
  misc_feature (585)..(585): n is a, c, g, or t
  misc_feature (587)..(587): n is a, c, g, or t
  misc_feature (596)..(596): n is a, c, g, or t
  misc_feature (608)..(608): n is a, c, g, or t
  misc_feature (625)..(625): n is a, c, g, or t
  misc_feature (632)..(633): n is a, c, g, or t
  misc_feature (640)..(640): n is a, c, g, or t
  misc_feature (650)..(650): n is a, c, g, or t
  misc_feature (658)..(658): n is a, c, g, or t
  misc_feature (670)..(670): n is a, c, g, or t
atgagagagagacatagcggtgggggagaggagagcagggagggactnnnngcnagcnattggntgtatnttttgaatatgacnaaaaataatgagcaaaactactctggataaatctcttctagananantannngaccctgatgcangaactccanaagataaaatgaggttgttncttatctattatataagcacacagcaagcaccttctgaggctgatttggagcaatataaaaaagctttaactgatgcaggatgcaaccttaatncttacaatannnnnnncagtggaaggcttttaccaagatggcctcagctccggccagctatggcagcactaccactaaaccaatgggtcttttatcacgagtcatgaatacaggatcacagtttgtgatggaaggagtgaagaacctggttttgaaacagcaaaatctacctgttactcntattttggacaatcttatggagatgaanccaaaccccnaaactgatgactatagatatnttngatcccaaaatgctgcggggnannngacagntcanttcccaaaatnaaaatnncattncangangccantngnttttgtggngggaggaggcanctacattgaatatcagnatcttgnngactacntaaggggganaaaggganacacattttatntgggtgcagggagctttttatgctacc

SEQ ID NO: 644062 - DNA, 1569 bp, Homo sapiens
atgaaagcaacaacacctttgcagacagtcgaccggcccaaggactggtacaagacgatgtttaagcaaattcacatggtgcacaagccggatgatgacacagacatgtataatactcctacacctcacatgaaatatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaatttcgggtctgagccaaggagtatttttgaatacgaggacagaaaagtggacacgagaaaatttcgatcggagccacggtctatttttgaatacgagcctgggaagtcatccatcctgcagcacgaacgacccgtctaccagtcttccatagacagaagcttggaaagacccagcagctctgcaagcatggcgggtgactttagaaaacggaggaagagtgaacctgcagtgggcccgcccaggggcttgggggatcacagttcaagcaggaccagccccggccgggcagacctcccaggatcaagttccacctttaccacgtctttcattagttcttctccttcctctccctcgagagcacaaggtggggatgatagcaaaatgtgtccgcccctttgcagttactcggggctcaatggctcgccctctagtgagttagagtgctgcggcgcttatagaaggcacttggacgtcccccaggactctcaaagggccatcactttcaagaacggctggcaaatggcccggcaaaatgcagagatctggagtagcactgaagaggcggtttcccccaaaatcaaatcacgaagctgtgacgatctcctgaatgatgactgcggcagcttcccagaccctaaaaccaagtcagaaagcatgggttctctgttatgtgacgaaggctccaaagagagcgaccccatgacgtggacttccccctacatcccggaagtgtgcgggaacagcagagaattcatgttaagcaaatggatattcgtggaatctctggatggaggaccattttggaaagtgctaaaggaatatctagagcgagtgaggaatctatgagaaagatgtaaagtgcaagacgtaaattttttggttgaggagatgatcactgatttaaatgtataacagagtagatgccccccccctcaaaaacgcataaccccccccttaccctgacatttagctttgaatatgcacaaaatagtttgtggggagaatagaaccctatgtctgaaagtatatgtgttgggatttcatcccatatatggtggtagccgccaactcagagataggtcgttctgtaagattctcacaacaaaatgtataacacaaacattcctgagtcaaaatgtacaacacaaggtcacgaaaccgcaagcagggcgccgtgataagtcc

SEQ ID NO: 644063 - DNA, 192 bp, Homo sapiens
tgaaaacagtatcatcccattcattttgtaaattaacttctattattgattttttatgccttaaaacaagtttatttatattaatgtctttgcaagccacaacttgtcgttaacgcacttttttcgctgttaataatcattttcttttgtgcaactgtcgcgtgtcatggaatgaaaagtaattaaattttt

SEQ ID NO: 644064 - DNA, 339 bp, Homo sapiens
  misc_feature (23)..(23): n is a, c, g, or t
  misc_feature (76)..(76): n is a, c, g, or t
  misc_feature (110)..(110): n is a, c, g, or t
  misc_feature (339)..(339): n is a, c, g, or t
gtatgttacgcatagcttttctnttcccagaaaccctaggactccaggcaaatcactcgtactccataagcttctncctttctgcctttctgctctctccaaaggatatnaagtactaaagccttaccaggaggttacaagcctctctgggatcaatacatatccaagtgtcttgaaagcacacctcttgggtattgtcttggtggtcgtagtggcttctgttgctggggctatctgagagaggtctgagaaggtcagactgctttgagcacagaaacccacagaagcaggatccaggagcaatgcctccggctctctgtcatctcccatgcaaatcan

SEQ ID NO: 644065 - DNA, 232 bp, Homo sapiens
tgatacaatcgagctcggtacctcgataggcaaggcaggaggattgtgaggctaggagtttgagaccagcctgggcaacatagcaagatccccatctctatatttaaaaaaaaaggacaaaatatagctatcctaagtgggtgtaaagtggtagctcattgtggttttgctttgcattacccacatggcttatgttgagcatcttttcatgtgcttattggcccttatcgag

SEQ ID NO: 644066 - DNA, 489 bp, Homo sapiens
ttcatctcacatgtgctgtgtgtaaagttgggggagctaaggtatatgcctacctatggctcttccaatgctagtttctacatttcccatgtatgtgatcccacatgggtagatactgtgcttgacaattttttgaagtaaattgaagaaataaggtgttcagatacattcaagtctggtcatgatgctttacctttccaagatgtcgccatgctccatacgtctaatgaaaccataatcgagactgagttaaaacataaacagaaggagctttcaaagcagcaagatgctatgaaaatgataataatgataaataacatggttcataaagtgtgatacttcgttaattgtagggaaaacccattcctaatgtaagtattaggtaactgtcaaaaaacagcattgccatatcagggcattagatacgctgtcattttaggttttgatactgctttacaagaaaaagtgaactaaagccagtacacaaga

SEQ ID NO: 644067 - DNA, 647 bp, Homo sapiens
  misc_feature (233)..(233): n is a, c, g, or t
  misc_feature (647)..(647): n is a, c, g, or t
tatgaaaccactgttgcgttcacagtaaaatcggggtgcctaattgctactggaatgtgcgatagctttgatataggggctcctatagttctgttatatcaagtagttatgcgcatatcatctgtctgagcttatagctaacgctctaaagtgagagctctccagtaggtgcaggtatctgaaaatgcgcagagtgggttagcctacgtgcctctcaagtctatcagcgacgnagctcatttcgggccaacgcgatcgatgcttaatgtctggaggggctttcaccaagtatcctcacaacccctaaaatctgtcgcgcactgaaacactttctggggggccaaaaaaacaaaaaaccgggaaacttcttcccttctttgagccccctatatagggttcccacaggacaccaaatattataactttataacaacaaaccaaaaacttaggatgctcgggcgacttttacttgggccgtctcaccacaacacttaatctctgtcttttgggaccatttcaaaaattctcaccaaaacaaacttatagttatggacaacaaaccggccccatatatctttaaataaaccgcccaaccaacgcaaagcaaagcaaaagtttaaccacaacatctttgggcaacccccaan

SEQ ID NO: 644068 - DNA, 706 bp, Homo sapiens
acccagtggatcctgcaccagagctgcaggtggagctacctgccagtcccacgccctgtgcccacactcctcagcccttggctggttgatgggactgggcgctgtggagcagggggcggcgctcggggaggctcaggccgcacaggagcccacggagttcggggaggctcaggcatggcgggctgcaggtcctgagccctgccctgtgggaaggcagctaaggccctgtgagaaattgagcacagcagctgctggcccgggtgctaaaagcccctcactgctccggcggtggggccagctggctgctccgagcgcagggtccgctgagcccacgcccacccggaactcgcactggcctgcaagcactgtgcgcagccccggttcccgcccatgcctctccctccacacctctccacacctccccgcaagctgagggagccggctccgccttggccagccgagaaaggggctcccacagtgcagcggcgggctgaagggctcctcaagtgccgccaaagtggaagcccaggcacgaggaggtgctgagagtgagtgaggggtgtgagggctgccagtgcgctgtcacctctcactaatttccccttagtttatttttcgtttaccatggagttcgctcttgttgcccagctggagtgccagggcgaaatcttggctcactgaactccactctaggtcaccatctctc

SEQ ID NO: 644069 - DNA, 639 bp, Homo sapiens
  misc_feature (30)..(30): n is a, c, g, or t
  misc_feature (69)..(69): n is a, c, g, or t
  misc_feature (71)..(71): n is a, c, g, or t
  misc_feature (91)..(91): n is a, c, g, or t
  misc_feature (104)..(104): n is a, c, g, or t
  misc_feature (108)..(108): n is a, c, g, or t
  misc_feature (121)..(121): n is a, c, g, or t
  misc_feature (182)..(182): n is a, c, g, or t
  misc_feature (234)..(234): n is a, c, g, or t
  misc_feature (259)..(259): n is a, c, g, or t
  misc_feature (262)..(262): n is a, c, g, or t
  misc_feature (268)..(268): n is a, c, g, or t
  misc_feature (277)..(277): n is a, c, g, or t
  misc_feature (280)..(280): n is a, c, g, or t
  misc_feature (285)..(285): n is a, c, g, or t
  misc_feature (304)..(304): n is a, c, g, or t
  misc_feature (332)..(332): n is a, c, g, or t
  misc_feature (378)..(378): n is a, c, g, or t
  misc_feature (389)..(389): n is a, c, g, or t
  misc_feature (399)..(399): n is a, c, g, or t
  misc_feature (401)..(401): n is a, c, g, or t
  misc_feature (512)..(512): n is a, c, g, or t
  misc_feature (550)..(550): n is a, c, g, or t
  misc_feature (555)..(555): n is a, c, g, or t
  misc_feature (562)..(562): n is a, c, g, or t
  misc_feature (577)..(577): n is a, c, g, or t
  misc_feature (579)..(579): n is a, c, g, or t
  misc_feature (614)..(614): n is a, c, g, or t
cgggccgcgcggcgcatttccgcctctggnaatggctcgtctgtagtgcacgccgcgggcccaactgcnancccggccccgcccccgggancccggccaaggangaantgttccccctcancttcccggcaaaaccaacccaagcctctggccctatgtggaaaaaattgaacaacccaaanaacggggcatgcgcttccgctaaaaatgcgaagggcgctccgcgggcaacancccaagcgaaaagagcaaaaaaaanaanaaaaancaacccaanaanaaaanaaataggctaaaaaagaanaaggaaaatgcgcatctccctggtcaanaaagaacctcctcaacggcctcaaccccaagaacttgtaggaaaanaatgccggganggcttctaanangctgaactctgcccggaacgctgcatccaaaattcctaaaaaaaaaaagcgtggggactaaaaactgaatagctgtgcggctctgcttccaagtgaaaatgcgggacccancaagcaagcccctccgcctgccgcctgtcctttctcancccanctttganaaacgtgcccccaanantgccgagctcaaaatctgccgagtgaaacgaaaanctggcaactgcctcggtggggatga

SEQ ID NO: 644070 - DNA, 158 bp, Homo sapiens
  misc_feature (84)..(84): n is a, c, g, or t
ccaggtagccttaatgccccaggaacacttactattctcagagtgatgttgtatcaaaaacagtctgcatttttacggttctgnggagtaaagtttgaataccgtgtattcaggttcacgttctaactacagtttcaaagagctgcatccaaatctac

SEQ ID NO: 644071 - DNA, 501 bp, Homo sapiens
gtcgaagggatccttggtcttcagtccttggcaggcagcgtggagcagaactttggtgcaacgcctcctgaagcagaagcaaagctggccaactcatcatcatggtcactttgctcagcactggcattctggctgtcacgttgcttcagcaggtgatatggtggtcggtggaagggcaggctcttgtgcttttcctgaaggccattcctggggctttctgccagggtgctgcaggtctcacgagtaatgtcaggtgctgtgggccaaacctgactgtcaggagtcgaggcctccctgggtcaaggctgcctccaggagggagggggtattatgccgatctccatccccagggcctccatcaagcccgagctgggggccgagctcgggccctggccggggccgtggggacagcaggtgcagtgccgaggcggctgaagccatactgtctggctcaaggccctctggtgcagaggagccaaaaccacgggacagggcctcaga

SEQ ID NO: 644072 - DNA, 169 bp, Homo sapiens
gcgtgagcggggaggggaggctagggagaggttaattaccagataccaatattacacgcaatatacggaggcatcaacttcttgcttctactgtttgtatagctgctatgtgcttgtatacacgcttaacagataatttatgtgtatattctttctcaaaagcttataa

SEQ ID NO: 644073 - DNA, 471 bp, Homo sapiens
gccccgtgtctcccgttgccaccgttcagcccatgtggattcagcgagggtttttagtgtttgtgcctgtgtccccgtgcgccttttcctggtgaggctgggcgcctggcatgtctgaacactcacattccccaggcatgcatgtccagccgtcgacgccacccatgtactgtggcgctggcccctcctgtaacagctgtggtcttgggctctcgtgttggtggcagatgtcccatttcccagttactttctgttgtccaaaagtttaactgtcctgccagccaaagctgctgagcattactctgatagaccatcagtccttggtaagtgtcctgtgcatctgggataagcatccgtttgttttcagctgcgctttctgtgacttgctctgcggtgagtcctccggtccacgtggggccgttgcgctggttcccagcctgtccgagacactcattgcgacacggtctctca

SEQ ID NO: 644074 - DNA, 248 bp, Homo sapiens
ctgctgtgaacgtaggaggaagagtacaggtggaaaaggagggaggctatctaaggctacgtgcagcgacagttcccaaggactctgatattgtctctcacagcttgtgaagcctgagacagcagtcttgtgaggggacagagattgaggatttattcacgcctccccttatgtgacttcaagaagccgctaggcatactctaatctggcaaaaggccccttgaatagtgactagcgatccctatata

SEQ ID NO: 644075 - DNA, 1364 bp, Homo sapiens
gatgactcacgtgtatctatgggaatacggctacgttgcatctcttatgggtcccaagcagcgccctagcctccctggctatgacccttgatgaagcagtgctggtggaaagcatatctgagggtcctggacttccccaagtgcctccacggggtaacccttctcagccagtctcaggactcttggacttgggacctagatactcacggatgctgcttcaaggaaggactgtagcatagccgtcgcttctagctgtgaccctacaccaacaatgacagccacacgcaggagccctctgcccagcacgggttgaggaggtcctccggcagctgcagatgcctggcaccaaaagggcgtgaagcgtccgcatcgctgtgatgcaacgcccagctgggccccagaccacatggcggacctgcaggctctgctgcagacgcggtgcccaggtccgcgtggtggacatgcagaagctgacccatggcgtcctgcatagccaagttctgggtggatggaccagacccacttctacctgggcagtgccaaccatggactggcgttcactgacccagtgtcaacggagctgggcgtggtcatgtacaactgcgagctgcctggctcgagacctgagcaagatctttgaggctacggttctgggccaggaggagtccatcccatcaacttggccccggttctatgacacccgctacaaccaagagacaccaatggagatctgcctcaatggaacccctgctctggcctacctggcgagtgcgcccccacccctgtgtccaagtggccgcactccagacctgaaggctctactcaacgtggtggacagttgcccggagtttcatctactgtcgctgtcatgaactacctgcccactctggagttctcccaccctcacaggttctggccggccattgacgatgggctgcggcgggccacctactatgcgtggcgtccaggtgcgcctgttcatctagctgctggggactactcggagccagtccatgcgggccgttcctgctctctctggtctgtccctgcgtgacaaccatagcccagctcgtgacatccaggtgacatagtctttgtggtccccgccggagtgacggcccaggctcggactcccatatgcccgtgtctaaccacgaacaacgtacatggtgactgaacgcgccagctacatcggagtcctccaaggtggtctggcaactatcgttcacggagacggcgggcacctcgctgctggtggcgctgaatgggagggggggcctgcgggagcccgctggaggccattttgctgagggactggggctccccctttgggcctggcctttcacctcgtgtccgctgggcag

SEQ ID NO: 644076 - DNA, 106 bp, Homo sapiens
aggctccagttaacgatatatggaggtcacgcacggtgctcacgtagtcgacggaacttgtaccagggaggcatagcaccgcattagtaaatacacgtacgaccag

SEQ ID NO: 644077 - DNA, 260 bp, Homo sapiens
tacattcctgcattggccttagctgatcaccactttcttcgaggtctgcaccttgaccgagagaggagcagcgaattccctgtcctccctcaccctgcgtcctgagccatctcccaactcctcaaagcccctggagaccatgcttcaaccagacgcaggccattctcccccatttccattctgaaaccactcactccaggcctttcttcaccttggagtcttggcccaataaaaacttttctcttctttaaatctttaaa

SEQ ID NO: 644078 - DNA, 501 bp, Homo sapiens
  misc_feature (144)..(144): n is a, c, g, or t
tctggaagcaggacctgtttccctgggaaaccacacccatgacacctgcaagactttggggaagatcgctgggcacagttctgcactaaagctggaccagaaagtgtttcctcagctgtatacttttgggatgaattaatgagntcaacagctcttgacatctgttttttagctgactctgctaggcattttcacatttgctttctcactcaatccttaccacaatcctttgaagcaggcattattatacccattttgcagactgggaaactgagtgtcacaatgcttaagtgacttccccaggtcacctggcttatacatggtaactcagcatttgaatccaaaattatatgatttcacatcccttcctttccctacagtgcttcatttggagaagtgttggttttctgttctggaatatggatttgcctgggtggcgttgcgagtggaaggtagggaaaggcctcctggatttctattaagagaaggtggctaggctca

SEQ ID NO: 644079 - DNA, 116 bp, Homo sapiens
gctgcggtcgcctctagacggactccccaaatctcattgcgtcagtaagcggagcatcagtaagcgggcagatctatgccacctcctcgcctccctactgacgcaatgagagattt

SEQ ID NO: 644080 - DNA, 402 bp, Homo sapiens
  misc_feature (12)..(13): n is a, c, g, or t
  misc_feature (25)..(25): n is a, c, g, or t
  misc_feature (148)..(148): n is a, c, g, or t
  misc_feature (186)..(186): n is a, c, g, or t
  misc_feature (209)..(209): n is a, c, g, or t
  misc_feature (264)..(264): n is a, c, g, or t
  misc_feature (277)..(277): n is a, c, g, or t
acagcccgccgnnaaacggcttctngcccacggacatcaatgactcaccctttgggactctgcctggctctgctgagcccccgctcactgcagtgcggcccgagggctccgagccaccagggttccccacctcgggccctcgccggancagggctgttcacgcaagaaccgcacccgcagccactnccgtctgggccaggcaggcagcnggggtggcgggactggtgactcagaaggctcaggtgccctacccagcctcacctncagcctcaccccnctgggcctggcgctggtgctgtggacagtgcttgggccctgcttgacccccagcggacacaagagcgtgcttcagcagccaggtgtgtgtaacatacggggtctgttttcacgccgttcaagcca

SEQ ID NO: 644081 - DNA, 477 bp, Homo sapiens
ctacctcttctccttacgtcccatcctggggccctttcagtgactcctgatggcagtggctgtactcattgtcctggcttccccttgagactggggatgaggaaaatcaaacagcaaagaccatatcctgggtgtcctgagtgtttacagcaggccatgtactagggattaacataaaaacaacaataacaaatctcatgaaaatttcacaaatggaagtgaaacaatatcacctctattatacagatgtgaaaagagagggccgatgaggtctagcaacttgccctaaatcatatacctagccagagcagatggagaggcaggattcaaacccagaattccttttttctttttttttcatcagaaaggcaagtcatccagaattagattttattttaggaaccaagtaagggttcctgggagaaaaaaacaaagccttggtgtagagaaggttggttcattttctatagcattact

SEQ ID NO: 644082 - DNA, 224 bp, Homo sapiens
tttccggggggatttaggggtaaacaattttttgaagccccaggcttccccggacttcacgtcattattggctcaactttcctccctatttgtttcatcccccaaaaaatatttccctttacatccaaacatccctttggttttaaaacccccccctgaaacgggcattttgtaaatggggtttgactatttttgtatgttcccctttattgatgagggtttta

SEQ ID NO: 644083 - DNA, 252 bp, Homo sapiens
gcttggttaaggattctattgtgcgacgaggccgtatcagagaggcatctcacccttaagtaccccatcgagcacggcatcgatcagcaacatgggacgacatggagtcaatctggcaacagaccttctacaatgcagctgcgtgatggctcccgaggagccgcccgtgatgctaaccgaggcccgcgctgaaccgatgaggccaagcgcaagacgatgagccaggtaagtgggccagctaggcacttctgg

SEQ ID NO: 644084 - DNA, 304 bp, Homo sapiens
tccccagaaaagggtgcaggaggagccatcatagctcactgcagccttgaactcttgcgctcaagagattctcttgcctcctgaatggctaggactacaagtgtgcgtcaccactcatggctaatttttaattttttttttccaagatggagtcttgctatgttgcccaggctgatctcaaactcctggcctgaagtgatcctccctcctcagcctttcaatgctttgggatttacagccatgagactcagaccctcctgcctcacagctttatctttgtatttgccccttactttatcttgcg

SEQ ID NO: 644085 - DNA, 1102 bp, Homo sapiens
ctcgtagtcagtgcggctggctgcaggcggcaggcggcggcatagcgcacagcgcgccttagcagcagcagcagcagcagcagcatcggaggtacccccgtccgtcgcatgcccccgcgctggtgcagccacccttcgcgtccctctgctcttcctccacttcgcgtcgcaccagtggctcgatcagccttgaccgagagaaccagatttgcatgaagttcaacggaatgcctttctccctactttgactaccggcatggcgactggcaccgatcaccaatccaaacggacacttgcgaacctgtcactgatgtgtcagctggggttcagaaagccgcaaccaacgacagcgtgaacgttctcgcacgcggactcattgacgtcgagactgacaaccgtcgcgatgtgctgttgacttgggttaaattagcgcaaactcgactctcggacttgtcccccgcgggaaaatttgctcgcgcgaaccggttactggaagtggggccttacgggaagataccgcgtcgcacagaggcagttaccacgggaattagggttgcaccacgcactggcaacacgcttcccgttggcagtggcattttccctggaaaggtctcgcttcctgggacccatcactggggcatctgagccaacagtggggcttttaattcactccaccggttgtcaacggtcaccgtaaaagcgtaaccggtatcaaacaggttcgacttggaacccaacggaagccttttatagcgggtatggacgctccacgcagccgttacgccgagtgaacccttgcacagctgccacgcgctgtttgcagcacctttgcgcgcagcatgtcgggaacctccccaagtgatgtgcagccctgcgcccacgggacttttacactttcggggcagtttgacgccaacggaacctggtgaaccgccgaaaggctgctccctcctgctgtatcacccttggccctgcccgcgtgaacacgtttgtccctgcatctagacctagtcgtgcattttcgcaactcggctgcaccgttgggcccctcactgaaccatcttgggacacactgcgaacacccccttgagacgcctgctcg

SEQ ID NO: 644086 - DNA, 707 bp, Homo sapiens
  misc_feature (536)..(538): n is a, c, g, or t
cgagcgcaactttcagcgtcttttctgcggcttccttctatcccgctccgaggctgcagggccctggcagagtggcgcactggaaggtggccagagccggattttgttgcactccgggcaggaagatggccgaggcggcggctgacggagatagtagtgccttgctgaagtcacggcggccggcggcgccctcctggaggctgacgggacggaggcagggaacttcccggtgagccagccgggcctagcaggagccttcggcggctgcccaaagccgtggggacggctggctgactcagccgctctctggacggagttgctgggtccccacaagcctgcccgtgcagctgaagtggcaggttagagttgtggtactcaaacttaagtccaagcaaacaggaggagcaccggcgcgggttcagtctttccaaacccagttcagccgtaatctctggagtcagacttcgccgcccaattcatggatttgtgcttttgactccgctctgatgtttttgaatgaataaagttgcctaggnnncttaagtatagttgcagagcgtcttttcggccctgaaaagagggaaagtttccattgaaaaagttctttatcacatattggcaaacccaaagtatgccaatttgcaacgtgttgacattttcattgaaatatctacaataaaggcaaagattccttgtttcagtgaaaa

SEQ ID NO: 644087 - DNA, 123 bp, Homo sapiens
aagatgtcggagagggagaggatgttagagggaggggatgtcggagagggagacggatgtcggagagggagaggatgtcggagggggagaggcatgtcggagacgggcgcggatgtcggacga

SEQ ID NO: 644088 - DNA, 291 bp, Homo sapiens
cgtgattcttttgccaatagtgaataggactacaatgcatttccgtcagagatcactgggtggaatgagattggatgagagatccttgggaagccaaacggagcggacgtctggatcatgtcccatccagtccagtgaatccacgatccgcagacctgcccctcgcgcgcaacagcttataccatggaatgaggaccaggtgatactctgagcggtggactgaactggcagacacaacctgtacagattgaaatttcaccttgtcaaggaggaagtgattgttaccccgct

SEQ ID NO: 644089 - DNA, 150 bp, Homo sapiens
cggaaggaaggaatggaatggaatggaatggaatggaatggaatcacccgactgcaggagaatggaatggaagggaatgcaaaggaatggattcaactcgaatggaatggaaagaatggtatcaacacgatgtggaatggcatggattgg

SEQ ID NO: 644090 - DNA, 151 bp, Homo sapiens
tccagctggccccaaggttgccaatgagtatggttatgtggcattccatacatccctaaaaagggtggacatggccaaatttatgaaatttatgaaattgggcatgctgtgtggcctcttccgggagggaggcctggggggccagctggag

SEQ ID NO: 644091 - DNA, 1266 bp, Homo sapiens
cccacgcgtctgggagggtgccctggcagatgtggtgggagagagatggctcatgagtgcttggacctgcctgtggagtggtgcccagcagactgtggtatgagagggatggctcacgaggcttggacctggtggagtgtgtgccctggcagacgtgtgagagggactggttcacaaaggcttggacctgccatggatgggtgcccagcagactgtggtgtgacgagggacatgctcacgaggcttggacctgctgtggagggtgcccagcagggggctgatgctctgaggggtgggtgctcatgttgcactggtgtgcccccagtgtcctctgatcctgtcctggtgccatcccccaaaccccatacccatgcagaactcccaggtcacatgcacgtatgtccatgggcatggtgggtggcgtgaagaggcctggtcagggcctttaggggctgcaggacggaatggccgctggggagcctgtgtggctgtgccgggcagccatcctgcattccacccagtgcgcagtctccactcgtgcccagaaagcgctaagcagccggaggagacagcagggggcttcctgaaggatgtgcgatggtggactccgggtcgacggaataccgcaggttcttgtcctccgggagactagaggaaggtgacaccaaggagcttcatgacctgggacttatgactgggggtcaagtagctgaattgcggctagaagggtggggttagccaccctgaggagtaatccgcggatgtgacacggtagcgaaaggaagacatgaaggaggcattaagctacaggagtagagagaatagtcaggggccacagtacttcttcacagatcaacactatataataacatcagcatcttactccacgtttcgacgcgccagcaacgatacaagaagacacgagacacagcacgaagtgaggaagaagtagacggagcatcagagcagataagagcatcccaaactaagcacaataagataagctacataaagagatagacagagggggaggcggatggcgcgaggcgagagcgccacgacccgcgcaggggcagggcgcggcgccgggggagaaccggcggcggcacagtgagtagggacaggtcggggcgagcggcagagggagggacggaggcagccgcggcaggaggagagagtcgggacgtcagagagggagagcgcgcaggcgcacgggagggaaggaaccgggggggcgcgggcagccggacgagggggggggcacgg

SEQ ID NO: 644092 - DNA, 1202 bp, Homo sapiens
agaaaaagttgatgccacagccaaagttgaggcactaggaggaaggcaactattcatttccctgcctcggagcctcccaggaaatcacggggccaactgcagattgtttcaaattcttcatctcactgcaacctctgcctcctgggttcaagtgattctcctgcctcagcctcccaagcagctgagattacaggcgctcaccactacacctggctaatttttgtatttttagtagagatggagtttcaccatgttagccaggctggtctcgaactcctgacctcaagtgatccgcccacctcggctcccaaagtgctgggatgacaggcgtgagccactcactgtactcggccaagacacaaatactttgaaagaagctgatttttggtcatggattatataaaaatttgtggctactactagacatatagttgtgctgatttaagaaagcatagtgcacagaaaactcatggtcttgaatgcaagaaatacaggaaagggtgaatttgtctttcttgaaaagatgagaggatttattgcatgattcttttaaagtattagtacctttggaattgtgatactgggtttattataatgcacatatgtgtgttcacatgaatggagttgacttagaatattgagtttctactaaattgtatgcttgtactgtatatattcatctaggaagtgtttcttgtttctgatttcagttgaaatgactttattgcattttaattaaaaatgtattggttctgtctttgcacctgtttttctttctggaggtgagaatcggaaggtatctagtatgtatatcctgtaacttaagatttttacaaatcgagaattataatattccagtatatctttaatttgggtttattactttcaaaattctataataaatcaggccattgaaaagtgctttattcagaggggacatcagtagcaacattacagaaatacaaaggattattaaggaatactatgaacaattacatgccaatgaaaacttagaggaattcgacaatcctagatgcacaagctacctaaaagtgactcaataagagacttaaacttcggacaaaaacctatattaacccgaaggagacttcatcatcacgtgaaaagccctgccttcgaactcagaaacgctccacaaaccagaaacattcaccgggaattctgccaactgctaagagcat

SEQ ID NO: 644093 - DNA, 206 bp, Homo sapiens
taagagctgctggagctggtaaggctcaccaatgttctgcccagaaagctcataaccgctaaatgaatattatccctaatacctgccaccccactcttattcagtgttggaagaacggtctcagaactgtttgtttcatttggccatttaacgttttgtactaaaatactggtttattgactaccatgcatcgtataactttcagt

SEQ ID NO: 644094 - DNA, 587 bp, Homo sapiens
ccgtctggtctatggccgctgttgctaggagcgcctcgtctgctttttcggcggtggataacacttgtcttcgcgcgggacacacacagtgcgcggcgccccttggtccttataggagccccctgcccgccttctcctgtgtgtagtacatcgcgcgtgggcgagaaaacgcgcgtatcgagaactagtttgttctgcacacaacgagccttgttcgggcttcccccccaggatgtaggtgtgcagtaacatgcgctccgcctcacgctctcccccgtcgcgcgctcgggtgcgacaggctgccagtttcttttatctcgcttctaggtcgcgctgagcgcgggcggcgttttgtcgccctcgcgcccctctctcgcgcgcgtttgcgcactcacgctagccccggtgcgcctccctctctctcgcgcggtatcgcgtgtctcacactcggtgccgggtagtgggagtggagcgcgcgcgttattatggactgcactatcttagatggcgccctcctgtacagcgctatcaaacaaacacgtgtctatgtatctctcttcttatcagacacaacaatagacagagaa

SEQ ID NO: 644095 - DNA, 1010 bp, Homo sapiens
tcttatccagtgtccagcgcccgtgagtgccaactgcctagaattgcctccttgcgagctccagggccaacagcttaatcaagctgtaccttttccccttcagcacctgtcccacgtgatctctgcacacagggtgcttctaaaccagtgtttattgaaccaaaggaggaaaactcgatttcactgtcaccttggttcattatccacttccaaatttcttatgctgaaacatggcactaacgccatttgcggtgtacccttcaccctctaaaattaaaatgcctcaagttctaccctttcgacatggtatccacccttcttcttgatgcttctccgttgcgctgacgaaaccctcttattctatttgtcactacctgtgtcatatctcgtcatatcaacttctcccctaaaacgtgttgtcctttcacagtctctcgattctatctcaacaaactacacagccatcttcctgtttcacgacgatctctaagacccatggcgcttattctgtgctacgcttaattaaccttctcctcgcttcaacattagttaataactcttatatatctgcgtcacaaggctgtggtgaggacagaatgacttctgtcaccaatctaggagccacttcagggcttcattccctggtaggacatgcctgcttgcctttcttggggacaactagccctcattgtcccttcatgtggtaccagtcggggcacaattatattgtaattaagctaaacatcttatgggaaacaacccgctccacgaaacacggagcgccccaagtaaagcacacaccctgcaaagattatgaactatgaattgtctctagtagagataaatttctgcaaacatatctcagtcttccctctgtttctctggtgattaagaagttccttttggtaaggaaaaggatttttaaccatagagttaggcatcctggaaattcaaaccagatttcttaatacctggtcttcctcaaagagaaataataacagtaatagtat

SEQ ID NO: 644096 - DNA, 106 bp, Homo sapiens
ctggtcttcacgccagcagaagcctggactttctggtaatagtgaaccgaggacatcgtctcctggtgtcagccagtttgagttgagttctgtaactgcaagtcta

SEQ ID NO: 644097 - DNA, 326 bp, Homo sapiens
ttgcggtgagctgagatcgtgccattgcactccagcctgggcaacaagaacaaaactccatttcgaaaaaaaaaaaaaaaaaggaaaagttcaaaagttagtgcttattaccaaagcttcaggcagtcatgtaatcagtgtaaggaagattttttttaaacaacttattttacctatgggtacagatttagtattctacaatctgaacctatttaccatctttaatagcaacagatatttgaagctctcatgaattataatctcttatcaatgatccagtggtaggtaagtaataattgaaatgctacccagtttccacttttttc

SEQ ID NO: 644098 - DNA, 128 bp, Homo sapiens
tcaacggcgtgctgaactggaagtaggaagagcgtgaagtcttacaggactacactggatagactttattctgactccgtcaatgtacttatgaactaccgtgcctcattccagacactacgagaagt

SEQ ID NO: 644099 - DNA, 270 bp, Homo sapiens
ctcagtatgttgtcagtttttctcaatattgatatatagattctgtgagagcccctaaaatcccagcaaattatttcatgaatatcaacaaacaaaatctaaagcttacatgtggaggcaaaaaaaccagactagccatcacgatattgaagaagaaaaatgttggaggaccgaggctacctgacttcaagaattactatgaaactgtaataatcaaaacagagtggtatcggcaaaagacgaaagtaggtcaatggaacagtggagaga

SEQ ID NO: 644100 - DNA, 140 bp, Homo sapiens
cggtcggcacacaacatactgtacatgaagctgccagtcgtgacaccattccactgcgggtacaacgtggagaggtgacttacaaaaatgtcaagtcaacgtatgggatgtgggcggccaggacaagatccggccgctct

SEQ ID NO: 644101 - DNA, 386 bp, Homo sapiens
  misc_feature (241)..(241): n is a, c, g, or t
  misc_feature (249)..(249): n is a, c, g, or t
  misc_feature (286)..(286): n is a, c, g, or t
  misc_feature (318)..(318): n is a, c, g, or t
  misc_feature (325)..(325): n is a, c, g, or t
  misc_feature (350)..(350): n is a, c, g, or t
  misc_feature (386)..(386): n is a, c, g, or t
gagagcttgaccattgaggttctaatttcaaaaagcccttcacagctaatatctcatcttcattctactaagatgtattcattttacctaattcagcactaatttttttcacttttcaacatggaaatacacccaatgattccaaatataccacagcaacctatgttcctagtctttattgagatcaacacacatgttatatattccagaaatgaacattacaagtttacccttctgatgnacaactgnttcattcttttattcacatcacacacacacacacacncacacacacacacacacacatatattagactnatggctnagtttagaactttctctcttgccanctactttgctatatatagacatagaacctgacctcn

SEQ ID NO: 644102 - DNA, 1204 bp, Homo sapiens
  misc_feature (328)..(328): n is a, c, g, or t
  misc_feature (394)..(394): n is a, c, g, or t
  misc_feature (492)..(492): n is a, c, g, or t
  misc_feature (602)..(602): n is a, c, g, or t
  misc_feature (646)..(646): n is a, c, g, or t
  misc_feature (741)..(741): n is a, c, g, or t
  misc_feature (817)..(817): n is a, c, g, or t
  misc_feature (820)..(820): n is a, c, g, or t
  misc_feature (912)..(912): n is a, c, g, or t
  misc_feature (959)..(959): n is a, c, g, or t
ggccttttcctgggccgtccctgtccccgggttggagaattttccttgccgccccctacttccggaggggctctacctctgctgcgctctcctggtgtcgctctccacaggtttgggggggcctgcaaggcgcttctttctggggaagttctttccccaggaggaccccctcccttagggcgccccctggcgggagccccaggggtgggctttgctcaagcttttagggcctcccggggggggcgcgttccctcgggacttcgttactcgggaatgcccgggggttttcccggggtttccccgcgttgcacccacagcctcagagacncctgttagagggacacctgtgggcgccccgccccctgtgtgtcccgcgcgccccggcgcgccctcncccaagagcgcccccttgtcccgagaattctggagaaatattgccgcggtctctcttcagaaagattgtgggggaagaaaaaacgcacacgaaggccncccaaggggcccgcccccggaattttgtgataatttgtgggagagagaaatcgcgacgcacagcccatactcttttttgcgcgctctcttctgtggaagatttagagganaatatccccagagacactgtgtgacaaacaaagatgtggttgtntgttgtggttggacactctctgggtgttctgctctcggcccaatggtctgctctctctctcacccggaggaacactgttctcaccccactttatnagacggggagagtctcctgggcccccgagagaacacacacaagagaccacaagattctggtcgtccccagtctccnccnccagcagtgtgggattctctccacgagttgagaacaccctcgggtgatgtgacaaaattcacagcgtgacacacacactctccccacaaagnagagaggccactcttggagagacaagagaccccacagcctcgggtgntctcactaaagggagattggcacacactcgagagatgcgcaccaccactaatgttatgcctgtaatccaagttcaccgagtcacttcttatcgatatccaggctgtgaaaatgtcacccacctaacctcggaccacagttgcaccactcgttttaactgggaatattttttttctgttttttctgtattgctctgtgctagatagggtggattccgtaataaatactgtgaagcttttgtttcca

SEQ ID NO: 644103 - DNA, 644 bp, Homo sapiens
  misc_feature (286)..(287): n is a, c, g, or t
  misc_feature (289)..(291): n is a, c, g, or t
tagtctatagatcattgcacttcaactgatgtctaaaataagatgctgttggggaagatactggagaataaaaataaaggacagcacttacctttgttaatacgttaagcagatgaatttttgatcacacatctcattacttgtaacatattaccatacctttcatttacaagggctttttcattctttcaacacatttttattgagcctttgcagtcagtatgtgctaagtcagtctgctggatcttgggacttcagtggtgaaaaattagacgtggtgccgccnntnnncaagcttttaccgctggtggtgaatacagataaataaccaaaacaattaccagaaactgtgccaaatgccatgacagcacagagaagaggttccctaaacagggaaaggaaacgaatgtgttacagaaagcttgctggagtctctaagctgagatctgagggctagttagaagttagctaggtgcagttggagtgggagaggaagtttcagttgtaggcaaagggaacagcatttacaaaagcctaaatacaagaaataacatggtccattcaaataattaaaagctcattatgatttaattattaagggactggggtaggagtaggggtgcggtaaaaattggagcgagctc

SEQ ID NO: 644104 - DNA, 850 bp, Homo sapiens
  misc_feature (93)..(94): n is a, c, g, or t
  misc_feature (97)..(99): n is a, c, g, or t
  misc_feature (103)..(103): n is a, c, g, or t
  misc_feature (105)..(105): n is a, c, g, or t
  misc_feature (110)..(110): n is a, c, g, or t
  misc_feature (115)..(115): n is a, c, g, or t
  misc_feature (316)..(316): n is a, c, g, or t
  misc_feature (341)..(341): n is a, c, g, or t
  misc_feature (486)..(486): n is a, c, g, or t
  misc_feature (508)..(508): n is a, c, g, or t
  misc_feature (556)..(556): n is a, c, g, or t
  misc_feature (558)..(558): n is a, c, g, or t
  misc_feature (567)..(567): n is a, c, g, or t
  misc_feature (573)..(573): n is a, c, g, or t
  misc_feature (589)..(589): n is a, c, g, or t
  misc_feature (599)..(599): n is a, c, g, or t
  misc_feature (601)..(601): n is a, c, g, or t
  misc_feature (609)..(609): n is a, c, g, or t
  misc_feature (615)..(616): n is a, c, g, or t
  misc_feature (628)..(628): n is a, c, g, or t
  misc_feature (633)..(633): n is a, c, g, or t
  misc_feature (649)..(649): n is a, c, g, or t
  misc_feature (654)..(654): n is a, c, g, or t
  misc_feature (658)..(658): n is a, c, g, or t
  misc_feature (663)..(663): n is a, c, g, or t
  misc_feature (666)..(666): n is a, c, g, or t
  misc_feature (673)..(673): n is a, c, g, or t
  misc_feature (675)..(675): n is a, c, g, or t
  misc_feature (689)..(689): n is a, c, g, or t
  misc_feature (695)..(695): n is a, c, g, or t
  misc_feature (708)..(708): n is a, c, g, or t
  misc_feature (712)..(712): n is a, c, g, or t
  misc_feature (715)..(715): n is a, c, g, or t
  misc_feature (721)..(721): n is a, c, g, or t
  misc_feature (726)..(726): n is a, c, g, or t
  misc_feature (733)..(733): n is a, c, g, or t
  misc_feature (781)..(781): n is a, c, g, or t
  misc_feature (784)..(785): n is a, c, g, or t
  misc_feature (803)..(803): n is a, c, g, or t
tatattccacagagtgtgagcaggctaaagcaagctgctcaagggccccagttgcaaaatctggggtttaagtaccctttaggggtttcctannggnnncacncnatgcnaccantcggaggccgaagtgaaggctcccagtctccagactcttattctcctagctcaaagaaatccactgatttcctctgtagcatcttcaggttccatcttgacaacttcctctaaatccccaggggaagagttgtttagagactcctggatgccctgagggagcggctccagagcttgccttccctcctctgttttcacaacnggtccagcgataggcactgttctcngacaatccttcttggcactgtttatcgactggtggaggccctgggctatgttccactttggggaaaacagtagcagagagaggagatagttcctggggctctaatttgggttctaggccctgaaagcattttccccatcagccantgtcacaagcaaatgtccacantcaatgtgggccttaatcttcaggggtggatggtatatggaagatttnangaattgccngaaaanattaaagggtgagagngaggagggcnanagggggtngtttanngggacagggganggaanagggtttaaaccaagngtggngctnggganagnttggggngnctggggccacgacnccttgnacaggtgggttcngttnacntccacncccanggctcanatacttcacagtggtagcaggaacagtgaagataacagatgcagggtngannacaggggcagggtttaancagcgaaaggccctggctccccttcttttttagcgggctcctgctca

SEQ ID NO: 644105 - DNA, 305 bp, Homo sapiens
  misc_feature (93)..(94): n is a, c, g, or t
  misc_feature (97)..(99): n is a, c, g, or t
  misc_feature (103)..(103): n is a, c, g, or t
  misc_feature (105)..(105): n is a, c, g, or t
  misc_feature (110)..(110): n is a, c, g, or t
  misc_feature (115)..(115): n is a, c, g, or t
  misc_feature (245)..(246): n is a, c, g, or t
  misc_feature (249)..(249): n is a, c, g, or t
  misc_feature (252)..(252): n is a, c, g, or t
  misc_feature (254)..(254): n is a, c, g, or t
  misc_feature (261)..(262): n is a, c, g, or t
  misc_feature (266)..(266): n is a, c, g, or t
  misc_feature (268)..(269): n is a, c, g, or t
  misc_feature (276)..(277): n is a, c, g, or t
tatattccacagagtgtgagcaggctaaagcaagctgctcaagggccccagttgcaaaatctggggtttaagtaccctttaggggtttcctannggnnncacncnatgcnaccantcggaggccgaagtgaaggctcccagtctccagactcttattctcctagctcaaagaaatccactgatttcctctgtagcatcttcacgatctcatcgcgacaaaatccgcattatgcccaggggaagannggnttntnatagctnnctananncactgannggagcccctgcagagcttgacttcccgc

SEQ ID NO: 644106 - DNA, 319 bp, Homo sapiens
  misc_feature (93)..(94): n is a, c, g, or t
  misc_feature (97)..(99): n is a, c, g, or t
  misc_feature (103)..(103): n is a, c, g, or t
  misc_feature (105)..(105): n is a, c, g, or t
  misc_feature (110)..(110): n is a, c, g, or t
  misc_feature (115)..(115): n is a, c, g, or t
  misc_feature (205)..(208): n is a, c, g, or t
  misc_feature (210)..(211): n is a, c, g, or t
  misc_feature (215)..(216): n is a, c, g, or t
  misc_feature (218)..(218): n is a, c, g, or t
  misc_feature (223)..(223): n is a, c, g, or t
  misc_feature (226)..(226): n is a, c, g, or t
  misc_feature (231)..(231): n is a, c, g, or t
  misc_feature (236)..(236): n is a, c, g, or t
  misc_feature (240)..(240): n is a, c, g, or t
  misc_feature (254)..(254): n is a, c, g, or t
tatattccacagagtgtgagcaggctaaagcaagctgctcaagggccccagttgcaaaatctggggtttaagtaccctttaggggtttcctannggnnncacncnatgcnaccantcggaggccgaagtgaaggctcccagtctccagactcttattctcctagctcaaagaaatccactgatttcctctgtagcatcttcaagnnnnannatannangatcnatngcaanaatcngcanggtgatgagcagangataggctgttttgcagttaatcatggcgaggcccgtgcagacgatgactacgctgatgacatgc

SEQ ID NO: 644107 - DNA, 375 bp, Homo sapiens
ggatcccccatatgtccatcctgtcagcacccaggctagaggtgcagtggtgtgactctcattgcaagcctcccaggtgcacaaggttcattgcaatgctagtgcctcagcctcccaagaagcagggattactggcgcctgcctaccacacctggctaattatggttattgtaaggagagacctaattggccatgttgaccaggctggtcttgaacctcctgacctcaagtgatccacccgttgtttggcctcccaaggtgctgggattacaggcatgagccactgtgcacagccagcctgcttcatcttgaatgctttgctgctcagaaatttcttctgccagttaccctaaacaatttatctcaagttcaaag

SEQ ID NO: 644108 - DNA, 354 bp, Homo sapiens
taacactagtttttgacccatgactacatctagttgtaacagtccacatagttctcttctctgtccactcaccctattctaggtttcaccctcatctttctgttgaaactgcttcctcaccagtgcactggccattggtctcctgcctgcagatctgaggccttagccccggtcttcctcttctcgtgtccccgctctgtgtttcttttccatcaacaaacctttgcgcctctgtatctccctgtctccatgacactggttgtccaggcccactcgaacctcatttgtttcctttttcttcctggcatgtagacacggggatgctgtgagatcctgtccttggccttatccgag

SEQ ID NO: 644109 - DNA, 485 bp, Homo sapiens
agaacacatgtgttgacctagcgaagcacaggttctatactcatgtagcccagtgttggagtgcagtggtgcaatttcagctcactgcaacctccacctcctgagctcaagtgattctcccacctcagcctcctgattagcttcgattacaggcacctgttgccacgccctgctaattttttttgtatttttagtggaaacagggtttctccatgttggtcaggctggtctcgaactcccgatctcaggtgatctgccttggtctcccaaagtgctgtgattataggcgtgagccaccatacccggcctcaatacatagttttttaaagttcactctttttttttttcttttgggagatggagtcttgctctctgtgcccaggctgaaattgcattggtgtgattcccactcgctgaaacctctccctcccgggttcaagcaattctctggcctcagcctcctgagtagctatgaaaagcatccg

SEQ ID NO: 644110 - DNA, 954 bp, Homo sapiens
agcgggggcggagcgcgtccgcagccggctggtccctgtcgcgtggccctgcgctcgtccgagctcacccgccaggtgcggagctcgccatggaggcaagctgagtctggagcgcttgtcgaatgcgatagaccaggagcgcccaggaggcgtcatcccgtgtggcgggactaggtggggtgatcagataggccgtcctcctgtatcaggcttggatcgtggaagctcggtgcgactcgaggacttgacgcttcggccatctctctgctgtggagggaagacgcgggcgactgtgagcgaagcactcgcagacaccgagtgaaccaacaccatctttggaagcaatcggaccgtatccgagacacaagacggtacaagccgacgtctaggcgactgaacggtcactggccgtcgacaggcgcatggcagcgggcgcgcgagcacgcggtactggtagccttcgcatgagaacgaagccgacagcgggttgacgtacggcatccaataggagatggattctcgacttggattgcgcacatgcacagacgtgtgtccaaatatgtgtgccgcatgtaccattggaaatacgaataggaaacagaggtagtatgaggaacaaggcgcctcaattatgtttggggatcataccgagataggaaatggtagatcgctactatgtggaaatatatagcttacattccttgcatagaggataagagaaaggcgtgcaacaagagagtaaagcgagactggggattgggaacttgctatgtgcgaatagttcccactaactatgtaacagacgagaatagagacatcgccacaccgttgttataggcacggttcttgtaagttttacaaatgcaaaggggcttggacaagtgaggagagacacagaatatacccacgtatgagctagtaatcaatacctaattacaatcctgaaagttggac

SEQ ID NO: 644111 - DNA, 139 bp, Homo sapiens
catgccgggcatgtctggcacgtgctcagtgcatcttctggttgtacatcgtggtgtggcgcagtgtcatctgtgcagctgtgcacactgtgtgctggcggaggccatcaactgccctccaggacaacatgggacactg

SEQ ID NO: 644112 - DNA, 929 bp, Homo sapiens
  misc_feature (929)..(929): n is a, c, g, or t
gaggcgcgtggtgcttgaggccgagaactggaccgttggtgccgccatacatggatgacgtttgtagcctgctgtcccgttctttatcctgctcgtcatgtctccaagcgctgtactctgatatgataggcctgcgcctgggttgcacattgccgtcgcggcatgacttggtgtactgctcgtggtgtgtggtgtcttagcttcctcgagtcatcctggagagaataatttactgatcgttacttgttgagacctccaagtgtcgggtgactatgtactgatgaaggatgggcatcagaggccagaagcttccttggcctacagagtaaatggacaatatattatggacacggacgttgcatccatacttccgtatttacaatggagagggttaggtttcatagatcctggaccgatcgaatgtgccaaatatcctcaaaattcaatagattccttcttctgtgcattggatacgtcggtgtcctatcgagttctgacatggctaggagtatcatgacgagatgaacactgccgggctatctgatgggttagagtgcctttgaccaagaatatcagttggatactggatttcgcatcctgtcaatgactgttgtcagaggctgtaccaattcctcgtaatattgaccatgtggcaccagagtgaacgagcagtcgcgtttcacgaagatatctagtgcagaaatcaggaagcgtatttgaagcttggactagaatttcttcatggcgtagataccgatgactaggtttacttcccgcggaacttagttctatccatgttgggcctatttgcgttattgcccaattgattgtttaacttgcgctttggccttttaggttttgccgttacagactattttcccttattttccacctattgtgttccctgtcaggtgggctactttgtgtcn

SEQ ID NO: 644113 - DNA, 558 bp, Homo sapiens
cgttccccacaaagataggtggtgcgtgtttcagggtctctcgtttctctcctacagaaatgaaaaagaaatgtcattagaagaggcgtaacacgtcagtccgtccccaggtttgtgtttcctggagcggccggagatcagttctaacctgctctgcaggaataacggtcctgcctctcgacactcttggcgaggtttttcgccagtttgctccttgagctgcccctttctttgcaccttcctctcccttataccatgcgtcttctttatgcttttctttcctaccatttctgtccatatctacactcatgacttcctatctcgtgcctcctccctactcgcacagcgctccctgtccacgcgacccgccattcgatccgctcttacacctctcgacctcatcactgcccacgcccttcattgcatgtccctatcccctccctccccagctcttccttctctcttccccttctaactcttcgtctactttcctcctctctccttcttctccccttctcctccccttcccctcccccctttcctcctccctctcccccc

SEQ ID NO: 644114 - DNA, 222 bp, Homo sapiens
gtttgatcgaggattatcgattacagaacaggctcctctagagggatatgaagcaccgccagttcctttgagtgataagctgtgactcgcagtgatctggcgagcagttttgttgatttaactgctgacggttagggctaagcataggggggtatctaatcccagtttgggtcttagctattgtgtgatcagatatgttaaagccactctcgtagtctattt

SEQ ID NO: 644115 - DNA, 335 bp, Homo sapiens
agtgagtattactggcgctcaagagttatgtctacagtcgccgggaaagatttcctctcgtgcatgtcacgctgcaacgagaagcatggtgagaaaggagggctgctgggaacagggcctaccttgcacatggaaggaaatgaggaaatctcaaaacaggcttttcatagaacaagttagttcataacttttccaggtaaatgtatttctttacagaattatttttgaacagaggtgaaattgaaggatttaaactaataccatcgataaaaatgaactacaggccaggcgcagtggctcacacctgtaatcccagcattttgggaggccaaggt

SEQ ID NO: 644116 - DNA, 791 bp, Homo sapiens
  misc_feature (3)..(3): n is a, c, g, or t
  misc_feature (73)..(73): n is a, c, g, or t
  misc_feature (90)..(90): n is a, c, g, or t
  misc_feature (98)..(98): n is a, c, g, or t
  misc_feature (107)..(107): n is a, c, g, or t
  misc_feature (109)..(110): n is a, c, g, or t
  misc_feature (112)..(112): n is a, c, g, or t
  misc_feature (126)..(126): n is a, c, g, or t
  misc_feature (131)..(131): n is a, c, g, or t
  misc_feature (140)..(140): n is a, c, g, or t
  misc_feature (156)..(158): n is a, c, g, or t
  misc_feature (168)..(170): n is a, c, g, or t
  misc_feature (173)..(173): n is a, c, g, or t
  misc_feature (183)..(183): n is a, c, g, or t
  misc_feature (188)..(188): n is a, c, g, or t
  misc_feature (190)..(191): n is a, c, g, or t
  misc_feature (196)..(196): n is a, c, g, or t
  misc_feature (203)..(203): n is a, c, g, or t
  misc_feature (218)..(219): n is a, c, g, or t
  misc_feature (254)..(255): n is a, c, g, or t
  misc_feature (291)..(292): n is a, c, g, or t
  misc_feature (541)..(541): n is a, c, g, or t
  misc_feature (560)..(560): n is a, c, g, or t
  misc_feature (584)..(584): n is a, c, g, or t
  misc_feature (625)..(625): n is a, c, g, or t
  misc_feature (664)..(664): n is a, c, g, or t
  misc_feature (707)..(708): n is a, c, g, or t
  misc_feature (717)..(717): n is a, c, g, or t
  misc_feature (719)..(719): n is a, c, g, or t
  misc_feature (728)..(728): n is a, c, g, or t
  misc_feature (788)..(788): n is a, c, g, or t
tgngcgagtagtcccagggtgggaggtgggagcagaataaaaaaaatctgccatgattcctaattgtttttcnatacagttgcttggggnggggtttntggggggtntnntntggggggcctcttnttgcnggggttgtnttggggtttgggtttnnngttctttttnnnggntggcctcttntcccncnnttgcnttggtgntgtgctggctggctnntcctcctgacttctgtgcgtgttacctgctttgtnnctgtgttttttaagcgagcttgcttgtggtgcgcgnngggttgttttggcccccccggaacacaccggccaggagcccgtgtgggtgttcttgttatctcggctctttgtctgacctctcacaagggtgcattcccaagaacttcacaatattacccacagcctcttcaagtgtcttgatggtagacaaggtgaacgtttcctccttctcaaattcatcccctacctcatcccaggctgcttcgaagttcagtttcatgaccttttgaatgtgatcagctacagtnacttccagatcttccagcncatactcatcctcatagccttcgncatcagtctccccagtggtgggatcacagtgcttgacagtnaacttcatcatgcagctgaatgtgcaggccacagctgtngggtcttctttgggcagtgccaccagtgtgtagcaggtcccgnnctggttgtngngcaggctcngggcaggcacgtcacagagcgcctcataggcctcagtgggctccatctgcactgtgacantct

SEQ ID NO: 644117 - DNA, 253 bp, Homo sapiens
aaaaaaaaaaaaaaaggaaaagggccattagggaggtttcccttagggatggccttttataaaaaatggctctgaaccaggccaggctgttggaaaacattttatccagggaagaccttttttaaaaatgggggcaagccttttaaaaccctgccattgtttggaaaacaaagtttcggggatattcaaaacccttggtggccatccaaacatggtcaatagcaccctcaccagaagatcccatctaaggaga

SEQ ID NO: 644118 - DNA, 188 bp, Homo sapiens
caaatcatggagcctgacccctggatctccccagtctaggggtcaggctccattacgatttgccccttcccatcatcttcctacaccatgccactcagattaatctttctttatcctgagaccagttgtggagcactgaagtgcaggcaggagaggggaagggccagtctgggctgccgggttctatt

SEQ ID NO: 644119 - DNA, 1497 bp, Homo sapiens
ctctgcccagctcaatttgggttgtcgcacctacctcttttctcgcccccctgatatataatattttcctctcccaaaacacttactaaaataaatttagcggacggatactctccaattgcgggtaagttgtaatacggggaactcttatctattttatacggccacaatcaggtcctaaatactcggtagcgctaccccccaattacgctttttccgggggaacctttaaaggtgatactacgccgccgaaccgatatgtaacccttcctcggggaaaaccaaacgaattgctataacgcttttctctgggccttccttttaagctgttggaattttatttctcttgggcctctcttgggactggaatattgtagcaacaattgtttgtctcacaagggaagtgtcacctgcacagtgttactctcgtattcccacaaaaaggtatcgaatgttccgcttaggaactgtgggagtctttcccctctcaacagtggcccaaacacctttcgcgaaacagttctccaagggaacgcttaacggagcatccaaggccgtatactacggtgtgtgccgaacacccaaagttctcatagtatggcggcgcacaatgggccccctggcgcaccgaaccgaattaacgttcccacctgcaaggccccgtttattatcaactcgggtggccccttactcctgaacaccaccagcggcccattggagtctcgaaccatcgcattgaaacggttatttcgaacaggcttccttgtgtgcgcgccttcacagggacctcacgaacggtgggaccatcacgactgtttggctaagcaaccacaggggctgggtttccccgcacgaaacacttccctcggcctggactgctgggatcaataactacccacgggcttcttccgcccactgtgtgcctgcactcgcaagttggcttactgactaattggacctaatcgcgaatgactcgtattcggcgaattaccgcacgctacactaccaattcgcattcgcacacgaagagcctcgagcactctaaacgctcttagccacagtcaagcattctccatcccctgtggatgatcatagagaactcatgtcctcaaaccaagtagcatgcacaatggaatgaagtgccgagaatgttgaacgagtccagctcaggcaaggccacctaccaaggaaaaacggcaatttcccacctgcaaattctatctctcagcatcaccccaggtctgccattacattacgcgtcgcggcaagtgccgcgcatctcctatgtagcataccgatccagcaccctgctctcacacagacgcacccggaatttctgtccgttcccaaagatcaggccccggataaagtctgccccagaaactctcacagcttccagagcctgagaaaaaagccaacctgaatttaccacggcatgcactcttcagataagccatgtcaggcaaataccgcgagtatctttatagtaaattcagc

SEQ ID NO: 644120 - DNA, 1718 bp, Homo sapiens
  misc_feature (621)..(621): n is a, c, g, or t
  misc_feature (654)..(654): n is a, c, g, or t
  misc_feature (1147)..(1147): n is a, c, g, or t
  misc_feature (1226)..(1226): n is a, c, g, or t
  misc_feature (1261)..(1261): n is a, c, g, or t
gttcccgcgcctcctcttgtgtttgtggaggagggatattttttgaggaggggttagtcgtcgccgcgtgcctcaggagttgtctcaagaagagttgtgggagaggaatctctttgtgggtgggttgtttgtggggccggcccgagtgttgggttgtcacatcacgtggggtaggagaggatcgtctcccacgcgtggggggggactaattttttggtggtaggtagaggaggtggtccctctctttcctgctcctgcctctgccggctccgtaggtggtcccgccccgtgcggcacttggttggggagaatctggtggggaaggatgtttttcctcctccaatatgtggtgcatcctcgtgtgtgcaccgacgagttgtgtttcgctcctcgcggctttgaagtggtggtagtttctctcccccccccatgtggttgtatgaggaatattatgggggggcgccccgccccctctgtgtgtgttgaaaccaccgcccccctgtttgtttttcctccgcagaggatggtgttgaagagcacaacaccatctccgccggttgtttttgtgccccacgcctgtttatgagatactactccgtgctgttttaggaacaactcttngggggtgtttcgtcctcaccacgaaagatgtgngtgtggaagaacaccgtcgtcttgtggaggagaaaaaatttgttgtcttaataggagaccatcacctttgggggaccatcacacagcgcttattattacgacatcttttttcatcatcttgcgaagagggatctacaccgcctcatcacatccaccacagtcttattatgggggggaaccccccagcgtggtgttgggctcgtgtggagaacaattataataatggagtgtcttgtgttgtcgtgtcttcgtctttttaaactatttgctggagttattgtggagagtgggggaaatattatcttcgtgagagtgggagatactacacacaatatataaagacatatgagcacacatcacacattagtagagagacacatctgtgtgtgtgtttgtggggcacaactcaggtgcgcacagatatggtgagacacatctgtgagtatatataagggtgcgcgggtaactcgtgtgctataagaagtatattgtncccgtcgtgtggtggcgtcacatcatgcgcgcgtttatacacacacagcatcgcagagagagactcgttatagacgccnacgcgtatagtatgcggcgtcgttgtgtgtgtgtngcacacagatatataaggggtgtgtgtgagaggtttagagagccaccgcgccctctcacatgtgtctctgtgtgtgtgtggagagtgtgttgtgtgtgtgtgtcttctctctcacaggtactcacctgtgtgagtaaaggtgtctccttgagagggcacagggccacctgtgcgccacacttgtctctctctgtgtgataagtttcacaaatggcccacattaaaaggggtcccacattaaaatgttttgttttgaacacacatttgagaatgtgctggttgttctggaaaaggggtataatatattggtgagagctgaaatcacccacacatataagtatattataattttgtttggactatggtgattgtttaaaagactgccgcccttctcagacttgggccgtaaatggcttaattaattatggccttttaattaaatcgaaattaacccttg

SEQ ID NO: 644121 - DNA, 717 bp, Homo sapiens
  misc_feature (717)..(717): n is a, c, g, or t
caggaagaccttgaggaaaagctgaaggagtatgtggactgtctcacagacaagatgtgccaagacccggtcaggggtgctcttgagagcctgcgcctggccctagacgtcccgcctactccccgacttcttgctggagacgcgcgcctctgcggctagcgcgtattgccctggaaggagagtgcgcgtcagggaaagggaagggcggaggtaagcagaggccctggtcgtgctgcgtgttgctatggcgctgtctctgcgttgctagcttgggcccgtggacctagatgggtgaggagctgtttcacaggccgtgcacgtcctctgtctgggtctctgtgcttagtgatcgagcgagcagctagccctgctgccgccggctccactgtgcttctgcccttggacctggggctggctacgtgggctgtccgctgatcgatccaggacctggtctctgtgccttgccgtgcttagaaagtgtttccagccggttctatggcttgcgtggggcaggctccacgaacgtcctgtggttcctgccatgcctgcacggcctgctctctggtgccctgcaggcctgggctattgctgttcaccatctggcctagcgacccaagtcagccacatccttgagcaggcagctgccccgtgtgcccagctcttgtccagtgaaagtgtgaactggggatcgctgcggtgaaagcattgggtggtctn

SEQ ID NO: 644122 - DNA, 435 bp, Homo sapiens
aactcggatccaagatacagtcctcagaaacagtccgtggacatgcatgcctttgtcactgatgttgcctacaatatgaggcttatgcaaattgaaaacatgcttttgagcccctggaccctaatagttgctgttctgcttcagaaccgagcatccatggtctttgacgctctgagggaaaagactttatgcctaaaagggttaacccaggcatttggaggttttatcatttcggcctgataataaacctgctgaagatgatgcaccgcacacgcatacttctgcattccaacattgccagcacttgtcaaagacgaggagactctgtaagtggggctccgttgactcgcaagggcgcgctgggcttatgctcgagcacatgactctcctcatgtgctcagcttatagtatccaagttatgctataccgtcgact

SEQ ID NO: 644123 - DNA, 172 bp, Homo sapiens
  misc_feature (138)..(138): n is a, c, g, or t
cagctgctgtcatctcctgagcgggaggatgcggggcttgagtgtctcttgatgttggtacctctgtcttctacctgctgctgagttcggttgtggtctcttgtactgggttggctctcgagaacttgcgtgctctgnatgcccagatagaacgtgcttcacaagccgtcac

SEQ ID NO: 644124 - DNA, 82 bp, Homo sapiens
gaagtgggcttttgtgttataattttccctttctccaaccctgtagaataagatttctttcttgtcttttaaacctaaaaaa

SEQ ID NO: 644125 - DNA, 838 bp, Homo sapiens
gaattcccagcgtgagaggttcgcagagtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatactaaatgcattgtagctctgagccaggtctgaagaactgttgcccaattcaacagtgccagcattccaactttgttaaaccatccaacatcttaaatggactttcctgtggtggtaccctttaagaggcggatgaaagctagctatatcagtttgcacattctaatcactttccagtatgagaagagagatttttacaattatataatagtcctagagtttgcagctg

SEQ ID NO: 644126 - DNA, 610 bp, Homo sapiens
attgccatgtatagaacagcagagtggttcaagcgtatactgcattatactgccctgtcgctacacgtagtaacattctcaatctatcggtttaccgctatcgtatgaagattactagtctataatgtattttcgggcccaagtaactgatagattgtctgcaaagaatctcttcaccatctttcctgggcactggagttgcttgggagctatcttgtaccttgagagccagttgttatcacccaggatattgttgagactttgagagtgagatcatatttcctcagaataccttcattataaatttcattcatttctggccataagccttctcccattgacacaagaatgatatacgttaaattttggttagtagctacctgttggaaagtagaaagatgaaaggtgttgaagataggtaaacaggaagcttccactcattggttctgggtttggtttgtttgtacttgtgttgtttgttctttttttaaggttggaatttgttagattttactttcgttatattatttttatttgtcttcaaaataattcccaattttaaaaatttaaggaaagtaaaatagaactggatgtataggccatccagctt

SEQ ID NO: 644127 - DNA, 114 bp, Homo sapiens
gtgtcacccccttcgtggacaggacagtctattctattctggcagcaatgatgacattgtattcatgcatgtagatgaacctgagagacactgggtttggcacaatctttacct

SEQ ID NO: 644128 - DNA, 457 bp, Homo sapiens
cgagctcggttccctatccgtgtctcggggttgcgcacggagtatcacgcttgtaatcccagcacttttggaggccgaggcgggtggatcctctgaggtcaggagttctagaccagcttggcgaacatggcaaaaccccgtctccactaaaaatgcaaaaattagccaggcatggtggccggggcctgtaatcccagctacatgggaggctgaggcagcagaatcgccttaaccctggaggcagaggttgtaatgagccgagatcatgccactgcactccagactaggcgacacagggagactgtctcaacaacaacaaaaaagaaattgtattcaaaagctcaaggacctactagcttaaattctaagttgaagatcaaatattatattaaagatttcattttttatgcagcaatattttgttcccaatatgccatacatagtggatagaacttaa

SEQ ID NO: 644129 - DNA, 922 bp, Homo sapiens
gtattcgaagggaagggagccccctataaaacagtctacagtggacagtctggtcggcagagccgcatggtcagatcgtgaagagggagccgtctattgccagccatgtagatttctccggcaatgtaccatctgtcctacgccaggacaaacttttgaagccttcatgaacgcggcgaatcggtctgccggaagagctcatccagaaggggacggatatcatagggcgtgtcgaaaatcgtgcagaatgggaatgcacttcataatgttgcacctagtcaccgctggggtcccaaagtgcagtccaaacacgaattcacggattggggcgtgacgcgaattgttgagcctcgtgatgacgaaattgactggcgccgaagagacgtcgagtgacatcgtaggcttcagttaggaaggttgacctagtaaaattgggtggatcaaagcttttcagacaaacatcagtcatatgttctggttgtaccgcagaatctccacactggtgaacattatactcatccaaatacccagtgacaattcgggttcgacattggtctctcaagaagacatcagcggctggcttataattgttcctttcataactaaaaaaatcccgtttgggggagtagccaggccaccttgataaatgtggttgtaattaataaactgcaagtaagggcatggcgcctctccagttagagatcttggtgcacttgcttgcactaaagggcggggtacttcagaagtaacctggggcgattgtaaatagtgggggccgatagcactccctcctgagaatactgccccggcttgcaaacgtaagggttgtctgaaacaaacctaacaatgaggtcatctaggccattggtgggattgttctccgaaggggattctcccaatgggtgcctcttttagtttgccc

SEQ ID NO: 644130 - DNA, 177 bp, Homo sapiens
cgcccagcaaaataacctttttttattttcaggtctagcccatcagatagatttactcaaatattttctgggaccctttatgggtagaccatttaatcctgtttagaagccttttaggaatactatagatttcaaaggcatcatttaaaataaataaattcccctttctctctccta

SEQ ID NO: 644131 - DNA, 658 bp, Homo sapiens
ttttaagtcaaaaaattaattttattgaatcaaggcattcattcagtacttaacacagattgcaagagaacctcaacacgtagggctgcaagggagagggggagcagtttacatttttaatgtaaaataaaaaccctaattgctacagatagtttataaaatttgtaaaattccccaaacaaggtctagccaactttattgtttagtgattttttcccccttacttaaagaatgaaaagctagatgatgtgtgtattactggttataactaataaatcagcttggaaaaattgtaagacagaagcataaatacaatataaaaaggcgagatttttaaaatcgtattataagaatattaacaataagtggaaaagatacattagagccagcgtggtgttacactagtttgaaacagaactgaaagacagaccaaaaccaatgcacgcggagggaaacggcctgatttcaggaagtgtgtccagtcagacaaccgcagagaagggctgtcggtggctgcgtggtcccctctgttactcagccatgcgtcccaggcagagtgcccagctcagcagttaggctttctctaaggacttgtagtactctaccagcacagtccagccttgggggccatgaagccctctggaggtttctggccttc

SEQ ID NO: 644132 - DNA, 113 bp, Homo sapiens
gtgccttcccacttggttgccaaaaagcacagggaaacggaaaacctcgttcagctgcaagtgtgaaaccatctaagaagcaagaggaaaaggagaagaagggaaagggaaag

SEQ ID NO: 644133 - DNA, 283 bp, Homo sapiens
gcaaggcctccttttatttttttggcctcaggggcccccattttcccatacagcagcccaagttgttcattgattccgctccccccaccctccttcatgcccccatgtttgtggtgttccctttgcggggcatgcccttacccatcaggggaactccttttcaaccttccggtagggccaattcatacccctcctatgaaaaaacttcctccccctccccctagcattacttatatgatatgtttccaaacccattccaatttccagcattccccctcaaaca

SEQ ID NO: 644134 - DNA, 406 bp, Homo sapiens
  misc_feature (137)..(137): n is a, c, g, or t
ctcggaccgctctcgtgagactgtacttcagatatcctagtgtcttgaatagaggttttttgttttgttttgttttgttttgttttttgtctttcctagggccgcacctatagcttatggaggttgccaggccaggnagccaatcggagctgtagccaccagcctaagccagagcaacttgccagatccaagctgcgtccacaacccacaccacagcccatggcaatgccagatccccaacccactgagcaagaccagagattgaacccacaacctcatgtttcccggtgggattcattaaccactgagccatgatgggaactccatgctttttgctttttaaagccatacatgcagcatatggaaattcccaggctaggggtcgaattggaactgtagctaccgg

SEQ ID NO: 644135 - DNA, 725 bp, Homo sapiens
tattcacagaaatcatggtagtattccccttcccatttgaatacccggtttctgtaggttttaaaactcatatctgaaaagttttcattctctcagtgtaacctgggagtcacattgcatcagttaaccgctacttactccttgtgtattatagtgttttacctttaacatcggttgctttttacccgacaatgagcaagttttatggacaatgcaattccttactatataatgaatccatagtctcattgtattagagagtccagtcagccagctagagtatccacctgttaaatccctaaacctaattctggtaaagagaaagttaatcaatgtctttacctccatcgtggacaagatctatgttaggcattattcatgtgaaacagatgtcgcaaagttcttatttctcaacttttaaagcaagtatgagtaagagtttcagtcctttcctgtcttatagtccagaacacctatgtcttagcaagtggtcatcatgagtctttgcacgcctatgtgttggtcaatggttaaggcacgtctgtaatattattatcctctgttgtccttcatgttctttacaacaaaagtccgcatgtattctatcttgcttcaataagtctttggcagaaaaggcaaaatcatgtcatttatacctctccttgctctaaagaaagcagttatatacatatataaaaagtgttaataccagtttctttctatca

SEQ ID NO: 644136 - DNA, 169 bp, Homo sapiens
taggtgtgttatggtatggtagttatgtctgtgatgttggacaggtaaaataatatgatgtctgggattgattaaaaagaataccttgtgggtcagggagtgactgagtggatgtgaggtgatattagggcgattaggtgacaggtatatggtagttcattatacctat

SEQ ID NO: 644137 - DNA, 660 bp, Homo sapiens
ggtatagatgctccccatctttattggtctcgaccttcctgctcagcttattctctccgttcttgtcgattatggtcattgtgatggtggcaaagtgtccctcgtggccaagatttaaacctccacttcatcacaatatgtttctcagggaccagatcagtaaattccccagagacgttgccatctaccatgtggaactttccacctctgtctgcttctaatgttgcaggagcatgggtaaaggcctgcaccagctcttgggtggtaaacactctatagagctcctctggtgacgtcaggaaggtttccttaagagtgatcttacaagtggggattttgactccaacaggtctggcctgggtttttgaaggagcaggcttagccttgcgctcctcagttttcagtgctggctgccccactgggtctactgactctccattcattgtaggtaagatcatgccctgggtgaactctgttttgagggtgctgatgtaaattcccattgcttctcttagaagtttcaccccctcttccttcattaaggccacgagatttgtgtcaggctcatctttggcaaggctcacactaatctccacttcatccacgctgttttcatcaaacaaaattggggatctccacacgtccttttggattgtactc

SEQ ID NO: 644138 - DNA, 286 bp, Homo sapiens
tggtataataaagcaggtacgtgataaaagtccactgtgggaatacctatttatttttttattcctcccaaagagtcgagttataggcttgctttccctatgtggaattggcttgagaaatgggctttgggtgactgactgccagatctgggggaatctcagaccagaactgaaaggaccagaagctgtgatgactaattgaggtgggagattgggggtggctttttcaaagggaattgtcccgggttcttttttttttttttttttttttttaaattaagggggg

SEQ ID NO: 644139 - DNA, 843 bp, Homo sapiens
cgtttagtaatatcccctatataacttatatatccgcccgtccaccatatttgtttgcccaaataacttttaagtctcgaccacatactcctatttcctatgcccaaagttttgcacttcataaggtgtttctagattggccgcggccaatgtatttttcacagagagacagctgtgctcttccttaaaccccccattgagtcttgtatcaccaagttcatcgtatcaaaagaactcttgtacagaacctgctttaacacgtaccaaacgtatgtgctccacccacttcgaagtgggttctccaaaaaccaacgtcactcccacccgtgccgcccaacctccccaagggggggtctcaaccccccaggatcaacaaaacctagtctagagaggttctttcctccgcctcaattgttggtaatcgatcaatgcctccgttctcaaaaagtcaagattctttcataacgagtcattttctcactaaaatcgtctattacacacccccctcttcttagcagcgtcccttatataaaaggacgcacaaacaattggacaatttctccctaacaggccccccggttgttcaatcccccacagggaattctctccgcagttcatccctagtcctcttttcctcctctccccggcggggccctccaccgttataactctgacacctttatactacctccccgcagcttattcatgagaaaataacaaacaaaaaggttataagttgacctctcccccctccaacccaaatatttgattaagcaaatataaacgtagctgtataagtcctaaaaccacccacaaacccgtgccttatatcaaagagtcaca

SEQ ID NO: 644140 - DNA, 195 bp, Homo sapiens
atggctgtctagaggatcccgatatgcgtctcaggactattccatgctaatattccgcatttccaggagtcgcctaagcgaatcggtcaccgtgatcagcatcactgtgcgctgctcgtttccgatagccaaagtgaaatcacctattttttgtaacaagttgtttggcatgagacccagtcacaagtgccttca

SEQ ID NO: 644141 - DNA, 206 bp, Homo sapiens
aaaaaaaaaaaaatggggccttagcttctggctttttattttgccagctaagggcataaaacaaaaattaaccaaccaaaaccaatagccctttgctatcagcatccttatgtaaaaaaaaatatattttagcccgtaaaattaggaaaaatgtaatctcagaataaaggttgtcctttaagttgaattaatatatagctttatta

SEQ ID NO: 644142 - DNA, 88 bp, Homo sapiens
cctgcctctaaaagttgtgaccagaaagtatgattcatttcgcgcccagagggaataaaatatgtttttctcatatacctcccatatt

SEQ ID NO: 644143 - DNA, 431 bp, Homo sapiens
  misc_feature (385)..(385): n is a, c, g, or t
acggcgtcggctgctgtttgtgctctaggggacggtgcacttgaagacagtagctctctccggatcagcctatctcattcctttctttcgattacccgcggcgcggtgagtctgggcggtggttgcggaagctggggcccaaggtggccgggcggcagctgctgtgacatgtgcagcatgaatcctgggtatgaccagtcattcacgtgactattcgattggcgactcaagggatgggttttgcctacttcataggcttgcggatgatacatatacagcaaggtccattagcactatcggtgtggcttacgatatccgtactctagagttagacgggaacacgatctagcatactatatggcacacagattgccattgccgattntgctattaggtctagtgattacagtggagacactggcctcatgctg

SEQ ID NO: 644144 - DNA, 128 bp, Homo sapiens
gtctacaggatcttatgctatgcggcagtacgtagctcagatctcccgcttcctcttggtgcgtatgtcgtccccacccttttcttgataaatttgagggcccgtttgtccttagagaccttcagtaa

SEQ ID NO: 644145 - DNA, 415 bp, Homo sapiens
  misc_feature (11)..(11): n is a, c, g, or t
aggtacatcanagatatattatattctgtacataaaatatcaaactacaccaaatatatattatatgctgtacataatatattaaatttgcccatatatacattatatactgtacataaaatatgaacgtacatcaaatatatagtatatgctgcacataaaatatcaaagtacccaaagtatgtattgtatactgtacataaaatatcaaagtaccaaaagtatatattacctactgtaaataaaatatgaagatacctcaaatatatattatattctgtacataaaatatcaaagtacaccaagtatatactatatactctgcataaaatattaaattacccaaaatatgtattgtattgtgtacataaaatatgaaagtaaccaaacatttataataaactgtacataaaat

SEQ ID NO: 644146 - DNA, 288 bp, Homo sapiens
tgaggcatagaacgtagacctggaggcagagtgtgcgcgagcgagatcacgtcactgcactcccagctgatgacagagctagaccccgtctcaaaaaaaatctaagaacaactgactcagttctgcagtagagctcaatctccctcaggtaagattgtcatgttctcttccgtaagatctatatgggagataatctagtccatgtgcttgtccagtacaaactttcttgcaatgattggtaaatgttctattatctacaccattgctagccccaatagaacacttcaa

SEQ ID NO: 644147 - DNA, 316 bp, Homo sapiens
ccctatgcctggaatttttttttgagtggagtcagggtttccccatgtaggccaggctggtttccgactcctgacctcaggtgatccccctgcctcagcctcccaaagtgctgggattgcaggcgtgagcccctgtgcccagccccagctcagtgatttttatagaccaactggaacccatgtgatgtgacttattcaaggttatagcgtttttgtggcagagccagaagtcgaaccgagtccttgtcccctgtttgaaccctgttttttttctggtcattgttgactttttaccccataaaatttgaacctttta

SEQ ID NO: 644148 - DNA, 804 bp, Homo sapiens
ttctatcacggatttcatgccggacacgtggaacccggctggtctgtctccaccatcctgactggtgctcctgatcttcatggtgcgaagaatgggccccaccctggtcagtatatgagacgtcgtgacttcagggataaagacaactggcagtgcagagtttagcatttaattttgaactcgatatagtcttttgtgaagttatttcctgatagtcgtggatggagattaaacaaaaagcatgaaagcacaacgacgaactcagatagcagaccccagactctccccttgtcagacgtggttccagacggggagacagcacctcgtccagaacgggattcaggctgctcaacgggcatgcgccgggggcctgtcccaaacctcgcagggctccagtaggccaaccgggtaccactggactcctgggtggctgccctgggagaacttgtctgagatagtagggtttgcagccttggttacacggtcaagtacgttgctgaggagccattgcgcagggagttgaggcccaatggctgccgaggacccaatgcgccacatgtagtggcaccgcgcaccagagcgtgacctcggcgggctgcacaatactgcccagtcgacaggcagagccaccaggctcctaggtatagcttttagaaacctgaataggggaagcaaaaaccaaaatgttgtgcattggggctttggaggaagactggagccctcagccttgtacgtggcccatgggccggtggaggctgctgtgggttggccttgtgtgctggatttgtagccttatcttccggg

SEQ ID NO: 644149 - DNA, 459 bp, Homo sapiens
  misc_feature (89)..(89): n is a, c, g, or t
  misc_feature (154)..(154): n is a, c, g, or t
tctacaggatccctgcaacggttggcagggtagctgtacacagttgcacgcagtggttaggggctgaggactccatgtacagaggatgnagtgtcttgcctcttccagactcgggcagtgggagacagcgggagattggctctgtgaaccagcnctgttctgtagatgcccagagggggcaacaacaggaaagaccagagtcgtggtcagtagtgcacatgcttaacaggtctttggtgcttgggtagcagcatctcttatgtacaaaggcttctgaagccagcaaagctgggaaagtcatctcctgcacagtcgcggcctgactcctctcctgtgtgctggccactcagaaggctccctgcagccttcaccttccacctccgaggttccccccggttggggttccttccatccaggagctccacaatttctctgatctcacactcattctccagccgc

SEQ ID NO: 644150 - DNA, 204 bp, Homo sapiens
ggtttctgtctccctgctgccctgtgaagagattccctctgccaagattgtatgtttcctgaggcctttccagccatgaagaattgtgaatcaatctaacttattttctttataaattacccagccttggtatttgtagcaatgtgagaccagactaataaagggggtgaataaagaaatgagaggagattgaaaattccttga

SEQ ID NO: 644151 - DNA, 215 bp, Homo sapiens
  misc_feature (24)..(24): n is a, c, g, or t
tggccaggtctctacctctggatngctgggaagtgggtcaatttctggagctagggggtagtgatctcacctaggtaggagcattgggtatgtgaagttaggcttgaataaaagaagttccacaacagcttctgaagcctagtctacctctggagagttaagggtggagcccagagctgacggctctgagtagtgggttaggatgggtggcaggg

SEQ ID NO: 644152 - DNA, 338 bp, Homo sapiens
atttagtgtcactttctatttgaaacgatgttaattttctggatcagtgtctagccgtaagttcactgtaaagaagggactgggccctttagcttgtaaatgcggtatgtgatttgaatgacatgaatgtgatgactgaacatgactcggtgaacatgagacacatggtgattctcccccaatattctttatcttttcggtgatcactgagaagtaaatgctctctgattactcctttctctgacttgttcctctgtggttgaggcagtccattgaacttctggttcattcttctcactagcagtagcatccttatcagggcagtttttgctagtttc

SEQ ID NO: 644153 - DNA, 891 bp, Homo sapiens
taaaacaaaaaaaaaaattccttttccctgtggtttaccttccaagggggcccccgggttgggcgggaaaggcaatgtctaaagaatgaatacccctgtgtatataagagggacctacaacggacgaggataatgctaaatataaattctcaaaatctctaccccaaattttaaagataaaataactcatttttttacgactaataaaattaatgggctgtctatgttcactctgaaaaaaatctaaatgactgaaatgttacagaatataaaatattaagcaaacaatttattctagggtattatttccagattttacttcatttcttgaaatgctgtgtcgccatatgcaatgcgctttctcttgtcgcccagaaactattagaccttatttcactttaccttttttaaaaaatgtgaattacagtcataatagtccaattcatggccttacagatggcttacatcacgcgtccgcagctgacactgcagtccctttcatgcaaacatcccataaaactgttggatgaaacatcatgcccctaatggaaactctctagttttcccatataagctatcctactgcacatgtcacacatatctcatctccgccccaagggcttaatgtgaaaacccctgcaataaggtggaccgctcgtgtgggtcatcctgtgaagcaatcggaaccggtgaccgagcggcgctatggtccatacacggattactccggtgaccttcttaataaaacgcgctaaacaacaccctgtcattacacaaaaaaggcggctaaacccgaagcacatacccccgtctgtaccgccccagggcaataacacggcgccacgtctgaaaccgacttgccttcgagtggccacagccaacatgagactc

SEQ ID NO: 644154 - DNA, 486 bp, Homo sapiens
tgaaaggcataaaaaaaaaaaaaaaaaaaatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaggggggccccctgggcccaaaccactttaaaaccgggaaaccttaaacaaggggcccaaaatgggcccaaatgggccaaaccccccaaaagggggggggaaaaaaaataaaggggccgggttaaaaaaagccggaacgggaaaaacccggggggcacccaaaaaaaaccccttggaaaaaaaccccctttaccaaaaggggagaaaagcaaaaaggccccaaccgaaggcccttccaaaaaaggggacaccccaaagggcaaagggaaaagggaacgcgaaaaaaatggggaaaaaacccggggaaaattttgggaaa

SEQ ID NO: 644155 - DNA, 111 bp, Homo sapiens
  misc_feature (1)..(1): n is a, c, g, or t
naccactgttcgtgtagaaatacatcttcctagagacagtctgtggaggtggactttaaagcactggttttaccagcttgacaggagactcaagcttgcaggaacagctga

SEQ ID NO: 644156 - DNA, 379 bp, Homo sapiens
ggtaccctgatattagaagaggcatacaggggactgggtcttgaagagtgtcccgttccatgactgggaacgtgttaagtttactcaaaggtcatgtgagcaaatcatccctctatcacaaggtcccaaatccagggccgggggcccattggtgcctagctccctgatcacctcgccgtaggggtcgatggaatagccaagctggagatgaaacacaatacaccacttcttaccacccgtaggctccccatccacagatctgctttactgaggcgactgatcactgggtgatggggctgctaatgggtgagatgctgaaaaggctggtttctaatggacagaaatggaaggagcgagggtcacagttgatttgtcatga

SEQ ID NO: 644157 - DNA, 628 bp, Homo sapiens
ctatgagtagacaaacgtgcggcaccgcgtatccaagaaggtagcctagaacatgggcttattcatggtgtcctagagaagatatctcgggaaaatgatcggtagatgcaagacattccgacacaatccaaggattgccttgggttttcggaactcctgatgcgagattctgggaacggaggactccactagtggccgtttgcatagagcgctctcctacatctgcaattcgagtcaggcctagtcacgatcctacagcacgatcgcactcctatttcctccggccagtagctgccccagttcagtgcacacccggaaaggattcacaatattcaaaacaccaacagcatctatgaacccgccgagaaaacgaattgcgaccgcacacacacaggaggtcaccaggcgcacctcgcgaccataggacacagggtcaaacttcaagagaaggacccgaaaacaaaacctgggggcagaccacccagggcgacaacgccaagaaaacacggaaacccgaacaggtaagtgaccccagtatcaccaccttgcgattaaggcgaaccacgggggatggacaacatggcacacacacacccccaggaacactggaagtcactgaccccaggaa

SEQ ID NO: 644158 - DNA, 649 bp, Homo sapiens
actctagagtatccctggtcttgattgtactgcttcctctcagcaaggcctcactgaaggaagttcatcaggttctggcttgacccggggaaaggccatttcacactaaaccagaagtaaacaactacattctatttgccgaagataatatacaggagagattgttttttctattactacgacagaaaaaggttaaaaacagaaaattctacacttgtttttacttgcttaattttgttcaatatagctgggcggtggtggctcacactctgtaatcccagcatacttgggaaggctgaggtagatagctggggcgtggtggctcacaccttgtaatcccagctacttgggaggctgaggtgagagaatcccttgaacacaggaagcgaggttgcagtgagccaagatcgcgccattgcaactccagcctgggcaacagagtgagaccctgcctcaaaaaaaaaaatttattcaaaggccaggcacagtgggtcacgcacacctgtaatcccagcaccgtgggaggctgaggtgggcagatcacttgaggtcaggagtcaagatcagcctgggaacatggtgaaacccgtttttataaaataaaaaattgtgggctgatgggggtacctgtatccaggtatcagaggtg

SEQ ID NO: 644159 - DNA, 303 bp, Homo sapiens
  misc_feature (85)..(85): n is a, c, g, or t
tgtttattaaatatcccttaaattatttcattgcaaagtgaggggaagtcatattgtattaggataaccaaaacattttacactntgagcctctaaatggatgaagaatgcccattgctttttaaacaaaccaaaacaaaaacaaaaaaaagtttatctttgttaaaataagtgatgcatttatcttctttctttacctatggcaatgttctgctaacatagtaataagctgagttactctctggatgtggcaattaatagaaataaatatattacagtgaagcacagagaggatatataagc

SEQ ID NO: 644160 - DNA, 1029 bp, Homo sapiens
gtgaacccgtcatacttaatgaatatcatcctaaacatcttcctttctacttcttctaatgcaatacgtatgtaataatagcatgatctgctcgatctccatccgcgtaactaattgcctagatatgcgaatcctatctaatatgtctcgttatattaactcagttgaatactgcaatacttcgctcttcggcaatccatttccctactttattctcaaatattctgagtccttatagttcacaactgaatctaggactcagcacttggcagagactcagcgagtgggagatctcttgctccattccactttccatttccttcccgggcacgttataggacctgagcctaagaagattcatgcttctcaataatcgaatttccatttaactaataataataatattaagttacctctatccataattaaataattgggaacataccaccatttgtacccttcgaaaaatattcatctaaaatatcaaaaacaactaattatcttcgcatattactaatctacaggcactatcactcagcaagccccattaattttactttttagtcaatactattctcccttactgatcgtaataacttttttaatccttgttgcaatactagctctgatcatattttacagctttgatactaactgaactcattcttgccttgcgctgagatcgcgcggcccaacatcagaacttctcgttccgataatatttgcataggtagaagcactttgtagtttcctcaatagtccccttacgtgctgctactttcatttttgactaattgataattaattaattcatactttaattttacaagtgtgaaaccccaacgtaattaaacgtaccccacaaaacggggctagcgctacttgcgtaatacataatttttcttccccataaacaaattgtttcctcacacagaataaagcgagtttcaaccagtcaagacggaaggaaattcattatatgtggatcattgcattttggaaaaccgactatatacatacctttgggca

SEQ ID NO: 644161 - DNA, 923 bp, Homo sapiens
cacggcgtgtgtgcgcttcacgacattggggtcagacagccagcctggttcctgttggccccccctatccctaatggtcatccgtgtgaagacccggagcgtgcgatgtggcacccccgacgtgttggtcccggccgccccgccttttctcaagggatgcttcctcgttctcctctaagcgcgcggggtcttccacccccgggagccagcgtgtttgccgcaccgaaagtgtggttcccggcctccccccacacacccgtgtttggacgttagttgtaaatcagcccctctgggagtggtaacccccggggagacatttacgggaggtgcaacaaccgggcgggggatataccaccgcctctgctactttgaaagatattggaattttttctgtaacacccctgctgaggggtaaagtgggaaccgagttggtcccatcttagaaatatctatataattgaacaaagtttgggaaattgtctccagcctgtcaccccccgatgttcgcccaatcgtgagggtgagattttgtgagtctttatttgcgtctaaccggcggaactctatctattttgacacagtttttttcacttcagttgcgctcctcggtatagttttccgcggcatagggtggcacgcgtctaagtgggggaggcggcctccccctgctgtgtgtgcacagcacagccttttcactcgggggtgccccccccactccgttatctgtcggcgcccttactgccgcgttgcccttccccacctatgggggggatttcacccctccttccccaaacttttttgtagcgacccttgtctttaaattaacccccccttttgtctatttttgtccctaattttttcccccactaccccgattttgggcctttacccaaattgtaaaaaaaaaaagttttcccatccga

SEQ ID NO: 644162 - DNA, 1285 bp, Homo sapiens
  misc_feature (291)..(292): n is a, c, g, or t
  misc_feature (294)..(294): n is a, c, g, or t
  misc_feature (315)..(315): n is a, c, g, or t
  misc_feature (326)..(326): n is a, c, g, or t
  misc_feature (347)..(347): n is a, c, g, or t
  misc_feature (349)..(349): n is a, c, g, or t
  misc_feature (370)..(370): n is a, c, g, or t
  misc_feature (372)..(372): n is a, c, g, or t
  misc_feature (386)..(386): n is a, c, g, or t
  misc_feature (388)..(388): n is a, c, g, or t
  misc_feature (394)..(394): n is a, c, g, or t
  misc_feature (411)..(411): n is a, c, g, or t
  misc_feature (414)..(414): n is a, c, g, or t
  misc_feature (417)..(418): n is a, c, g, or t
  misc_feature (425)..(425): n is a, c, g, or t
  misc_feature (430)..(431): n is a, c, g, or t
  misc_feature (434)..(434): n is a, c, g, or t
  misc_feature (445)..(445): n is a, c, g, or t
  misc_feature (461)..(461): n is a, c, g, or t
  misc_feature (500)..(500): n is a, c, g, or t
  misc_feature (503)..(503): n is a, c, g, or t
  misc_feature (516)..(516): n is a, c, g, or t
  misc_feature (682)..(682): n is a, c, g, or t
  misc_feature (692)..(692): n is a, c, g, or t
  misc_feature (776)..(776): n is a, c, g, or t
  misc_feature (786)..(786): n is a, c, g, or t
  misc_feature (811)..(811): n is a, c, g, or t
  misc_feature (826)..(826): n is a, c, g, or t
  misc_feature (838)..(838): n is a, c, g, or t
  misc_feature (860)..(861): n is a, c, g, or t
  misc_feature (930)..(931): n is a, c, g, or t
  misc_feature (936)..(939): n is a, c, g, or t
  misc_feature (942)..(942): n is a, c, g, or t
  misc_feature (948)..(948): n is a, c, g, or t
  misc_feature (965)..(966): n is a, c, g, or t
  misc_feature (976)..(976): n is a, c, g, or t
  misc_feature (1003)..(1003): n is a, c, g, or t
  misc_feature (1012)..(1012): n is a, c, g, or t
  misc_feature (1145)..(1145): n is a, c, g, or t
tagcataatgaagcaatgtgtcttccttttcctttgtccgccagaggtgtgcaggactttgagcaggagcatgcaccttgactcagagctgataggctcccgcatgtggcttgtggggttgccaagaatgctggggttgcccatcctcggggtacatgtctggccagtcctcgttggggtattgtaccatcgtgatgctgagagttgtgagttacgctgatattgtgtctacgtactacagtacttaggagttcactgtgttcagtcttaaatgcctgcatggatgccttnntnaggataaggtataaccatacnttttcggtggnagtgtttctgggggaagttanangtctgtttatccgtaagtggngnaggagggtcagctnangagaantgggagggccagagctntcnggnntctgatntacannatnaatgaagtagntttcaaacaacgcggncatgtttacctctccatttgggagcctgcctacattctngtnctagaagcacaanaaaatcctcagatgaattagaagaaagaggtttggggactcagcggatactagttcttttaccttctgcttggtaacttagattaaactgagcattgtttttctgtcacaaatgttttccttatgacactggtttcgacatgtaaaatgtgtttgaaaacctgctntgtagatgcngagagaagctataggaaacccagtaccacccctggtctgtttgacgagacatcgttcataaggcacagcacatcgcaagatgancagttgttantaaaagctgttgctggaaacttgcnttaggaacagctcangaacctggagtncatatttcacacatattaatanntataagtccaagagctgtcagcctaatctgtaggagcagaacctctgattgacacaaggcatatgggtnnaggtnnnnctngatgcntatgctctgatgggctnnaagtgtactngccttgacactgctgctgtgggctccngcctgccgngaaaacctgaaatgcgagaagcagcaaaccagggccactgaaaaaatagctctcattagatttttcgaggaccaaaagtaagtaacgttgtactgtacttttgagaaagtactaaacctcctgattacatcantcaaagttgagaaatttgggaacttccttaggactgtgtgaggttcacctattggaccggaatactcttgtaggcactttgtttaaataacttcaaaaaggatttttttgcttaagggaataatattctctttttatggg

SEQ ID NO: 644163 - DNA, 118 bp, Homo sapiens
tatggcactagaactggatgaagatgatttagaagcagagtaggatgcactaggtgatgagcttctggctgatgaagacagttctatattcggatgactgcagcatctgcccctgcaa

SEQ ID NO: 644164 - DNA, 375 bp, Homo sapiens
tctcctatgaaagaggaattaataggaaaagaaaagcaaggaagtaatgttcaaaacttccttaatggccaggtgcggtcgctcacgctggtaacccaagccctttggggggctgagaggggtggatcacctgaggtcaggagttcaggaccagctgaggtcaggagttccagaccatcctggccagactggtgaaacctcgtctctactgaaggtacaaaaattagctgggcatggtgtcgggtgcctgtgatcccagctgcttgggaggctggcacgggagaatcgcttgggcttggaaagtggaggttgcagtgagccaagatcctgtgccatggcactccggcctgggcgacaagagtgaagctttgtccc

SEQ ID NO: 644165 - DNA, 530 bp, Homo sapiens
gactgcaggacacttaaaactgcaacatccgttctctgaacaagttaactgaggcaaactgagaaggcagtatatatccaggagcacagcacacattgggcggaagatctgggatgagagcccaaaagtcccatttgcctgtctcatacttttgtattcaaaatattgcaatctgttacctagaagaagattagtgtgtagaactgaatgctttaattttactgcaggaaaaagtaatgtagaaagagcataggctgtgatggatataaaatgtgtctaaacacagatatcttgggttaattagtaaaatggcaaagacacttcgaaaaacaagagaggcacataaatctctttcataagtgttaaatatttcaatattcactcatatgaaaatctttgaatggagctctcacatatttgtagaaataattaacattatatttgaagcatcaattttgtggcccactgagctaacataactttttatcattatatctttgaatactgtattacctatctgatctagaaca

SEQ ID NO: 644166 - DNA, 99 bp, Homo sapiens
ggatttgctggtgcagtacaactaggcttaatagggacatgagatgagatgaccaccaatcatttccttggggggagggggtgtctgcaccttagaaaa

SEQ ID NO: 644167 - DNA, 654 bp, Homo sapiens
  misc_feature (4)..(4): n is a, c, g, or t
  misc_feature (21)..(21): n is a, c, g, or t
  misc_feature (120)..(120): n is a, c, g, or t
  misc_feature (127)..(127): n is a, c, g, or t
  misc_feature (135)..(135): n is a, c, g, or t
  misc_feature (138)..(138): n is a, c, g, or t
  misc_feature (158)..(158): n is a, c, g, or t
  misc_feature (160)..(160): n is a, c, g, or t
  misc_feature (205)..(205): n is a, c, g, or t
  misc_feature (287)..(287): n is a, c, g, or t
  misc_feature (293)..(293): n is a, c, g, or t
  misc_feature (495)..(495): n is a, c, g, or t
  misc_feature (548)..(548): n is a, c, g, or t
  misc_feature (551)..(551): n is a, c, g, or t
  misc_feature (563)..(563): n is a, c, g, or t
  misc_feature (574)..(574): n is a, c, g, or t
  misc_feature (590)..(590): n is a, c, g, or t
  misc_feature (611)..(611): n is a, c, g, or t
  misc_feature (621)..(621): n is a, c, g, or t
  misc_feature (639)..(639): n is a, c, g, or t
tccnagtatctgtaaaatgtncagggattttcagttatctgctggcacccagaggcaatgggtaaggttaactggagctagagccaatatttttttcttcctagaaggagtaacagcagnaaacagnaggagagnagntgccaagttagaagtggatntngttctcttccacaggagggctacatgccgccacttgtgctgccgncatgtctctagtgatccctgaaaagtcccagcatattttggcgagtagtcaacaccaacattgatgggtggcggaaaatggnctttgncatcactgccgttaagggtgtgggccgaagatatgctcatgtggtgttgaggaaagcagacactgacctcaccaagagggggggagaactcactgaggatgaggtggaacatgtgatcaccattatgcagaatccacactagtacaagatgccagcctggttcttggacaggacagaaggatgtaaagggatggaaaatatnggcagggtcctaggcaatggtcttggacaacaaactcttgtgaaggacctggnggngattgaaaaagntccgggcccgnagaggggtggggtcanttcttgggggctccgggtccnagggcagganaaccaagaccccaggctnccgtggccgatcgtt

SEQ ID NO: 644168 - DNA, 149 bp, Homo sapiens
  misc_feature (1)..(1): n is a, c, g, or t
ntgccaaagctgtagtacccaatatgtgtgctgcactgaactgtcctgtgcagcatgctcatcaacgagtatacaacaaatgcctgacacacagagatggcaaacttgccagtgtggctctatctaggcctgtgcctcccaacacgctc

SEQ ID NO: 644169 - DNA, 349 bp, Homo sapiens
tcgcacctaagcaagataattttaagccacttaggtcaataactgtgcctataagaatttcctttgggccaggcatggtggctcacgcctgtaatcccagcactttgggaggccaaggcgggcagatcacctgaggtcacaagttcgagaccagcctggccaacatggcaaaaccctgtctctactaaaaatacaaaaattagccggggtggtggtacatgcctgtagtcccagctactcaggaagctaaggcacgagaatcatttgaacactggaggcagaagttgcagtgagctgagatcgtgccattgcactccagcctgggtgacagagtgagactctgccctgg

SEQ ID NO: 644170 - DNA, 196 bp, Homo sapiens
ccccctttttttttcccattggggggtaatcccgggtgaagcccaaaaaagaatgggccgggggttcccctttggaaaaactgggggggggggatagggggggggctttttttccacctgggggattgccccacctggggatttgggtttttggaggtaaattaaaatttaggttaaatttaatttttaaattcca

SEQ ID NO: 644171 - DNA, 98 bp, Homo sapiens
gctcgaattcaagcttctaaagatgaacggggacatgggatttggcctttttgattaaattcctgctcccctgcgatgaaagcctttttacacatcaa

SEQ ID NO: 644172 - DNA, 1020 bp, Homo sapiens
tcgtgagatccccatgcccccgtgcttaccatccgcagtatacggggctcgccgtgtcaggccaggcctcaggtccttctgtagactcccttgcctggattcgacgtaacctgggatgaaacacctaacacttgcgaaaggttcctgctgccaaaggggtgtcagtacgctgcccccagaggattcgaatttcacccaagatgtcacggcccagacgcccttggaggcgactgtttctctgatgccacgaggcaactccatgggcaagcgcaacactgtaatgtcttctctaatgggagcatacctaatagcctgccgctcagcgactggtgtcccttgtctcgttctgacccacgtgggaaagtagtcagtagaaatcatcacccacattgggtcccgcacgtgtagccaacggggtctcaggtcagctacagatagggcgcgcgggccttttgggaccagatgtcccacgctatccccatggggtatctaccccatggctggcacaggccactgtaggatcggcaaggggtctcttctcatcagagccattgtaccaggcaaaagacaaggccctgcttggccgcgagtcactggccgccaagatcacgggcatacacgactgtctgctcatcatggaccccacagtgactctggccatctggggaccctccaccgcgactcccactcccagtgatgaggggcacttttcagtgcaagtcaaaggcatagacgaggcttcacgattagacgtcccaggaggtccctcctgtgagcgcaccaagggcctaggcgtgccctcccagcccccaggccctcgtcccacctacagagacgcctccgctgcgcccctccactccggggcctgtgccgccagaaccgggctctgcaccccatacgctgccctcgcagcctggcggcctcacgactgtggctgcctagcatgtcaagagcaaaggctttttttttcttcaaccccattttcttccatttctcatactcgtggtgccagaacacttt

SEQ ID NO: 644173 - DNA, 1606 bp, Homo sapiens
  misc_feature (823)..(823): n is a, c, g, or t
  misc_feature (886)..(886): n is a, c, g, or t
taatgtcctttgaagtatacttgaggagggtgacgggcggggtgtacgcccttcagggccctgttcaactaagcactctacctctcagtttactggcgtaaactccacctttcgacccttaagtttcataaggggctatcggtagttttctgggggtaagaaaatggtacgcccatttcttggccacctcagggcgctaccacctttgacctaaacgtgtctttcactgtgggtgtcacttggcgcgcttcactttggtgacgccttcaactcaggggtttggcgtggaacatatgggcgggtatattatatagcgctggacgcaaaaagtgtgggtggagtgttgagaccgcggggtgttatatacgatattacacgagaacacagaggtctcctctctctatagagaggggtattttgtgaagagccccacgctgcccagaggtccccctctggagagagattttatacaaagctctgtgtgggtgtctcacgctaaagatgtgtgtctctggggggcgaagccgagtgtttgtgtgtgtgtgcatattatacactgtgtgtgatgagagagtgttatgaggggccataagcccatatagagtggggggatatctctctatatctcccccgagttgttggtgggggtcccttatagcccctaatttgtgggtgtgtgtgttcccagaatatatgtgtttttaagagccccccacccttttctcgggataggactccatattgtgtgtggggtgtgctcaccacgcgtggggggagattttttttttctaccaaacctcctccgcgggtgctggacgggttntattaaaggcgcctttttatgtgtgggcgaggccacccccagtggtggcggggtttgttgggnctcaagataaccccaaaaggcagcgccctttataaaccaggaaaacagtggtgccggggggcgaaaaccatgtcgggtggagggcccccaaattgacaaaccggaaacactgggtgtggtgtgtgtagatcctccccacttttttctcccataaaaagcacacaacggaactctgggggtcacattgacactttttgttgtaaataagccaccctcctgtggcttaatttggttcccccacaatatattctacacggacacacatctttttcgtggggcaggaaaagagaacgctcggctttctcggggttctcaacccacgcatggggaggacgccccccagtgggtggaagcccccacaaaatttggtgcggctcttcgtggggatgtgggggcccccccaaagggggcaggcccgctgcgtgtgggttctctgcaacaaatgtgacgagtatcaccttcgggccgagaaagtttgggccccacaatgcggtgttgtcgaacaacgcttcctgcggcagttctttacagcagcacaactaatctaccaacgagccggggactacaacaccggaagacgtcaagttcttccctccgcgtggtgaagacaacaaagcggtgcgtgcgtaggacacaactacaccagagggggagagggaggaatactacaccccggcggagcaacacatagtgtggtccttcgtgttgcacaactaaaga

SEQ ID NO: 644174 - DNA, 1080 bp, Homo sapiens
agcgggagggagccgaagccccaggctaagaggtgccaagcttctagatctatttctgagctcttttgcgtacactgaatacattgaatcctcacaacactccgtatataaggctacggtatcgcctagttacccccactttctacagcactgacaaactgtacttagcgcaccagagcaggctccaggaaaagcacgtgctcgtctaccaatggttcactcaacaggttacactgcaggtcacgctgccagcgcactctgggacaacgcaactgacgccttacccaatgtgcgaccttgaattgtctgctcaacgaattgccatgcgaggctaccactcgggcaacaacggctgcacaccccagtaccggtactcgcaatcctcatggtcgctataacactcatactgctacaataccgataactaaccaacccccaagttgaccccctgctacctgcacccagcctactgccgcgagacacctacggctcacactcaacgcacgccagccacaccccttccgcctccacaacacctcaactgacctaactagcccaagacagagcctaccctgaaccacggcacacctccacgaaacatgagtacccagcgcacatgcacacgcgcgcacacacaccccatggcgcgggcactctcgcagtcacaaccaccacgcgacgtgccctttaacaacgacaggcctaccgtgaccgctagaggcctatacacgcaactgtaggcgccgaccccgcccatgagcgtgcccaacggctgccgagacaccgtcggacgacccgggccaacaccactggacgcgcgactgcccgtaacgcggtacgccgcgagaccgctgctcgaacactcacaccgactcccacacccgctcccagccaagctccagtcgaccaggcgtacccaaccgcgtaaccatacatcggcagaacacaactgctcccatcaccgacgggcactgtgattcgcggccctgagctccacacacttcacgaacgcgccgtcacccgcgcacctgcctcccgtccctcccagcagacatccaatgatgtggcccagcgaagaag

SEQ ID NO: 644175 - DNA, 579 bp, Homo sapiens
gacccggtatgttagtaccataatcagtgcctcttcgtaggattcctgagactgagcttgtggcagccatcatcatgtggctcttcggtcaattgtaaggcagatcatgactgggttctggagaactgagttctctaatggaggccgattctgagtcagaacttcagaagacaatggccagcatttaccagacatgcagctcagaactgtagttaacttagtgtacacgataacaacaggagccagcacagggaagtgttcctctcaagtacaggcaggcccaaggagacatgcatctgataatgcatggtgcaaaatcgagaccatcccagcctcatactcgaaccacatgtgacagtaggagtggcatgcagttgcgaaatccaaacaatttagttgaacactggaacactacccattcttcgccttggtcacttttttttactaaattgaaccgtgatgactgatgatcgaatacgtggtttaaccaagatgagcagacttgacaatcttttcctccaggcactatgagcataacagtatggatagtgaactaggtaaaactctgtagtgtttgca

SEQ ID NO: 644176 - DNA, 191 bp, Homo sapiens
agcgacttctgcgggactttcacccgccacggagttctggggcgggagagtcttctctgggcatggcgcctccttctcaggcgaggagggctctaggggggacctgtcacttggctgcacctcaggctacgacgccaggtgcccgccatcctccgctggctccggcccctgctcagctacctgctgccctc

SEQ ID NO: 644177 - DNA, 732 bp, Homo sapiens
agcggggcaggctggtctcaaactcctgaccttaagtgatccacccacctcggcctcccaaagtgctgggattacaggtgtgagccactgcacctggccatggttagttgttctattcattattgaaaggagggtgttgaatttttcaacttttattatttaactgtctatttctcacttcaaattctgttagttttgcttcatatatttcgagactctgttatgagtgcatatgtttataccgtgttatatatcttgataaattgacccttttatcattatataaatgccctccttgcctcttgtaacaatttttgtcttaaagtctattttgtctgacattagtagccactccagctctctttgggttactattttcatggaatatctttttgtgtcctctcattttcaacctatgtgtgacttgaaagcaaaaatgagtatcttgtagctggggtataattgggaaatgttcacccattctgcaatatctggtttttaaatgaagagtttaactctattttatttaaccgtgattactgatcattacttctgcattttatcttggttttctaaatgtcttacatatatttgttcctcagttcctgttattccccttcgtttgtattacaaaatatattgattgctttcatgggagtgtccggcagtgtacaaagaacgatattttaacaggaaccatttgattccattttcatttcttttactataaac

SEQ ID NO: 644178 - DNA, 175 bp, Homo sapiens
taccgcaagtacttgaaagtagtagatgcgcagaaataggtcctcaatatttacacaagttgacatgtttgttcaagtcagcaagctctatgtgagtctcaggaagtgaattaaattggaccttatgttttactcttgtttttttttttttttttggattgtcccttggccgcgg

SEQ ID NO: 644179 - DNA, 243 bp, Homo sapiens
aaaaccccaaaaaccaacaaaaaaaccctcccttcccaggaacaaatagaattctgggaccaaggtcacaccagatcgggaagaccccttgcccccggggcccagggaaaggaaacacagttcaaggtttgggtgttttgttcaagggaaactgcccccctgccctgagactccaactcacgggccgtaagggttttttttttttaaagttttttttttctttttaaaacccaacccatccta

SEQ ID NO: 644180 - DNA, 335 bp, Homo sapiens
tggtttccgggccattatgtcccactgcacacattcgagctgcagatattcactttcacatgcagggtcatgtctaaaaactgaaccctgattgcaacagaagccagttagaagattaattagttaagtatttaatcaattaatcctgaattaagatcccattttggctttactagccataaccatttctttctttgaactaaaatcttctgccttcatttataagctcttaaaccacgtgtttgaatttcctcaggtgggctggaattttacccctcttgtgttgcagaagtgtaacttaaatgggccaatattttcacctacggacattcgta

SEQ ID NO: 644181 - DNA, 392 bp, Homo sapiens
atggcatgtagtgaggacacttaggcaagaggaatcaaaagcccagctacaaatagaaaagacttgcaacatgcgtgacgtgaagaaagtacaagcaacttgaaacactgcaaacaagttagaagtagctgctaccttcaagggcaaatagtggaggttaagagagaaacttgggtgtcaatcaaactgctttccaattggaaaagacatctgttgctttaatctcgggtgtcctgctaatttgcaccacatgcagctatcctgggcttcagtacaggtcaaagcttattcagcgatgatcattagatctctgagtgctgtcatatgtatcggtacgatagttcatttgcagttctcatttacatatctgacttgaaggaagtatctttgtg

SEQ ID NO: 644182 - DNA, 281 bp, Homo sapiens
gggttaaaaatttcaatttttgggggaaacccaaagaaaaaggaggggggggttttccccaactccccccccttgggggggcaaaagggggggggggggggggggccaaaagaaaaccctttttttttttaaaaaggggggcggccggggggatattggcctttttccaaaaattcggggaaaaaaagggggttttttcttttattaaaaaaaaaccccccctttttttaaatttttttgggggaaaaaaactgccaaaaaaaagggggttttggggccca

SEQ ID NO: 644183 - DNA, 331 bp, Homo sapiens
aggatccggaatgtgtggtgttatgagaatagaacagtcgtgaagcacatttaatcgtatttggtataagacctaattacgatttttggcactctcatggagagaagccatttagcagtgttgaggatgttgttgatgatcatgataatgataatgacgacgacattgatgatattgatgatgaaatcgaggaaaaagaagttccacaataagatgaacgagtggaggttattggcgaagaaatctgatgcgaagatcagtacatggaggatataataaatgatttatatccaaatattagtctttgtgaccatcataacaccacacaatt

SEQ ID NO: 644184 - DNA, 1386 bp, Homo sapiens
  misc_feature (293)..(293): n is a, c, g, or t
  misc_feature (319)..(319): n is a, c, g, or t
gatggaagagaactttggcgttgaagctgcttaactaccaagacagtaatgggcagccgtgctcggtatgaagattcaggtaagtatgtaagggacggaatatggtctcggtcaccgtttcgctgaatacctagaggacccttgtcgtctacattgtttaatgactggcgcctctgcagcaattgaaggattgcctacgatacagtgaaggctggcgtagaacgtgcgtgaggagtaggcaggagtgttctctgtcactctatctgcaacatggtgtttctcgtgcccttganacgcatgagggtgaaacgtataatcntggtagttacatcatccacctcgtggtattgattcctcgcatgcgtcaaatataggagacaactatgcttggattccatagtaccgtggtcttgatacaacatatagcatgagatcgcgcacaagagtgattacatacgaaacaaggtatatacatctccatccaaagaccatcgcacttgaattgagagcgtatagatacaattccacaagagacatatgggctacgacgcacttgctcagtggcatatggcgaaaattgcaatagtattagcgctagggcaagaggtagaataaacatacgacagggaatatgccttatcaatcccttatagacatgcaaggacgcaagcggtattctcaagaagggtagcccatttgtccctggtgaagttgtgatttttcccaaggggaagcctgggcggagaatggatttgaaggaattttttgcggcaaatttaagggggaccacgttagcagggccttacccattaagggattatatccgtttgtaagaagctataacccactggtcgggaagctcttccccatttaacccgtagaggaagtccctcaaccgaaaaccgcacagcacactggtttctggaccgagagcccaatttaagggtctcgtaaaggcggatattaaagcatcggaagacacacaatttctttctgttttggccgtgacgaggaacactttaaccgtgtttttttcacaaacaccggggtgaactcctctctgggacaattaacccctcagtttgtgaaaagacacaccattggcgtttctcttgggatcttttctgttgttccccacagggcctgagaaaggtgaaatctccatgagacccttgaagaacagtttgtgcgactatgtcctgttggccattattccacatcgtccacaattgtgttctttgcgggcagcagaccgacagttgtccccagaaagcatagagaacaccgtattaaagcgcagaggggggcgggcgagcggcacaacatagagagaaatacacacagcgctcgaagagtgggacacgcacagatggcttatctggagaa

SEQ ID NO: 644185 - DNA, 155 bp, Homo sapiens
gtgtgtcactaaattccttgcccttgagcacagctgtacctcaaccttgttggaataattgtagtcctgaggccgctttcattctgttattagtgaatataaagatagatgtttgtgtcacttgctctggtgagttggttttggtcttggttgtt

SEQ ID NO: 644186 - DNA, 249 bp, Homo sapiens
cctgatctgttcttatacagactgtgggggacacaactgtgtgcacgtacgtgctacatttccagtagatcgcacctggcatcacaagctcagcttcatcttagggtcctgcttgactattacaaacagactaattttaagtcctaggactcaaaataaacatgattttttgaataatagatctatacatcaaaaatacatctacaacaggcattggttcgtgctattaaaagagctctcacgtgggga

SEQ ID NO: 644187 - DNA, 548 bp, Homo sapiens
  misc_feature (238)..(239): n is a, c, g, or t
tggacgcagtacactggatatcattttaaaatctagagttgtttagcactgagttgatgaaaagacggcaggattccattaagttcaaagttctctagcattggacagaaaagccatctacatgtaaccgattttcatcaagttcagaggctcaaagatggaggtggaaaagacagacctcaatgaagagccggagaaactcaggagtcaattgagtcatcagcccaggtgggttcanncctgtggatccccggtccgaggctacaggactctcctcccagggatccaagtgactgtgcagtgaccgtggtccgccacagccaccagccagagtgcagtccacatcgtggccacgtatggctcctacaatctcaagcttgccgagaaggcagccgtaaacccgcacaggctcagcgatctggggtcccgagaatgattttcctttcacaagatgaacatgcagctcaaagggggagtgggatgtggttgcggcctcaactgaacgcctctctggacccaataattaaaaggacttgctcctcagaaaa

SEQ ID NO: 644188 - DNA, 140 bp, Homo sapiens
tcgagctcggcccacatttcgatcgcggagaaaggcctcaagcaacaacttgcatgctgggactggagatgtcgtcattccagggatcttcattgccttgctgctgcgctttgacatcagcttgaagaagaatacccaca

SEQ ID NO: 644189 - DNA, 547 bp, Homo sapiens
  misc_feature (436)..(436): n is a, c, g, or t
  misc_feature (470)..(470): n is a, c, g, or t
  misc_feature (508)..(508): n is a, c, g, or t
  misc_feature (522)..(523): n is a, c, g, or t
  misc_feature (525)..(525): n is a, c, g, or t
  misc_feature (527)..(527): n is a, c, g, or t
ggccacagagccgcgggaccatggcacctgctggacgcccgggggccaagaaggtgagtttcgtcccctcgatcctcgcggagctcctggccgctgggctgcgagcgaatccgttcacacccggcgtgcattcctagacaagccctggggcctcggcaaaacacttggacgggatgggcctgagcctgaatttttccctgtcacgggttgtgtagcgtttatggagcccttactcggtgcctggcgctgtacagagagctgtgctcaagttatctcctcatcttcacaattatccccatttcacaggtgaggctgaggctcggcgagtcaggcgactagctcatggtcacgggtccagacccgcggggagcgaggatcagaagtctagctttcggacgcatgtcgcgcacacatttattttccttaaccgaccctnggcccgagatctttgggcttaaaccgaccggganctcttttgactgtaccctccggtttggatagtaggctnggcacacccccagnntntngtgcgttggagggggggcgg

SEQ ID NO: 644190 - DNA, 980 bp, Homo sapiens
  misc_feature (35)..(35): n is a, c, g, or t
agcggctttaaatatattatttaattgtaggaatnggtttacacagaacttttttggaatacatctcttagtaaagtgaaatataataatataattgtatttagttactattgtagataacttaaacttgagtagtgatttactgttttataaaatgctttcatatatgttatctcatttgaacctcataaccagccctgaaatagtaaaaacaagctatattcccactttataaagaatttgaggttaagataaaaggactcatttaagctcacatggtcagtaggtggcagagctactagtagggaaagaagaaagctagcattaatgaatgcttactatgtgccaggtactacatcctgtcatttaatcttaacctagtctgggagatgcgtaatataattctggtgaagtaatagtttcagtggatgattgaaaacaacaacaacaaaaacaaaatgaaactaatctgctgcctctaatttccaaaaatgtaagaaattttacaattgtgaaaacctcatggatttgggcaaactgaatgtatataggcttttgacaaaagttggaaaaaagtataaaaggaggcctattcttttcagttgaccttttgtaatatttgatttagagtattttggacaaatgctctataactctaatccatttattttgtaactgtacttaaaattttgaatcttgcaactaagtttagcctcattcagaatttttttattttgtgagcataatttattgttttaaattaattttttagcagatagcagttagcacttaatctgtaaattgaataatttatcaagtgcaggaatgtgttaatctaatgggttttgacttaaatgcaccaaagatttttagtaggtattaaatagtttaaaagactttaaattctttcttgcttgaataactatttgtccaaagaagcacagttgaagtcctagaataatggatttttttaaaaaaaa

SEQ ID NO: 644191 - DNA, 170 bp, Homo sapiens
  misc_feature (1)..(1): n is a, c, g, or t
  misc_feature (80)..(80): n is a, c, g, or t
  misc_feature (86)..(86): n is a, c, g, or t
  misc_feature (103)..(103): n is a, c, g, or t
  misc_feature (117)..(117): n is a, c, g, or t
nctgctggctgcttttccgcaactgggctgggccttcttcggtgccgggcagaaggggacaaggcatttcattcttgggnaagtgnccccaatcctccggtgncaggagaaattttnacgtgaaataagtatctcggaaagatggtacgaaaattgagaaagatcccaac

SEQ ID NO: 644192 - DNA, 154 bp, Homo sapiens
catcagatgagggtacgctggtgggtgggggtggttcgttctcgagccagcagactctacactccatcataggacatcgagtccctcctcctcttctcccatgccttgtgtgccacgcctctctgggtcccctccctggcctttgacttcctct

SEQ ID NO: 644193 - DNA, 329 bp, Homo sapiens
  misc_feature (136)..(136): n is a, c, g, or t
  misc_feature (145)..(145): n is a, c, g, or t
  misc_feature (152)..(152): n is a, c, g, or t
  misc_feature (154)..(154): n is a, c, g, or t
  misc_feature (166)..(166): n is a, c, g, or t
  misc_feature (173)..(173): n is a, c, g, or t
  misc_feature (177)..(177): n is a, c, g, or t
  misc_feature (179)..(179): n is a, c, g, or t
  misc_feature (186)..(186): n is a, c, g, or t
  misc_feature (190)..(190): n is a, c, g, or t
  misc_feature (208)..(209): n is a, c, g, or t
  misc_feature (215)..(215): n is a, c, g, or t
  misc_feature (218)..(219): n is a, c, g, or t
  misc_feature (222)..(222): n is a, c, g, or t
  misc_feature (230)..(230): n is a, c, g, or t
  misc_feature (301)..(301): n is a, c, g, or t
agattcaggagaaactgcagcagcctcgattcctgagcccggcccctccatatccttgagatccacttcatcatctagccataatgctatcataaagattcctgacttggggctgagtttaaagatattaggcccngcctggccnacatggncnaaccctgtctcnactaaantacnanattagcngggnaatggtagtgcatcctgnnatcccngcnnctngggaggcngaggcaggagagtcacttgaaccccggaggcagaggttgcagtgagctgagattgtgccactgtactccancctgggtgacagagcgacactgtgtctc

SEQ ID NO: 644194 - DNA, 357 bp, Homo sapiens
gtcacctctcccttctcccttctagaccctcattgcagaggggtcctgctccatacccagaaggaaggaatgccacccagaaaggccaagaagaatctgttgaggcaggccttgagggtttcccacttcagtccaccaccattaggtcagaacctttcatggaatctaagtgtaaaaagttttccttgggtcttcttttctgaagactctcatgtcagataaaacttacatatctgttatgcttttctcctgttaacctagctttttgtatgactacagccatacctgtgctacagctgcctgcatgccttcccttcccttcaaatactagctgaacctctgaccaaagatatggcc

SEQ ID NO: 644195 - DNA, 1256 bp, Homo sapiens
  misc_feature (1255)..(1256): n is a, c, g, or t
taaggggagcgcgcgaagctgaacttgtgcgctcgatgggggccgttagcctgccctagagctgcgcggagccgcagaggcgtagctggactacaacgcagtgcatctcgtggagtgccaactcgactggactggccccctcatgccctggctgctgagctgccctgtgggcacctgccctggacatgtgccctggcctgcctgagctgctgcccagctgctgaaatgggagcacctgtctgcacctgcttggatggtgtgtgcctggtgtttgcctgccatgggaccctgcccctgctgctggatcctgcatgctgctgctgtgtgaatgtgatgtacatgcctgaccctgcctgccgtgcaatgccccggtgccccctgcccatgccagtttgctgtccgtgccactccgttgcttgcttggccacctgtgctgctaccttggcctggtgaggttggctgtgagagctgcctgacatctgccctgctgcctgagtgtggccagcttctgtttggcagaccgcttgcgagcttgtgcgcctggacctgtgcgctgcagggagcgggcgacgccgaggcaggctggtggtgctggaggcggcgctggccacgctgctggccgtagtggcgcggctctgggcccgacgcggcgcggggaccctgggacccggtgctgctgcatggcccagtgtgcaggagggcttcggatcggctgctggtgctgatacgcgcggggcgcggtgcgaagccccgacaaaccgctttccaggggcctctttcatgctctataacctgggctcggttggaagccttgaattgaggttctacagatggctgttggcttgtgcgcctgcctgacatcgaaaggcttgggggaatgtgctccgagagggcatgtgcgccttgaccggttggtcagaacatgggctactggcgagttggctgtgactgccttgtgggacagccagcgggaaacctggggcggatagatcgggggcttagagccccatggggagagattggacttgggttcagggaacaccttggcatgtgggtcgatgaggagagaactttgtagaacacggtgagctttagagaaaggagatgtgcatgcacgagcgagacgaaaagcgcagcgacgcgcgtactgaagtgagaggaatgaagacagaacgatggaggcagcgaagaagagagacgcaaggacacgaagcagacatgtagattgctactgccgacgtgctctctctaagcnn

SEQ ID NO: 644196 - DNA, 344 bp, Homo sapiens
cgtcgacctggtttcttttattctgcaatatttttaaaaatcacattttcagccaggcgcagtggcccacacctataatcccagcactttgggaggctgagatgggtggatccaaaggtcaagagatcaaaaccatcctggccaacatgatgaaaccctgtctctactaaaaatacaaaaattagctgggtgtagtggcatgcgcctgtagtcccagctactcggcaggctgaggcaggagaatcacttgaacccgcgaggcggaggttgcagtgagccgagatagcaccactgaactcaagcctggcgacagagcaagactccatctcaaaaaaaaagtcgac

SEQ ID NO: 644197 - DNA, 1175 bp, Homo sapiens
tgggggaaattggggggcttccatcttatatctcccacaaaaaaacggttatatataggaacccgcaaaaaaaaaaaaaaaaaaaaaaaaaaaaaaaaaggaaaaagaaaagaaagaagcacaagaagagcaccgagacagccgcgcgggacggtcgcacgctgtactagtgggggtggctgttacaggacggcgaccatcccctatgcagacgagacaggtgcgtgccgatcaaggcggtcacacacgccgcattcaatttccatgtatgtctaatcaaaataccataaaagattaatcatagatactagacatttactcgcacatacataatgaaacatgaagaaaaaaacatatctcacatactccgtcattacaaaaataattcatgccgtcactatctattatgactatactcacgcaatccagcagagacgcgaagagagacggacgcacgccacactgcagggccagtgacgcggtgggacggggggcgactcgacgcggcccacagcgacgacaaccaagcgatggtgtggtggacggcaagcggggggcagccgagcgcggagggggggagggataggtagggaaaaaagggggggagggaaagagaggagggaagggtataatggcgtgagggtggggaggggagagggacgggagtcacggaaggaggaacagaagaagaattagtgtgctgaagacggcggtgcggcggcgctcgggggtggcgtagtggaggaggagagggtgggatgattgcaggcggggaggcaaggggggcgggggggcggcggccgcgtgggcgagggacgggcgccgaagcgagaggggggggggaccggacgcgcaggggggtggtggctgcggagacggcgagaggagggtgggaattgaggtatggaaagtaagcgcgagaaagtaggggtgatggtgcgagggggatgcgcggcgcgcggcgagggagcgagacggccggggaggtcggaggggggacgacgccacacacacaccacgccaagaagcaacccagcgaacgtagggctgacgagagagagtgaggagtgggagatgagcgaaggcaccagaaagaaagcaagcaagtcggtccggcgaagcagctccatgacaggcgagaggacaggcgaccgacgaacgagaaagcgacgaga

SEQ ID NO: 644198 - DNA, 91 bp, Homo sapiens
ctcagccatccagcctgtctctactgggccccacttctctggatcatagaccctgcctctgtttgaccccgcactgactgaataaagctcc

SEQ ID NO: 644199 - DNA, 1473 bp, Homo sapiens
gtctgtgtttacttcgtcggtgcttctgactgcagtatgttgtgttgtttgtctcttgtctgcgtcactctttgcctccttggtcatgttatgttttgtttcctgcccagcttcctctttcttggttggttagtctgtcatatgtgcggcgtctctctgtgtacttattttctcgtgcttccgcgtttgtgttagttgttggttctcttctatctttgcggttctctttcggcgtcgtcatagtatccgtgcgatattttatgggtgtcggctctatagtatgtgtctcacgctcgtgcgtatcggtttcattcttcttcacatgccgttagggctttttcattccgcttatattttctccttgtatatatgtgggtcacgcgctatcttcgttgtatgtcctgggtggatttcggtcctcgtgtctctcgttgtcatacttttttgggtcgtctatctatttttggggggcccctcctcgtttctcggggttttctctgtcttactgtttgtggtatcactctcctcatggatgttcgggtcccgattcattgttcctccataatctttaggtgtgatatactttcctttgtcttggacgtccatagtccaaagccccgtctatcactgggcgtctattcttgggctgcgtgcaagttggtattcgttctgtcttaaggatgtgaacggattaaccagtcctacggactcgccaggccgaagtgcggggcgtgattcagattacctgttcttaggatcgtttctatgtatcttaacttagtatccattctgggctcatattagtatgtgtgtccggacctctgtcttttatctttgtctatagcgttcacggcgttcctaggattcaacagttctttcggtatcataggagcgataagtgtcgtattactctctcgtcgtcactgcatgctatggttgtctattgtgtggacgtaaggttcacagggtctagtctattttccatcgtactgagtcagtagagtcttatcgtctacgtgtcggtaggagtcatagagtcagctctccacctctagaagattctaggtcatggttcgtattatataggtattcgaggtagtgtccaatccccgtcgtaggtcaatgtattcaagtattcccaggtctattgttcacgtacccatacgatagcagccgtatcataagtccagtatctcctatctccaaaaagatagtcgttcccctatcaggcatagtcctcgcgagaagtgcatagtcctgaaagaatggtactggaagctgctcgaagttgcaccctttagggtaacaagtgtattattgtttagcattattataagggatttgtgatgtgctgtaaagtgtaacctaggaaagatgattcaaccatctaatcataaatggatctggaattaactaatgtaaattcacagcagtaagataatataaattttgttgaataacatcgaacgtcat

SEQ ID NO: 644200 - DNA, 589 bp, Homo sapiens
  misc_feature (2)..(2): n is a, c, g, or t
  misc_feature (14)..(14): n is a, c, g, or t
  misc_feature (560)..(560): n is a, c, g, or t
  misc_feature (571)..(571): n is a, c, g, or t
cngtctcgggtagnctttatcaggcagtgtgaaaatggactaatacatcagacgagtcctttcattacccatgataaagtgaggcaacaaacaccacccactctggagccttgtctaagcagagacaacaacagtatcacgtgcaaagtaccaaaacgtgcccttctcccatctaagaagaatggcaggtgcttccttacccatcacagcctcattctgactttcctcccctacgtaagattccttaggttacacagagaattacctctgcagagaaaagtcccccttccttaaactcttccccccaaatcaccaagcacaagcccagatcaccgtggcatacattctcctttgtgacgctgagcgataaatccgacttgcttaactatagatgtgtactcagtggtcttcaatgctggagggcactgagaaattaaactatattattttttgttgaaattaaactatattatttttgttgtttttcatccactttgtgtgcaaaagcccacggtactgacaggtgacaacgtgctagcagccctcgcttgctctcggcncttctcggccntcgtccactctggccgcg

SEQ ID NO: 644201 - DNA, 137 bp, Homo sapiens
gcggccgcctactactactactactgctcgaattcaagcttctaacgatgtacggggacatggcctgctgggcttggctcggcgcccccacccctggctaccttgtgggaataaacagacaaattagaaaaaaaaaa

SEQ ID NO: 644202 - DNA, 937 bp, Homo sapiens
  misc_feature (871)..(871): n is a, c, g, or t
tttaatcagtagatgtcagagttatacgggcagcattgagccttctatgcttggcgatttacgaaataatagattggtgtcattctataattgcgctagcatcttagatctgagagaagatctgtatacttgtaatgacggaatggtgttgacgagacaaggaattttgttaaaaagctatatcttcactgttatgtgtaacgacgattatctacattctaaggaaattgattaaggatcccccaccctggcgagtaggtacccagtataaagatacgggactcaatagatgttacagccaagttttggaacgggcaaactatatttcgttaatgagaggccagtccttcatgtcaagcatttaaaatgacttttagcgaaaattattgacacgtggtgggagccgtagccaagagattgtccctcagagtgggcccctaggattacagcgatgaccacagtattgactgtgtgcccactggctggttcccatataaggagtagtctaatttaagaaaggcgaaggcggctgggccagacgattacttgaaacgcgatcttgggcacggggtgaacacggtgacttacctgtgcgggaattcctctgacgctaagagtatacctttataatcccagagtgatgtttgcgacataatgtggcgtcaccaaactttaccttataatggaacatcctaaaaagctgctacagagggtacaatttttacaccgctttttattaagggggcgactcactgcgtgctttaccctctttagaccggactaagttgcttgagcggcttgagcacaacgcatgggggcacaacgacgcaacgtacttggacgcaaacacttctcattacgccgacgatangctaaaataataccggccatctcacccaggtgtacacctcctcaggaacacctctcatcggcagcc

SEQ ID NO: 644203 - DNA, 102 bp, Homo sapiens
  misc_feature (37)..(37): n is a, c, g, or t
  misc_feature (79)..(79): n is a, c, g, or t
  misc_feature (88)..(88): n is a, c, g, or t
accagcagcctcggggggcaccccccgcccagcctgnctccctcccgctcagccctgccagggttccccagccatgaanctcttccgnttcctgggagacct

SEQ ID NO: 644204 - DNA, 467 bp, Homo sapiens
  misc_feature (108)..(108): n is a, c, g, or t
  misc_feature (130)..(130): n is a, c, g, or t
tagtactgtgagagggattctattactaacttctggaataggatccttcaggagagtatcatgctcttctggacatcttcactcaaaggaggcccttgagaagagcanatcaaaacatcaataggcaggnttctgggatctcttagtttcatctctcatttttatatgggaaagctgagacccagaaaagtcaggggttttgtttccctagccttagactcttcattcattcattcattcattcattcattcattcatttaccttacagatatttattaaaaggcgtactttgtactggatactagttgctggggatacagcagtgtaagggtctctgcgctccggaagcttataatttaggggagggagaccgaccataaccacaaaataagtaaatatatcacgtcgagggtggaaaagctatagagaaacgtcgaattgaggggtcccgggctcaatcgtaaca

SEQ ID NO: 644205 - DNA, 173 bp, Homo sapiens
cagccgccaccgtaggctatagtgtgcacacattcaaacagcagacagagctatttatatagaaaggctggaatgagggattatgagctaaagcacattaacttcttgtcaactgccacaacaaaacagaactgagcatatgagtgttagtatactgaagcgcatgttatacc

SEQ ID NO: 644206 - DNA, 392 bp, Homo sapiens
gtcggaggataaccgaggcgttgctggaacgagagatcccagtgatggtagtctctgagagtcgatgacggggatcgatcaacaggcagtccgaagcgcagcgtcggatatcgagttgcacgcgcacgtgcagtcatgccattgcactccagcctgggcacgacagagcaaaatccgtctcaaaaaaaaaaaaagaggtaaccatccatcagggtaaacaagattatactggggattggtcaaaataatccttggctacttttgaatggtggaaaattattctcaaaattccttgaagatagggtaacgggatggcttaaaaatgattgattgacttgcaaaattagcaatatttcttgaaaaatattctggcatgatgtatactatatata

SEQ ID NO: 644207 - DNA, 381 bp, Homo sapiens
tactactactaaattcgcggccgcgtcgacggctgggcatggtggctcacacctgtaatcccagcactttgggaggcccacgcaggtggatcacctgaggtcatgagctcgagatcagcctgttgaacatggtgaaaccccatctttactaaaaaaaaaacagaaaaacaaaattagccaggtgtggtggtgcatgcctgcaatcccagctacttgggaggctaaggcaggagaattgcttgaacccgggaggtggaggttgcagtcagcccacatcacactattgtgctccaacctgggcaagaagagcgaaacttcatcaaactaaaaaaaaacgtcgacgcggtcgctaattcatgccctgcagatggcgcatgctct

SEQ ID NO: 644208 - DNA, 225 bp, Homo sapiens
  misc_feature (39)..(39): n is a, c, g, or t
catcctcagcacaatatttctttgtgcttatatatgtgnggcaacagagatatatcgcacattataaatatggtttggtacaccacgcacgctctttcgcttgagagtcttatgaaagaatatacgaaaccacatgtcactcacataatttaaaatgttccggtaatgtgatgcctcaggtctgccttttttttctggagaataaatgccgtaatcctctcccca

SEQ ID NO: 644209 - DNA, 200 bp, Homo sapiens
ctgcttaagcttcaccgctatcttacccagagagaccacgtctgtctctgcatccagtcatagaagttctgggcattgtcgagtggggtctccctcaccgtaggttgccatgcagaaaaccaccaggacgttgtcgatctctggcagagctgctacaggtcggccagcgtcatactccgtcaggatccgcatgactatgc

SEQ ID NO: 644210 - DNA, 93 bp, Homo sapiens
ctagaagattcagcaaagtacttttgtgctcttggggaacccctcctagcgtcacacttctgggggatacgcgaatatgccgataaactcact

SEQ ID NO: 644211 - DNA, 282 bp, Homo sapiens
acactaacttcactcctattaagacaactaaaagcaagaagacagataataacaaatgttgacacgaaatatcaacgctcataaactgctaagattgtcaaatgcgactgccactttggaaaacagtgtagcagttcctcaaaagattaaacattaagtgaccatatgactcagcaattctactctcaggtatatacccaatagaattagaaatatatgtgcaggccgggcgcagtggctcacgcctgtaatcccagcactttgggaggccaaggtgggtgg

SEQ ID NO: 644212 - DNA, 836 bp, Homo sapiens
atcccggcgactgacatgaataattacaagaggttggatcatctatgttggctgattaccatattgtacagcacatggcattagttacgcacttctattaaagttctatctacggaaatgtatttcgacagttcaatgcatgtgtcatattctggtcacttcattatatatagaatatggcgtacatgataatgagggacgagtatagagccacttaatcatgtgtcaggtcctagattagataaattttagcagctaagtcaggtctcaattcacttttgcacagttatcaagagatgtacatttccgatcagttaaccatttactattaatgtggcaagttttagcatagtctgtactcgagctttttatttggttcagacctacttcaaatagatatactttaaaagggaacaagagaagctctcaacatttcacaattatgcatatgttattgtagccattttcacacgtttctttaagaaggtgtaaacctccatgtgtccttgatagtttgttactcctttcatttatacaatactgataccaggagatttcttttaagattctgagttagcagagttcaaaactatttgtgtgggaaacaagccaacttagtaacatatgcggcaacacttctggtttagctaaaattatttttccaatgtaggaaatccacactgtttgtacgtctgactgaggagaaaagatgctcgtctccagcagagaaaagtggcacagcattgtgggaaggtgatggtctccctcctccctccccatttcatgtgggtacgtacagggtgttcggaccttttacataaacctttttttacttc

SEQ ID NO: 644213 - DNA, 394 bp, Homo sapiens
  misc_feature (162)..(162): n is a, c, g, or t
  misc_feature (342)..(342): n is a, c, g, or t
  misc_feature (389)..(389): n is a, c, g, or t
acttttagtagagacagggtttcaccatattggccaggctggtctcgaactcctgaccttgtgatccacccaccttggcctccaaaagtgctgggattacaggtgtgagccaccacgcccagccatgtcgggtgctttctctcactggttgttaaacttggnctgcatgtttgaatagctagagatttttaaaaaatactgatgcctggggcctcaccttcagaggatttaggatacaattattgggggtcccaggaatatttttaaagataggtattgtcataagtatttaggttacggttgcacctttcaaaaaaaattgtagggatttacctttaaggncccaatattttaggggttttggaattatttgtgggatggaaaaaacncctaa

SEQ ID NO: 644214 - DNA, 165 bp, Homo sapiens
tttagtaggaaagtggttctattgtgaaacaggagttgtgcctttgggccagatgctgggtctgggtcagcatggacatgattctccaaatcttccatcctcggcaaggaaatatgccaccagggtcaacccacgggcaagccacggtctacccacaagccacgg

SEQ ID NO: 644215 - DNA, 219 bp, Homo sapiens
atgcccggccagagactcaaatttctaagggccattatttaaaggctaatacaatttattttaaaaatattttaagaccaggcatggcggctaacgcctgcaatcccagcacctcgggaggccaagacgggcggatcacctgaggctgggagttcgagaccagcctgaccaacacggagaaaccccatccccgctaataatacaaaattagctgggcgt

SEQ ID NO: 644216 - DNA, 1205 bp, Homo sapiens
cacaggacactgacacagtagagcagggactttttacacacgtccaatagccaaactacgaactttcaatctatgaactattttctacacccactcagaactgagtgaaacaacttctacttatttggctgtacccggctgctacacttccataaaagtcttactctttctcttctccattccagggtgcaccgtctcttactcaattcttatatccagtgcccattgcgcggcgctgctcaacggtttcaatattacgttaacactttcacctgtgctccactctacacgaacaagccgcctttgctctcacaaaagtgctctcaaacccgctcacataccgacacagggcgcgcaataactctccacgccaccctcctccccccgtggcttaccacaccctcctaccagcgcttcctctacgtctctgatctccctctcacgcacgcctcctcaagcgcgctcccgtggctaccagtttatactgggcgctcttcgactcactctctatacaccacaaccctctcctcacacacccccattaccctcactacataccacataccgtgcgcgcgcatccaacgctactccacacaactatctacatccttccccattctcaatctctccaacaactcattcccccaccccacggtcaacccaaccctccaccactccacgggactaccccccttcttctcttcacgcctatcctattccccaaaacgtctgacacttgtgtcccctcctattcagttccccctccgtctggcttacaacacgacccatgttcctaacgaggccgtctcacctcgaccccttccctggcggcacaccttcctgccgcacaccaatgtacaccgcggcatctgacctcggcgcctggtccacccaaatatctttaccacacatccccaccaacccacccccccccacctcaccgccccacaccccgcacaccccccgcaacaccccctcaccgcacaactagcacacccgtccacaccacctcaccccccctacgcggcacaccgacacaacgcacgcccacacacgcgcacgccaaccccagccaaccctccccccgccccccaacagctacacgtaagccgactaccacacggcagcacgacacacactcagacacgccaacgacgccctagctcgcccacgcaacacacacactcaacggcggctccacacca

SEQ ID NO: 644217 - DNA, 475 bp, Homo sapiens
acgtcatagctcaatgcattactcacaggtttgcggtcatgctgatgtaaactaacctactgcgctgccaggcttataaacgtctagcacatacaattacatacagtgcataatatacttaataacaaatgactatatgactcctttgtgtatttactatactatacttttcattgtcattttagaatgtatttcttctacttacaaaataaaaaagttaactgtaaaatggccttaggcaggtccttcaggaggtattccagaagtcactgttatcacaggaggacagctccatgtgtgttattgcccctgaagacagtgggacaagatgtggaggtagaagacagtgatactggtgatcctgaccctaacgtgtgtaatgtgtgtgttcgtgtcttcattctaagaaaacgttttgtacagatgtacagtgtgtttgagtttaagctaagtgttatttcaagagtcaaaaaga

SEQ ID NO: 644218 - DNA, 1413 bp, Homo sapiens
ggcgacacgctgggcgaggggacgagaggctaacagattgtgaccccggctctccaaggcaggtgctgacactcactcatcactctctggccggacacacgaaaagtgtgaggctgccaaggcaacgctctggaggcattggcttcctgtcaccacttgaacgctagaggtgccctttgaccttcaccgcttacgctctattggcgcagacaacggcacagctggcgactccgcacagcactgcactggcactgacgctctctgagcgctgacaccatacaactgatcccgcgcaccctggagcctgccagctctgacactcactcgcccatccacggcgcccatcgccatggccacacactcccgcgcacacgtgggcccaacggccctgggtatcctgccatggcgagccgctgctggcaagcgacgccttaacgaggggcaccggaaggcatggggagggcaccccggggcccttgctaacgcggacggctccttacacacgcccctgcaggcgtggctccaccctggctagggaccccccgctaacagttacgcaagttctcccaaatggaactttcactcggcggcaaggcacaagggcgggcggcccagcgtaaaccttttaagcccaccaaagaagttcccggatatggagacccgccacctccaccggcttgcaaaaccaacatcagccaggaactcctaccaccgttggcacctacccgcggagcgggaagtgggcggaaaaaccccgaacgcgcgccccgcgaggggcaagcccgcacaccagctctagaccccaacctccaaccagacgggtgcctaccgggaacacaccaggcaaaaccccagccaggcacaggccgtggacccaaggcgggcacacggcccatacctaacctggcagcaaaactcggcctggcgcggattgaaaaccccttggcatacgccacgcaactgcagctctaccctgcgacaccgcagcggctcccccggcccgtgtcggacccaacacggatagacttcaaacctgccgcccagcacaactccacgttagggagcgggccccccgccggcaccaccaccccccacatcccgccccaaccaccccgacgggcaaccggaaagcccccaagggactcgcacccactcccgggccattcgccccacaacgaagccggcgagcccccacaagaaacccacccaacgatggcggcccacctgcgcgcaccgcggcgacaccccaacgcaccactcggcgccggggacgcccaccggcacccacaatagcccgacatcctggacagagaggacaccaccgcacaatccagaccgtcgcgtgggaccacacgaagggcccagcacagcggaccaacacacggagagacgcccgcgaccgcagcacgcgcg

SEQ ID NO: 644219 - DNA, 103 bp, Homo sapiens
ttcagagttggcgacaatactgaggcgacaataacctgagtttgggttgcagaatgaaatcactcctgaagagagcagtgaaggtctcagcagaagcttcccc

SEQ ID NO: 644220 - DNA, 190 bp, Homo sapiens
  misc_feature (54)..(54): n is a, c, g, or t
  misc_feature (170)..(170): n is a, c, g, or t
  misc_feature (187)..(187): n is a, c, g, or t
ctcacatgaatgcactcacctcctagaaggaccaggcttccatcatgctctggnaagcttgtggagaatgtcaagtacgaagatatctatgagatgttagtccacacctattcatccatggaccggcacgatggtgtcccgagccacagctcgcggcctctccccagctngggctcggttttcccanggg

SEQ ID NO: 644221 - DNA, 123 bp, Homo sapiens
aagtaagacactgtctcaaaaggaaaaaataagataaaatatgagacaggttatgatacaatgttaaatgcaaaaaggaaaatgtaaaatgatacctagtggttaatctcaatcatgtagata

SEQ ID NO: 644222 - DNA, 206 bp, Homo sapiens
atttagatttttctagtgattttgtaaagcagatcatatatggtcccctagttcagcatttttccaaacttgttgcccacccatctattgttaaaagtatcctttgcattcatattataacaaaataatatttcctcttcctggacccaatcccctctattttttaaattcgatttccctttttaaaagttggtcccccctcgcta

SEQ ID NO: 644223 - DNA, 128 bp, Homo sapiens
atggaagagagaggcccatcaccttgcccttcagtgttcaagcaggggacatgcacctctttagtaacctggatcgggacccatctacatgacaaccatgctccaacgaccatcattcatgaagccgc

SEQ ID NO: 644224 - DNA, 281 bp, Homo sapiens
gctcgacaggtgaaaaaggacatatcttcccataaagactagacagaagcattgtcagaaacttactcatgatgtgtgtcctcaactgacggagtagaacctttcttttgatagagcagttttgaaacactctttttgtagaatctccaagtggatatttggatagctttgaggccttcgttggaaacgggatttcttcatataatgccagacagaagaattctcagtcacttctttgtgttgtgtgtattcaagtcacagagttgaatcttccgtcgacg

SEQ ID NO: 644225 - DNA, 1165 bp, Homo sapiens
  misc_feature (10)..(10): n is a, c, g, or t
  misc_feature (219)..(219): n is a, c, g, or t
  misc_feature (545)..(545): n is a, c, g, or t
  misc_feature (558)..(558): n is a, c, g, or t
  misc_feature (739)..(739): n is a, c, g, or t
  misc_feature (788)..(788): n is a, c, g, or t
  misc_feature (1038)..(1038): n is a, c, g, or t
ttgaaatctncgggccactgtcgagggcccggcggcggcgaccgcggcggacacatcagggcgagagcaggacgggcgagggcgcccagcgagcgccaggagcaaggtgagcgtgcgtgaagatttattgtatatatatgtcgactaggcttctgcgttctctgttgtgacacaccacaccatgcccttacgacctgtttctgtcctttggtgttatantatagttggacacccgtggtaggttcgataggtatagattggggagggagggagggcgcgggggcgcgcggcgcggcaacgatgtatagctagagaatattgtttgagtacatttttatgtttatctgaggtcagtgccctcttctctccgcatctccacaactatagacctacgatcacgactatcatgtacgaccatcaaacaatgacgactcacctatctgcgcgggggagaaaggcgactggttgtgggtgagaggacaggaagtccacgagacaccgctccgacactacagccgtcctctaactacgttgggagggtgagngtacgattgtcgnatagggagatagacagtgtgtcaatacaagtcagagtcctcgcgcgactctctgctgaggtgcgacattttgatacgcgtgtgatgttgtgggtgtcgcgtagctgcagaaggtaaggtgacgagtagatcgacgcaaagtagaacatgggcgaatatatctgtctgctgtcatcggatgntatacgatacatgatctagtcgatctcgttcgtatgcacgcgttgctgntgtggcagcgcagcccgacgtcaccagcgacgcgtagcggacactggtcgagcgcatcgtttacacgctcgctctgtgtcacatgataactcgtcacgtaatctcatgaggagtcgtattctatctataatttatgttccacactagtttgttatgatgcgtctctactacggatacaacaatagaacaatgcgctgagacaccaggcaccagtctcgcattcatccacacacacgtatccatgtaatantatccatagtcatgtagatcacagacctggtgagcgacgcgctaaggaaaggctaggtatcgcgactaatgtgcgttatgtagttagttcctacgctactcattgctacagttactgtcctagatat

SEQ ID NO: 644226 - DNA, 925 bp, Homo sapiens
gttaggcatggagctgtggtctgctattgctcatgcgagtgcccggagagacccggtacgagagctacgccggggtccaccgaccgagatctgctgcccgggcccggaccgctcatggcggcatccgcaagaagctggtggtggtgggcgacggcagcgtgtggcaagacgtgccgtgctgactcgtggttcagctaaggacgagattccccgatggtgtacgtgcccaccgtcttcttataacgtatgtggaccgacagttagaggtggacggcaagcaggtggagctggcgactgtgggacacggcggggcacaggaggacatacagaccgcctgacggaccgacatcataggagttatccactctgaggaggccacaaaagccgttaacgacgtaccacagcgcttcacattgataacaaaggtgagatcacctaataggtgaacgtcgataattatacatgcataagaggcacatgggcacgaaacggttaataacgaacgatacgttgaacatgggggaaaaaactggactaagacattggggaactcataatggtggaaaggggaaacactataacattcatggtggatagatgcagccttaagtatggggaaccaaagagagtagacgcgttaaccgaggaggcaatttctaaagaaggacatcttagaagcggtacaaactcgatacaagagttcgtacttaagaaggatggatgaatacaaacgtggataggtttcagcaaaaacacgttgagacctttgggccaacttagttggtcaatgtcactgtgacacatgtgacgaaaaggatacaaaggaccctataaacaatggggggataacttgaagattagtaaattgcaaagaaagataggtaacaataagccacccaagggagaagacataaaagtggaaata

SEQ ID NO: 644227 - DNA, 942 bp, Homo sapiens
gaatgaggcatccacctcttggtgtaagtggcctctgtggatgacgtctctcatccttgaacgcagttgcatagttggagatagcgcaggatcctgtcttcagtaggagggcccgaagcgggttcctctggtgtcaagctctttggaggtagcctggtttgcatgactactgtcccagagcaggtgatgatgaatgatgggtgtgtgcagagggagtgggacgcagtgaggcaggggtcttccagctaggccgctgacgagagcctcgctttccgagcaggcaatgatacatccgctgtgctgaggcaagattcaagactccgataggcatgtctcctgctcccagtctgcttaggaatggagtccttcaggcgcttgagtcccagattttccagtgatgctccgagttaaggcagcgtgataggcacaccccatcgtccagggaaagtgacgttcagagatactatggtctaactgcatccgtgtgttgaaatttgaggaccctgtccccatgatgattatcactcttgtctgcatcttgtttctttgtaggccaggggtatgaaggcctcattcgggtgcgtgggcatgggtcagtccatagacaattccctcactcttgtgtgcataacagcgaactaggaatacactaataagggttacaactgtactccataccgttactgtctcgccaggcattaagctaagtgctttacatatattaaagtgatttgaatcctcataagtgacgctatgaaaggagataccatctcaacccaattgaaagtgggttcgcaagaatcgggagggatgaaggacccaggggaaaatgcgagggaaaatcttgacccggggccaagctgggatgtcttgatgctgggaccaaggtatcacatgttggagttaggaccacctaaaggagattcggggggcgggggacac

SEQ ID NO: 644228 - DNA, 166 bp, Homo sapiens
  misc_feature (51)..(51): n is a, c, g, or t
atagatgagctggtacctggttctcaactgcagttggattaacgtcccccntttttccggcgcttcggcgccgctaatttcatcggcctgattgcgggccgatgctgttttatctgggcggttcgcggttgttaattgcaaaatcggtgatggcaattatgattag

SEQ ID NO: 644229 - DNA, 120 bp, Homo sapiens
gaggttgcaccactgcactccctcctgggctacagaacaagactccatctcaaaaaaaaaaaagtgcttcataaaattccttcatccgtgaacttgctagagcaatgcagggtgtaccga

SEQ ID NO: 644230 - DNA, 225 bp, Homo sapiens
cagagatgatgccactgcactccagcctgggcgacagagcaagacttcatctcaaaaaaaaaaaaaaaaaagctgctgaaatcaggcagcgcctttaaaattcccggcccaggtaatttcgaaactcctgggcacccggggatagggccctttcctaggccctgtgcaatttacccttcttcctcacatttagcacttggggcccagtgttctctaaaattctcc

SEQ ID NO: 644231 - DNA, 209 bp, Homo sapiens
  misc_feature (40)..(40): n is a, c, g, or t
atgtgccctgtgagctactcgtgactgcagcttcccacanggatacagtcataagcaaaaatatttttcaaaggcagctctggataagagcttttttttttttgaaacggatcccgccctgtcgcccaggctggattcgcagtggccaatcttggtttattggaacctccacctcctgaataccagtggtcctccaacctcagcctccc

SEQ ID NO: 644232 - DNA, 409 bp, Homo sapiens
cttcgcctgctccgtcccgccgtgccacttcgcctgcctccgtcccccgaccgcgaggcatgtctgtggccggctcggagctgccgcgccggacctaggcaccccggcgcacaggagcgggacgccgagccgcgtaccgccgcacggagagctgaacggaccatggggcagatccaagagatcctccgctgcggcgtacaggaaggacgaccgcacgggcaccgggacccttgtcggtattcggcatgcaggcgcgctacagcctgagagatgaattccctactgctgacaaccaaacgtgtgtactggaagggtgtatcggaggagttgctgtggtttatcaagggatccacaaatgctaaagagctgtcttccaagggagtgcacaatctgggatgccaatggatcc

SEQ ID NO: 644233 - DNA, 200 bp, Homo sapiens
gggtgagaaaggtccgcgccagagcccagcgcgcctcgtcgccatgcctcggaaaattgaggaaatcaaggacttcctgctcacagcccgacgaaaggatgccaaatctgtcaagatcaagaaaaataagggacaacgttgaagttttaaagttcgatgcagcagatacctttaaccctggtatacctgacaaagagagg

SEQ ID NO: 644234 - DNA, 440 bp, Homo sapiens
tgtgaatgatgagattcaagtataacgaagaactccatgagttcgctaaaatataaattgatctttatatattacacatacactattttagctaaatgagaaatgtgatggatatatacatctttcccttattaaatacttagtcaaaaacaggcatggtaaaatatcaggcttcggctcctcaggcctctgaatgacaagttacaacgttgattgcattgttaggatggaccttacgtggagatgttaatggtgtgtcccatcggaggcatcacagacatgctggccaccatcttctccctgttcctgcagattctctactctacttctgcacagtgttgtcaagcccagcttgactactaggcaacaaagctgggattagactacaactggtgaactcctcatttactgcccttttcatgttacctttctgcctttaa

SEQ ID NO: 644235 - DNA, 378 bp, Homo sapiens
  misc_feature (9)..(9): n is a, c, g, or t
  misc_feature (31)..(31): n is a, c, g, or t
  misc_feature (83)..(83): n is a, c, g, or t
  misc_feature (122)..(122): n is a, c, g, or t
  misc_feature (189)..(189): n is a, c, g, or t
tttaaaagnctactgttcctagggtaagaancgttgtaaacagtaaaacctacacaatgggtgtttgggttttttcctcacantaaaaaaaaaaatagttatagcaggcatggtggctcacncctgtaatcccagcactttgggaggctgagacaggaggattacttgagcctaggagttcaagaccancctgggcaacatacagagactccaactctacaaaaataaaaataaattagctggatgtggtggtgcatacctgtactcctactacgcaggagactgaggtcagagaatcacctgagcatgagaggttgaggctccagtgagctgtgatcatgccactgtaccccagcctgagtgacagagcaagactct

SEQ ID NO: 644236 - DNA, 277 bp, Homo sapiens
tcgattaaggatcccggtcttggagtagcatcatgttgtactgttccatgggtgaaggctctaacacggccctgtaaaaaccctctcagaggctttgatggtggatgaggtggccaacaatgggagaatttggggagatccttagggtctttagcaggttcgggaaggggaggtgggctgggtaagggatgataggagagagagagagagaatcctctagggacgcccagccagagcctatccccttccggggttggggcaccaaaatgaaggttag

SEQ ID NO: 644237 - DNA, 132 bp, Homo sapiens
tgcctacggagatagtatgaaatgagcagtagagaagctacggatgcttaaaacattcttgattaaattactacatagtggtaagttcaacagttttaagttacttaattgaagccctcagaagtgcaaaga

SEQ ID NO: 644238 - DNA, 622 bp, Homo sapiens
  misc_feature (493)..(493): n is a, c, g, or t
  misc_feature (582)..(582): n is a, c, g, or t
  misc_feature (597)..(597): n is a, c, g, or t
  misc_feature (602)..(602): n is a, c, g, or t
gtatccggatgggctcattttatatgtgttttaaactctgagctagaaggcaacactactttcttgtgaagcacaccatctgtccttggccctagggagctcctgccgtcggtcactgggtcccctgatgcacccctttcaacagacttttcattttggggtacgtcctgacttcctggcactgcagggtgctccagcctcctcttgcattccctgccctggcccgggaatcagccccttctccaaggagccccgggtccttttattggcaagtcttaagagagtgaggcctgggtgccaggcagggagccccaggtccttttattgggaagtcttagagagtgaggcctgggtgccaggtgggtgccaggtgggtccggtgctgctgggatgttgtcacgtggaggccctcagctgcagagcagggacgagggtgtcacctgttcagctgcagagcagggatgagggtgtcacctgtgtgtatgaacatctncgcagccacttctgtatctgtgaagagaacatgagttcatgctactgcctctgactctaattcagaccccaaagctccttctaaccttnctagaacgttatttntcagnttaaaaaataaaaagaaaaa

SEQ ID NO: 644239 - DNA, 836 bp, Homo sapiens
atcgtgccactgaactccaacctgccaatagagcgagactccgtctcaaaaaaaaaaaaaaaaaagaaagaaataccttggaagaaaataccgcacatcagaggaaagcttattttctggcatggggtctttccaaagatagaatattggaaccatgtttcctagccgatggtgtggatgagggtgagctgggctgaggcatgcgctcaggctgggggggtgggtggtgtaaaaaagcgacgtggagccacaagagggacctcctatagtcagctaagggcttccctttctggggcccagttttggggtgaagggtgatttctattagacacaatctggtgcttcagtcatagatgtaaatagaggaagcagctttctccggcggcagatttcctgaatagagtggctgaaaagagctctacttcgggactcaggggcaacgttgaaggccagtcgggtggtacacagggctgaggcacgggggaaagaccgtgccagctagttacattacgcctctgacactagtactcccattgagtggcttccagtgacactgtgcctggatcagaattctaaactctctggaattccccgtggctggcgacttcctatggcccgtggactggtcccagggtaaccctgaatgcccagatgctatggggtgcactgaagcaactcacagccctcgccgtcttgggggcacccctgcgaggccaccggatcctgtggcttcctgccaggccattttttgaaaacccctgtcccaacggtgcctcgggctgcctcgctgacacaagtccgggggaaaattcgcgtcaactaaggcttatcccagc

SEQ ID NO: 644240 - DNA, 1536 bp, Homo sapiens
tgtggacctcctgaaatcttttaatgtgggccccttgtccccccaaggggtcccctgttttctgggtgggtttaattggctctccaaaatcttgggtgtgtccttgtggtgtctctccaaacccctctctttggcctatcccatctatatcccgggggggggtgggtctctttggggtatggtgttggcttgggaagtcggctggttgagtcccagggtctatcccacagaatatataaagagtcctctccgtcgcacactattttccacagagagagtgtgcgtggggagtagagggtgaggagatatctctcacagcctctcccacagattgtgaacactctttgagatgtgttacaagagaggggcctctaatattatctccgcgtgggcctcggtggcgcgtggcgcctctctctggcccgggtgtcttctgtgtgcgccagtctctctggatctccaaggtgtggcaagaagagagtatcccctgtgagagaggtgtgtgtgtcccactctcgtgtgtgagggggtgtgtatgcggggctctcccacctctccctctcaagggtgtggtgtctctacacaaaggtgtgggggctctatcaaaagtatttcctcacagagagagagttccccagagtgtgacagattctccacagaggagagtgtgagagattagtggtgaggtgttctcacagagctctctgttgagaaagagcgtgtgaggtctctcacagggaaattgtctccacaaaacatcttgacaagaaaatagattgtgtgtgttgttgtgttgcgagaacccaactgtcgtggtggggggtgcgtctctcctctctctcacaaaattttgtgtgtgtaggaaacaaacaccatagaaactgtgagtgtataaacagtctctctctctcacagagagatatatcacacacgagaaaaccaacagatcggggaccatatataggggggcgcccgcgaagatatgctactgagccacaaaaaaaaaaccttgtaggaggaaaagagcccgacgaaaaaacaacgagggggagggggaaaatataaacccctcccaagaggagtaaaaccccacgaagaagatcggggacaaaatcggagggaccctaagtaaagagccccaataaaaatacaatccacaaaacgagagggaaacacaattcaaatagagaaaaaagaagcagggtctcccacctcaactgaaagaaagacccgcaagagaaatcaggggaggaccacaccagagctgtgaacgacgctggttgacaaaacaatggggaggggcaccaacaaagaacaactcttgtgagagaccccacgtaggatagtttttgttataccaccaaaaaaatgagagcatgtagtgcaccaattgtggtccaacaagtagtggagactataaatagtatatccggagcgaaagagagtgctgttggacaccatgtgcgacaaaaaccagggtgcagttgacacacaatttgcgacaaatattgcccctcgaagcccaaaagtgtgaaa

SEQ ID NO: 644241 - DNA, 452 bp, Homo sapiens
cccgaagtcgcacgagtgtgcgcatcactgctgcctctacttcatccccgccaccggtcatctccctcaggcccctggacatcgggttaatgaaacgcgctgagcaaaggtggtcaacaatcgtccctagtcatcgcgcaaggctggacacactctaccctggcaggagagggtccacgttcaacacaggcggatcaccgcagaacctagatgtccaactggcatcgaagttgtaccccacagacaggaatttgatgaaggactcggaggaccggctaatagaacgagaagtcccgggagattgatcccatatgctgtggagggcagtgaccacgaagtaccaggtcaacgggcaagaggatccttgggaggaagaccaagtggggtaccatcgaagttgaaaaaaccacacactgtgagatagcctacctgcgggaaccttctcatcagga

SEQ ID NO: 644242 - DNA, 510 bp, Homo sapiens
  misc_feature (16)..(16): n is a, c, g, or t
  misc_feature (415)..(415): n is a, c, g, or t
  misc_feature (417)..(417): n is a, c, g, or t
tgccttggcgggacgncggagggccaagcgtagacctaagcatcacttgaggggggcgggaagaggaataagatctgcgggcgccactcgctctatgtggacttcagcgatgtgggctggaatgactggattgtggctccagcaggctaccaggccttctactgtcatggggactgctcctttcggtggggtgagcacctcggctgaagcagggatggcagtgtgcagaccctggtcagttctgtggattccggtatcgcgaaagcctgttgtgtgggcagtgaagtgagtgccatgtccatgctgtagctggatgagtatgataaggtggtactgaaaaatgatcgggagatggtagtagagggatgtgggtgccgctgagatcaggcagtccttgaggatagacagatatacncnccacacacacacaccacatacaccacacacacacgttcccatccactcacccacacactacacagactgcttccttatagctggacttttatt

SEQ ID NO: 644243 - DNA, 1010 bp, Homo sapiens
taaaaaaaaaaaaagttcaatttttgaagttcttatagggaccaaagtgtggtgcccaggaatgtgatcgtccaaacacagtggaaccaagaagaaacacagataaaatttctcctgtgttgtgaagaaaccaagtagttttggtgccagcgcccgaggtgattcctgagggtttaggccaaaacacgagcccaatttccgtggaggggaagccctgtgttccgcacagcaggggttcctcgagcccggagaatataggcatgtgaggcggtgtgggatgcagggaacctgtgtgtcccctgtcttatccaaccaagcgcgcgggaaggactttctgtgagcacacaagacgttcacgtggagtgggaggaaagcgccaaatcagcatcacaataacgccccaggtgggaagagaccgcttctgtggggaacaccacaactccgcagagacaatgccccgaggcgagggggcaccacggaacagcgcctcccaggtgccccctcacgtggggacctcgctcgagaccaaagtgggtctcacaaatctcgcaaagatccaaatcttccaagggggggacggtgattccccccaaagagtccccccacgggggggtggggggaagtataaaccattaagagatatatgtgccttgtggacggagaaatttttgaacgccttcacaaaagtggccccgtggtgttctccccacgcgaatttggcaaaagcggtcaactatatgagccgagaacaggacagaaaaatgaaccacacaaaaagaaggcaccgatatgaggcggccgaaaagcagcggccagcgggaccacattcaagagaaaacagacgggcgccacaaaaaaactgccagcaatccggcgatgaggcacgaccaggcgaagggggaaattagcgcaaaaccatcccggggagttaggaagaaagacaccagcgcgatcggggaagagacaaccagagggcatgggcccacattacaccgggaccgacagggggg

SEQ ID NO: 644244 - DNA, 120 bp, Homo sapiens
cacatttctctttaaactaccctaacagacaaatttaatgcagactcatatcacattatcgtcatttgacacgttgattcttccaatccaccacttactttccactgatctataaatgct

SEQ ID NO: 644245 - DNA, 464 bp, Homo sapiens
ggttagtataagtaacattagttcttctatagggtgatagatggtccaatgggtgtgaggagtcagtatatgttgggatttaggtagtgggtgtgattgaagtttaattggtggtgtaggctatatggggtccaaaatcgaaatcacccaaggcataatataagacacaggacccaccccgataagcctatcatgcatgaactgacactgaacccatacgcaactagacttatcggcacatcggccgcagcgcgaccaagcatcagatcacccgccaaaaaacgcgcgcaccgacgcccaacgcacaacgacgcccgcttagcgcaccagacgcacaagcaccgctcgaatccaccgcacaacaagagagcgcacccactccatacgccccagacaggcgagccccccaacactcagccagacgcacccgactcgacaccgcccggtcgggtccgaccatgccg

SEQ ID NO: 644246 - DNA, 102 bp, Homo sapiens
ctacgtacttctcgacgctctagtacactgtccgcggtcggacgtaccgcgtactcgactggcgccacgctgacggcggcgaactactgcatcctacggcct

SEQ ID NO: 644247 - DNA, 557 bp, Homo sapiens
aaaaaaaaaaaaattaaaacttaaaattcttttttaattttaaaaaaaaaggtttttgctataaaaaaaaaaataccccccccgggttaaaaaaaaaaaaattatgggttttaaaaaaaaaaaaccccccccccaaaaggggccaaatctcgggccccaaaaaaaaggggcctttccccaaaaaaaaaaaaaaagacttgccaaaaactggggggtggggaaaaaaagggaaaaactttttccccgggaaaaaatgggccccctcaaaactggtgggaggctttttttttttggggcgccgtgtttaaaacaaaaccccccgataatttccaaccggaaaacgcggggaaattctttccgcgggggggggcgaaataaaaccctccccgtatttttgctttagcgccccaccctcctcgataataaaaacaaacctcacgttagattacttaaaggggcccccaaaaatggggggcggaaaatcaggaacaaagtgttttcttgtgggaatatgtttttctcctaaacaaattcacaaaaaatatagggcgcgtgct

SEQ ID NO: 644248 - DNA, 141 bp, Homo sapiens
aggatccccgtgagacgactttcacttctgatctgatctttctgataaagatagcaaagcaatgaatcaaagaaaatacagaagaaaaaactccagactaaaaaagaaatattcaaaaaaatctagttgagaaaaagaaag

SEQ ID NO: 644249 - DNA, 183 bp, Homo sapiens
cctttcctggatatcaaagtattaagtttctttctcatattaaataaaaaaatttaaaaaggctgggcccagtggctcatccctctaaccccacccctttgggaggctaaggcaggtggactgcttgagctcgtgagtttcagaccaccctaggcaacttggtgaaccctcttcttttattta

SEQ ID NO: 644250 - DNA, 185 bp, Homo sapiens
gggggttggcccccccccccccccgaaaaagcccttctcttttcccgggggtatttggggggggggggggggaacccccccccccccgggttttttggttggccgggggggtttggggggggcccccttttttttttttcccgggcccccgggggggatttaaggcccccccccccccctgggga

SEQ ID NO: 644251 - DNA, 333 bp, Homo sapiens
  misc_feature (328)..(328): n is a, c, g, or t
tcaagtggtctagacactccaggtagcatttaaaaagtagccagtctctagcatgaagggagtccttttaggaagtagattttttccccccgtttatcttttttttttcttcgaggcataaataggagtgcttgtggattttaatttaaattataattggtaaatcaggaatatgtggccaccagaacccaaaaattactaaaagatacgggaattacttccccttaatgacatgtcaagagtttcctgtggggaaggctagtaatcgggtgcgggtgcataccctgtgtccctgggagaagggtggagtgtggttaaggactctcgnttggc

SEQ ID NO: 644252 - DNA, 676 bp, Homo sapiens
catggtggctcacgcctgtaatcccagcactctgggaggccaacgtgagcagatgacgaggtcaggagatcgagaccatcctgggtaacacggtgaaaccccgtctctactaaaaatacaaaaaaattagccgggcgtggtggcgggcgcctgtagtcccagctactcgggaggctgaggcaggagaatggcgtgaacccgggaggcggagcttgcagtgagctgagatcgcgcctctgcactccagcctgggcgacagagaagagactccatcttaaaaaaaaaaaaaaaaaaaaggtaatttaaaattggcaatggttaaaaggaaaaaaaaggagaccgggaggggtaacaggaaggatattggggcccacgttgaaagagaaactgggggacctaaaatttttttgccttatgaaatttttccaggcattggtaaattcctgggtaacagagaaccaaggagataacaattttgacagagataaagaataagtgatcgggaaacagttaagggtatatatatatccagttaaaggttcccacgcgggagagacgagactatgtgagacataatttttcagaggaatacggcggtcagaactttctagatcctccttgaaggacaaattgtggaatcgtgaaacacttgcttccaaaatagggattactttac

SEQ ID NO: 644253 - DNA, 439 bp, Homo sapiens
aggattccaggcgttgtcagtgtagaacagctcacattatgcggtgatgttatcaaagagcactgagctgtctgaagccaaagcctgaggacagaaagacctgatgcaggtcaggccatggaggcagatggccttgctggggctgggggttttccaagccctcagctggtcctgaccaggatggagcaagctcttcccttgctcatgagctcctgatcagaggcatttgagcagctgaataacctgcacaggcttgcttgtatgacccctgggcacagccttccctctgcattgacctggaggggagaggtcagccttgacctaaatgaggtagctatagttgcagcccaaggacagttcagagatcaggatcagctttgaaggctggattctatctacataagtcctttcatttccaccagggccagagcagctccac

SEQ ID NO: 644254 - DNA, 192 bp, Homo sapiens
cagctatgcaggactcagaaacacccatttcctaatgacagggtgagtaactggatttctttttttggttggtttggtttgggttttcaactgggctgaccccgggtctatgatctattcacatcgaacccctgacgggtctgcctggtgccagggtgagcgtgcccgatcccaagatcgggcccatcttcg

SEQ ID NO: 644255 - DNA, 197 bp, Homo sapiens
tcctactactccattttaactcaagcaccattaccctactactatctcgcacctgaaacaagcttacatgactttcacgttttattcctttcaccctcctctcccttggaagcctgtccccgcttaccggctttttgcccaaattggccatttatcgaagaattcacaaaatagaaatgatatagttgtttgattgc

SEQ ID NO: 644256 - DNA, 323 bp, Homo sapiens
caatgaaaagaaaaggggcccttttttttcccccagaattattcaaagggggatttttgaaacggctaattccacacgggtgagggatgttggttttttagggcaatttttttgggggctattttttgccccaacgggggggatggttaaaattaatttaaatttgtttcatttgggagggatgggaagggggtttgggggtatggggggtttataatttgccaaagtcatgaaggtcggttgggggggaatttaattccccttcccttattttttttttttttggggggggggtgattcaataaaagggcctgcccctccca

SEQ ID NO: 644257 - DNA, 419 bp, Homo sapiens
agcctatcctctagtgaacgtccataacatgttcgcccagtccttgcgctacgtgagcatgcttatagctcatatcagctcgctaatacagttcgtctactgaacctccatagtgctcacatcaccccactccttcccctattgaacctccataacactcagatcaccccactccttcctctactgaacttccatagtgctcattatcgtaaaacatttattagctgtattagtatatgctggttctggtaagatcttaactatatttcctttttccaaactcggttgtaacaactgatgtcaaggacctgatatctgcctttttatatccccagtaatcaggctgggaccctgtatacaatagacacacactgcatgtatcttcattgtgatgggatgaagaggtatgagtggccaaa

SEQ ID NO: 644258 - DNA, 150 bp, Homo sapiens
cgttccggggggagatcttagccggagttgaccagagatttcgtgtagtcatctaaatcagagacatcacattgattatggagaatttgtgaatcttcagctagatgaagaaacccaataccaaactgctgttgaaacttctaaaactag

SEQ ID NO: 644259 - DNA, 394 bp, Homo sapiens
gcgtggtcgcggccgatgtacaggggaatggaatggaatggaatgcaatggaaaggaatggaatcaaattgattggaatggaatggaatggaatggaatgaaatggaatggaatggaattaaccccaatagaaaggaatggaatggaatggaacggaacggaatggaatggaatggaatggaatggaatggaatggaatcaacctgactgcaggggaatggaatggaatggaatgcaatggaatggattcaacttgaatggaatggaaagaatggaatcaacacgagtggaatggcatggaattaaccccaatagaaaggaatggaatggaatggaatggaacggaacggaatggaatggaatggaatggaatggaatggaatcaacctgactg

SEQ ID NO: 644260 - DNA, 276 bp, Homo sapiens
ctggaacccaggaggtagaggtagcagtgagccgaggtggcatcatggcacttcagccggggtgacatgagcgaaactcggtcttaacaataacaacaacaaaaacataacataaaatttaccatcttaactaatttcagatgtacagttcaggggcaattaatatattcgtaaggtggtacaatcatccccaacatccatttctataagcttttttcatctgggtaaaacgtgaaacgtgtattatctacgtaaaccaagtgaaggccccagtta

SEQ ID NO: 644261 - DNA, 624 bp, Homo sapiens
ccacagtgcccattgtcttactctgaatagtattgcaggtgtatagttagggtccacactcaatctacgtctttgtagaggtctgatcactggagacagtcaggcacgcaatacgagtgtaggtcgctggtaagtgcatgatgcatcatgagttcccttcgccaagacaatggcattcaccacatgcgtgtaggagcgccctactatgttctgtaagtgatctgttcgcaccatggacctttgagtgggtgctaatctcccagggataatgggtctgttcgcaggatctgaaactatcagcagacaggttaatcatctgcctgtattcaatatgtcctccggttcttggaaggcagcctgtggcacagtatgagaaatgatcgtgtttagctccactggatgggcggtatcagctgctgcctgtccagccttgggatgtgctctttcagcatggatggagagttataccgtcaaattcagtgtctacaagagcatatgacactttttcataaggtgcacagctggcagttttatcatccacaggcagtctgtgctctatagctctcagtgggccagcagtgggcattaccccatgctttgtgaatctcaatagcatcagatctg

SEQ ID NO: 644262 - DNA, 394 bp, Homo sapiens
gggagcttgttttaggggtcccaaggtttccacccacgtgcccaggtttcccacggtgcagggcagagggccacgcccacacccggccttttagctcaggtcccccatgggggacggccccgcgtgggtgggggttccagagggtcccgagtgggggccgttccttttcccagacccttcactttcaaccaggccagtccggttttggggggcaggggcctccccggcaacagccccaggggccttgggggtttgaggtcccccccctttttccaagtggccttttccccagctccctcctcccaggtttgtttgggtttgcgtgcgttttttccgagcttttttttcattttgcaaatttaaataaagggaggccgttttcggaaaaaaaaaa

SEQ ID NO: 644263 - DNA, 926 bp, Homo sapiens
cagcgtcttgcccgcccctctatggttcgcacctctttccgcagccgagtcgcccgccgctcttgtccctggggttttgcgcataggcaatttgttcgacgacccaggagccacccgtgagttggccccattagctctgtcccagccgagtgtgggccgccccccgcaaaagttcggctgattcccgcacggttttccgcgaagttcttttcccggggggggggacacatcacacacacatgacggtgtggccccccccgtctcctactcaaagggagggtcccccacccggtggaaagttgcaggagagttcgtcccgcccccccgtttcatgtcgccacaattctacggcccccagtgcaaaccccccgtcttctaatcacccgctgcttttttatgcgacttatcccccccccctaaagtaatactataaaggcgcccccaaaaagattttccatgtgctttctaaaaagagcaacccccctgggtatccctccttccttcggaataaaccccacccccgttaccaccattgacgacagagtttggtccctacacattcttatcccccacgagcctcaatagtataaattattccgacgcctcctccttggaggggatggcacgagaaaacgaggggtcacgaagaccccatcgagccagagtaggccccccctcgtatcttgatcatacaagggatctccatccctcgcggctttgtgggagtggtagcctgattcaatgatcccccccttgagcggagtggggtcttttgcttctcgcgggagcaacagcgccttatctgggtcgaacaacgcgcaagacgtagtgccattacccgagttatcactgtcgtcagaaagagggaagcccaacaaaccgttttgacgcaatctctgtagtaacccccacacaacataacaaca

SEQ ID NO: 644264 - DNA, 153 bp, Homo sapiens
tggaattaatacctaatgatcatctctcatgttctcgttgacacgtgctggggaaatccagaaatacaaggaatctgaagtctattcctaaggcaattaaagcaatccaatgctgcagtaaccatggtagtttggtctgttgatcatcgttgg

SEQ ID NO: 644265 - DNA, 213 bp, Homo sapiens
gtattcctatgagggataattatgacgtgctccatctgcctacgacaaacaggacctaaaatcgctcattgcatactcggcaagcggccacatggccctcgtagtaacaggcattctcatccaagagccccgtgaagcttcaccggcgcagtcattctctagtttcggccaggggtcttacatcctcattactattctgcctcaggtagagca

SEQ ID NO: 644266 - DNA, 503 bp, Homo sapiens
tgtgggtgttattagtctgcatggtactaggggggcgaagagatcagaagtgtcatccaacgtggtcagaaggtcatctgggagggtttccaggtcgatctatacccaacagggcatcgaagtcgaactccttcaaatccattttctccaagatccaatctgtgccggagaaggcatacctccattgctggtgttggagggacatgaccaacccatccacagccagacatgcggaggagcgccggcttagccttgtcgctggagaacccatgaggttagaagtgcttgggcacctccaggtaatcatctaagagacctaggcttgcttcagcccccaaacccgacgtggtcgaagggggacatcatgtcccccaccaacaccgtcgcggctcaggaagctcattgcggtcatgtcgcggtgcttggctgcaatcggggaatgtgcttaattcgaaggggtctttgtcggttacaggaacgctgttgctgaatgccgtgagaag

SEQ ID NO: 644267 - DNA, 1003 bp, Homo sapiens
  misc_feature (6)..(6): n is a, c, g, or t
  misc_feature (70)..(70): n is a, c, g, or t
  misc_feature (118)..(118): n is a, c, g, or t
  misc_feature (249)..(249): n is a, c, g, or t
  misc_feature (265)..(265): n is a, c, g, or t
  misc_feature (459)..(459): n is a, c, g, or t
  misc_feature (483)..(483): n is a, c, g, or t
  misc_feature (532)..(532): n is a, c, g, or t
  misc_feature (535)..(535): n is a, c, g, or t
  misc_feature (538)..(538): n is a, c, g, or t
  misc_feature (556)..(556): n is a, c, g, or t
  misc_feature (702)..(702): n is a, c, g, or t
  misc_feature (710)..(710): n is a, c, g, or t
  misc_feature (714)..(714): n is a, c, g, or t
  misc_feature (738)..(738): n is a, c, g, or t
  misc_feature (750)..(750): n is a, c, g, or t
  misc_feature (906)..(906): n is a, c, g, or t
  misc_feature (925)..(925): n is a, c, g, or t
  misc_feature (936)..(936): n is a, c, g, or t
  misc_feature (1001)..(1001): n is a, c, g, or t
agaganaagtgtgtaaaaaaagcaggcggggacgggccggaattccgcggatcccgcgagccgggccggnggcagccggcgaagcgggtggggtggtgtgttacccagtaactcctgnggacatcgctcggatacactccaccccgtcacaaccactactgtaatcaccggtccgccgaagggccgcaatactggttgcccgcagtgtaagcagaattccacgtgtatcgctgccgtcaaaatgaaagngacctttatccgtatncaataaccacacacactagggaaaccatccgctcccaaaacattatggcttcaacttcaatttccaatattataaaaaattctcttggtccaattggcttgaataaaatattggtggataatattagtgatgtaaccattactaacgatagtgcaaccatcctaaaattactaaaagtaaaacatcctgcaacnaaaattctttataaactggctaanctccaacacaaaaaaattggacatcaaactacttcaatagttattattncancanaactcctaaaaaatacanataaattaatcaaacacaaaattcatcccacatcaattattagtggctatcgacttgcttgcaaggaagcagtgcgttatatcaatgaaaacctaattgttaacacagatgaactgggaagagattgcctgattaatgctgctaanacatccangtcntccaaaatcattggaataaatggngatttctttgcnaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggntccagggcatgcccaaganaatcgtaaatncaaaaattgcttgcctttgacttcagcctgcaaaaaacaaaaatgaagcttggtgtacaggtggnca

SEQ ID NO: 644268 - DNA, 421 bp, Homo sapiens
aaaccacatggtggcttattttctgagtttctggtagagacggggtttcgctgtgttggccaggctggccttgaactcctgaggtcaggtgatctgcttgcctgcgcctcccaaagtgctgggattacaggcatgaaccaccacacacattttttttgagacagagtcttgatatattgccaacaatggagtgcagtggtgccatcacggctcaccatagcctcaatctcctggggctcaggtgatcctcccaccacagcctcccaagtagctgggactacaagtgcatgcgaccacacccagttaattttggtattattattttgggagagacagggtttcactgtgttgtccaggctgttctccaacttttgagctcatgtgatcggcccacttcagcctcccaaagtgcagggattac

SEQ ID NO: 644269 - DNA, 252 bp, Homo sapiens
atgcttcatttacgggggccgggcttagtgaagtagcggcttattactcttgtcctgttcgtacagggaggccctggaagtagcagtagacaccgacctggattactccggtctgaactcagatcacgtaggactttaatcgttgaacaaacgaacctttaatagcggcagcagcacacgaattcccttagcaccagcacgaattcccttagcatcagcacgaattcccttagcaccagcacgaattccctt

SEQ ID NO: 644270 - DNA, 220 bp, Homo sapiens
  misc_feature (129)..(129): n is a, c, g, or t
gtggatcgaacccatgtcctcatggaggagcagtcagatccatgtccactaggccacgaatgtaactccgaaaatgttcattttaaagttatgtatttaacagttcgcatcacactttctttcccttgnctcttaaaaggtgggttggtggtccgaggtgatgaaattcaaccctaacacaaatgcagtgtcccatgtcataccctggactgacctgcgg

SEQ ID NO: 644271 - DNA, 519 bp, Homo sapiens
agagcgacccccgagagtaaagtccaatgtcttgtaagcatggttagcaatcaccatgtggtaggggcacagagccatagtgtacctgtgggtgggtagagatagccacagagagggcgtactagagtatgcatcttctctaccttgaaaaaatttaccatttgtaactctggctgcataccaaatcgaacgaagacttaaggtttttagtttacctaactgattgaatacacttttaaaatgaattcatgtgtgtaaactagtatatcagtcatgtggatgcaataccgcagcccctgtcgcaaggacgcgtagggaagtgggtagagggtgtggtggagacaagaaacgcatgcctgatggtgtcctggtacaaccgctgctcagccggggtggccttggacaaatttcccaagagtacggcattgatgaagtacccatatccagcctcacagtgatgttatgaaatagacacgatggcaagaaaagcaacgacaaggtatgaaaatggtacataag

SEQ ID NO: 644272 - DNA, 116 bp, Homo sapiens
ggacgaagggaacgtaatcgtttggaaagcgtcgcaataagacgcacacgttgtgccgcagctgtggctataaggatctaaacactacagaagtagacatctggcaaatgtggcta

SEQ ID NO: 644273 - DNA, 211 bp, Homo sapiens
tattatagaggaccccttatcaactgggtcatatatcattggtttagtataaattggtcatagctgggttaactggaaaacaaacacatttaaaatgggtttaccttcaggttgaggtgcagaaaattggttgaaggataaacggttgagaggtggccccaatggttaggatgtccctcttgtctttcggtggtgctcggggtaccgagct

SEQ ID NO: 644274 - DNA, 179 bp, Homo sapiens
aaccccgccttcccctcagtgaggaaagttgcgccaataatgacgttaagtccgtggaagcttgtgctaactaaaaatgttgaacctgtagtatccgtcgagacatggtgaagtggatgactcgcacgtactctgaggcttgttaggagggttacaatagacgccccacgtaaaattgt

SEQ ID NO: 644275 - DNA, 732 bp, Homo sapiens
  misc_feature (47)..(47): n is a, c, g, or t
  misc_feature (66)..(66): n is a, c, g, or t
  misc_feature (77)..(77): n is a, c, g, or t
  misc_feature (135)..(135): n is a, c, g, or t
  misc_feature (156)..(156): n is a, c, g, or t
  misc_feature (186)..(186): n is a, c, g, or t
  misc_feature (190)..(190): n is a, c, g, or t
  misc_feature (201)..(201): n is a, c, g, or t
  misc_feature (224)..(224): n is a, c, g, or t
  misc_feature (257)..(257): n is a, c, g, or t
  misc_feature (279)..(279): n is a, c, g, or t
  misc_feature (301)..(301): n is a, c, g, or t
  misc_feature (322)..(322): n is a, c, g, or t
  misc_feature (327)..(327): n is a, c, g, or t
  misc_feature (336)..(336): n is a, c, g, or t
  misc_feature (360)..(360): n is a, c, g, or t
  misc_feature (467)..(467): n is a, c, g, or t
  misc_feature (579)..(579): n is a, c, g, or t
  misc_feature (589)..(589): n is a, c, g, or t
  misc_feature (594)..(594): n is a, c, g, or t
  misc_feature (604)..(604): n is a, c, g, or t
  misc_feature (606)..(606): n is a, c, g, or t
  misc_feature (610)..(610): n is a, c, g, or t
  misc_feature (620)..(622): n is a, c, g, or t
  misc_feature (631)..(632): n is a, c, g, or t
  misc_feature (655)..(655): n is a, c, g, or t
  misc_feature (671)..(671): n is a, c, g, or t
  misc_feature (690)..(690): n is a, c, g, or t
gtacttaccggcgtgcgccaggtgatgttgctgaggaagagcatgcngctgcccgtgtcggatgcngagtgtacgcncaggcccagcaacccgccttctagctgggcctgggctcgcggccggccctcgcgaggntggggcacctttctccaggtnaccaatggctgcgggtagccggagggtggnaggnaacccgcagtnctcacccaggttggctgtgagcnccagcgcctgcacgtggacagagggcggaatgnagatgaggctgctgtgggatangtccaggagaatctggagcgcnaggagcgggggctctgcacanatgancttcctgtncctggaggtgagcagccgctggcngccctccttgatccaggcacccagccagtgcagggcgcagtcacagcgccatgggttctctgtgggagagcagcgttaggcaggtggcttgagggtgctgctaaaanagcctgtgcagttggggttttgcaggccaggacagaggcctctttcccacctcccacagcgttttcacacggagtccaaggccctggcaccccttccttgaccccaagctcnttgggggggnagggncttcaccctngncccnctcccctttnnntcttttatnnctgcctgttacagatcacttctncgtcggtctctgaganagcacctgctccttaagtnttcctgcaacaagtgccactgtttttaggaacctgggcgtcc

SEQ ID NO: 644276 - DNA, 122 bp, Homo sapiens
gagtccgatagatgagtaggagtcagactatgtgagaaagagaggaagatgaggaggggaaagtaggaccagagaaatcatgcgaacagataggctcggggtggagaactgacacttgtgat

SEQ ID NO: 644277 - DNA, 133 bp, Homo sapiens
ctatgttagctgggccctggggcagtaggccgaaaacggacggaagacaaggtctggccggagattggtctcactctgtcacccagactgtagtgcagtgagtggtgcgatcatagcttactgcagcctgaaa

SEQ ID NO: 644278 - DNA, 458 bp, Homo sapiens
aaaccggtattactctttctgactggggaaacccctcgggggcttttatcactcgtagaaaccatgatactacttgtcgaggggaatgcacccacgagcccgtgacataaggactgcgcaaatatatcttgtgtaagtacacaccagcacaggctaccagagcaaacatagacaattggaattacataatgctacaaagcttctgcatcacacaggaaacaacaaactgaatagacaaaccacagatagagagaaaatctttgcaatctaactgacaaggggctaataacctgaatatataaagaactcaaacaactaaatagcaaagaaacaaataatttcatttataaaaatgggcaacaaattgggacaaacatttttcaaaaagaagacatacaaatggcctacagttatattttttaaatgtatgacattgctaatcatcagataaatgcaaa

SEQ ID NO: 644279 - DNA, 1106 bp, Homo sapiens
agcggcttggtgcgcgggcacagcagccaggctgaccggagagctgatctcggggattcgggtgcggatcccgttgcgcctggaggtgatatgggtggcccgtggacccggatcagtctgttgcaaaagtccgtgggaacaggcctgttctgagcgcctgcatagtacgtaccctattctggagacatgtgggggcctatgagacagacttgcgtctctaacattgacgtagcgagcacctagtacgtgtgctcccgtacagaagaagcatcgatctatcagaggtatcagcgtgcagtcgttgggccgatagcaaggggggcatggccttaaggtctctgcatatattcgctatgtagatctccgtaggggagtcctggcgcatcttcaccttgcctcttgcgccacacgtggtcgctggatacgagtagtggagttgtgcgtcgcgttggggccggccgggcacatcgtctttgctacccatagcacgcacccaacatcggccgccgggttttgggcatcggagccatgttgaaactacaacaccctgatggagatatcgcatccacggtctccaagtgccttgctttgcatgtgggggccctagggttatcgccccatgcgacgcccccatgacacgacgccaaaccatggtgctacaaactaggttctaacatattggtgccggatacggcttaattggagggggtagacgctccgaccgttgaacaaccaattttgccctctccagggtggacggtattgcaccatggactgggacccgtttgttggagaagcgcaataatcaccacgtagggggaaggctagacgggcataagccgtcggatgtctttcgcctccccgtattacggacagaacgtataaacacggtcccgtggcgagtgagtggccctcattccaaaacagaaggcgtcttaattgcgccgtcgttcgagggccgatactcgaaggaaagccgtgggaccaaaaaagggtgatacacacctggaaggaaatgttcgggtccgcccaggaaaattcacaaggcacggccaaggggggtgccgggtgcgaattcatttctaggttaggtcggaggggcttgg

SEQ ID NO: 644280 - DNA, 504 bp, Homo sapiens
aaaaaagggtgcccttttgtttttggtacaaaatatttttggggggcgcgcctcccctccccagaagggggggtttttaaaacaacaagtcttttttggggggggtttcccccccccccttggggggggttttttacccccccccaaaaaatttttacaggggggcccccttttttttttttttttaaaaaacaaaggggcccccccaaatatttttttttttttgccccccacggggggccctttttttttttaaaaaaaaacccccctttttttttccccccccccgttggggggcccatttttttgttttttcttcggggggaaaaagggcccccaggggggccccccattttttttttttttaaaaacccccctttttttttttcccccgggggtttttttttttttcccccccccccttttttttaaaaaaaattttttttttccccccccttttttttttttccccccctttttttaagggggccccctttttttcca

SEQ ID NO: 644281 - DNA, 773 bp, Homo sapiens
agcggaagaaagcggaagatggcggcggcggccgtggaggccgtgaggagagcggcggctgcgagggcggccgatggcggccgggaggcgccctcggacacttgctgggtcgttagtggcagcgacgctgggagtgcatgtctggagcactgtggagccctgcattctcctggggccctgggcccatacgtgcggcggcggcgtgcccggcccccgcgtcgcgggcctcgcacccccaatctcaagcctcaaacccctcatcgagacgtgcgcgaccggctcttccacgcgctggttcttcaagagtggctgtcaccttattcgcgtgctcttcccgcccgccttcccgccgctctcgttcgtagcttcttcgtgctgctcaaggcccctgtttgtgctcttcgtcctggcctacatccagcatcgtcttctcccggctcgcccatcaactgcctggagcacgtgcgtgacatagtggcacgcgtgagtggcatcctgcgtgctggacagtgcggcacaactcgagtccgcgcgcccgtacttcctacatgattctgtgacacgcggcggccgcggggagcttcccgggcctggccgtggaaccaggcagcaacctggacatggaagatgaggaggcagaagagctgaccatggagatgtgtgggaacagctccatcaagttaacgctggacatcgagccaaggtgtcaaagccgacaagtagcacagaggccctgaattgacagccaggagtccccttcccgagacgcccat

SEQ ID NO: 644282 - DNA, 477 bp, Homo sapiens
  misc_feature (463)..(463): n is a, c, g, or t
  misc_feature (469)..(469): n is a, c, g, or t
aggatcatttcctaggactggaactgccttggaaactcatcaccaaacacaagaacttagccttttctaagacggtggtattgacatgccacatggtttccaaattggtcaagtcattcagaactgttctgagatgggcactggaccacgaacattactaaggtgtgcttataccagaggtttcctttaaaactctgctacataaacaaggatctgccatttgctgcttcataagaggcgggctgacttcttagatcttggtttctatgtcctgcccactagtcaggcttctggtgacagtgacagattcaggaacacgtgcccctgtgggagctactcgaccagttggctggtgactgcatgttagtttgttaccaaggtctaaaattggtcatattttcctgggttttgataagcagctaacctaagctagggtttgtgaagtggaaaatccctttaaggncaaaanggggggtt

SEQ ID NO: 644283 - DNA, 152 bp, Homo sapiens
cccgagattagagagataggcttcagcgaacaaagagagcgagaactcagagcaaagcgagccgcggagggccttgccacagtgattagaatctgcaaatagctgtcttgtgcctgagggatgtgaccttattcatctgtattaactcttat

SEQ ID NO: 644284 - DNA, 463 bp, Homo sapiens
  misc_feature (146)..(146): n is a, c, g, or t
  misc_feature (382)..(382): n is a, c, g, or t
  misc_feature (392)..(392): n is a, c, g, or t
  misc_feature (455)..(455): n is a, c, g, or t
ccaagggccggtggtccgggcctggggggtcggggtcaagggtcccaaggaggtgctggtcaggcccacccattggaaggtggataggggcccttgttctttagatgtttgtctttgagggggactgtgggaccaaggactttgcngctgttttcctatgtcatttctgcttcagctctttgcggcttcccttctttggaaaggtggaacccgatgggaattagccggcttccttatttttgtaggccaacccatatgttccttagaattctttgcctttaatgttgaaaccggaagggggtttcgttccccttaaatgaatcaaccccgcccccttctgggcgggtttgtttgtttttttttttttttttttttgcttggngaaaaccccncaaaggctgggaagggatgtttttataatttgtttttttaaatatgaaaaataaaatgtttanctttttta

SEQ ID NO: 644285 - DNA, 375 bp, Homo sapiens
ccagattggaacgaacaatgggacggacaaggatggggagaacaagtgagcatgtgctgacagatactaggggtagaggatctgagtgaaaaatttgatcttagacaagcgcctaggtagagaaataatgggataagatattctaaaccccactatggtgcttaaaagatcatcctcgccattggggctgatctctgtcatcctctccttcctcagcctctttcgcatcatccttgatcaactccagctggtcatccccccgatcattcattatcatcatcatccagtagagtccccctcctcagcagagtcatctgcaacaccctcagactccatcttcacattagtctcatcttacttcacggagctgatgct

SEQ ID NO: 644286 - DNA, 155 bp, Homo sapiens
ctaagtgcccttttccaacttctgcttcccaggtccctggtctcttcctaagccccttaagttttatctgctcataattttgcatacacttcttgaagttggtcttgtaatacttggtggctccttttccaatccgtgaaaattttcccccttgt

SEQ ID NO: 644287 - DNA, 1034 bp, Homo sapiens
gagcgtactggtgcttggatgtggtccggcgacggtgtgctggcgaagcagaaccatattcaaagtctctgactgctagaaatgggaccgggtgaagctgtgtgcatgcaaaagacacttctcggaattatggacacacatatgagaggagtgaatttagaattccagtatctatggaatatctttccgaccagcagtctgcacactgcgagaaacaatgcccaacgcaggctacaattagcatagatcatgcaattacccatttatataaggcggcttgaccaagtaggtgcttggccggcttcatgctgttgtaagggctcgcctatccgagatattgggagaaattccgtgccttgctgactagttgacacctaactcgagacaagggccagagtttgggaggactatcaactgtgaagtgagtcgctattgggtattgtctgcaggatgtgttcacgagacacacacggagaccacgaaatgggttacactacctatagcagaaaattcgcctgcatagataccactttaccaaaagctacacgtgctcgcaggaccaaatgagatgtgtttgaaaatagttggaaatcagatggtgcctgggtttcatgaactgtccacttccctgaacagggattggcgtcatcgagcaacacattggagtcgaggtcttggcgtattgcaagtgggagcttgcaatctactcgtgcactggggcagaggaagtgacaggaggttgatagttgagatatttgtgcctaacccttaatacttgcctcatagcagatgcctgtagggcacaccgtgcaggtgtgagctcatgactagggagaagacttactaaggcgtgctgaaagtggaatacaatgagagcgccccggacgggcctcggggcacaagtccatgtatggagacctctagggcccagtgtgggcatggaccaaggccccctcgtttggatcaactcgagctgcctacacgaaagcttccaatgggacaaaacgacccttggcgaactcaaaaaccgtgtt

SEQ ID NO: 644288 - DNA, 889 bp, Homo sapiens
gagcctggggcggccggcaggaaccacccgttaaggtgtcttctctttagggatggtgaggtggaaaaaggctcctgtaaccctcctccaggatgaaccactgccagaagacatggagaacgctctcaccgggagccagagctcacatgcttctctgcgcaatatccattccatcaaccccacaaatcatggccaggattgagtcctatgacggacgggaacagacaggcatatctgatgtcaggaggacttctgtggtttgtccacctttgacctcttattcgtaacattactgtggataatagagttaacctgtgaatgcgaggcattgagaacacattaagagaaggaggtgatgcacgtatgactactattcttcatatttgatatatttctctctggcagctttttcgatttcaaagtgttaattacttgcatatgctgtgtgcagactgcgccatttgttgggcaatagcgtgacaacggcgtgtgacagtgcctttttacctagcacaagtgatcctttcgaagctttctctcaggggcttttgggctatgtgctgccatcattttcattcatccttgcctgtttgtgaacgtgttcctggattcacagtgtaacctcaagaagcgaggaagaaccaggatccggatagttcaggagctccagagagggcaggcttatatcacggggctcgaaggcagtatccctcagaaccgagcgctctgagagggagaaacaggacgggaaccctttgacatgggatacctggaggaacctccgaagatcgcaagaggggggccgcgagcaagaaggggccgcgcgttgagcaaacatatcccacgggcaccccaggtggggagagcaccaacgaggggagggggaaaa

SEQ ID NO: 644289 - DNA, 730 bp, Homo sapiens
  misc_feature (20)..(20): n is a, c, g, or t
  misc_feature (64)..(64): n is a, c, g, or t
  misc_feature (74)..(74): n is a, c, g, or t
  misc_feature (146)..(148): n is a, c, g, or t
  misc_feature (151)..(151): n is a, c, g, or t
  misc_feature (168)..(168): n is a, c, g, or t
  misc_feature (182)..(182): n is a, c, g, or t
  misc_feature (195)..(198): n is a, c, g, or t
  misc_feature (227)..(228): n is a, c, g, or t
  misc_feature (232)..(233): n is a, c, g, or t
  misc_feature (260)..(261): n is a, c, g, or t
  misc_feature (264)..(264): n is a, c, g, or t
  misc_feature (295)..(295): n is a, c, g, or t
  misc_feature (353)..(353): n is a, c, g, or t
  misc_feature (376)..(376): n is a, c, g, or t
  misc_feature (387)..(387): n is a, c, g, or t
  misc_feature (390)..(390): n is a, c, g, or t
  misc_feature (413)..(414): n is a, c, g, or t
  misc_feature (416)..(416): n is a, c, g, or t
  misc_feature (467)..(467): n is a, c, g, or t
  misc_feature (480)..(480): n is a, c, g, or t
  misc_feature (482)..(482): n is a, c, g, or t
  misc_feature (497)..(497): n is a, c, g, or t
  misc_feature (519)..(519): n is a, c, g, or t
  misc_feature (538)..(538): n is a, c, g, or t
  misc_feature (540)..(540): n is a, c, g, or t
  misc_feature (563)..(563): n is a, c, g, or t
  misc_feature (566)..(566): n is a, c, g, or t
  misc_feature (572)..(573): n is a, c, g, or t
  misc_feature (577)..(577): n is a, c, g, or t
  misc_feature (600)..(600): n is a, c, g, or t
  misc_feature (641)..(641): n is a, c, g, or t
ccctctcctataaggctctnatctctttcttgcgggttcccccctcattccctacgcatttttntgccttcccnaaggccccccctcttactacgttcgctttgggttttgggttctggcccatactttccctctttttctttccnnntantcgtgtgggcatttttnaaaactataaattntttcttgcataannnnccccccctatttttttttcccgttaaagnntaanntgtctgcttccccccccttagaaagcnntgnctccccccccctctgccggctcgcgtctgtncccccccccctcctttccccccctcctccccgccccggttcctgtccttttttttgcncttttccggcctccctgctgggngctggggcccngcngcgggctcccccctcttgggggnngntgttttgctgtgggggctggctggggcgtgggcggggggtctgggttcccncccttctgttctnanatgggggtggtgggnagtatctcatctttgggttccncaatgctcacgtggtcagncnggggcttcttagggccaatcttnccngttggnncccngggcagcatgatcttcaccttgntgcccagcacaccctgtctgagcaacacgtggcgcacagcngtgtcaacgtagtagttaacagggtctccgctgtggatcatcaggccatccacaaacttcatggattttgccctctgtcctcggagttt

SEQ ID NO: 644290 - DNA, 258 bp, Homo sapiens; identical to SEQ ID NO: 643295

SEQ ID NO: 644291 - DNA, 1010 bp, Homo sapiens
  misc_feature (694)..(694): n is a, c, g, or t
tgcaagtgattggattctagatactgatttcaagggtagcacacacgtgatctgctgatagattccatgtcaggtgtgagagggaggagagtcaagctcatccacagctctggcagcggaagacggccaaagtgaagaaggtggcctcaagtttacctccaccttccaaacctcaactggtaaaacctcatgcatgcccagaatgctagcacaagagatttagggaaatgtgggtattttgctttctggccctgcagttcaggttccaccttataaaatgggagtggcgtgggtggtgggcgccaccagccatattcacgggagttagcataagggttcacagtttgagtgaagcttcctgagactgtgccgtgctgccaacacagttctctccgattcattccctcaaaacagtatattcccaatgaaagcacgaccagtacttaaactagccatgttcagtgtggctctcagacctttccccagggcaagatgatcacaagaattcctttaggaacgtctcttaaattgtacaactaaagtttaatggttatattagaatccgtcttcgtactatgaaaattcacccaactgatctcccatttctgggatatttagattttttctagtttttcatcgtttaaaaaatgatgcagcctggggtggtggctcatgtctataatcctagcagttngggaggccaaggctggtggatcacttgagctcaggagttgagaccaagtctgggcacatggtgaaacccatctctaccaaaatataaacttagccggctggtggcttgctcctgtaactccagtacttgggggtgagtggaggattggtgagccgattggtagtgctggctggagaatgccctggcctagcggtggacgggaatgtcccaaataaattataaccttaaaaaaaagggggtaatcccgggcagcctttaagccaagataaaacggccgaaggtgatcggtgggccacactattttcggtgttcaagc

SEQ ID NO: 644292 - DNA, 325 bp, Homo sapiens
cgagcaacgatagcatgtaattgggatgtgatgtggtcaggtttgctaactcaggctcaagtgtggaagattggtgtactgcagagaagatatgtccaggttgactgtttgtagaaattctcgttagaggtgatgagggaacctggcataagggagcatagcagcgaggagatgtgaggggaccgatttaagtgactttaggatgttacattaagcggaattcgttactgaccagatgtaagggttgaaccataaggccgactcgaatattactcctcggtttcgtattctcggtgccagagctgggagtgtctttatctgggtt

SEQ ID NO: 644293 - DNA, 283 bp, Homo sapiens
tcagatggcacaggctagacacaggctcaagatggatcacttgaggtcaggagtttgagaccagcctggccaacacgttgaaaccccgtctctactaaaaatacaaaattagctgggcgtgtcggtgcgtgcctgtagtcccagctactcgggaggctgaggcaggacaatcgcttgaaccttggactgggaaggtggaggttgtggtgagccaagatcgcaccattgcactctagcctgggcaacaagagcaaaactccattaccatcttgagcctgtgtct

SEQ ID NO: 644294 - DNA, 167 bp, Homo sapiens
atgatactgtatcttgccccactactgccttctgccgcgattgtaggcctccccagccatgtggaagagtaagtccattgaacctctctttcttctcagtctctggctatgtctttatctgcagtgtgaaaatggactaatacagatatgatacatttcaggggtac

SEQ ID NO: 644295 - DNA, 133 bp, Homo sapiens
aatatgactcattacaacaatagtagcattaaaaaaattttaagggttttttgtttgttgagacacggtcttgctctgttgcacccgctggagtgcagaggcgcaaccatgactcactgcattctcgaccttt

SEQ ID NO: 644296 - DNA, 263 bp, Homo sapiens
  misc_feature (259)..(259): n is a, c, g, or t
gattacaggtgtgagccaccgtgcctggcctattaatatgctcttaaaactcatccatacgttttcatagcaagaaagcttatttctcccaactaccgaataatattctatcgtatggccgcacctctgtttatccatttacctatcgagaggcatcttgattacttctagctttggattattacaaataaaactatacaaacacgcaaacagagtttctcgtgtgaatataaacccgcaaaccggctggaggcatatnacca

SEQ ID NO: 644297 - DNA, 249 bp, Homo sapiens
  misc_feature (218)..(218): n is a, c, g, or t
  misc_feature (232)..(232): n is a, c, g, or t
tgaaaaattttgttatatatagcatatgccaaaaaaaagaaaagccccccaattggaaaagcagaagtaaattctctctgttcccagatgacatgattttatatttaaaaaattttaaagattttgcccagaaactattagaactaggaaatggattcagcaaagtttcagcccccaaaaccaaccctcaaaaatcagttgcatttttataccaatgnccgaaccccctctnccccctctagagcccaa

SEQ ID NO: 644298 - DNA, 105 bp, Homo sapiens
gttctgttcattgacgagttatgtgacatgaagataaaatggttatgtcgtggttaatattgtactttgtgttgatgtaaataaacatggtaatttattcattga

SEQ ID NO: 644299 - DNA, 341 bp, Homo sapiens
cactgtgcccctaagtcttcaaagcccacagctgggaactctaatacattgcctgtgtcactaatgaagagaagtgcacgttactagactacatcaacactattaaagggcaagtgacagcaagcaaggcacctactcatgtgtatgaagaccaggatttaccatgacacagtctacaacacgggcatagctgttatgatcctgaataccgctatcataaaaataatcaatttctatctttctgtcttccttctgctgcatgaggaaccaaagaagtcaaacagatgattgttctgtctgagccaaccatgaaatctttaagaacagacaggtgcagcgta

SEQ ID NO: 644300 - DNA, 113 bp, Homo sapiens
acccccggaaccgcgggtgaaaaacaacccccaccgccacgattgcatacctccagcaagaccctggaggaccccctgaaattccaggcccttggaaaaaattaccgcccccg

SEQ ID NO: 644301 - DNA, 141 bp, Homo sapiens
ctctagagtatcccgctacaaggccaaggagatcttgacatcagaagtacttgcatgcagaaatactatcatcgagactgccggcgaaacctgtccatcttgctggggaaagcgccgggctcctgggctcatgaggggcgg

SEQ ID NO: 644302 - DNA, 173 bp, Homo sapiens
acggttcacaccccggcacatgctgctggctgtggccaatgatgaacagctgactcagctgctaaaaggagtcaccatagccagtgggggtgtgacacccaacatgcaccccaagttgctaacgaataagcggtgatccaaaggaaagttggaagccatcatcacaccaccca

SEQ ID NO: 644303 - DNA, 126 bp, Homo sapiens
tgaggttaacatctcctcctgttttctccaatgttctcctttagtattggctggtaatttgttttggtgatttgccaccccctcgagattgccttgccataagtgctctgttgtgcccttatcgag

SEQ ID NO: 644304 - DNA, 141 bp, Homo sapiens
cggagaggacccgggaagcatttattgatccacggtggctcagggttggagccctacatactcccttccctttcacctcaaagggaactccttggtatgtagccacacactcatcattagggtgaagatccggctgtctca

SEQ ID NO: 644305 - DNA, 624 bp, Homo sapiens
caaacatggcttactgtagcctcaacctcctgggctcaaagtgctcctcctgcctcagtctcccaagtagctggaattacaggtgcgtgccaccatgtccagataatttttgtatttttagtacagacgttggtttcaccatcttggccaggctgtcttgaactcctgacctcgtgatacatccacctcggcctcccaaagtgctgggattacaggagtgagccaccgcgcctggccgagctatttaatttcttaaagtaattaaagcttaaacactttcaagtctaaaaacttttttttgaaacacaaacacttttgagcaaataagaaaacacagtatacatttttgctccttgtagataccttttcttaatgaatttttaccttacccttactccctttaaagcctatgctaggcttcagagaaatgctttctgttttctttagcctcacttgcatttgaatcctctagcagcttctcagtgactcttgctcacttattataaaatgccctcctccctcctgaatgaattgagcttaatctctacatgttaaatccccttgtgtgggcacccatgccagcagcctgggcaacagagccagactctttgtctcaattaaaaa

SEQ ID NO: 644306 - DNA, 402 bp, Homo sapiens
  misc_feature (279)..(279): n is a, c, g, or t
  misc_feature (346)..(346): n is a, c, g, or t
  misc_feature (353)..(353): n is a, c, g, or t
atactcgctgtatccttgaactcctgagctcaggtgatcctcctgcctcagcctcccaagtagctaggaccataggcatgtgccacaatgcctggctaattttgaatttttttttttcataaacagggtcttgctatgttggccatgctggtttcaaactcctgggcctcaagctatatttcctccttcagcctaccaaagtgttggggattacaggtgtgagccaccatgccctgccacttagggagttgttttatttttatcttggattggattggnttttctttgggggaaaagtatttaactggataattttatgttgggtgattcatatttttaatatttnctggaantatttcatatttccgagtagggaaagtttgttttttaacctggaaggtg

SEQ ID NO: 644307 - DNA, 146 bp, Homo sapiens
tgtgaagatcggcgactttgggctctctggtgtgcagtatggattctcggcgtgtgcagtctggacgttcggcgtgtgcacgtgaagatcggcgattttgcactcgtgcagatcggcgattacggtctggacgttcggcgtgtgca

SEQ ID NO: 644308 - DNA, 567 bp, Homo sapiens
acacgttacagatcatgcatactaacaccaagtccataagtccttaatgtgcaacttgtgtataacagtgtcactagttactagatgaacacagcttgttcatggaacagcacatctagaacgatgtgacgtagagactgctgctcaccttctgtgacctgaggtatcccatgcctgttttaacactaaatattcccacaattgcagcacatgatgccagaaatatgcactgaatcaagaaaatagccattgcggaggtgccctcttggagtctttctgtccatcccattctattctgtacggtgacttcaggttcagggaggttgggtaaggttgttaaaaataaacaggaaagagcaagtttggctcagtcaagtgatcagatccccgaactctagattccccagttctaaggccttatcaccctccccgtgaccataggccaaacaaccatagttcctcacataagtgtttagcagactctttgtggacgagtgaatttcacaaacggcacaatttcagaagaaatcgagggcacaggccccagtatgcttctttgggcgcatc

SEQ ID NO: 644309 - DNA, 496 bp, Homo sapiens
  misc_feature (91)..(91): n is a, c, g, or t
  misc_feature (284)..(284): n is a, c, g, or t
  misc_feature (296)..(296): n is a, c, g, or t
  misc_feature (301)..(301): n is a, c, g, or t
  misc_feature (309)..(309): n is a, c, g, or t
  misc_feature (319)..(319): n is a, c, g, or t
  misc_feature (341)..(341): n is a, c, g, or t
  misc_feature (398)..(398): n is a, c, g, or t
  misc_feature (419)..(419): n is a, c, g, or t
  misc_feature (459)..(459): n is a, c, g, or t
  misc_feature (489)..(489): n is a, c, g, or t
ctgcttgtttgttgcttttcttctcatatttattgtcaaagataaatgtttcaaaaagaaatgactaaggaaggaaaagaaacaaatgctntaaagattttctctccccaagcacttttactggtgaaataaaaaccagtaacaatcaatatgtaaaaacggcccacttccctaaaaaaaaaaaaaaccttgcagactacaaaaattacttttttttagtctgcaaggttttttttttttttgctttagtctaaatacttgttaatcttacatgttctcccaangtgctgggattncaggngtgagccnctgcgcccanccatttttgattttttgtaaanatggggtctcattgtgttgcccaggctgattaaagtttctataaggtatgtttattnttaaggatatctactctaacncctgtaaatgtagggtgatcaattagtaaattaataaatntgaatcaattaataaatctgtttaaaattnaaaaaaa

SEQ ID NO: 644310 - DNA, 502 bp, Homo sapiens
cagaatcatcctttttgaatccctgtctcagcatccattgcacagggtatgagggctggtcttcctaggacttgtggcaagatctgcacctatggcatttgcagatgttcagccccatgtagctgacgtcatggacagggctggatgttgagtgactgtagcttttccatactgagggtgcaatgctgtttgtgggtctcatgactctggggtttggagaatgatgcctccctgtatgggggcctgtgcacagcaatgggctgctgcagaggactgtgaaattgccttcgaggcctctttcccattgtcttggctatttgcactgggcttcttttcatgccgctactctaagcctccctgaattttcccccgggacaatcagcccctctttacgaccacttggccaggcagcggatcttccaaagtttaggtctccaattctcatgtcaatcgaacgtccaacttgaagtcctttcttaggtcacgcctaagaacacaggct

SEQ ID NO: 644311 - DNA, 388 bp, Homo sapiens
  misc_feature (46)..(46): n is a, c, g, or t
  misc_feature (159)..(159): n is a, c, g, or t
  misc_feature (176)..(176): n is a, c, g, or t
  misc_feature (188)..(188): n is a, c, g, or t
  misc_feature (193)..(193): n is a, c, g, or t
  misc_feature (201)..(201): n is a, c, g, or t
  misc_feature (211)..(211): n is a, c, g, or t
  misc_feature (233)..(233): n is a, c, g, or t
  misc_feature (290)..(290): n is a, c, g, or t
  misc_feature (311)..(311): n is a, c, g, or t
  misc_feature (351)..(351): n is a, c, g, or t
  misc_feature (381)..(381): n is a, c, g, or t
gccttttgggttcaagcgattttcctgcctcagcctcccaagtagntgggcctacaagtgcatgcccccacgccaagctaatttttgtatttttagtaaagatggggtttcatcatgttggccaggatggtcttgatctcttgacctggtgatctcccngccctggccctcccaangtgctgggattncaggngtgagccnctgcgcccanccatttttgattttttgtaaanatggggtctcattgtgttgcccaggctgattaaagtttctataaggtatgtttattnttaaggatatctactctaacncctgtaaatgtagggtgatcaattagtaaattaataaatntgaatcaattaataaatctgtttaaaattnaaaaaaa

SEQ ID NO: 644312 - DNA, 133 bp, Homo sapiens
aaaaaaccgtgcgtcgcttgcaggatctacacgcaggattgaaggaatgatcaaatacccaatgaccgtccagggcgcaaaagccctggaagaagaacacgcccacctgaccaaggtcgtccgtccgaagctg

SEQ ID NO: 644313 - DNA, 158 bp, Homo sapiens
gtctgcgttgtcgtgagctgtgtcctgtctggccaattccttggcaacagactgttgtacacggagtgcaaactcctcattcgcttcccctagttggcgatgaacaggacgaagccaccttacttgatacaccgtagaaagggacgaaagagtgacca

SEQ ID NO: 644314 - DNA, 1091 bp, Homo sapiens
cttggaatgtcagtcgtagtcctcgcaggtctcggctgggacgctggaagtgcgcagtccacgacagaacaaatattcggtgcttttacctacctacaactgagcgcgagaaccttgccgctcaatcgctgctggctgctggctgacacaagcttctccgagagttggaattcaacctaatgaacattataactcatagactgcactggaagccccagcattggaaacaaggggactgctgctgaaacacgttggaagaacgatctatggcgtcacgacagaattcttctacagaccaccgagagcaaacacacgttgggcacctaggaactgccatactattcatgcgacatgcaacacattgccacaggaaaacttacatcacttaatcaatggagtgcctgatcttctcaccacccaatcgcaaaaattttaattccctgacacttcactcacgcgacacgccaacaagcgagcggctaaattctcggactacttggtcatctgggaaaccccgttaacaaaggtacacatggcgcgctgtatattgcgctggcgatttcgcacaggacacaataactcgcccgctgggcgcccaatttttttaacctccaggtctatgcctggagaacccagtgagccatcttgattttacccagcgaccggtttccaagatttaattacccgaacaaggcacgtttcctaagaggaacacttacttccacacaaccggttgttacctaaagggcgtacgggcgttcccagaatggccgacttgacttgcgtcggggcaagaacccaggttggacattatacaaatgtgcgaagggttcccactatcactttgtgggcccccgggccaaacggcgcaacacccccgtttgggagcgacagcgaaccaagaaccccctcgcacagggccgatacttagcccccactacggcgagcagaccatcacacaaagcagccccacctgcatagcagaaccagacccaccaccgcggtacaactaacagaagccagcgcatcccgacatgaaatacgggccacccgcagacacactaagcacggagaacacagaccattagacg

SEQ ID NO: 644315 - DNA, 200 bp, Homo sapiens
tggtaaactacatacccaaaataaagcatatcaaaaactgtaaaaaaaaaaaaaaaaaacccctaatatcagatttcccaaacacaacaataccataatttaatcccttaaaatctttacctcaaaacttaaactcaagtgactcttttagggccaggtgtgttggtgggcctcatgattagtaactcacagctactttg

SEQ ID NO: 644316 - DNA, 449 bp, Homo sapiens
cacaggcacctcttctactcagaacatggcagaatactgagctatgcagccagcagtcaacaagccactctcaagagcgagggttgtcccaacagaggcagtcagatcaggaatcggcagcccttgaaaagtgtacggtgcaacaatgagcaatggggcgttcgacatccccaagtcttgcacgccaagaaaactgtatccccagtcagtccgcgtcagcattggcaaaagacatccggtgcctctaggcgccatcaccactgtccaaggcgctgtcttctttgggaaggtatctgatttggtcagtcaccaattgttttttagccttccgtggagaaaagcaagtcctcaagaaagaattcgctgtatgtagagaaaaaatattttctctcatgttagtacatgcagaacatttaatattccacaatatatatggttttttattcaaa

SEQ ID NO: 644317 - DNA, 1096 bp, Homo sapiens
cctcctttccacccccctatgtatctaagccttgaacccacagtctttgtgccctttttccttaatggcccactacccaccgctattcccaagcgaaaatgttaattctaacctataaatgccttaaatactcacaatctcgtttttttcgcccacactagcgtcgttgtcgagggttgcccaataagggtatcaacgttcgagtaggaaggacgttgaccttaacgtgagaaactcgaatgctgcccccccgtgggcacacagagaggacccccgagggcccgtcggattgaggtacacaatatttctgccggggcttctcgcaaagttgacactcggatttgttgccacttataggcacccctttcatggattccaaccacgatcttttacaccgaaccgcgctttcaagagctcgtgctctccggggcgcccagagctcgatagaaaaaggtggaggtcccaggtacatagcgcacacgttgcaaatttctgagaaattgtctatgggtccatatagtccgtgcacgccctccactctgtctcactgactcccgcgtccccagacgtcaacttcatggaccgttcagttagaatttctctttttgatcccagtatagtgtgcttgatgtgccacacaatgcgccatggtgcagcttgtcagtaggccgccatacttatggcataccacttgcaacgcctccgacccttcccggtgcctcagagccggacttccaattcctacgctcatcagctctccttcgagtagtctaggacctgccaggctgcgtccaccacgcaccggactaatttctttgtatttattagttacgagatgagggtttccccatgttgagccaggcatggtctcgaactcctggcctcagagtgtgatccgcccagcctccgcctccccaagcgctgagattacaggtgtgagccaccgtgcctcaggccctcactaggttttaaggagtccccagcctctcctcccttctgggcccgaccagccttatactgctccatcttccccggccacatgccccgccaagtacgtgctaccagggaccccccacataaggccgtgctccgtgaa

SEQ ID NO: 644318 - DNA, 1369 bp, Homo sapiens
  misc_feature (1369)..(1369): n is a, c, g, or t
gataagtaggtttatctcatggtagacatgcagaagagagagtacagattgttattaacatttggatgattaggtgtgataatggtggacggatgaactgggagtatgtaaatataatacatttatattgacgtgaaggctagagtagtcgctaggaatagtacgttgttagatgatcgctgtgcaaaggacaatcctctgatatatcatcctagacttgcattgtctttagcggagaagcatatagagcaaccgcacgtatacgcgcatgcacgtatgcattggctcaatttcagcttgaatggggcaaatctttcagaggttcgttagtgcttcggcaaggtctgcttgatcactttggaatacaaacgtgaacgtagaaacgtaggataagtaactcccgtggtgctacttcgaattcctttcaaagttataggccgtcacgtttagtggtttattaatggatatacaaagagatactagttgtacccgattttcgggagatgactactaatatatgctaggcggaattgtatatagagaaggtatgctgggagcatggcgaataaactgggtcgatagtggatatagctggtgttagagactcgtttagataagattttggcgtataacttgcggtagaaatgtaattaaaaagccagtggtccccccaatttccgttggtaggtctagggatatggaacagaatctccgtccatcaccaattaactttagcaaagcgcggagcgagagggaaatgtattcgcctcgcgagagtcgtatacatggataagagtgttggaagcccttttaatccaataaagggcaacccattgtgtgccagggtagagaattgctagaaaaaggtcaagtcagtcagttcccggttttctgaatctaggcggaggagctcaggagaagaatgacgagaattgaagataatttagccaatttttgccaagggttgtggcagacaggaagggtttatctcatatgtggcttttttggagagggtaaattcaatcgaagggggtaaatttgctaatgggtgggagaatccgagatttgattaatttcctctaagaaggggtggaccttttttggaccccatttctatcagtggaaaatcaataattgggacaatttaaattaggattagggtagttccaagttggaaaaggaacgggtgggggagagagagttggccccataaagggttgtaaaagggcgcattttacgagtaccactttggggggaattttatccatacactataaaaggtccaataaaaagacaggacagttttatacgagaaacattttgggttaatagggagttaagatatgcgggtcgtgttttataatatacn

SEQ ID NO: 644319 - DNA, 279 bp, Homo sapiens
tagctgtgagtctgactcttagagtgatcccccagcgtaaattagcatctgccaaagtagagtgccagtcagcacattacagaagaggaagatgatgatcctgatgtttattactttgaagtcagatcatgtggcactgaatacacaacaagagattatcagacgactattacagaacgattgcgtgtactcggaggctcacgcgttctccaagccagtccaagcaccttgaaaagtttcaggcaggcacccagaggagaagcacttgaaaaaatccca

SEQ ID NO: 644320 - DNA, 365 bp, Homo sapiens
gcagaggatttagacttcgtctaacagagctgagtcctggatggcgtcgcgggacactagaacccaggcccgcagctgccttcatattcccttgtaaagtgagagaaagataatctttggctaagtcacagacctatgttttgctacttgcagcctagtatagtctgatttaatataggacctgccctacccttactaggtatcgcctgctttcccatagacaaaccagcatgccgagaaagatctaacttctagatttctctaaagatgtgtgtctgtgaaggacaagtataggactgttccgcttcatactaccatgactatgtgagttcctagcgacttatgaagtctgcggactcactctc

SEQ ID NO: 644321 - DNA, 475 bp, Homo sapiens
  misc_feature (9)..(9): n is a, c, g, or t
  misc_feature (26)..(26): n is a, c, g, or t
  misc_feature (31)..(31): n is a, c, g, or t
  misc_feature (50)..(50): n is a, c, g, or t
  misc_feature (61)..(61): n is a, c, g, or t
  misc_feature (88)..(88): n is a, c, g, or t
  misc_feature (118)..(118): n is a, c, g, or t
  misc_feature (219)..(219): n is a, c, g, or t
gcccgcccntagaaatgcccagccanggagnagccttccaaaattggatnaagccgaattnggactacctccatggatgtactagtangcacacaggcacttgaaaaggccaccaggncctggcgctgacccttaggacccaggaagaattgacttggatcttgagttgagcctggtggtgacaccaacccacttgacacgacacaggtggcgtccccntcacagaggagagccagggtcactttggagagactgtactgagtcctgggaacttcacatccatccacctgtcttgaccagtgaaggagttggaaatgagccccgagtggtgaaatgacagggcccagtgacagtaatggtgtttgggccaggctggggttgaactgggataatagtttgggctatcccatcccattatccccagtgtgggaagagacctcataattttttgaaattaaaaccagctttgggaaat

SEQ ID NO: 644322 - DNA, 357 bp, Homo sapiens
cgccgttttgtaggatgcagaatctagacagtagttaatttgacaggtttcagaatggtagcccagcaaacacccaggttaggcgcctataactctgccaagttgaaagcgctctgcataattggcagtctcttgataggtagtctgacagcatcttttcagtttttggcctaaaggtgactacagagacttcagagaaaaatctttttttttttttttccttgctcaagagtaataatgaggctggagagctagatctgtccttaaagtatttgccaaacaagtgtgaggaggagctatgtttgttactaagagcccatgctaaaaaataaccataaagtgaaaccaggtcgacgc

SEQ ID NO: 644323 - DNA, 232 bp, Homo sapiens
tgaagctgattcagagtatcccgctgtgcacgtgtcatcagtgggtcattaagaacatggcaactcaatgaccacaatgagataccatgtcacacccgttagaatggcaatcattataaagtcaggaaacaactatgctgaagtgtcttagagaaataggaacacttttacactgtatgggagtgtaaattagttcaaccattgtggaaaacagtgatgagacgatagaagg

SEQ ID NO: 644324 - DNA, 172 bp, Homo sapiens
tgtttcttataccacgatattgtgttcatcttttaataaaacacagttaaactttgggaggcaaggcaggcggattgcttgagcccaggagttagagaccagcctgggtacatagcaaaaccccatctctacaaaaaaatacagaaattagccaggtggggtggcacatgcc

SEQ ID NO: 644325 - DNA, 331 bp, Homo sapiens
  misc_feature (90)..(90): n is a, c, g, or t
  misc_feature (141)..(141): n is a, c, g, or t
  misc_feature (151)..(151): n is a, c, g, or t
aaaattgagcttttttattagaaagacaacagtacataatttaccccttgctaaaggtattcaataaaaaagtggagatatttttattcncaggtaattgtcacatacagtctttcttctctacttctgcttcattctctntgtgtcactntagtatgtgtacctcctgggtgctctctgtacatttttctcctctatacaagtctgtgccatggcttctgctgtcattcttctgcttgctctcacagattcctgtgccgttctgtctccttgctgtactacaggattcgtcggctctcggctcctttcctccttctgtcgtctctgcacc

SEQ ID NO: 644326 - DNA, 110 bp, Homo sapiens
tcccaaacgtttaactgaactcctcacacccaattggaccaaggctatctccctatagaagaactaatgttagtataagtaacgtgaaaacattctcctctctgcgtttg

SEQ ID NO: 644327 - DNA, 260 bp, Homo sapiens
ccggggggcaatggactaaactctttccatgccaaactttgaaccaccacccttgaggtgacccaatgcagacctcctgtaccctatacatggtagagattcctgaggggctaacttacaagtttttgtttgtttgtttatttttgtcttgatttactctacaatgttgtataaacaccactattcaatagtaaccaaacttcaaattttgatcttttcctgggtctaggggcaattagttgtatttgtaattctcttga

SEQ ID NO: 644328 - DNA, 479 bp, Homo sapiens
  misc_feature (475)..(475): n is a, c, g, or t
cgcagcggtactggtctgaagtcggaaacaacaagttcggtcggtccatgggtctcgtcgatccaggtagtaagctcttgggcgttcgctactgttgccgaaagaccaacaagctgaatatctttcggagcataaataatcgattcttcccaaacagtgccccgatcagcatcattcatgtaatgacattcatctaagacaacaaaggcacatcgcgcaagttgcgactaacgtcaccaagaatggtgccatacaacatgttgcgaaaaacttcggtagtcattacaaccacaggagcatcacggttgaccgaaagatcacccgtgagcaaaccaactttttcatccccgtacttttgcttcaagtcataaagcttctggttagatagagctttaagcggcgttgtgtaatagcaacgcttgtttgacatcagcgccatctcgacagcgtattccgctatgactgtttttcctgnaccg

SEQ ID NO: 644329 - DNA, 146 bp, Homo sapiens
actgaatggatggcgccatgacaacacaggacagtgaatatgtgattgagacggattctccgacgagactgtccgatacgcccatgaaaagctcaatgccggcagggcttctttgctacgttagtggatgttgtcgtccgagcgga

SEQ ID NO: 644330 - DNA, 403 bp, Homo sapiens
aaatcgagctcggctacctgtaacattcgtgtctacaacatgtgagagggtgtctggctgctctctggctctgtactagactcggtgacaagagtccctcatggagcagattggaaaggacccaaagtgtgaatctgctcaaggaactgcacagcgtgcttgcaaaggcagtgactttcgtgtgagtgtcggatgaaaccatcagccagaacatggggcggtgctgtcgattctaacctggttacttgtctgtgcccccactcgatcgtgtgggctgtaagtagcgcgaattaccagtgtgctagacagtgctctgccctgcactcgccggtgttgcctcgcgcctgtgtctgccgtctagttcccggaagctgtcctggctgctggcctgacccctgagact

SEQ ID NO: 644331 - DNA, 1370 bp, Homo sapiens
gaggcatgaatatcaaatcgctaaggggacaagcattgctgtagtctgcccatccgtcaattccggtcagctgctttctgcataattgaacagacaccatagaggccacgcgcaattatcgaatcaatgatcagccttgcattttgcgtactcctctagtcacacaactcaggcctctctgcgatagaccttttgtctcatcatctagtaccatcagtagggaaagggatgtgaggattgtgaccttacgacgaaaatctgatgaccttgagctcaaatgtcataacttgatatcatcactcgactggacgaacgaccttcgtatgagaatcatttataccgttgctgatcctgtcagaagaccctattaagtgaatcctcattcttctgttgctcttacacgtaccttctattactccataccaataactcacataaggccgagaggtactcataatcgaagcttcaacatatttattaacttcacaggacaaagcagcttaggcaacgtagctaatatgattcttactgaccatcttggggaaaaagaacagccataaaaagctatagcaattccacaaaaagtctattcagtaacacacgttctccaccccggcgtcctctccatgctcgcctaacgagtcagtggtggttgaacgccctcgggggtaagattcccgtgcgcattcaaggtggttcattctggactttggagagtctcctatggtgaatttcggaaaaatggaggtatccaacccatttagggggttcgaaataaaaaacggtgcttacttcgatggaaccacggagggctattaacatttatggtcgagccaaagtcctcacagttcgccataggaattcgtgcctccattgggtgcgtgcacacgtggaaacgcacggtgaaatttccctttacaatcgcggaggcgggtccaaaagttcttatcgaacttaaagatggacagccccaaagttactctttttaatagctaaggagcggatggaaaggaattttgcgggcgaattggacggtgaccaattggttcgggtggaacctacctatgattggccatagggccccaacgtaaggaataatattcattcccttggtcacgttcggcgcttaattctaaagggggtgtgaactccacctttcctttacccctgagatcaagtattaactctgcttgggaacactgggagaatggaggtttccttggaaaagcctgactggaaaaaattccaggacgggcactacatcggtcccagttccattcacaaaaacccctattaagaggataggtggacgatccatagagaggaggatgcttctgaactgtccaggaccggaagaaagctatctttgg

SEQ ID NO: 644332 - DNA, 726 bp, Homo sapiens
agcggggttgagattcagaccttgacagtgtaaccgatagactgggctggggcaacgctgatgaaaggcaaattcctgagagaaaaatcacccagagtaaggagttggcactgtagactagattcagctgcaggaattgtgcactagaaaaatgcagtgtttcttttttttttttttggagacggagtctggtcctgtcgccaggctggcagtgcagtggcaccatctgggctcactgcaacctctctctcccgggtttcacaagattctccgtgactcagcctccgtgagctagcctgggacttacacggcacccaccacgattgcccggcctaattctcacgtagcagacaggcgtttcaccagtgttgaccaggctgtcctcgaactcctgacctcacgtgatctgcccgcctgggcctcccaaagtgctgggattcacaggtgtgagccactgagcccggacaaaatgtggcggtcctaatggcaggcacttgaacccacattgaaccctgagaacctctctgacagggctgcgctgctctgggcactgccacgagctcatgactattccagtgccttctctagcttcctagagagtcgttactgagtggacctgactacctagagagagtactccagaaagctccgtgccgaatcacagcctacctctttaccagtgtccctccaccgatggccgcccctgaggacgaatcctcaacctgg

SEQ ID NO: 644333 - DNA, 1699 bp, Homo sapiens
gctcttcttatcatcactgattgtctgttggtgttccgctaagatgttaatccactattcgccttgttgtgtggggttcgtcacacaggacaccacaatccaggagagtttttatgggggcggcccaacacctcagtgtgatagatcaccctccctgcgaagcgggggtcgcccacgccacctacagtgcggttggtggaccacgcaacaaaatatagcgccctacgggccgttgtttgttttgataactctcgcgtcgtgcgggctcgccgcttgtatctcattaatatttattctccgcgggggtcctcttctaaaaaagggtgtgattacgtccgcagcagggcccctcattctgggggtgttgggcgtgcataatattttttcgtgggtcatctctccgagggggggctttgttctcctcctcgctggcgtggctgctcctctgggatgggtctttttctggctccgggggggactgtttgtgtccaactatttcctgctggtgcctcgcgcggggggggtaaaatattatgtccgcggtgattacacacaggggtttttcttgaccggaagaaagctcttcattaaatagtatgtgtgttttcctctcaccccgtggggcggccacaccacgcttctcgccgggcgcgtgaagaagagaatttctcctcccgcgagagggaagagaaaaaaggggaggagatctctcgcccaccaacaagagaaaattataggcgcccccctaccggggggataactctcggcgatcagagagatgttggggagcgccacacgcccctctattatcgccgacaagaaaattggtgagaagaagagtgagaaggagtccccccccccccccttttgtggggagagagagagagtgtaaaagggcgcccaccccaggcccccccgtctcagaggggatatactgccacagggggggcacaacagagacgtctcgtcctcgcacacttcgcggcgcgcgctgtagatatgtgttctcgagaagagggcgcgcacataatacgacccccacagagagagcgccgagagagcttctacacagttgtagatggtgaggagagggtgggggtgtgagagagagtgtgagagagatagtagatatatggtgagaaaatatagtctctactatcgtgagagagagagaatagtagagagagagataatatcactagaggagagagaatacacctgtatagggggagagcctcgcgacactgttggagaggagaattttgtgtttggcggtgatatctctctatatgggggggagagctctctctctgaatagtcacccactggtgagaccactctcactgtgagagagattttttgcgcgctcttataagcactctgagagacttctctctctgccactactgtgatgtcactgagagagagtgtaaataaactcgctggagattcccgcctcgtgttttctttgtttcctctgcactattttcctcaaaatagcctcttactggagtaccctgttgctggtggagaccctcataggtgatattgccacagggtgcaaatggggtgtcttgtggtgtggcccgcttttatttgaagagttgcccttgcaccccggggaagatttttggcccccggaggttcacccctttgcctgggaaaatttaaagcttatataagccattttaaaagccca

SEQ ID NO: 644334 - DNA, 457 bp, Homo sapiens
cgtacactgggtcgagtctgcaggcggtacagaaagcgtggctggggaggctcaggaaactgacaatcacggcagaaggcgaaggggaagcaggcacgtctggccatgtggagcaggagagacagagagagtgaagtgggagggctgcaaggcttttaaacaaccagatcccacaagcgctcactcaatatcacgagaacagcaagggggaagtcggaccccatgagccaatcacctcccaccaggtccctcccagaacactgggaattacaatttgacatgagatttgggtgtggatacagagctgaaccatgtcaagggtagttcaaccgctgagatcgattgattgatggattgactgagatggagtcctgctctgatacctaggctggagtgcagtggcacaatctcggctcaccgcaacctccgcctcccgggttcacgcgattctcccgcc

SEQ ID NO: 644335 - DNA, 1543 bp, Homo sapiens
  misc_feature (1137)..(1137): n is a, c, g, or t
  misc_feature (1429)..(1429): n is a, c, g, or t
taggtagggggggtgagcttgaacgctttcttaatggggggggggtttataggcctactaggggtgtaaaatttttaactctctcttacagagggttttttcctaggtggtccaaagaagcgtggttcctctttgggactaacgaggttaaatttacaagggggatttagaagggttcgtggtgggcaaatttaaaggtgtgaactaagaaattcatatctctggggacaaccgaggctaatccaccgaggtgctccggtaaagagtttggtgcgcctcttctaaccctatataaatattcttccccatctaatatgtgggctaactataagaagcgggtggtggcttcctttaaaggctgggtcttatagaggatagacctcgagtcgtgggtatatgcggggggatctatatagagctgtgtggggtctctctcccttgggcaagagggtataatcttccatagagtatacaatctcatatatatgtggcacgaaagagtgtacatgagggggggtataggctcctcgtgcgcgatatatattatacgcgcggttggcgcgatatataacgtcttgttacaaatctgtttccccttgtggcgggggaccataatatatctatatattggcgcgcacaagtggttttcaacaatcttctataatatcgggcgcatatataccttataattgggggggtaaatgggtgttgggggcgtaaaaaggtgtgtgtgctgcggatacgtaacaggggtggagatgtggggagatggggtgtgtccacaaggcggctatacgtggggaaagggtttgggcccggggttggggccttatttgttctcacccttgttggagacctacatgtgcgcgggaaacaatgtgggtgccggcgcaatgggtcgcaatcggtacactgtggatccaggacacaggggggcttttgggggtccgcaattggaacccccttggccgacctccacagtttgaacgcgacagacacagcggccaatatggcctttcccaacacgttggtctattggcacggtcccaccgtggaagttaccaatccgccacaaggtttctcccgggcacacaaggggtggcccaccccaagaaaaaggtttatgggtcccggacnaaatgcctgtggcgccacaaaagcgtggcgcgaccattccaactctcaccaacaaacgggggtgccagcccacaacgaaggtgggcggcccagagaaaaggattggtagatcgcgcggaagtgaaaagtgggacacgtccagaaattgcacagcacacttattgacgacgcgccgtcaacactggtctctgacaaggcgcgcacggaacctgggtcgtgcgcagaaatacaaccccacgacagcagagcgtgtacaacacgcgctcaacaaggcggggccccgctggaagangttcccccagaaagagcgcggggacaaagggacagtagacacaggcagagcaatcgacacgcaacgtaacacaccgacaaatacgccggcgatagaacactacgcagtgtccaa

SEQ ID NO: 644336 - DNA, 294 bp, Homo sapiens
gcgtcgacctggggtgacaagcatacaccaccacgggcggctaattttgtatttttagtagagatgaggtttctccatgttggtcaggctggtctcaaactcctgacctcaggtgatctgcccaccttggcttcccaaagtgctgggattacaggcatgagccatggcgctgggccaacatcaaatatttttacagccttttacaattcaccaagcactttaccatccatggtctcaccattatcttatcacaggctgtctgttacttgaataggagagcctccatttggattc

SEQ ID NO: 644337 - DNA, 239 bp, Homo sapiens
cccgtgtttaaattaaaaaacccaggtttggaaaaatgcgattttcccgctagcaaatgaggatgccaggatgtgagcccgtatcattgcaactgccccttcaggccagttttgggaagctcataattgggggctgggggagtggctgtccctctgtaactgcctttaaaacaaaaaccccctttgttttggtcaaaaccattttccggccccatgtgcaataaaaatttgtgaaatga

SEQ ID NO: 644338 - DNA, 412 bp, Homo sapiens
aagatggcgtaccagaagcttgcggctggagtacctccagatcccaccggtcagccgcggcctacaaccactgcctgcgtgcctcaccaccgcccgccgtgcagttgggaattgaatgcaaaacctgtttgaagttgtgactgtcaatgcctggaatgtgaatgctgttgaaacaactgtttgcaaaatgatggggaggatgtgaatgcaacccaacctggctgtgatgtgttgttggggggcccagttggggaattgcaatgtttttgtgatgtggaaacaaggatgttgtgcctgatgatgcgttaactggtgcgaaatggctaaggaaggaaggggctgcttttgccggagggtcggggccaggaaggacttgttgttaatgttaatggttcccttttggggttgggaa

SEQ ID NO: 644339 - DNA, 513 bp, Homo sapiens
acgatggttggcaagttaacccatgatttcacaaataatattggttagaaaaagctaagtttaaaaaaatgaattgacttaaagttgatttcaagaaagctataaatagaacctgggaggttaagtctacagtgagccaggctcacaccgctgcactccagcctggggcaacagagcaagattccatctcaaaaacaaaacaaaacaaaaaatacaaagaaaagaaaagaaaagcagctggaggctgggtgtggtggctcatacctataatcccagcactttgggaggccagggcaggagaatcgcttgagtccaggagtttgaaaccagcttgggtgaaatcccttctctgcagaaacaaacagaaattagccgggtgtggtggtgccccaggtctcagctacttggtggggtgaggcgggaggatcccttgaacccaggaggccaaggctgcagtgagccgagattgtgcccctgcgctccagcctgagtgacggagtgagaccctgtcac

SEQ ID NO: 644340 - DNA, 434 bp, Homo sapiens
  misc_feature (7)..(7): n is a, c, g, or t
  misc_feature (13)..(13): n is a, c, g, or t
  misc_feature (37)..(37): n is a, c, g, or t
  misc_feature (100)..(100): n is a, c, g, or t
  misc_feature (131)..(131): n is a, c, g, or t
  misc_feature (134)..(134): n is a, c, g, or t
  misc_feature (187)..(187): n is a, c, g, or t
  misc_feature (339)..(339): n is a, c, g, or t
  misc_feature (369)..(369): n is a, c, g, or t
  misc_feature (372)..(373): n is a, c, g, or t
ccgggcnaacggncagaaaggcacgggccgtccctcngacacgtcccagaactgaacttcccttccattgaagcgggcgcaaacacccagaatgatgttncgaccctatcccgtagccatttaaaaacttntcngcagcagcaggcttcctgccctagagtttgaccctatcccagaagttcctttnctcattctctttcacctgcccaatcagctgttaatctgaattttcaagagaaaacaagcaaacataactgatcagctgccggtatgttcatcgtgtgaaattgcattccaagtgagctgtgctcagcagtgcttggacacagagctgtcaantgcgctggggtggaggaccgtcacttaacnaanncccaaggcagaggttcgcattgctgtatcacagtattttattcaggtttctgcaaaaaaaa

SEQ ID NO: 644341 - DNA, 136 bp, Homo sapiens
aggaaaagtggcatgatgcaggtctgagtggtgtgtcatggatgacatgctgtcggcgttctcgttgatgcctgtaggtcatctggtcagaggaactgtcagagataaagcactcggtgatctacaaactatggag

SEQ ID NO: 644342 - DNA, 201 bp, Homo sapiens
gggggcccttttgggggccccccgggggctgggccttttaagggggggcccgtcccccccccccttttttttttggggccccccccccccttgggggggggggggggggttttttttttttttttgggaaaatttcccaaaaaaaaataaaaaaggggggttttttttcccattaacgggcccccttggggccccccccta

SEQ ID NO: 644343 - DNA, 393 bp, Homo sapiens
aggtcttagggagctgtcacggaagaaccatgttgctgggcacggtggctcacacctgtaatcccaacacgttgggaggccaaggtgggcagatcacttgaggtcaggagttccaagaccagcctggccaacatggcaaaaccccatctctactaaaatccaaaaattagtcgggtatggcagtgcacgcctgtaatcccagatactcagaaggctgaggcaggagaatcatttgaacctgggaagtggaggttgcagtgagccaagatcgtgtcactgcactctagcctaggtgatacagcgagactcagtctcaaaaaataagggaagaaaaagaaaccaggtgactgttgtgcccgtctcttgtgcccgatctttctccctaagaaccta

SEQ ID NO: 644344 - DNA, 631 bp, Homo sapiens
agcccctttttccgctccctgtgactggcagatggtcttcttgcagaagtaccctcccccgctgatccccccacgaggggaggtgaacgcggccgatgccttcgacattggctccttcgatgagtgaggacacaagaaggaatcaagttacttggacatgtgatcaggatgctctacctgcaacttccccctcgaccgatctctcgtatgctgtgtgtgcatgcatggatggtggcatgagactgtcttctgacaccgatcaactgctgagacatgacctggctggatggctcgcaagaaatgccaagaacaatgcatgcttgggccatgagtgaaggactactgccctgtggcaatggactgcatcatgcatggctacatgtccagatgatgtggcaaccccgttccttgacgccaagtttggcatgctgtgcttggtacttactagccttgttccccaaacctgcctctgattttgtgcggtggcagatgggctgatggctccctgcaagatgcctgcttgaccactggagtgagatccagtcggtggatggagacgcagatcaatggagctgcaggtgcctgctcctcaagatccgctggttggaaacatgttcaatttttgcacgtg

SEQ ID NO: 644345 - DNA, 288 bp, Homo sapiens
gtgacctagaggatcccctgtgcttttatttatcttctgggacagagtttcgctcttgttgccaggctggagtgcaatggcgcaatctcggctcaccacaatctccgcttcccaggttcaagcgattctcccgcctcagcctcccgagtagctgggatcacaggcatgcgccaccacacccagctaattttgtatttttagtagagacggggtttctccatgccggtcaggctggtctcgaactcccgacctcaggtgatctgcccacttcgccgtcccaaagcacag

SEQ ID NO: 644346 - DNA, 303 bp, Homo sapiens
tgattagaggatcccgaatcatatctcttcctctctttacgtcgtcctcctctggcctcaatggcttttctttacgtttctggcttttctggatggtgaagtccttccaggcgtcttatttcttccggtcgtctcatcagatctgggcgcaaaagattggccggaggtccaggataggcatcttccatttcactttccaattggtctttggcatctttcatggtttttttcaacttggttcccttgggtggtttttccatttcatccaaagacttccatcggctgagaatatccgtactcaaa

SEQ ID NO: 644347 - DNA, 347 bp, Homo sapiens
ctagctttggcagtagcttgccaccagccttaccacagatgaaacctgtctccactaacaataaaaacattagccaggcatgatggtgagtgcctgtactcccagactactgggagaggctgaggcaggagactcgcttgaactcaggcggcagaggttgacgtaagccaatatcgtgccactgcactctgtcctgggcgacagcgcaagatttcggtctcaaaaacaacatgaaatcacataaacataaaaacaaaaataataatttaatgcagggcatggtggctcatgccttgtaaatcccagcactttggacgagcgaggcgggcggatcacctggggtcggg

SEQ ID NO: 644348 - DNA, 152 bp, Homo sapiens
cccagcagtagcttagaggagctagtccagcaagccggcagagaatcccccacacgctctgaaggacccaccttcagcttcagcttggctcattcatttgaaaataaaatgtttacatgcaggccgcgcctgtgtccagcgtgaaagtgggt

SEQ ID NO: 644349 - DNA, 873 bp, Homo sapiens
  misc_feature (531)..(531): n is a, c, g, or t
gaccacatggatgtatcctgaaggtgtcttcctacctaggtcgccatgtatttgcctctcccgcattctgcatgccctgtgggcgctaccatggaggttcaatagctggggatgttcccctctgtctccttcaaggctgctctgtctgcagtaatcagagcaggaggagagcagagtcgcctagagatagattaacgaagatgcgggattactggtagagaagatggggcttccgcattggagagccatatgcaggtagagcctgtctatcagacgctgtgcacgcatccaagcacgacatgtcaggataattgtcccagcacgagcacgttgcttggaggtgtacgtaatagaaagctggggggagatggatctgaaagatgaaaccaacagcatgaacgcccccttatcgcacgggctgtcaccttgaaggagggactaggaagtaggagccgagaaccggtgtctcctaactggtgtccattcactatgaacctccaacgcactactaggcaaccttacattttcagncacgagggtggaggcgcacttgtcgcattgtatggtctgacaggatcgtatgctacataatgagacctgggggaatggccccttataattaatccagcgaaggacagtcaaaaacgcgtctacaacgacattagtgtctgcaaacactcacgttctgactcgcaaacaatatagagtagccctatgtgctggataaggcatggggtgcgtcccgttatgcaccatccccgtcgcgcaagtgtattccccatatatgagttgaagctatttgggtagttacaagggaatcgctagaccaacacgaagccgagccttgcgtaaagaaatacgcctgttccaggg

SEQ ID NO: 644350 - DNA, 411 bp, Homo sapiens
  misc_feature (64)..(64): n is a, c, g, or t
ggctatgtcggagagcttgaaaaaaagaatatttgtcgcctacacagtcgtcgtatagcctagntgtatcgccgggatcgtgttttttatactctttttagtgcaggcctctagcgtcaaaaagtacaaaaagcgctgcgacatcatgcagcaaaatctcacctccatccggacggcgcaaatgtactcaggcgaccagaccgtggcgcgccagaaaaacacaggtttatctcgcatgtggatggcctgctcgaagaatacgcctgcatgacgcctgcacgctcggcgctatcgatgacaatgtgctcgtggtctatcagcatggcatgggttctagcgcgctggagccctttgtctcgccaaaaaacaagaccatctatcaggctatctccgaaaagcaaccagaagcca

SEQ ID NO: 644351 - DNA, 757 bp, Homo sapiens
tacacacgtcttttggtggacgacctcctcgtctatgacactcagaggggggggccgtcgcgcacgccaccctcgcgcgaccgacgagctgtcgctgcgcgggggtcttcagcgtgatcgcggcacacactctcgctcatatagtgggtgggtctctcgtcgacacacggcgcgcgacattttttgacgcattctcgtctccgtctggtgggtgagaccgccacccactcttagcgcggcacgcctccttttggtgacgctcatctctctcgggtgggactcattcttgttgctagagaggcgcgttgttgttgcgtgtgtgtgtgcacaaaacaatcatttcttttatctttcaggacagaagagtcggcccgcgagatacgcacggagagagaagttcgctctggagagaggagataggtacagaccgcgcgggcttgttagtcaccaccacccgcgagagatagaactgagggcgcggattcctcccgagattatatcgattagttagcaaagatactctctcccacagaggaactttctttctgtaagaggcgaaggcggctgccaggaggacccatccagcagtggagcgttttgtacgccaccaccccggggtcactcctctctccctgcggtctttagcagaaattactaagtgtttttctccctttttaaaaaacccccccccgcggtagtcccctcaaacaaacttttttttttttttaaaaaagagagggttttttccccactctca

SEQ ID NO: 644352 - DNA, 130 bp, Homo sapiens
gtgcatcctggatttctactccagggtaatttcacctctgctatgccattagattactcaagagaaatctaacagatcagcatctccagcccaatgagccatgtctcaactttttggaaaacttgcgtgg

SEQ ID NO: 644353 - DNA, 505 bp, Homo sapiens
  misc_feature (4)..(4): n is a, c, g, or t
ttanagatccctcaaagtcatctccgcgagctttgtccattgctgcgtgagctgcgatcctttggaggagaagaggcactctgatttttagaattttcagcttttctgctctggtttctccccatctttgtggtttaatctaccctttggtctttgagtgatagtgacgcacagatggggttttggtgttgatgtcctgtttgttagctgtccttctaacagtcaggaccctcagctgcaggtctgttggagtttgctggaggtctactccagaccatgtttgcctgggtatcaccagcagaggctgcagaacagcaaatattgcagaacagcaaatgttgctgcctgatccttcctctgaaagcttcatctcagaggggcacccggctgtatgaggtgccagtagggccctactgggagatgtctcccagttaggctacttgggggtcagggaccccacttgaggaggcagtctgtccatttgtcggatctcaaactctgtgct

SEQ ID NO: 644354 - DNA, 1337 bp, Homo sapiens
  misc_feature (811)..(811): n is a, c, g, or t
tgtcgacccgagactgtggccaaaaaacgcgcacacatctgtttgtggggcacagagaccacatcaccatgtggggcctccgccaaaggggtctcacgttggatggacacccccccccgtgtgtttccaccaacggtacttgtccaaacctggtgtgaggcaccccagggagaattccctgaaggcctttctttcaacaggggagggggaacccttcgcgttctcttttccaatgtgaaagaaatgagacccccccctcgttaaagaaggggaaatttttataaaggggcctttaccaaaaggccccccacaggattttggcacaggaacttctttggggtttgtacacccgtggggaaggggtaaaggaatggcccccccccccccaaaagtgtttctaaggggagctcttttgccgccacagaattaccacatggcgccaaggagacaactttcccggggggcccacacaaattattgtgacccggaggtctttggcttccgggaaaggaactccccgcagagattgggatgccttatatacaccacggtatcctttggggtgcttccacagccacggagttttgaaaggatcgagggccaaccccacccccacttgggggttcaccccacccaacacacggtgtcttgtcttgagaggtttgggaggcctcgctcgatggtaccgaacgcgcttcaaccacagagagcctgtaagagaaacgctaaacacagttcccacggttcccctctcggagggattctcgagcccctgggagactccccactggagagaaaaattctgaaaagnggccacgcctcttggaggaacacacgcccccgagagggagaggttggaagggccccgccttaacgccccctaccacagagtggaggcacaggcttcaaacggggagtccctctgctggcaccccctgagagttcacagagagctggcgaccaagagaccccgggcacagagagggaacaagccgccacaggcccacaggaggtaatgagaggcccctgctgaaacacatcacaaggtcaaaagctggagaggctgagagagtctcgccaccctatccccccgcctgctggaacagaatgtgcgaggagctttaaattttggtgaatgccttggagcacgcacgcaaactccacatgcacaaccactccacaaagagccacccaccccgcccggagatatagtggagatggccaaagtggtgtttgaggagaccacaatgagcacccaagattttgaggcattaagcccgccagaagcagggtaccctttggggagcaggaggcccaataaaaagttcagagttcca

SEQ ID NO: 644355 - DNA, 422 bp, Homo sapiens
tccatcatctgctctattttattttacaaagtggcacataccatcagagtaggcaccagtctgacactgcactcattatgagagacttattcagaaaaaaagaaaaagaaaaaaaagacggggcatggtggctcatgcctgtagcactcccaaatcccagcactttggaggccaaggcgggtggatcacctgaggtcgggagttcgagaccagcctgaccaacatggagaaaccctgtcactgctaaaaatacaaaattaactgggcgtggtggtgcatgcctgtaatcccagctacttagtaggctgaggcaggagaatcgcttgaacccaggaggcagaggttgcggtgagctgagatcgcgccattgcgctccagcctgggcaacaagagtgaaactccatctcaaaaaaaagcaaatc

SEQ ID NO: 644356 - DNA, 221 bp, Homo sapiens
tctacagatcttatccccggctctgggtagctgcgtttatttgcagagccaccaaactcactaccccatatcataatcttccaaatcagtctgagcataactagcttccttacatctttactaagaaacggcaaggctacttacttagcttttttgttatcagcggaggaatggtttagagtggcaaatacatgaaaaaaaaaccaaagtagatactagtt

SEQ ID NO: 644357 - DNA, 87 bp, Homo sapiens
cccgaggacacggctgtgtattactgtgcaagatcgagttgtggaccgatcatccgaaacaactggttcgactcctggggccaagga

SEQ ID NO: 644358 - DNA, 820 bp, Homo sapiens
ggcgcccctccctgcagggatcaggctctccccctcctgtcttctccgcgctgtgcctcgtcatggcggccctcaggcaagtccatccctcataactgctatgagatcggcacacttggcacccttcctgccgggtctccttcctgcaagatcaccgggggcgccctggaaggagtccctgaagatctatgctcctctgtacttgattcgcacgcaattctccggaaacggaaaattagagctattatttacacaaactactccctgagatcctacaatccggcttcatttctaacttgctaatggggccttgtatatggctttcttttgcattcttcaaggaagatacttggaaaattctactcatggactcctggcctttggtgccgtctgccagacatcttatgtggccattctcattgacaagaacaaagcaggagagggctgctcacaatttatatggccaacttgatggagtctcactgtcttccccaggctggagtgatttcagcttcctgaagctctgactcccaggttcacagggatgcttcctgcctgagtctccctgagtaagctggggactaacagggagtgcaccactaaaaaccttgtaaattttgatctacagtcagagacggctttccacaatgttggccggtaagtcttggaatcctgacctcaagtgaactggctgtttcgggctccccaaatggctgcgactcaatggtggtgaccacatgctgtccaacatagggtttgaggctatcataatcagacttatacccttcatgaggactggccctgggggctcacttcgcag

SEQ ID NO: 644359 - DNA, 474 bp, Homo sapiens
cagcgccaggaaacaagcatatgaacagtcaggactctgttacacctatggatcggagcaacagaccgtgactacaatgtgtaccgatggatgaagcactatccacgcacatctaatatccgatactacatgattcactacagctatccgataccagtatacaaaatgtgtcaccctcaaagaatacaaccaaaatcaagatagcaaacaagaacctatataacttttttttttttacaggaaaatactttggaagtatgctgtgtaactgcccattctttataaagaaaatctacggcaagcaaagttatcaacctccaaaaaaatcacacgtagcattactaagcatatccccaaaaaagtgtacaatatgcacactgggcaaaatacaaaataaaaaaaatggtaagcaacaggtgagcttcatatttataagattgtgaaaagaagtcccatttttagcacggtggtata

SEQ ID NO: 644360 - DNA, 258 bp, Homo sapiens
  misc_feature (121)..(121): n is a, c, g, or t
  misc_feature (128)..(128): n is a, c, g, or t
  misc_feature (131)..(131): n is a, c, g, or t
  misc_feature (133)..(133): n is a, c, g, or t
  misc_feature (208)..(208): n is a, c, g, or t
  misc_feature (212)..(212): n is a, c, g, or t
  misc_feature (223)..(223): n is a, c, g, or t
ctgcgctgcgacgtgctctggaaggagaggacggggcacaaaccctgaccatgaccccccacaggcatgctgcaccgctgctgctgctgctagctctgctgctcgctgccagcccaggagngcctttnggntngcccaggctgcgggcaaggggtgcaggcgggttgtcagggggcgtgcgtggaggaggaggatggggggtcgccancgangctcgcggaantgagggctgtctcaggagggaggggcaggagtcgg

SEQ ID NO: 644361 - DNA, 344 bp, Homo sapiens
ctgcatgaaacacatgaaaacatagagcagcagagacaatggggactatatggcgggtggagggtggagggggagcagcagacaaaataactatctgagtactagcctgggtgatgaaatactttatacaacaaacccccgtgacacaagtttacccaaagaacaaaccggcacatgtgcccttgaacctaaaagttagtatacttgagagagagtctcgcactgtcaaccaggctggagtgcaatggtgacaatcttggctcgctagcaaaactaccaactcctgggttcctgcgactcttctgcctcagcctcccgagtcgctggaataacaggagacacaa

SEQ ID NO: 644362 - DNA, 495 bp, Homo sapiens
  misc_feature (29)..(30): n is a, c, g, or t
  misc_feature (55)..(55): n is a, c, g, or t
  misc_feature (65)..(65): n is a, c, g, or t
  misc_feature (67)..(67): n is a, c, g, or t
  misc_feature (390)..(390): n is a, c, g, or t
acggcttcaacggaacttttctagttctnnaagatgcattattagattgtttatntgaagttttncntctttttttgatgtaggcactataaacttccctcttagtactgcttttgctgtatcacataggattaggtgtgttacatttccattatcatttatttcaataaattttttaaattttcttcataatttcttcattggcccactggcactgatattttacccttactgggattctcttgtcatttccttaacatgattattaagtgaaagttcttaaggacaatctcattcactctagggttggtgtgagtaaagtaacatggcagctgatcttctggctaaaaatagtaaccagatacaatattgattgcttctctactagtntgtcttttattcacataaattctgcattatatgtatttactttaaaagacattaaacttgtgtatttccatgtgttgtatagtttccaaagttccgttgaagccg

SEQ ID NO: 644363 - DNA, 356 bp, Homo sapiens
ggctccagagtgcgggattacagggtgagcaggtggcgcagactatacgtgggtaattgaggtatttgttctaggagacacgggtctggccatgttgcccaggacggactggaactccgggggctcaagcaatctgcctgcctcggtctcccaaaatgctgagatctataggcatgagccaccatgggccagccaagaacctctttctggagagcttcttttcttgggttgtttcagacagggtctcgctctgtagtccaggctgtattgcagtggtgcgagcacagctcgaactcctgggctcaagcaatcttctcatctcattctcctgtgtagctgggaccataggtgtgtgc

SEQ ID NO: 644364 - DNA, 861 bp, Homo sapiens
  misc_feature (32)..(32): n is a, c, g, or t
  misc_feature (94)..(95): n is a, c, g, or t
  misc_feature (113)..(114): n is a, c, g, or t
  misc_feature (117)..(117): n is a, c, g, or t
  misc_feature (123)..(123): n is a, c, g, or t
  misc_feature (152)..(152): n is a, c, g, or t
  misc_feature (237)..(237): n is a, c, g, or t
  misc_feature (243)..(245): n is a, c, g, or t
  misc_feature (257)..(257): n is a, c, g, or t
  misc_feature (321)..(321): n is a, c, g, or t
  misc_feature (325)..(325): n is a, c, g, or t
  misc_feature (328)..(329): n is a, c, g, or t
  misc_feature (333)..(333): n is a, c, g, or t
  misc_feature (350)..(350): n is a, c, g, or t
  misc_feature (369)..(369): n is a, c, g, or t
  misc_feature (422)..(422): n is a, c, g, or t
  misc_feature (468)..(468): n is a, c, g, or t
  misc_feature (549)..(549): n is a, c, g, or t
  misc_feature (565)..(565): n is a, c, g, or t
  misc_feature (567)..(567): n is a, c, g, or t
  misc_feature (576)..(577): n is a, c, g, or t
  misc_feature (592)..(592): n is a, c, g, or t
  misc_feature (624)..(624): n is a, c, g, or t
  misc_feature (662)..(662): n is a, c, g, or t
  misc_feature (751)..(751): n is a, c, g, or t
  misc_feature (759)..(759): n is a, c, g, or t
  misc_feature (761)..(761): n is a, c, g, or t
  misc_feature (784)..(784): n is a, c, g, or t
  misc_feature (787)..(787): n is a, c, g, or t
  misc_feature (801)..(801): n is a, c, g, or t
  misc_feature (818)..(818): n is a, c, g, or t
atgtagtgagagggtcgcgaggtgtgagagtnaatggaggtagcagaaggatgatgggggggtggggagagggagaggtggtggtgtggggggnngaggggtagcttgagagnntgnagtggntgtgggggtggaggtgaagttgggggggntggtggtggtggtggtggtgagggtggtgtggagggtggtggggatgtgtgtggtgggggggggaggaggtaacgatgaagggtnaggttnnngggagaaagggntgagggtagtaaggtgtttgggggggggggtgtttttggggagttgtgtggtggaggtggtggntgantanntggntgggatagatgaggggntgggagggttggaggtganggtggagttgggagtggaagagttgatggtggggatggggttgttggtggtgntggtgatggaggagatgagagtgggttagaaggaggagtgagggcngtgaggtgtggaggaaagaaggggtgtggtgggaagagtgaatggtgggggggaggattgggatgatggggcaggggtgcnagaggggagtggaggngnaggaagggnntgagggttgggtggntgtgtagtggtgttgtgggtgggggtggactncgtgttggagggggtggcggtaggggtggagggagagnggggtggggggatggaggtgtgggtgggtttggtggtggagaaggggatggtgggtgtgagggtgtgggtgggggtgttggagagcgangttagggnanaggtggtgggtgggtgtgggatngtnttctcatgcatganacctctaggcatcgggntgggtgcagctctggcagagtcggcaggacctctgcaccagct

SEQ ID NO: 644365 - DNA, 917 bp, Homo sapiens
ggtggactgttccctgtcatcagtatgcagcgattgctctttccgccgttgagggccttgaatggggaggcagtatctgccgctcctggctcctagggcagcgcctagagcacagtgtgattgcatcagtgcgccctttgaggccagggcaatacagcaccgatctctgaagtagcctttgcaaggtctggaaggggtacagtgtcccttcacctcgaaggctgctgagcgggtggtgggccgatgggtcgcctggtctgcagtggaacagtggctggagcagttattcttggaggagtaactaggttgacgagagtctgtgcatctcgatggtagatgggatttaataaaggagatgaagccagctacaagccaggaggaatgggaagcagaattcggcagatataccagcaagtttccaagaagttcacaatcttgaactcatgatctgacactgcacagaattcacgttcatcgtggtacatggagtactcaacaccgaatgtggggtccgccttgtaggccttgtgtacatcctgctgctgactactttgggagaaatgggctggcttcggccgtggcatgaacaggacgtgtgcttgcctctgtggctcgtctagttccaggggtctgttggggacggtatatggtgaagaagtgggactaacggaagaatagaagtgccatgagcgttggtctggagtcgataagaagggagcttgatagggcacgtggggataaggctggcaccttagtggtggcaagtggggacaatcaaggtaaacactgggaaagtgcgagaacacaaggcgtaaagaaggaggagtagtttgcagaggagtttggggtgtaagggacccatagagggaatgtgtggggacggagatgttatatagcgttagacgagggaagtcaga

SEQ ID NO: 644366 - DNA, 1256 bp, Homo sapiens
  misc_feature (385)..(385): n is a, c, g, or t
  misc_feature (515)..(515): n is a, c, g, or t
  misc_feature (557)..(557): n is a, c, g, or t
  misc_feature (1031)..(1031): n is a, c, g, or t
  misc_feature (1256)..(1256): n is a, c, g, or t
atagattatcttactaagtcatttattcattcttcagtgtctagatgacggactaatagatcgctctactggtcatatactccttacaatacataagaaagtaataatctaatagatctgcttgttatctaatctagtagtggtacctcatcagtagtcccgtcaagcggccactatcccgtcgttagtccaatctacttgggggccctagtgtgcgcgatcagcgtagatccaattgtcctgtacttgtcgagaagcgagaaggatatgtgccatctaaagccacatcatgttacacacacatgacaactttctgccagggcatgcaccactgtgcgcgcgtacacaggctcacgcgatacacactacacgacctacagatgcnctcacacgtgcgcagtgtgtgctcactcatgatgcgtatcactccgaatgcgcgtagcacgcgaactgtactattcttgtcttatatgcaagcttgggcaacaagtgtgcaccgtgtctttcgtcgaaanatgcacatccatatactacctcatatttatttagggacgacntcccaaattcgcaacgccactactcgagactcggcgatcccaagtctccttacaattttgagtattaaggtagggatacgaaatacgctcgtgtcgtgaccctcattcttcgctgttgaaacacgaaagcactcaaaagtccaaatctatgaccccccgcatgtttaaagcactccgctttgcacaacagcaaacactcgttgtgttgccccgtgctgctcgaaatacacacgccattacattccttagaagcaccccataccatataccatgaagatgttgagccccacctctattaagggctttgggaaattttgctaatatagaaaccatcactcttttgttatgtggtaccccacagatttggggcacaacgcgtgtctgcatagatgcacgagccaccaagactataagtagagtgcgctcatgccggtggtataaacctccaatggaatagaaatgcggtctccgcanatacgatgcggggtacagagtcctcaaccaccttccttttcgtaaatataccctgaagaattttcaaacccgcgttgggtgtaatgtagatacaatctccaatgttcatatactctcacataaagagggcgcgattttggctcctcttggtcatgctgagccattggataagcgggatacactctgtgtccgagcaaaatgtttctcccaccttgatatactatn

SEQ ID NO: 644367 - DNA, 186 bp, Homo sapiens
  misc_feature (175)..(175): n is a, c, g, or t
tcctgccacgactgactctggttctaatgctggttcagtctcttcaaactgcattttctgccttttaagtatgctttgtaattttctgttgataggtagacatgatacactgggtaaaaggaatggcagtaaacagggctttcatcctgttttcaggtgtgggggataacatcangggatcctcta

SEQ ID NO: 644368 - DNA, 136 bp, Homo sapiens
tgcagtctgttttacactaacagctataaccatcactgcccgtcgtttaacactaacagctataaccatcactgcccttctttgccaccaacagctataaccatccattgcctgccttttaccacaaacagctata

SEQ ID NO: 644369 - DNA, 164 bp, Homo sapiens
ccggtcgtatgtataagagtccaagctctaatcatgtcctggtctttgctgtgaccagcccctatctaggagcccatcaagagttgccacatcaggagttcccattgtggctcagcagtaacaaccccaactagtatccatgaggatgcaggttcgatccctgg

SEQ ID NO: 644370 - DNA, 1274 bp, Homo sapiens
cacttgggccaaagtaggctttctgtacatggagtttgctcaatgtatgaaacgataggatgacttcgggctgcgtatagagaatcttggcctgactcctgttgctctgatccactgtacattgccctacactgtgcagattagagcatggatgtcgtaaaccagggaacggcaataacctgctgtatgacatgacttgaaccagtggcgacggaccggtgtagagatgtttgggacagtattcttcgactatctagtaggtaatgaccttgaaagcgagacctcaatccgttagggacattgattgagattatggcttcccgttaggacctgctgccttttccacttgacatagtggcttatacactatagacactctgactatggcgtaggacgtgctactgttgtgcccacttcggtactaacggactaattgacttgcaactataataccttttcttgaacccggtagagctatgctcctggacgcggtggttcatactgcggtgataaccacgtgcttacaggagtattaagcaagcccatggggactaatctcagggtgtcacgtgttcgccagagtgacccatctgcaggttccgggttttcacagtgcaactgaacttgtgggatctcgcagatccgggcacctagttatgacccctttccctgggaagccttccaagaagttgaattcaccttacgggttgctttgcgaaagcgtcgggttttaccagagaattacccatagagatgcgactgggcagctaattatgaacagggggaacagattcacctgatgtacttttttccgagaacctagagggccactcgggtgcgcctttccaaaatgcaccgcttgatggcaatgtggtccccgtcaaatgttttcaagcgcccattgcctttgatattcaggaggccactttatcgcgtagatatggcccttacatggacattgaggacagggtatacggccacagcaggctatacgcctagaaccaggccgctaataaggagcaatacctgtgtttataccacttgttagaatacccgtataagcgcagtttagatatagtgcgtggtaagacatatatatgggtctcattgtacagaggatagtcgcacagctgcgagaaggagtcggctatatcagtatgtatcgtctctattatgaggtgtattcacctgcggccgatgacctattaatagaacagcaagcagttttgagagagtggcagttaggacatggtgctatcagagttcctacgttt

SEQ ID NO: 644371 - DNA, 631 bp, Homo sapiens
ttcaaatgcagagattgcatttggggccaacacttaagcccacttgtagttgtagtatcaagcggggtatctacttgcaaatatgtggctgaaactacaaaggaacttgttttttgggagcggagggataacttgcgtcctttcagaaaccctcctatcaacatcatagatggtttctaacccaccaggtacgtaccttgaatgcagctccaaatctacactagcaaaccttatctgacgaagacttagtgagccagcacgaaaagtcctagctgcaagaagcttcaaatatacttcttcagggagactctccccagtttcataatgctttgcaatgctcatcaaagtatccctatggtaacaccagttttccatgaactgagaaggtaattcaacggcatcccactcaatccccctaataccggaaactagaccctcatcctgtttggtcagcatatgctgaagtgcatgaccaaattcatggaagaccgtctcaacctcacggaatgtcatgaggcttggtttgttcccaactggtggtgactgattgcacaccatgcgggcaataggcaaccttgcagaggcaccatctcgtgacgtcgacgcggccgcgaatttagtagtagtaggc

SEQ ID NO: 644372 - DNA, 1776 bp, Homo sapiens
  misc_feature (1164)..(1164): n is a, c, g, or t
  misc_feature (1411)..(1411): n is a, c, g, or t
gagttgtcagtgttgcttgttgtcgtgtgactgtgtgtgtcggcgtctatcatcgtgggtgtcacccctcgcggtgtgtgggccctttgtagtgcttgtggagcgccccgcacggtgtgtgaccccaggagcacgcgggtgttgttatccctcgccccgctccctgatttttttttctggcggttctctaagggatcatgcgcagcgccgcctgtgggcgtcggccgaattcgcgggcaccccgaggggggcaccacactcgggcccgggtttggccccaaagggcccacctggcgcgcccctatattcctcgaaaatgcgccgcgccctcatatatggggggcgacccacaacagagaaagaaaaaggtggggtgtgacagccaaccaacgtgtgttctagcaacgagaaaaagaattttcggtatatattaaaaagttgggtgtgaaaacccccccccccgtcgcttaaaatgggctcccacaaaatattatgaggcacaatatattttgtggggagaaaaaagcacccgccctttgctgtgtcacccccaacggggccgcccctcacggggggacccccaacagagtgtggccacattctttggagatgggttcttctacaacaaaggtgttcctccatggtggtgtttttaggaacagaggtggaggattccttcttgccccctggaaattgtcttgccccaacaggagaaaattggtaagtgggaaaaggatttcgccgccacattgtttaagggaaaagatagttgctccccacagagccgctttggagagtttatcccgcttggtagaagagaagaattgggtctcctccacagggggggttattaataaaaaagcatcgtcgccgctccttggtagccctaataagcacttgtctccacactggggcgccaattggggagatctttttttaatccccccccgccggggagcccacacgcacaaaatgtggtggggtgtcccacacatgggggtctcaccaccagagaaaaatggggcccaccagagcccacacatggaggatgtgaggagggcttctcacacgcgtgtggagatgggtctcacagagaagagctcatcccccgcagcatgggtgttatcacaccttggggcttcttatcggcttctctcgtttttntctcgtcttgttttttgggtgtgtgtataacgtataaaaaatatactgcccccaccccatcttcatcgagatatctcgcgagaagacccctctcttctatatgggctctacgcgcacccccacacacaacggggtttcccccccccacattttctcgcgagaagagaaagagatggagatgtgagagaattcacatcgagcccccccgagagaaggtgccacagagccacacatgagactctgaganaagaaagttgggtccacatataaatgtgagttccacagcacacagccccttggagaaaagacacacatatgaaaaaggggcttgtccccactctaattgtaatcctcctcccacatcgaatgttcttcgttatgagaaaagtataaaaatgctcgaaagaaagccccacagtttgaaattgggaaagctcactggaggcttcactggtggaaaggcacgtaagtttctgggaaaagcccctcggggaacgaagacaccggtggctataaattggacgagctgatggatatgagaccccccctcccagaatctgttttaagttcaagaccttccaatagtggcccaattaaaagtgctaatttgtg

SEQ ID NO: 644373 - DNA, 279 bp, Homo sapiens
tccgggacccagaaggaaagcagacagcctgccaaacagagccggagagcacatctgtctcactttccctattaaactgacaacaaggattactagtgaaaacatccactaccctacagcgctaaggagccaatacgagctcgagatgggactgtgtgattgtaaactggcgccatgtttccgacacttggtattctaagagtttctcttgaagaagttatgagatattccttcaaagaatcatgtgtaaagaagaatattacctgccatagtaaaata

SEQ ID NO: 644374 - DNA, 152 bp, Homo sapiens
ggacaacagagtgagactttgtctcaaaacaaaacaaaaaaagtattgaagcggcacttatgtcgcaacaagggtgtgtttatttatctatagaggcttgtaattgataaggaaaaaaggggaaaataggcaccacttccaaacataagcag

SEQ ID NO: 644375 - DNA, 386 bp, Homo sapiens
ccccctttactttagggggcggggaaagggtttttaatttttttttaatagaaaaatggggccccccggtttggaataaggaaactttggtttaggcccccaaggttaatcccaattccaaattttccctttaaggttccttttcctgggtccccattttttaaggtggaaaggctccccggttaacttgatggggttggttaacccaatgaaagccttatggtccctctggggaaagggggtttaggggtgcctggggggttaaatattttgggcctggtttggttttggttggtttccctagaaaaaggggcaaaactttttatttttttcccttaaccttttttaaaggggaatttggggagggcttttccggccttccccca

SEQ ID NO: 644376 - DNA, 342 bp, Homo sapiens
gtactctgaggatccgatcacgtgcattgtgctgggcccacccaagtctgaatccatggagggggagggtgtctgagagtactcccaccacaaaaccaaaacaacaggctcagatttcttttttgattggcactcctgttgtcacccatgatctggtgagatcaggattgcggtgccaactgcccagagagaggtcaggaggtagactgcctcctacagttggatgggacaggatacctgggagtcctggctgccaattcagcccccaccctgatggagtgtgatggaggggactgagactcaggctgcttctggataagatgccccacaatggcacgggat

SEQ ID NO: 644377 - DNA, 395 bp, Homo sapiens
atcaccaccctcatttcctctccctatagctccaagatgcatagctgagctaccaaacttcactgatactcaactgctctgcaggctcccgtctctctgtcattgtccttggtccccctccagttggaatcccttccatcaacctgttgaaactctacctgcaccccgtcctctctggagaatggtctcaatagccaccaccactctccacctcaggctcccctgacatccaagctgtctatgacaatcagcaccctctgcctggcagatcctatgtcaacccagctcctgtccactccaccagactgcaggtcctcaggacagggactgtgtcttactcccacccccaaagcccaggcagggcctgtgggctttgggggtgggctgaagagcgg

SEQ ID NO: 644378 - DNA, 143 bp, Homo sapiens
gcgtaataagctggttggctgggtatgtagtgaatgtgtgaaagtatgctgggaagtgaggaatggcaatgttagtgaaaatggttacgagtcgtgggcaagaaagcgagtcgtgggctagaaaaggagtcgtgggcaaaaaa

SEQ ID NO: 644379 - DNA, 286 bp, Homo sapiens
tcagtaccggcaagccataggtatggtggtaggcacgtaccaggtggtcgctcgccgccttgctcgccgagtaagggctgttaggctcgtactgatgagtttcggtgaacgccgggtcttccttggccagggagccatagacttcatcagtcgacacatgcaggaagcggaaagactgctgtgcatcagcgtccagtcctttccagtaggcgcgcaccgcctccagcaggcggaaggtaccgacgacgttagtctcgataaaatcttccgggccatgaatggagcg

SEQ ID NO: 644380 - DNA, 485 bp, Homo sapiens
ctactccagaggctgaggtgggaggatggctcgagcccaggagttcgaggttagcctgggcagcatagggagacctctcttctaaacaaataaaataaaaatttacctaccaaggactcttgcattcatcactgtagttgagatctctccccaggcttcacgaattagtcaaaactctacctgataacactattttgatgtctaaattgatctcaaagtgaatatgttcaaaatggaacacagaaaaatctatttgaatttatgaaagagaccagtggtccatataaataggcagctgatcttgacaaagaagaaaaggcaattcagtggagaaagtattattttttcaacaaatagtggtgaaacactgggacatccagatgcagaaatataaatctagacacagatttacacctttcagaaaaattagcatgaattgaatgatagacctaaaaatacaacacaatactataaaacttctagga

SEQ ID NO: 644381 - DNA, 238 bp, Homo sapiens
tgggtctcgtgtatccggggtactctgttgcaacttgtcactacctctctgggagcctcgccatcaccaggtccaaacgacagactcatccaaaaatgcaacacactcagaggccaaaccaataggcacacagatatcataactctcctgatgttctctggccgtccctcgtgcttccttccattctaaccacgccaagttctttcctgccttgccatctttgtctctcacaacgcta

SEQ ID NO: 644382 - DNA, 432 bp, Homo sapiens
  misc_feature (48)..(48): n is a, c, g, or t
  misc_feature (56)..(56): n is a, c, g, or t
  misc_feature (259)..(259): n is a, c, g, or t
  misc_feature (368)..(368): n is a, c, g, or t
  misc_feature (392)..(392): n is a, c, g, or t
gctcgtgactctaaggatcccagtcgaggagactctcttgtgcaggtngttcttangcccttcagaaaatgacaacgtggtcagttttcctcttcccctggtgactaagctgttcctttagagcccaaagatttttttccagacccatgagcaaatcttcacaccccatcccccggcgcgatggcttgcatacctgtcattcatttctgcctgtgctaacaagtttctgcgcgctgccctccagctgacaaactggatngccacaaacagccgggagcaaagtgctttttaatctggagacttccgggggtacaggagcctgccaggtgcctctgagcacagtgtccaagttgaactgctgggaaggncacactgttccatgcggggctggntcctctcagcacccccgagagtctccgtcgaactgggtac

SEQ ID NO: 644383 - DNA, 748 bp, Homo sapiens
  misc_feature (402)..(402): n is a, c, g, or t
gtgcaagtttgcaacatgttgcaggttcttgagtataagccaggtggaaatgtgggctcatatgataacttgttttttcggggactaccgaactgtgtttcaaagcacctggggattttttttttttttttgactgtaaccgaaagtcaaagatacttaagactcagttacttttctgtttttagaattggtcttgtcagcaagtagagtttactctggagatgtgagccttacattttctaatctctttggcgttcatttcttttgtttgaggctgtgattcaaagtaggaaacatgctggaaccaactctttttcagaacctggcccgcatctcaggtgctgcttgcttaattgcgtaataaaggacctctgtggtagaagcctggaaactgctgtggcntctcttatgccaatgtctgcttgttccctttccctcaaagaaataatacatctcttgctgacactcagtgtaatggaggttcataattcaaaaaccaattatttggggcaactattggatgaattttctttggcatccttttgttggctgattttcctgttagctgtgtgtactgttttctaaagaaacatggtaagtggttgtctgttggaaattgaattgtaattgaatagattctgagatttgacgactgaaaccaggcaacaccatgtactccccatttttgttgtctgttaaattctaaagaggtttttaagtatctttgactttcggttacagtaaaaaa

SEQ ID NO: 644384 - DNA, 1570 bp, Homo sapiens
gcaaatggcggatgacgccggtgcagcgtggggggcccgggggccctggtggccctgggatggggaaccgcggctgcgcttccgcggcagcgtttcggcacgtggcactccggggcccggggctcgcggccgtggacgggggccggggccgacgggacagcggagcactcgccggcccgcccacgccgacggcactacgcgcgtggctgcccgctcccgcccgctcgcgcccgcttgcgcccccggcccctgccacgccctcccgctcgcctgagacgcgacgcactcctcctctcctctcctccccctgcactactccccgcgccctcccacgcactccatccgcctccccctctctcccctgccccgcgccctcgtccctccacgcgccactgagcgaccacacacgcaaccccactcactgcccaccgcccaccacagccacaccacccacagaactgcacgacacccaacccaccaacccagacgcctccacccggcccacctacacagactccgccctcacctcccccccacccaacacacacccgcccccaacgccctccccacctccgcccctgctcccacccatgcatcaccacacgcccgctccaaacacccccacccacctaccaccccacccacacctcccctcacctccacccaaccaccacatcacaccccagcacacccacactacccccacaccccatcccctcgcccccacacacaacatctccagccaacaaagaacacacacacaccatcaggacgcagcacaacgaaaacaagcataaaacacagaaccaagcctaccaccacactcgaccgcaccacggcgcacacggccacgaacaatcaccctagcacacccacaccacggcggccaccctcccgcccctcccggacacccactccaccacccccccacacacacgcaccccccccgcgccacagacctcaccctccccttactcacacaccacacctgccttcacccacatccaccaccccacaccactcaccaccctcgcaacagccaccagccacaccccccccaccccatcgtccaaccactattacgccaccacacctaccccaacacaccaaaaccaacaccactccacacccaccgacaccaccacccgctcccccaccaccccccaaacccacacccacccacaaacacccacttacaccaacatctccaaacaacaccaaaccaaaccaactccaccgtctccaccatcacgccacaatcccccacgacccacaacgacccacgcctccaaccacacacacaaacccaccccccccaccccccgcacaacaacacccaacaccacacactaccacccccactaacccacacactactcacttacaatacacccacccgaaaacacaacacaaacatcagacaaaccaattcaccacccacaccacaatacaccacctcaccctcatcactcacaacactacacaatacacaaacaatccaccacaccaacccaacccccccatacccacacgaccccaccaccaccgcatcacaacctctacctacata

SEQ ID NO: 644385 - DNA, 327 bp, Homo sapiens
taattcataatagtataaagttttgttatatcagtgatttgttggctgaagcctaggtgttggcagtatggtcacttctgaggtcagtcctgagtttgtcagagttaggcagaaaactcagacagcagcctcaaggaggctggaggtttatttttcaaacaagaagaaagatttcagaattttgcaggaggaataaaagaagtctaggtactgttaaggccttggaagaaagtacagagaaaaatacagtgatgcttttcattgttgtttttattgcttttttgttgttactaactgataaatcatagtttgtcgagtagttaattg

SEQ ID NO: 644386 - DNA, 209 bp, Homo sapiens
aatgcatacagcactgagacgtatatcatctgtaggcaattcattttcttctaacagtagtaatattaatgcatattcatgattagaagaaggcttcgcttggaagcgaaaagtcctaatagtagaagaaccctccataaacctggagtgactatagtggatgccccccaccctaacagacatttgaagaacccgtatgcatctcggaa

SEQ ID NO: 644387 - DNA, 673 bp, Homo sapiens
  misc_feature (327)..(327): n is a, c, g, or t
ggcagtgtcaggattaaacccgtggatgtcgtcagatttcgttgttttacatctaaatcttcagctattgtctgcacatacttaagactcagttacttttctgtttttagaattggtcttgtcagcaagtagagtttactctggagatgtgagccttacattttctaatctctttggcgttcatttcttttgtttgaggctgtgattcaaagtaggaaacatgctggaaccaactctttttcagaacctggcccgcatctcaggtgctgcttgcttaattgcgtaataaaggacctctgtggtagaagcctggaaactgctgtggcntctcttatgccaatgtctgcttgttccctttccctcaaagaaataatacatctcttgctgacactcagtgtaatggaggttcataattcaaaaaccaattatttggggcaactattggatgaattttctttggcatccttttgttggctgattttcctgttagctgtgtgtactgttttctaaagaaacatggtaagtggttgtctgttggaaattgaattgtaattgaatagattctgagatttgacgactgaaaccaggcaacaccatgtactccccatttttgttgtctgttaaattctaaagaggtttttaagtatctttgactttcggttacagtaaaaaa

SEQ ID NO: 644388 - DNA, 231 bp, Homo sapiens
cacgggagagcgcacaaccgtccgatcccggcctcgcttccggtgcgtgaccggccgacacctgtacaggaccagcactcccaggggccgagcgcgtgccttccccgtgcggcccgtgcgcagccgcgctctgcccctccgtccccagggtgcaggcgcgcaccgcccaacccccacctcccggtgtatgcagtggtgatgcctaaaggaatgtcacgcagcaaaaaaaaa

SEQ ID NO: 644389 - DNA, 201 bp, Homo sapiens
tggtattatctcctccacttgcgacctggggcctaggcgcccctccgcgtgtataaccagttagcctacgacggcaaggattacatcgccctgaacgaggacctgatctcctggaccgcggcggacaccgcggctcagatcacccagcgcaaggtgggaggcggcccgtgatggcgaagcaggacatgagcctacgctgga

SEQ ID NO: 644390 - DNA, 511 bp, Homo sapiens
  misc_feature (150)..(150): n is a, c, g, or t
accgcatatcgtatgatgtatatatggagtgctcaatcatagtgagaattaaagagaagtcagtgtatggcattttaataagaacaaatagtcgtctaaggggatggtggcgcatatatgttccttgccatatgctttctacttcttgtncttattatgaaattatgaatttgaagcctctgaaatggtgatcagtcttcaacatctttcaaaaacaaaattactattgcctccatattgccttttttagataactttaaagttaggattttaaaatatttgtaactggctaaattttaaagtcgtgacaaataattacttaggttcagaaatatacacacacttactctttagccagtttctttcaaggtttactgtcccatcagatatctagccattttcctttgcaaattacataccttcttaagagtgtatttttaagattattacttacgctatatgatgatatagttttgcaaaattatttatagcttcatatgatgttttgtaa

SEQ ID NO: 644391 - DNA, 187 bp, Homo sapiens
cctgccacacgccagcagatattgtagtttagtagagatggggttttgccatgttggccagggtggtcttgagctcctgagctcaagtgatccacctgccttggcctcccaaagtgctgggattacagttgtgagccaccgcgctctgccatttagttttagagacagcgtcttgcttgtgtctgcc

SEQ ID NO: 644392 - DNA, 850 bp, Homo sapiens
  misc_feature (291)..(291): n is a, c, g, or t
tcttgataaatcacaacaacacctttttaataatttttcagaaagaaaaatttaaaaaaatgctggcttgaccccaaccaaccagggaatattagcaacttcctccttcccccgaggttttcaacttacacatcaactgctcccgtctgctacgaaataaccccactgcgtcacacgaaagcagttgtgaaccacactattgtacagcgtgcacacaattataattctcccctctggtgccgtaattccttcctccgcctctccccctctcttgaacgcagcggtagtctntctaacacttcctccccgagcgagagtctcactcttgtctcccgcagaatactactcaacaggaggttttcaacatcttctatacttgcaggtacacacattctcgctgcaataaatagttctgactagtgataaaatttcttgttgtagttgtcacccgcgcacccgcaggggtctcaccactcctcgctgattttccccccccaccctcgtggaatgggatcacgttgaggtgggtgcggaaatatcccccgcggtttcgcgagtggagatatacaccacacgcgtccctctctgctacacaagcacggtgtgtaacccccctcttgttttcataattagaaccaccacgattatgtgtctagggcgtgcgtaggttggggaccccgaaggtccaccccaccctgtcgatggctcgggtgcaaggatcatgcgtttgacacccctgcaggctgggtaggcattcccacggggatcgcgagtaatgcctcacgcgtctacatgctcgccctccaggatgcattacagaggaagaattgttttcgccccattcaaaaca

SEQ ID NO: 644393 - DNA, 298 bp, Homo sapiens
atgactcaccgtaccttatgtggtgcacattttctgtcagtgcatagtttcgcagtaggttgataccatgcagaaagactaccctgggcttcctgtctatccttctgggccactcacatgggaggcgccatcgccatcctcacggccgcaaagaggccgggccattatcgccggcatggtactcattatcgcctctggttctatgcaaatctctaaatctgcaacacactttcaaggtccattctagagaaagttgctcaaccattgtgctagccaaaacttgtcccttcgggcccca

SEQ ID NO: 644394 - DNA, 1050 bp, Homo sapiens
agcaaatatgtctgcatcaaaagcagttacgtttgcatagcagtaaataatcaggcagctgtaaacccccattatttctaggcactatgcagaatcgaaccacatccctgcagaatccagaaattctccgctgccacctagtcacaccccagtcctaaagtaaggtcggactaaataagctatcgggcccataccccgaaaaatgttggcttatacaccttcccgtactaagttaatcccctggacccaacccgtcatctactctaccatctttgcaggcacactcatcacagcgctaagctcgcactgactaggagacctgagtaggcctagaactaaacctgctagctctagatccagatactaaccacaaaacataaaccctcgttccaacagaagctgccatcacggtatatcctcacgcaagcaagcgcaatccataatccttctaatagctatcctcttccaccaataatactctccgagacaatgaaccataagcaatactaccaatcaactactcatcctcaatcatcataacggctatagcaaataaaactaggaatagccccataccactcctgagtcacagaggtcaccaaaggaaaccactctgaacatccggacctgaattatacatcacgatgacaccaacttagccacaatactcgacacatataccaaatactctccctcactacaccgttcgcccttatcactcagatcgcgccaagaccaatccatcacagcaggacaaaagaacgagaaaataaacgcaaaacaacgacagcgaaacaactaagacaaccgcgcgcagaatcgaaccaacataggatgggaaaaagacagcagacccgggacacactagaaagaacagagacaacaaaaagcaggaaaatacagccaagaagaccgagtgcaacagcaacaatcaacgaccaacacagaacaaagaataggccacgacaacgaaacgggcaaaagcgatagcagcacccgcagcaggaaacacacaacgacagagccacgcggcagtcgcactgcacaccc

SEQ ID NO: 644395 - DNA, 662 bp, Homo sapiens
  misc_feature (9)..(9): n is a, c, g, or t
  misc_feature (13)..(14): n is a, c, g, or t
  misc_feature (49)..(49): n is a, c, g, or t
agagctgtnagtnntctcttacaaactgaaataatcatctcagctatanatttatttgaggacactacatttataggatgttcaggatctcattggaaaggaaaagcaacctctggggggttttgttaatttttgtttgggaataaaaatttcatttggggttggccttttggggaagagggggtctctggcctctcggaaacttaaaggcccccaatccaaaaaaaaatttacctttcttttttacacccccctccaagaaaaaatttggtgggggcccccccctggggtgttttctttggggagagaacaccgggggggcccttctttaaaaaggggggggaattatttttaaaaaggccgggtaaaaaaaaaaaaacccttttttttttcttttgtgggggagagaggattttttttccccacccccccccctcttttttaaaaaggagacaacacaaaatttttttttttttttgtctcccgccgttaagtttattttttctcctccccggggttgtatttttttttttggggggggccccctccatgtttggggtttttcctcgcccccgcgccccacaaaaaaaaaattccttttttggttgttttcccccccccgaaggaagagggtgggtttttatttaccccccccccccggt

SEQ ID NO: 644396 - DNA, 112 bp, Homo sapiens
gagtatcccgaccatgtaacagatctttgttgcacacaaactgttgcatagaaaagaacatgttcagaagccatggggcaagcacatgcggggacggtctacaaatgcgtga

SEQ ID NO: 644397 - DNA, 1729 bp, Homo sapiens
  misc_feature (897)..(897): n is a, c, g, or t
cgccgcccttttattatttctctgaaaatcatggcccaaactttattggcataaatcgatcaggaattgaacactgggtaaaagccacgcttggatagttcacagagagaaagaaacagtacgattctaaaatcaatattttcatgttaacccactgacttcagaagaagagtggtacccctgaaaagaccccatgttcccttctttgggtgaagaatcttaagtggggtggcgttcaactaatataaccaagaagactgtgtaaggggcccttgagcgggtttgaaatcgtgtgcgagctaccatctcacaaacgctatttagagaaggtgggtgcatagagcgtcatgaccgctattcactcgcccaagacagagggacggggacacacgctttctttgtctgtcggacgaacgcaccctgaatagcaacacaactctactgggactatatccttagctcaatgaggagagcgcgaaagggtcgtgaagtttgcagctatgtgggcactagttctcccaccatttaaaacacccccgtgtgtgtgggcgccccccttttttctatcactctaccaatcagagagagagacccccagaaggcgcgcgtgtgcctcttccccctcctatgtattacaaatccctatgtggtgtctaaaacagagaagtccctccgtgggcgcggggcgtatctatcccccccaaggagagcggaaagccgctgttgtatgtccccactttgtggtaccccccccaaaatcatcatccccgttaatactcgaagttgagcaatacccgcttttattatgttggaagcccctttatactattttctcccagaaggaaagaccccccccacaatatgagaaggtgtggtcccagtaattatccccacccnaaccccgttgtggtgataacaccaggccggggggacacggcggcaacgacccaagagaatatttctcgtggggcggatgaaccaacgggcggggcaacattatagtatggcgcccccccaaatgtagcagtgtgcaaaaatcatattttcccagcagacacaagtacgacatccccaaacagaagagtatggagaaagcgcgtcttccgaacgaagacgctattccccgcttggagtaattgtgtcggtccgcccaaccaactacactcttgccgtagtacgacaccagcccacacaaggcagtacatattatatacccccctgcttgtcgaaactacacacgcggggcgtcatcatacaaccgcccaacgatacggacagagggcccccccccctaatattaagatacacagcgccacggtgagctggggggagggcggccaccatccacagcaaaacaggcgggctataccaaagttgcgtggctggtggtttctcccaaccaagcgggtgggagcacacgcccaagaacagtggtcgctccacactctagtaaagaggcgggtacttaatcaatctcgccgacaacacagagtcgagaaaaggcacaatgatgccccccccgcccagaaaagaaagatagattaatctgttctcccctcgtagactattctcactacccaaacagcgtaagaaaccgaagcaaaaacaagtcaataaaaacgttgctctacagaaactatcttcataagacggccccccaaaacaagggtggtgtgttgccaacacaccccctctctatcatcaacgatatgactacacgtgtacacaa

SEQ ID NO: 644398 - DNA, 330 bp, Homo sapiens
ttcatatcgagggcttcatgccctggttcagactatactacaaagcaacagtcaccaaaaccatatggtactggcacaaagacagacatatagatcagtggaacaggatagaaagcccagaattcaacccatgcacctacagcaaactaatccatggcagaggaggcagaatatttatctggtacaaaacccaaagctgtgtgcaatgggttccgggaagaggtgcattcgatcccagtacgtttcgggttcaaagctatcaaacaggtgctcgctgccctccttgagcaagcagctgatgttgagtgggatgaaggcgctcgacatgaa

SEQ ID NO: 644399 - DNA, 155 bp, Homo sapiens
ccccattccccactgtgaggtgaaaacgtgcttgtcctaacacaaagacaaatggatcttctattcccagaggaccatgggacaccaaaacctccctcttcagaatggaggtagacagataaaaatgagaggggcttgagtgtcacagaccaatc

SEQ ID NO: 644400 - DNA, 137 bp, Homo sapiens
actgatatgcatgtcgttgtggcggatgtactcagcgagtagagcaggaccagcctccctctgtgttactggtaggcaccttcttaaacatgttgtaaatgagatcgacgaaggcccaaaagagaagggaagaacgg

SEQ ID NO: 644401 - DNA, 187 bp, Homo sapiens
  misc_feature (126)..(126): n is a, c, g, or t
  misc_feature (153)..(153): n is a, c, g, or t
ggtcactttctacacatagactaaagcttgaaacagcgttgtggttttttccctgggcaaatgattattttattgtctgactttttattttctactatggttcctttagtcagaaaagtaactttntgtgcatatatctgaagtggtttttcnagctatgacactctttaggtgtagaacattgaca

SEQ ID NO: 644402 - DNA, 490 bp, Homo sapiens
cgtgggccccactgggcacaccatgacagccagcaaaaacctggggggcgcgaccccccgccggttgccccctggcccccgccgatggggtccgcccggcaggggttaggggcttcactattcccgtgaccaattcttgtggcggtaggaagaaatggttgctgctgtaatgttccgaccgcaccgctggcgttgccataacgaggggccacccataggaagccccccgtagggggtcatcagcctcccacgtgcgtgttgttccgggcggcgccaccttctgaagacagttgtccacatagtcctggtgccccaggagcatcgtcttgccgtccagaacacgtgttgtgccacgacacagccgcaaagcttagggagtcccaaagtgatagccccccccctttgtacaatgcaacggttattatgaaactaccccagggccccacccccccgggccaaccgggggaaccccccctctcccacaaaacaa

SEQ ID NO: 644403 - DNA, 1338 bp, Homo sapiens
  misc_feature (812)..(812): n is a, c, g, or t
  misc_feature (856)..(856): n is a, c, g, or t
agtttcatattactctaaatgcattacaaatatgcttaacctctaaatatttcatcactgaagaaatcccagccctacaacgttggaacagtaaaatattagtccaaggatccagtgagagacacagaagtgctagaagccactcctcatgaactaaggagaaaaagaacagacaagggaacaccccagacatggtatcagagatccacatgacaggcccaatgtgcctcattgagaacactaatgggcgactgatggcgaatccagaagctctgaagatcctttctgccattacgcagcctgtggtggtggtggcgactgtgggccgctagcgcacaggaaaatcctacctgattaacaagctggctcagaagaaaaagggcttctctctgggctccacagtgcagtctcacactaaaggaatctggatgtggtgtatgccccatcccaagaagccaggccacatcctagttctgctggacaccaagggtctgggagatgtagagaagggtgacaaccagaatgactcctggatcttcgccctggccgtcctcctgaacagcacttccatgtacaatagcatgggaaccattaaccagcaggccatggaccaactgcagtatcctttgtgacccagaacagcaccaaggtcagagggcacctgtattcataaaccagctgcctgactgtgaatcctgatgaatcaagctcaaaaggagaaaacataaaatacataaagtacagaggagtgatcccatatatccactttagacttgacacttaggttaagaacaaaggaaaatggaaggttngggaatgtgttgaactaatatgggatgaggtccatgttcatttngtcacatttctttagttagctactcagctatgtgacagagctgacacatcgagtccaaccaaaatcttcacctgatgagaatgagaatgaggattcagctgactttgcgagcttcttcccagactttgtgttgacactgagagatttctagcattacagaaagcgcttttggacaaaactgtgataaaataaactaaatggaggacttttttttattggaatagtgtcatttgtttcatacatattgatcaaatgcttactatgaatagactgaagatacagatataaatgaaatagatatggttcctgtcctaatgttgcttggggttaaaatggatgcaaacattcaattaacacaggtctatgtaatctagtacaagaactctcaaatgttggtatgcatacgtatcttctgaggatcttaccaaagacaaaagtctaattcaatagatcttggacagggtctaagagtctgtatttct

SEQ ID NO: 644404 - DNA, 428 bp, Homo sapiens
  misc_feature (1)..(1): n is a, c, g, or t
ntcaggctttccggttaggaagataatttggtcacttgtgtctgtggccactcttagaattttctcttttgagggaacctgtgactggttggcttttgcattctatggagggagatggggttaaagactgtggcaacacacaccctccagaagagctgggaccagagactgtcagcacagaaaggacaatgtcttttttagtagctgtggcagacttgagttgctgtaatttatacaaattgtttagaatggtttttaagactaagaagggaaatatacttattgcacaagacttttataattactatacttaaattatgctctatgtggggactgagaagtgtatttctacgttgcttatatctgatcacttttgtatttgttgatttaaagcctgtgggtcttttttttaatcactcttaatatca

SEQ ID NO: 644405 - DNA, 860 bp, Homo sapiens
  misc_feature (388)..(388): n is a, c, g, or t
tgggaagttaaagtatttattggatgtgtttaacctggggtactttccccacagatcatattagggagtttgggtagggtgaagtttataactcgtggtgcataggtgggttagaagaacagtaaatagggctcaagagggggaggaaaacaaaaaaaaaaaaaaacactctcgagagcgctctcttatgtgtgtggggtgtggggaaaaagagaggtagtaaataaaaatgggcgccacatgtggcgccaataacgctgtgtgttcccatggcccccaggcttttctcttgtggtccacaaaaggtggagaaaaatctctctggcgcggggtccctccctatatataggagagaggctcgcgatatattatattctcgcgagaatanagcgccccaggtgagacacaccccgctgccgcgtatttaacagtagaaatccgccgggaggacaaccacgacacccccacgcaggggagcacccacccacaaacacacccggccgcaaccaacacaccaacaacccgcgaggcacacctacacacactcacgtgtcaagagccccacgagacaggagacaccatcatccaggagacaacccacccaccacaaaccaccacacgagagagaaacgaaacaaaaatacggcagagcgagctgagccgaacaaaacaaaaaacaaaaaaacaacagcacacacggccatccaaccgaaataggaagacgaagagataaagaggaaagcggcgggacgagcactcatccaaaacaccgaacgctagacacccaaacacactttactcaataacacgcaggaccaacagaacatacaacaccagggcaaacacccaaacaacacaca

SEQ ID NO: 644406 - DNA, 1074 bp, Homo sapiens
agtttcatattactctaaatgcattacaaatatgcttaacctctaaatatttcatcactgaagaaatcccagccctacaacgttggaacagtaaaatattagtccaaggatccagtgagagacacagaagtgctagaagccactcctcatgaactaaggagaaaaagaacagacaagggaacaccccagacatggtatcagagatccacatgacaggcccaatgtgcctcattgagaacactaatgggcgactgatggcgaatccagaagctctgaagatcctttctgccattacgcagcctgtggtggtggtggcgactgtgggccgctagcgcacaggaaaatcctacctgattaacaagctggctcagaagaaaaagggcttctctctgggctccacagtgcagtctcacactaaaggaatctggatgtggtgtatgccccatcccaagaagccaggccacatcctagttctgctggacaccaagggtctgggagatgtagagaagggtgacaaccagaatgactcctggatcttcgccctggccgtcctcctgaacagcacttccatgtacaatagcatgggaaccattaaccagcaggccatggaccaactgcactatgtgacagagctgacacatcgagtccaaccaaaatcttcacctgatgagaatgagaatgaggattcagctgactttgcgagcttcttcccagactttgtgttgacactgagagatttctagcattacagaaagcgcttttggacaaaactgtgataaaataaactaaatggaggacttttttttattggaatagtgtcatttgtttcatacatattgatcaaatgcttactatgaatagactgaagatacagatataaatgaaatagatatggttcctgtcctaatgttgcttggggttaaaatggatgcaaacattcaattaacacaggtctatgtaatctagtacaagaactctcaaatgttggtatgcatacgtatcttctgaggatcttaccaaagacaaaagtctaattcaatagatcttggacagggtctaagagtctgtatttct

SEQ ID NO: 644407 - DNA, 315 bp, Homo sapiens
cttcctctgataatggaatgtgagagacacttcctatatagagagagttcaagcgtgtgagaataaaataatctcattcccagagtcagaggagaagagacatgtaccttgaaccatcgtccatccactcaagctagccagagggtgggagccataaggaatgcgtggggtagcagatggagtaatggtcacgaggataccatgacccactcccaaagctcatacttgcaaggttccctttctcttcttccgtcaggtccttcctttatgtctggttgttgcaccatctgcttggttggctgaatcgggacatga

SEQ ID NO: 644408 - DNA, 861 bp, Homo sapiens
  misc_feature (1)..(1): n is a, c, g, or t
  misc_feature (67)..(67): n is a, c, g, or t
  misc_feature (88)..(88): n is a, c, g, or t
  misc_feature (113)..(113): n is a, c, g, or t
  misc_feature (116)..(116): n is a, c, g, or t
  misc_feature (120)..(121): n is a, c, g, or t
  misc_feature (124)..(124): n is a, c, g, or t
  misc_feature (140)..(140): n is a, c, g, or t
  misc_feature (149)..(149): n is a, c, g, or t
  misc_feature (154)..(154): n is a, c, g, or t
  misc_feature (171)..(171): n is a, c, g, or t
  misc_feature (194)..(194): n is a, c, g, or t
  misc_feature (201)..(201): n is a, c, g, or t
  misc_feature (221)..(221): n is a, c, g, or t
  misc_feature (224)..(225): n is a, c, g, or t
  misc_feature (245)..(246): n is a, c, g, or t
  misc_feature (252)..(252): n is a, c, g, or t
  misc_feature (270)..(270): n is a, c, g, or t
  misc_feature (278)..(279): n is a, c, g, or t
  misc_feature (281)..(282): n is a, c, g, or t
  misc_feature (289)..(289): n is a, c, g, or t
  misc_feature (292)..(293): n is a, c, g, or t
  misc_feature (317)..(319): n is a, c, g, or t
  misc_feature (337)..(337): n is a, c, g, or t
  misc_feature (343)..(343): n is a, c, g, or t
  misc_feature (354)..(354): n is a, c, g, or t
  misc_feature (361)..(361): n is a, c, g, or t
  misc_feature (387)..(387): n is a, c, g, or t
  misc_feature (395)..(395): n is a, c, g, or t
  misc_feature (402)..(404): n is a, c, g, or t
  misc_feature (415)..(415): n is a, c, g, or t
  misc_feature (429)..(430): n is a, c, g, or t
  misc_feature (434)..(434): n is a, c, g, or t
  misc_feature (454)..(455): n is a, c, g, or t
  misc_feature (457)..(458): n is a, c, g, or t
  misc_feature (493)..(493): n is a, c, g, or t
  misc_feature (495)..(495): n is a, c, g, or t
  misc_feature (504)..(504): n is a, c, g, or t
  misc_feature (556)..(557): n is a, c, g, or t
  misc_feature (590)..(590): n is a, c, g, or t
  misc_feature (603)..(604): n is a, c, g, or t
  misc_feature (608)..(608): n is a, c, g, or t
  misc_feature (616)..(616): n is a, c, g, or t
  misc_feature (622)..(622): n is a, c, g, or t
  misc_feature (635)..(635): n is a, c, g, or t
  misc_feature (645)..(645): n is a, c, g, or t
  misc_feature (685)..(685): n is a, c, g, or t
  misc_feature (699)..(699): n is a, c, g, or t
  misc_feature (744)..(744): n is a, c, g, or t
  misc_feature (752)..(752): n is a, c, g, or t
  misc_feature (758)..(758): n is a, c, g, or t
  misc_feature (760)..(760): n is a, c, g, or t
  misc_feature (776)..(776): n is a, c, g, or t
  misc_feature (798)..(798): n is a, c, g, or t
  misc_feature (804)..(804): n is a, c, g, or t
  misc_feature (846)..(846): n is a, c, g, or t
nttttattattttatttttgatcaacataaaataattatacatctctatgggttacatagggatgtnttgatacatacaatacaaccntactgaattgtttatcacatctaanggntttnnggnagggtgtttaagttcntctatatanaagantatgttgccagcaaatngggacaatttgacttccaccttnccaattngaagaggctttatttctttntcnngcctaatcaccggcataagnnggtatnggatacccactagatacnaggctatnngnnctatgcnagnngctataagaatagaaatatgaaannnaaatacctaccacaaggnatttcngtcccaggggncagcccnagggcagagagctagctatgagaganattggggnggggacnnnggggccagggnacacggagaacagnnccgngaattcacattcacaggggnngnnggggggaaggggcaacgggtaggtacggggcattncnaggccattnggcgttggttaggctttgagtagacagataagaaaataaacgggttttcagnngggagaacggtatacccacagtatgcgggcggngggactcgaaggnngtcnaccaaagngctttnggaccaggggganccaggggagngggggagctcgcggagagggggagcgggagggcaagaggngtaacctggaagtnctggctggcaaggttttggagcaggctcatataagggtggttggnaggtgcanttcttnanggtacggctgccaaancagttcttcacaaataaaagtnagatanagatttttccagacaaataaaagctgacttgtctcacaaganatcctaaaggaagct

SEQ ID NO: 644409 - DNA, 141 bp, Homo sapiens
tgccacataccagacgctgtgacagaatcttcatacacattgctcccagatgagcaccaaagggagacacagcagatacgattctgtggacttgagaacccaatctatacaaatattttcaactctaagtccccaagagaa

SEQ ID NO: 644410 - DNA, 351 bp, Homo sapiens
gagcggagtacggcccggggaccgcagtggagagtgagcgggctttccccgcgggaccagccgggcgctcgccctggctgggcaggttactcactataaacaatatgcaccaacacaagcaaagttattctactttgaatgccgtgaaaagaagacagaaaactccaaattacggaaggtgaactatgaggaaacagtatttatgggttgcagtaccattcttaataaagtacttaaacaggtacagtaggtaaccaaagagaaaatcctggaagccacaagatgtctacaaagaaccatttccaagatgcatgtctttaatgaaaagggatggaaactacattcttgaga

SEQ ID NO: 644411 - DNA, 658 bp, Homo sapiens
cgagagcgttgagttccagaacctggctacgcttaagccttccaacaaggcttttgagaagaagttccgctttgattataccacatgagagggccctgcggcgcactctgcaggaggacctggtgaaggacgtgctgagcaacgcacacatccagaacgagttggagcgggaatttgagcggatgcgggaggatcgggaggtgctcagggtcatcttcccaactggagacagcaaggtcgtcctcccctgtaacctgctgcggatgatctggaatgctcagaaaatcttccacatcaaaaaaaaacaaaaaacaaacaaaaacaaataaaaaaaacaaacaaaaaaaaacccacgccttccctccgacctgcaccccatcaaagtggtggagggagtcaaggaattgagcaagaagctggtgattgtgaatggggatgacccactaagtcgacaggcccaggaaaatgccacgctgctcttcaacatccacctgcggtccacgttgtgttcccgccgcatggcagaggagtttcggctcagtggggaggccttcgactggctgcttggggagattgagtccaggttccaacaagccattgcgcatcccggggaaatggtgggggtctggctggcagtcccttggagaactgcaccaga

SEQ ID NO: 644412 - DNA, 1429 bp, Homo sapiens
agcggggctgctgcgtgatgtcggtgtgagcgagcggcgcctgaacacacggcggctgccgagcgcctgacccgggcctgcgccagagcctgcacctgagctcctgtgggccccacgaccgctgctacgtgtggcccatgctgcccagttgctcacattgagtgcggctgtgctcctgcaattcttcgcgtgtccaaggccttgccggggctcatggtgtcattgcttggctcccttccttgcttcggccgtgcgtccacctcctgcattgccttgagatcacacggccgcccgacctgcgcgacacaagcccatggcccgaagacgtggttgaaacgcgggcgggtcctccgaggctccccaagggatagcctgcctgccaggaacccgaagggtggctggcggccccccagcggggcgcttgacatcccggcgggaagacccaaaaaaattcagtgagaatggtcaacctgtggaaagaaacaccacgaaaagtgaaaaaagggacaggaatttacagcgcgatgccgcccgaagaacattaagccctcccggatcccaaggcccacgtttttaaaagggaaaaggaagaatcatcctaaacagccgtttgtaagagatgcaacagattgacttgaagcgcaagaatattgttgataaggacatactttagtctgggaaaaagaaattttatgagaagaggaatcaaagtaggaataacccgttgagagggttccaagcgatttgcggcacgtcaccaataggattggagagagtatagctatgtgcacgacacatttggtcacagattagaagaacgaacagaagtaaacaagtggccatcgagggtggattccatttttcaagagattcaaagagcaagcacaagaaggataacacatggctatggggaatgagcaaaaatgggtaagacatgacgaagttcaatttcaaaaagttccagtttagattataggttgaagactacgttgagaaagttagttgggggttgcataggattaaggttaagcgcaaaccgcacgatattaggagagtataaccgggagttggagcacattatgaggagagagaaagtatggcaagagagtatagagggagaggtaaagagatatgggaggataaagaagactcaacacaaagacacaaagcacgtaacactccagtggaacagataacaagcaaggagaacgaatagcgcacggagaacagcaggaatcaatagagacaaaaaagccacggtacaagaagaaggagggcgacaagacgacatgagaaggacaaacaccaccaagagaccggaacgcaatgcgccagcagaacaacccggaccgagccgtcaagacaggtagaccacgggacaaacacaagacaaccggacggaagacgtagaaaacagacacgcgccgag

SEQ ID NO: 644413 - DNA, 709 bp, Homo sapiens
ggagaactagtctcgagttttttttattttatatttaacggtttagagggggaatgctggacaattgtaatgggtttggaaacttgtcatataagtaatgctagggtgagtggtaggaagttttccataggaggtgtataatgggcctagccggaaccgggggtatgctgtaccgaaattcataaaaccagggaggttaagaagtagggtcttggtagccaaaatcatgttcgtgtcagagttcacggggaaagtgcgtcatactagtggtccctagcgaaccatctgtcgtcgcgcagagcggtcgtcatcataagatcaagcgaaggcggagagcaactagcagcgcatcatagaacgacactagcggcagaaagagcggcacgccgaagacagcaacagataacgaaaaagtgaatctagaaaagaaagccccgtggtaagaacacataaagattataagcagcagacgaaggcaccccaactctttacgggaagcaaggaggaacaacaacagacgagccagactctcgacaaacagagcaaacctagatagacataaagccctggggtgcgcaaagaatatccacacctccctactactcttacttgcgcgcccaaacaaggagtacagctgcaagtggcgagcgacgaaagcttaaccaccagagaggcggctgagtcccaatagcacagaacgcgacgcaaa

SEQ ID NO: 644414 - DNA, 368 bp, Homo sapiens
aaccacagagtctcgtccgtcgccaaggtgtagtgcaaatgttgcagcatggctcactgcagctttgaactcccaggctcaagcgatcctcccatctcagcctcctgagtagctgggactacaggcacaggccaccaaacactggctcaatgtttaaattttatgtagacgatggcggggggggcgggggtctccctatgttgcccaggctggtctcgagctcctgacctcaagtgatcctcctgccccagcaattccaaagtgctgggattacaggtgtgagccactgcctgggctggccgtaagggtttgtaactggtttcatagaagagccctggagcagcacagtagaaatgagccctatcgga

SEQ ID NO: 644415 - DNA, 297 bp, Homo sapiens
ttataagtctgacagtctctttgagaaattatattcagatcaacactccctcgtgttcacgtctgtttgtcaccctgccaactccttgcccacctgaatactaggacccactgagtccagtctgcagcacccacctattccaacaagaacatacctacctactacagcaaggatacacccacctcctccaacaaggacccacctcttaatccttcctaaacaatccatcaagtgccaaccaaacatttaaataagtgagcctatggggggggggcatcctcattctaaccgtcgacg

SEQ ID NO: 644416 - DNA, 348 bp, Homo sapiens
  misc_feature (280)..(280): n is a, c, g, or t
  misc_feature (285)..(285): n is a, c, g, or t
  misc_feature (313)..(313): n is a, c, g, or t
  misc_feature (322)..(322): n is a, c, g, or t
ggtctcactccgttgctcaggctagaatgaagtggagcaatcacggctcactgcacctcagtctcctgggctcaagcaatcctcccgtgtagctgggcctacaggcatgcaccactaatttgtttgactttttgtaaagacagggtttcaccacattgtgcaggctggtctcaaaactcctgagctcaagtgacccacctgccgtcttcacaaagaaggaagaaaagaaggagtggaggaagactctggaaccctggaagctgtatgccacagtgggctnatggntcttgtgtgaataggccatttatttganctcttcagnaacactgttctaaccggctgaaactt

SEQ ID NO: 644417 - DNA, 125 bp, Homo sapiens
tctcgcctggggcacatgagcaggccggcgagcgcctgcgctggcgctggccgtacgacatctgtcatgggcggctggccggcgcgaccgcctgcgggcgcaccgcgaccttgcccggggctcct

SEQ ID NO: 644418 - DNA, 247 bp, Homo sapiens
atagtgacccctggaaagatttattaaagaattaaatttggggaacctttaaaattagctcccccattagattttttttttcttaagcataagactgaacttaaatgtgttaattttagtagaaccaggcccggctcccaaaaggaacccagattgtagagattaccataaattgttcttgttctaaaaaaaaaattttttcatttctgtcgggcttggaaaactagtaaaaattatgtttaagata

SEQ ID NO: 644419 - DNA, 289 bp, Homo sapiens
  misc_feature (168)..(168): n is a, c, g, or t
acaccacctggtccacaccacctgagtccatgtgtccttcgggaaaagggggagtgagagtgggaaaaagggagagttcaggacacctggtccccagctccccattgcctggggcagcacgccctcaactttctcgcttgtgccctacccctacttccagtgtgccanaatagccattaacctcgtacttggaacgtgttatgtaggcctactctgggtgtccagtgtttcctggttcaacgcctgggaaatgccagcggaggaaacgggggtctaggctacatgcgac

SEQ ID NO: 644420 - DNA, 166 bp, Homo sapiens
  misc_feature (153)..(153): n is a, c, g, or t
ccccagccgccccaaccaccttttggtgccacacttctcaggctggccgccctggttggggcagccgagagcctaaaaaacattggtgaaggggccttggagttgtgaccgccggggccgaaacaggaacgtacgggtaaacgtgtgttttcnggaaaaaaaaaaa

SEQ ID NO: 644421 - DNA, 93 bp, Homo sapiens
cccaacccgaattgaggggggctttgccaaaacccgaaatggtaatgtgaagttaaaagcaaagagtggcccccagtaaaccccccgggcaga

SEQ ID NO: 644422 - DNA, 174 bp, Homo sapiens
  misc_feature (6)..(6): n is a, c, g, or t
  misc_feature (74)..(74): n is a, c, g, or t
  misc_feature (114)..(114): n is a, c, g, or t
  misc_feature (144)..(144): n is a, c, g, or t
  misc_feature (148)..(148): n is a, c, g, or t
ctaaancttcttagcatgttaataacttatgtattatatagttttagaaattcttaaagtgctattttaaaacnccagcctgggtgacagagtgagattccgtctcaaaaaganaaaaaaaaagaatatatatatatgtatgtntgtntgtatgtaaacacacacactaatttg

SEQ ID NO: 644423 - DNA, 1804 bp, Homo sapiens
gcactggactgagaaccttcaccaaaaaaatgtctgcccagagacagatgaggtccttcagctccagtgctgattggttcttttccaaaggcccatctaatcctaccacgcacggaaatatccacaggtttttattctttctgccaggtacatcagatccatcaggtccgagctgtgttgactaccactacttttcccttcgtctcaattatgtcttggaagaaggctttgcggatccccggagaccttcgggtagcaactgtcaccttgatgctggcgatgctgagctccccactggctgagggcagagactctcccgaggatttcgtgtaccagtttaagggcatgtgctacttcaccaacgggacggagcgcgtgcgtcttgtgaccagatacatctataaccgagaggagtacgcgcgcttcgacagcgacgtgggggtgtatcgggcggtgacgccgctggggcggcctgacgccgagtactggaacagccagaaggacatcctggagaggacccgggcggagttggacacggtgtgcagacacaactacgaggtggcgtaccgcgggatcctgcagaggagagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaacggtgactggaccttccagatcctggtgatgctggaaatgactccccagcgtggagatgtctacacctgccacgtggagcaccccagcctccagagccccatcaccgtggagtggcgggctcagtctgaatctgcccagagcaagatgctgagtggcgttggaggcttcgtgctggggctgatcttccttgggctgggccttatcatccgtcaaaggagtcagaaagggcttctgcactgactcctgagactgttttaactaggactggttatcactcttctgtgatgcctgcttgtccctgcccagaattcccagctgcctgtgtcagcttgtccccctgagatcaaagtcctacagtggctgtcacgcaaccaccaggtcatctcctttcatccccaccccaaggcgctggctgtgactctgcttcctgcactgacccagagcctctgcctgtgcatggccagctgcgtctactcaggtcccaaggggtttctgtttctattctctcctcagactgctcaagagaagcacatgaaaaacattacctgacttcagagcttttttacataattaaacatgatcctgagttatctgtattctgaactttcttaattgagaagaggcaagaaatcactgcagaatgaaggaacatcccttgaggtgacccagccaacctgtggccagaaggagggttgtaccttgaaaagacactgaaagcattttggtgtgtgaagtaagggtgggcagaggaggtagaaaatcaattcaattgtcgcatcattcatggttctttaatattgatgctcagtgcattggccttagaatatcccagcctctcttctggtttgctgagtgctgtgtaagtaagcatggtggaattgtttggggacatatatagtgatccttggtcactggtgtttcaaacattctggaaagtcacatcgatcaagaatattttttatttttaagaaagcataaccagcaataaaaatactatttttgagtctaaatgatagaagcccaaatatattttgttcatggtaaaaaa

SEQ ID NO: 644424 - DNA, 330 bp, Homo sapiens
cgcctgctcacagcagaagtgttgtgtggaaacaaaatgagtatctctttctggctaccctggagtgtgtaacgctctgccaggcagccctcctcctctgctcatggagggcagcccctgtgatgtccttgcatggagcctggtgaattactaaacatgaacagttgcatcctctgtgtcgtgacttgtcatgtgccctggtgagggtgggagtcaggagacaagacagcgcagagagggctggttagccggaaaaggcctcgggcttggcaaatggaagaacttgagtgagagttcagtctgcagtcctctgctcacagacatctgaaa

SEQ ID NO: 644425 - DNA, 1370 bp, Homo sapiens
gcactggactgagaaccttcaccaaaaaaatgtctgcccagagacagatgaggtccttcagctccagtgctgattggttcttttccaaaggcccatctaatcctaccacgcacggaaatatccacaggtttttattctttctgccaggtacatcagatccatcaggtccgagctgtgttgactaccactacttttcccttcgtctcaattatgtcttggaagaaggctttgcggatccccggagaccttcgggtagcaactgtcaccttgatgctggcgatgctgagctccccactggctgagggcagagactctcccgaggatttcgtgtaccagtttaagggcatgtgctacttcaccaacgggacggagcgcgtgcgtcttgtgaccagatacatctataaccgagaggagtacgcgcgcttcgacagcgacgtgggggtgtatcgggcggtgacgccgctggggcggcctgacgccgagtactggaacagccagaaggacatcctggagaggacccgggcggagttggacacggtgtgcagacacaactacgaggtggcgtaccgcgggatcctgcagaggagagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaacggtgactggaccttccagatcctggtgatgctggaaatgactccccagcgtggagatgtctacacctgccacgtggagcaccccagcctccagagccccatcaccgtggagtggcgggctcagtctgaatctgcccagagcaagatgctgagtggcgttggaggcttcgtgctggggctgatcttccttgggctgggccttatcatccgtcaaaggagtcagaaaggacctcaagggcctccaccagcagggcttctgcactgactcctgagactgttttaactaggactggttatcactcttctgtgatgcctgcttgtccctgcccagaattcccagctgcctgtgtcagcttgtccccctgagatcaaagtcctacagtggctgtcacgcaaccaccaggtcatctcctttcatccccaccccaaggcgctggctgtgactctgcttcctgcactgacccagagcctctgcctgtgcatggccagctgcgtctactcaggtcccaaggggtttctgtttctattctctcctcagactgctcaagagaagcacatgaaaaacattacctgacttcagagcttttttacataattaaacatgatcctgagtta

SEQ ID NO: 644426 - DNA, 137 bp, Homo sapiens
acgcctattaaaaaattctcataatcactaatcactagagagatgccaatcaaaaccacaatgagataccccctgataatagagtggcggtacttgaaagtccaaaattaccagatgctggcacggttgtggagaaa

SEQ ID NO: 644427 - DNA, 934 bp, Homo sapiens
cggtaccccacgaagcctccaatcccactcagcatcttgttctgggcagattcagactgagcccgccactacacggtgatgggccttatcatccgtcaaaggagtcagaaagggcttctgcactgactcctgagactgttttaactaggactggttatcactcttctgtgatgcctgcttgtccctgcccagaattcccagctgcctgtgtcagcttgtccccctgagatcaaagtcctacagtggctgtcacgcaaccaccaggtcatctcctttcatccccaccccaaggcgctggctgtgactctgcttcctgcactgacccagagcctctgcctgtgcatggccagctgcgtctactcaggtcccaaggggtttctgtttctattctctcctcagactgctcaagagaagcacatgaaaaacattacctgacttcagagcttttttacataattaaacatgatcctgagttatctgtattctgaactttcttaattgagaagaggcaagaaatcactgcagaatgaaggaacatcccttgaggtgacccagccaacctgtggccagaaggagggttgtaccttgaaaagacactgaaagcattttggtgtgtgaagtaagggtgggcagaggaggtagaaaatcaattcaattgtcgcatcattcatggttctttaatattgatgctcagtgcattggccttagaatatcccagcctctcttctggtttgctgagtgctgtgtaagtaagcatggtggaattgtttggggacatatatagtgatccttggtcactggtgtttcaaacattctggaaagtcacatcgatcaagaatattttttatttttaagaaagcataaccagcaataaaaatactatttttgagtctaaatgatagaagcccaaatatattttgttcatggtaaaaaa

SEQ ID NO: 644428 - DNA, 402 bp, Homo sapiens
  misc_feature (23)..(23): n is a, c, g, or t
  misc_feature (29)..(29): n is a, c, g, or t
  misc_feature (51)..(51): n is a, c, g, or t
  misc_feature (86)..(86): n is a, c, g, or t
  misc_feature (196)..(196): n is a, c, g, or t
  misc_feature (304)..(304): n is a, c, g, or t
  misc_feature (399)..(399): n is a, c, g, or t
  misc_feature (401)..(402): n is a, c, g, or t
ataaaagccctgtgaaccccttnaaaccnactggtcccccccatgggtganatcctcaatgtgaccaatgggcatgggcatcccanaccggggaaagtggggcactgctgtgggtgctgatgctggttatagactgcaggcctggctcagggctcccccagtttccccctgcactggggcaaggaggctatgtganagtttcataaagtgtgtaaattcctggaccactgtgacagacatagctgtcccattgtcactgagatccccgtgtccctcagagacccctcattccctgttccttggnaacctctaacctgttctctacctctatagttttgtcattaaaggaccctttgaaagtacttattccagcctgcgcaacatggtaaaaccccatcncnn

SEQ ID NO: 644429 - DNA, 901 bp, Homo sapiens
  misc_feature (881)..(881): n is a, c, g, or t
gaaggaaggggcggttggtgcgggctccattgtgcgtgtttaaaggtgccatgaggggtgacagaggccgtgttcgtggtgggcgcttaggttccaggaggagggcccaggaggcagggttcagcgcctccatttgttaatcacacagttatcctcatattgagcattgcatatgtcttgtgtgataaatgagcctctattcccccacgggatcaatgacacacgactacctgtattgtaccattgttgctcgtttcatgtgaagtgggcttgtctgagaagaagggatatcagtgaccttgtctgcacaatgtactggctgagagagggccatttcttaattaacattcctcctagcggtgggatcgatatccatagttgagaccaaaatggctgcatattgactgacacctcctgaatgtagttgcgtcacttcgccagggggtagcaaattgtagtagacgtcgcaacaacgtttgcatacgaaaattgtttccggagcaagggatcgtggactcccatgataaaatacccggggtgacaagaatgaacctcaccacggaacatccaaaggtgtggtttagaacacttgagttgtggctgaatcatcgtccagcatggagtgtctttgtcccagaccggttcttgtgaaatggcttgtttggcgttgcccgcttgcgtagtggaatccatagaggatcctgagtgaggaaaaggcccataatagtaagtccactaagggaattcctttccatgaaaaggttccttaagccaattgcattgtgccaaaaggtacaatccctgggttattgacaaagtcgaggtccgtatccttgactaggcgttacaatcatggcagacgaatttgcgtccatttaccnaggcatggctgcccatccca

SEQ ID NO: 644430 - DNA, 1665 bp, Homo sapiens
ttccaggcccctgcagccatggatgtctggaggcgtccttcccttatctgtcccctgactccaggcccctgaggcctggtggtgggaagatgtgctgcattgactcagcgtaaggcacgtcgctggtggtgttctcccgtgcgatgcaccttccggaaggactgggcatgctctgagcgcactatctctggtgcacgagatcctgtcatatgcatcgtgcgatggtgatactacagtggcggagcagacccatgagcattatacgcatcaatctatgacgagggcatcttcacaagcgatgataatagtcatgcgacatatttgtcttcacatgttggtcctaaggtggtgatgtccaggagcccaaggcatggccattcattgtcttgtcgtattcgccttttgtacgtaagatcccccagtgtcccagctttgtacgttaaagtagagtctccaagtgcgagacacagtgattatgcctcaccaagcaaggggtagagcgctcaagataggaactacagagaccgagaccaacgtcccacgtttggaacacgtcattgacacatcattcgcgcaacgagtattcccctcccacccagctgagggcgtggacgtgaccgtcggccccgcattcgttggacgaagagaagaccaaccctgtttagacaaccaattgggtcgagagaatgcaacaaaaaaaccggttggggcgcatgataggaggctaggtaggggaccatggagcgtccggcactagcacgttccttcccgggtgaggcacttgaaaccccattgtcgggttcattggggacccctccagtttacgaatatttccatttacacacaattaactttacctagcaaagggggggtatacaatggaggagaaaggatcaaaacaaaggaaacgccactatacaccaccatttcgtacccacgtccaaagattagcgaacagtattctagagccgactatattgccaaccagggcagtggatccttatacaccccgcggaggaaaaagcaatggccaccaaggacaaacattacaacaccttggaggtcgatcggaacgatatggccgagtcggggaacaacaacccaggatagggtgactcccgtagggcataccgatagagtgggcccccagacaggaatatgttagcaccaccccaagacaaccgatgatacaatagacacccaccaaggaggaacgattcgcaaaaacagttgggcactacaacaatagcacgggggagcacccccacacatacgtatacagcatctccacacgccataaggggcgaacaaagcacagccaacaaagtatgcaagatgcatagacgccttaaaggccaggcatttgcctaacgcaacgagaggaaaagagttgggagcggtttgaggccagtgagtaacaaacaaagaaacacaggaccatcactggagcaagagagcgccaagacatccattcgacgtgagaacagccatcaacgaccggcgcctagccaccgcgaaacccaggacctccattgaggcacgacgcgacgcaacaattgccacgccatcctaggactagtagggataggacccacagtgcaaccacaggacagaggatcaggccgaccgccaggagcacacacacaccgacggcgcacgggggcg

SEQ ID NO: 644431 - DNA, 1174 bp, Homo sapiens
  misc_feature (5)..(5): n is a, c, g, or t
ctcangcaagctgtgcagtggtggctactgcctgtaggtattttccagtgactgaaagaggctgctagtggtcgggattagatatcatctgatgtcctaaaaagactgaacccttcatattccccagaagaataacagctgttccccacctcccacacatctgcatcaagctgaagttctgtgtcctcgtgagctgatttcacctttgcacagatcttgggggaggtgatgacaatacaccctggacctcaactttctctgtctgaagctgcagggggcccctgaagggtgggggagatggcaggcccaccaggataccctgtgctgatcaatcctcttctctcttctccagggcttctgcactgactcctgagactgttttaactaggactggttatcactcttctgtgatgcctgcttgtccctgcccagaattcccagctgcctgtgtcagcttgtccccctgagatcaaagtcctacagtggctgtcacgcaaccaccaggtcatctcctttcatccccaccccaaggcgctggctgtgactctgcttcctgcactgacccagagcctctgcctgtgcatggccagctgcgtctactcaggtcccaaggggtttctgtttctattctctcctcagactgctcaagagaagcacatgaaaaacattacctgacttcagagcttttttacataattaaacatgatcctgagttatctgtattctgaactttcttaattgagaagaggcaagaaatcactgcagaatgaaggaacatcccttgaggtgacccagccaacctgtggccagaaggagggttgtaccttgaaaagacactgaaagcattttggtgtgtgaagtaagggtgggcagaggaggtagaaaatcaattcaattgtcgcatcattcatggttctttaatattgatgctcagtgcattggccttagaatatcccagcctctcttctggtttgctgagtgctgtgtaagtaagcatggtggaattgtttggggacatatatagtgatccttggtcactggtgtttcaaacattctggaaagtcacatcgatcaagaatattttttatttttaagaaagcataaccagcaataaaaatactatttttgagtctaaatgatagaagcccaaatatattttgttcatggtaaaaaa

SEQ ID NO: 644432 - DNA, 352 bp, Homo sapiens
  misc_feature (65)..(65): n is a, c, g, or t
atcacaggatctccggaatgtgtggtgttatggcaggcaccccggaggagctagccagaagattngaagaacaagctcgagtgcagcaaatacagaacgaaatgctgcaagctcaacaaaagagcattgaagagctgaagtctatggtggccgctctgcttggtcactcaacaaagtccaagagcatggacgcttcccctagcaaaactacgaaaggcaaggggaaagaaaaaatggctgaacactcagcttctgacgatgctgtggattctgaacctgaaatcgtagtatcctcggctgaagaacctgaagctggagatcgaaagagaaacgttcataacaccacacaatt

SEQ ID NO: 644433 - DNA, 201 bp, Homo sapiens
attccctaagagaaaggaagtaagccccccaatctccctagctttccccctaggggcaaattttggactgtagaccaggaaggaaatccccaagtacataagttttactgagttatggagccccatatcagagttcagggaccctgaggcaactggaagttgtggggtaaagttttgaaaaagagagagctcctgccccca

SEQ ID NO: 644434 - DNA, 1027 bp, Homo sapiens
gcactggactgagaaccttcaccaaaaaaatgtctgcccagagacagatgaggtccttcagctccagtgctgattggttcttttccaaaggcccatctaatcctaccacgcacggaaatatccacaggtttttattctttctgccaggtacatcagatccatcaggtccgagctgtgttgactaccactacttttcccttcgtctcaattatgtcttggaagaaggctttgcggatccccggagaccttcgggtagcaactgtcaccttgatgctggcgatgctgagctccccactggctgagggcagagactctcccgaggatttcgtgtaccagtttaagggcatgtgctacttcaccaacgggacggagcgcgtgcgtcttgtgaccagatacatctataaccgagaggagtacgcgcgcttcgacagcgacgtgggggtgtatcgggcggtgacgccgctggggcggcctgacgccgagtactggaacagccagaaggacatcctggagaggacccgggcggagttggacacggtgtgcagacacaactacgaggtggcgtaccgcgggatcctgcagaggagagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaacggtgactggaccttccagatcctggtgatgctggaaatgactccccagcgtggagatgtctacacctgccacgtggagcaccccagcctccagagccccatcaccgtggagtggcggtcctgcacttgactccctggaaactattttaactggggatgtggtttcactttttctgaacgctgtttgttcctggccaaaatttccagtgcctgtgtcaagctgttccctgaaatcaaagtccaaaggggggttacgcaccacaggtatttct

SEQ ID NO: 644435 - DNA, 736 bp, Homo sapiens
gggcggacctttgtcgaggtacctcaacgctgtgaccgagagcgagaaggcactgacagagcaaccactttgaactgagcctgcgcactgagagccacgcaggggcctggtgctctggagatggaaggccacaggagcgggcagactatgtggcactggccattgtggacgtggcacctgcaaactgagctacaactgggctcccagcccgtggtgctgcgttccaccagtgaccctgtcaacaacaaccgctggttgcgggtcgtggacacatagggagcagagggaaggttccctgcaaggtgggcaatgaggcccctgtgaccggtcctccccgcgtgggcgccacagcagactaggacactgatgtgagccctgtgagattggagggcactgcctggagctgcccgtgggccagaaatgccaaggcctacaggacagtgctttgtgggctgcttgcgggaacgtggtgagtgggaccaggaaacccgatgaaactgatggaggacgcacgtcaacaaagccagagaatgtggacctgacaccaaacccagtgagcttggcaaccagagaccccgtgccacgctgtaattattttatattatagtacaacttgtcgcaagagatatgattttcttgcctgatgttggccgagggactgtgaccggcctcacttccgtcaggaccgcggatgcagaaaaacaagctagagatgaaaggaagtggaccgtgaagg

SEQ ID NO: 644436 - DNA, 1190 bp, Homo sapiens
cggacgtttctgcggactctagtggcgaaatcatgcccctaggagctcaaagatggtttgtactcgggcagtttggagggcttttcccgatgtctgtggacttagaatcgttcccttctacgacctagggccgtgcatctattccccgtccaaaagtgcagatctcaggaaaagcggcttttcttgccaactgacttcccgtcgagaaattattttataaaaactaagtggaacctcgggatgtaaatcaaccttccttccgtgttgattggccgtggctttagtggcccttgccctacggataagttctcccatgcttagtctcttgtgtctcagcgtgtgttccacctcttgagattcgaaaagtccctaacagtggaatgttccatcgtcagttcacatctcaggtcatgctgcatctgttcattcccccacatcccgcatagggcgtcttggctctgctgagctctgcctttcctggcatctgtacccacagagctcctgctcgtcctgtgctcattggcctcagtgctggcgttctctcacgctgcagggttactcacaacgggagttgtctggtgtgtctgatatgctgtctgccgtacatgaccctggtcttccaatgatgataagtcatcattcgaaaataaacacttgagcgctggactgttgagagcgttctcttgtacgatagatatgaaagcatcgatgcctcgagttaatcgtggtaacttcgtgaactcttccttaaatatgacgaagaggcaggaaatcactgcagaatgaaggaacatcccttgaggtgacccagccaacctgtggccagaaggagggttgtaccttgaaaagacactgaaagcattttggtgtgtgaagtaagggtgggcagaggaggtagaaaatcaattcaattgtcgcatcattcatggttctttaatattgatgctcagtgcattggccttagaatatcccagcctctcttctggtttgctgagtgctgtgtaagtaagcatggtggaattgtttggggacatatatagtgatccttggtcactggtgtttcaaacattctggaaagtcacatcgatcaagaatattttttatttttaagaaagcataaccagcaataaaaatactatttttgagtctaaatgatagaagcccaaatatattttgttcatggtaaaaaa

SEQ ID NO: 644437 - DNA, 722 bp, Homo sapiens
  misc_feature (51)..(51): n is a, c, g, or t
  misc_feature (72)..(72): n is a, c, g, or t
taaagttctaagttctcattctggttgtaaaggcccatcacaaagaagttngtccagttgctacaccctccncgacataaatgcaaagccttggcaagtcagctcgtacgactgtctcagtcacaagcatcatacttatttcagctctgagaattagcttactctgcttcccacttccgtcttatgcataacatggttttttattggtctaagttctacctttattcccatgcccaagtatggcacctcactgattctggttttgactctgaactctcatttggaatttggaatatccctgttcattctcatgtatcaatatgtaatgtttccaactgtctgtcctgccttttaaggtggatctttaagaaaggacctgtggctttttctctaccatccagccctgcccctgttgtgctgtgtttagaagggttgctagtctgatgactaatcattttaacagatctgcctaatttttgtgctcttctcaggtttattctttttaatgagcaagatactgtgcttgactctccttggaaatataatatttgcttgctgttgaaagccctgtttctttgccttccagcttttgaatttgtcgacttggacagtttgctaaggggtcaattccttaccatttgggcataaaggaaaatgcatctccatgcttcatttgcttcatctcagcttggttttataataaacagaaatagggaaacttt

SEQ ID NO: 644438 - DNA, 399 bp, Homo sapiens
atgatgatgatgatagatgaatgatcaacgagtatatgaatgatagaaggaatgaatagataaatcacccgtgtaaatgaatggaatgagtggatgaatagaatggaatgagtggattgaatcaatctgagtggaatggaacggaatggaaaggaatggaattgaagggaatggaatggaatgggatggaatggaatggaatggaatggaacggaatggaatggaatggaataaacccgagtagaatgcaatggaagggaatgattcgaatgtaatggaatgcattgaatggaatcaacacgagtagaatggatgaatgcatgattggagtgaatggaatcaaccccagtggaatgtaatgtacaggaatggaatggaatggagtagaatgaacacgag

SEQ ID NO: 644439 - DNA, 1365 bp, Homo sapiens
  misc_feature (404)..(404): n is a, c, g, or t
gcggatgctatgacggctgtaagttgggtgaatctacaccgtgggatccgagttaacccttgttctttgtctgtgtcctcagttgtgaccattcatccgcgaaattacgagaaatgagcgttgtggcagaggtgaaagagtgtagtcaaaagtgcatcgtccgtgcaaatggttcgacatcataatagagcagttcttcctcgatgtcgaccatcagaagcacgtacctagtgcgtaccaccaagatggagaccagatgttccatcagatgacctagaaatcgtatgacgtacctgaatcactggtacgttgtatcgggcggctcgacttggcctgctggctgtctacaagaagacatacacaagtcaccttgtgaaggataccgttcaaccgtggagcatcgntccatttggagacatggggcgagagcatagatgcagtcagagaaggatcgtaaccaagggtcagagcaggtattcaacaccacttcagttgcatgtgtagtaaaacgtctggtatatttgggatggcaggtagtttgaacggaagtaagggaatttcgtggttcgaattgagaaggttatacaagaaaatgattcgtggtgcgatgggttggtgagtacgctaggagcaattccaaagaatattcatccgtggagattgggagaagaggacatatggggttgtaatcatgcaaaagaagttggaacttaaagaggggagtggtggcctgggaactttcccgttggtttgaattcgtaagggtaggttctaaaataggtacgtcttaacttagggtggttgccaaggtgaaatgggtgggattatcacacgttggggataggtgggattgttcgtgtgggaacatagagcactaactttttgggtcccgttatgacgggacactttcctacgttggagtagtgccaaggtttgtgggaggcttcaaaggcataggacttttttccaaaaacctaagagtgaaaaagttgacttaggaataacggagagtaatggacaccacttgaattaaaggattgtaaacgttgttggggcatttgtcaccgatgagaggcgcaatatacggttcccgggacagcaccaacctgcggggttatatgaacggcgacatttttgacagctggatctctcaaaaggagagcttgtttgacgagatttttcaacactgggtgcctgtcccacaacacttattaagtaggcacacacatgttgtggctcggtgacgcgacatactttttccaccagttgcgtcggcaacaacaacaccaccagctgtccatactccgcgagacactaacacaaaatcaacacagacgcggggaccgaaaaaatcacttcgagtag

SEQ ID NO: 644440 - DNA, 146 bp, Homo sapiens
aggcagtatggactaacacccatgttggccaggttggtgtctgcactcttgacctcaggagatcgaactgccttgtctcccaaagtactgtgcattacatggcataagccatcacagccagccttctcgagccaatctcaaactct

SEQ ID NO: 644441 - DNA, 334 bp, Homo sapiens
atttttttttttataaaaaaaaccgcgggggggggtcctccccctttatcccccccttttggggggtgggggggggggttccccctgggtggggggtgggccccctttcccccccagggggaacccccctttttttttaaaaaaaaattttccccgggggggggggggggcccttttttcccccgtttccccccccccgggggggggggggggggaatttttttttaccccggggggggggggtcccttaaattaaatttttccctttccccccccccgggggcccccgggggggatttttttttcctttttaaaaaattttttttttgcccca

SEQ ID NO: 644442 - DNA, 267 bp, Homo sapiens
gtcgtgcttggtggtctcgctggcggccgcaccgagtgcgccctgaccgatgacgtacagccggaccttgccgtccgccgtctggccggctttgccgccttcgatgccgacggccttgcgcagtttcttggcgatgtcgacggcgccgctgttgttgaagtcgaggcgcagcgtcacgacgtagggtttgccggcctgcggctcggcttgcgtgggatcgggcacgaccttgacgttggagacgccggccgcgatgcgtctcagctc

SEQ ID NO: 644443 - DNA, 288 bp, Homo sapiens
agttgtaaatgatgggaagtgttagaggaagcagggttattagtttttctttgcagtgtatagtgagaattggcggtaaaattccgggtcctgggcttttcttagacgagaggttttcatggactgagtcagtctcctggctagtaatagatctgttaatattttctgtttcttcacaattcagtcttgttaggtcgtgtgtttctaaaatttgtccaattcatctatgatattcattctgttgttcatagtactctcataatcgccggtcacgagatgggtaccgag

SEQ ID NO: 644444 - DNA, 252 bp, Homo sapiens
ggagggagagactctgttacggctctgaggcagggaagctcttgcatgttagggaaactgagaggatttaaggatggggttgtcagggtgtatctagtgagggcagagcaagccagaagagtaagcagagagcagtttgagcaggacttgtagaccttcttgggatgtctgacttcatcctcagaccatgtcgccagttgagagctataagcagggtgagagggacaagccagttgccgcatggtatgtaca

SEQ ID NO: 644445 - DNA, 284 bp, Homo sapiens
gctcgaccactttgggaggccagggcaggcagattgtttgagttcaggactttgagacaagtctgggcaacgtggcaaaaccctggctctacaaaaaaattttaaaaattagctgggtgtggtgatgtacacctgtggtctcagctactcaggaggctgaggtgggaggactgcttgcccctgagaggtcagggctgcagtgagctgtaatcatatcactgctctccagccagggcaacagagcaagccccgtttcaaaaaaagggaaagaaagaaagtcgacg

SEQ ID NO: 644446 - DNA, 528 bp, Homo sapiens
agcgatcagaggatcgccctcggatgcaaggtcggaagaggtgacaagtaattgggggtaataatataccttccgatcatgggcgcaagaacgcactataggagatgtgtgatcctaccacattcctttactcgtacgtgcaattgaagattcaaggatcacgttccaggggaaactgatatgaaggttgcaatgaatgtgtatgagtaatcatcaggtgccggataccttgtgagattgagtcgctgcatgggcgcgtaggctctttcttcacaaaaatcggacaacatcagtccagaagaagagtatacagatggcctgccttctcatggtgtcggtggcacgtgtcttcgccaacacgggccggcgttgtcgaagtctcagtacagccctgctatagaagggcatggcaacaacatacatggcttggccaaagccatcaaccagatggctgcagctttgtttacaattcacaaaggaagcatagaagaccgtcttaaagaatttctgacacttggcctccagagg

SEQ ID NO: 644447 - DNA, 216 bp, Homo sapiens
acttacaatgctctaagatagcaatttccaaagacagagatggtgaacgcatgctcaggcagtggaatcatcaacctctataaagcacaatgtactgaatgtcctgaagctattggggaacataaaaagatgaaaagggcaatgcagtatagtgggaaacatctgggctgggagatgcctgtgtttcttcctagctccgcaggcatacagcacatg

SEQ ID NO: 644448 - DNA, 434 bp, Homo sapiens
tcgtttgttctgtggtggtttttttaaaaaccgcaccaatcagaacgggggccctttttgttcagccccccccgggccgcccaatccggaagaagatgatggaaatccttacccccgagggcgcggccaatacctttaaaaaagtgggccattaatttattcccgcccgccttgggaaagacatagaaaaggcctgcccctctttttttcccccccccgatgtttttggttgaaaaggaaaaaagcttaaaaagccccagtttttattggggaagcccctggggcttcctggggaaggccggagtttttggaaaacccccgggggccagaccggggctaaaatttaaccagcttatgggttttaaccccccggcccagaatttgttttaaggtccggcctccaaaaggggccaaaaaaaagggccttttgttga

SEQ ID NO: 644449 - DNA, 742 bp, Homo sapiens
taagtggttgagaaagtcagtgatctttttactacatcatgtctccccttcagatttcccttgctgtcattctgcttttgagagagatactctcaaaacagagatataaagtgtcaacactgacactgtgaccacaagtcagccctctgaggcaaggggaaccagaaaggcttggaaagggagattggagagggtgaggggctgaacactgacagttactgcagctgtctgtagtgctccctcttccagttctgtctcatttggagtcattgtttaaatttcagtccacactgagcttcttacaggaattaggcacagttcaggcccaggattgtaaacaactctcttccatgtgtctcttccttcctggagaggtgtggtgtggaacgatgatttatacccaaccttatccattcccagttaggcttaggatttactctttcatttttcaggcaaatgttgaacatctggtgcacacgatgaaaacaactgtgaacaggggctggtgttcaggtacctcatccatggttggtcctaatgaagaagaaaatagcttgggtcaacccatgaatggcatggtgggaaaccctgaggaatctgtagatttacgggagggagcagcctaatcctggaatcctggcggagtacacattgccggcatgacaaggcgacacggggatgggaccaccaaagtcacggctggccccctgcggcatgacatgccaggaaataacaggtcttc

SEQ ID NO: 644450 - DNA, 469 bp, Homo sapiens
aaatatttctttcttcaataatcaactttactgtataaagcttttaatttttaaaaacgttttgactgttttgtaataacactagcttaaaacaccaacacattatacagctgtataaaatattttctttctttgtatccttattctattagctttattttctatttgtaaaatattttatttcatttattttttactttttaaacttctttgttaaaaacaaagatacacatacattagcctaggcctgcatagggttgggatcatcaatctcgctgtctcccacctccgcatcttgtcccactggaaggtcttcaggggcaatggcacacagggagctgtcatttcctaggataacaatgccttcctctggaatccctcctgaaggacctgcctgaggctcttttacagttaactttgttttcaaaaaatatatatcagtagaaggagtacatgctaaaataacagt

SEQ ID NO: 644451 - DNA, 174 bp, Homo sapiens
cgacaggaagatggctggtgttgtttgagctcaggagtggggctggtctatcagcatcctgcttatccttgcactgcagctcctcgctgtgtttgagacagctgcatgcctcagcagagacagatgcctggggatccacttcttgccatggacgtgggctgcgggctagtcggg

SEQ ID NO: 644452 - DNA, 231 bp, Homo sapiens
ctatccgtcttaaaagcaacgggttaaaaaatccaagttgtgtttttggtggtgcaataattataaatgtgccagtcaatgccaaccagtgtctgataggcttcctgtgcatgtccaatttcctctgtgacacggtgtggtgccagagcttctgaatcttcttgaatcgctcttggcataaatgtaaaggatttccccgtctgagtccctggtcggtctccccatagtcat

SEQ ID NO: 644453 - DNA, 249 bp, Homo sapiens
tgcgacttttactacagagacaacctatataaccttgcgtctgggaaaacccggtgtcatcttctttacagcaggaaaaccgattgttgatttttcttgggagaaaaacacgcgatgaatgtttttatgcattagtatacctctctacctgttctcgcaccgagactagaggtttatacaatcgactctagagcccagaagacagacacagaggctagctaccggccatggtttccacagagaccagga

SEQ ID NO: 644454 - DNA, 175 bp, Homo sapiens
gcctcattgtacccattctaatcgcaatggcattcctaatgcttaccgaacgaaaaatttctaggctatatacaactacgcaaaggcccccaaacgttgtaggcccctacgggcctactacaaccctttggtgacgccataaaaactctttcacacaagagcgcctaaaacccgc

SEQ ID NO: 644455 - DNA, 146 bp, Homo sapiens
cacgaggggaattatccaccatttttagacattatcaggtggggtggtcatcttgtgacgaaagatgcatcatccagcatataccatatgtagtttatttacaatggaacctctttctgtgacgtcaaatactctcgtgacagcgt

SEQ ID NO: 644456 - DNA, 269 bp, Homo sapiens
aagagacacgcacgaatggtggcatgcccagcctcacactatgcactgtgactcctcctcaccgagacatatactcggcaccctctgagcttggatacaactccaggcatgtgaccttggaatggtctcaggcccgtgagataataccagaaccaccctcacacaggtaactgtggcccaacaggtaatacccaaagacagcgacatgtataataactcaacatgagtcagctataactgtgagcagacaatggtgatacagcgaccca

SEQ ID NO: 644457 - DNA, 325 bp, Homo sapiens
cgccttcatcatagttaatattctaatcatttatggaattaatttggaggtactatattatgaccaaatatggaaatgcttgattcttactgccagaagaaatagaatagagaataaagtttgagaagatctgaaaaatcatttatgtcttgggttcattttttttaagtaggtgtacataacatctgacagttaaaaggtaagattagacctaggcattttagtttttatgtgcattgtaataactaatagaaaactgatagaaatatagatgtgtaatatttggtaactctctctttaccagtttgtcactcaagccctatca

SEQ ID NO: 644458 - DNA, 648 bp, Homo sapiens
  misc_feature (10)..(10): n is a, c, g, or t
  misc_feature (66)..(66): n is a, c, g, or t
  misc_feature (73)..(73): n is a, c, g, or t
  misc_feature (102)..(102): n is a, c, g, or t
  misc_feature (107)..(107): n is a, c, g, or t
  misc_feature (165)..(165): n is a, c, g, or t
  misc_feature (170)..(170): n is a, c, g, or t
  misc_feature (181)..(181): n is a, c, g, or t
  misc_feature (232)..(232): n is a, c, g, or t
  misc_feature (262)..(262): n is a, c, g, or t
  misc_feature (267)..(267): n is a, c, g, or t
  misc_feature (344)..(344): n is a, c, g, or t
  misc_feature (405)..(405): n is a, c, g, or t
  misc_feature (426)..(426): n is a, c, g, or t
  misc_feature (460)..(460): n is a, c, g, or t
  misc_feature (504)..(504): n is a, c, g, or t
  misc_feature (508)..(509): n is a, c, g, or t
  misc_feature (530)..(530): n is a, c, g, or t
  misc_feature (547)..(547): n is a, c, g, or t
  misc_feature (555)..(555): n is a, c, g, or t
  misc_feature (564)..(564): n is a, c, g, or t
  misc_feature (579)..(579): n is a, c, g, or t
  misc_feature (639)..(639): n is a, c, g, or t
aaatattagntggtttgagtttcttaaatctggcaccagatcatgaatttgaaagtgttaatgttnaagtgtngatgtaaaaatgtctattaacaaaactgnttaanactgtttgagaatcaggacaaaataattgttttttttttacagatacttttctgaatnaattntctacagactntctcccattaagaattagttgggtggattgatgaggcaaaaaataaattcnttttaaaaaacaaaactggagtttatttanaaaanatgcaaagggagaattttaagcaggtgttactgcagaactgctcagaagtgaataaagctgagtgaaagaatatacntttacttctacaaatataggtccttcctccagactttctggaagaaatacattttcagggngtggactataaaatggcatanaatgtagagatagaaaaaaagaagtttgcaaatnttttatatttccagctgttgagatagtatttttgagggttgttnttanntctagcggcgaaaacagagcnagctattaagcagccanaaagctanatttattgnatacatgatcatttnctcttttagcacgctctttgttcttctctttcagaagttgtagatgtatatttagtttgnttatatgta

SEQ ID NO: 644459 - DNA, 372 bp, Homo sapiens
gcgggagctgggtgtaggaagaaatagttacaagtagttgtgagaaaaacagttccggtacaatactgacatctaagggactatgtctacctccaagtgcacataataagttgattattacctaccaaaagccgcgttccatttttcctgaagctttctgttacagcaataaatagttatgtagtattacacaaagtagatcttaacaactgtaggaagtggcaagtggtggttggggggaatcctacgctctcattagctttctgtcaccaattaaagaaggagcagccatgtgtagctgggtaacacaaggtcaactgcagtcacctccatcactgtggaatgtgctacgtagttaataactagtaaaag

SEQ ID NO: 644460 - DNA, 256 bp, Homo sapiens
tcctctagagggatatgaagcaccgccaggccctttgagttttaagctgtggctcgtagtgtactggcgagcagttttgatgatttaacagatgagaacaagcactgagcatagcgcaaacatctaatcaccagacttggactcttagctatcgtgagctcagatatgttaaatcaacaaaactgctcgccagaccattacgagccacagttaaaaactcaaaggacctggcggggctcaatatccccctagagga

SEQ ID NO: 644461 - DNA, 615 bp, Homo sapiens
  misc_feature (45)..(45): n is a, c, g, or t
  misc_feature (97)..(97): n is a, c, g, or t
  misc_feature (106)..(107): n is a, c, g, or t
  misc_feature (110)..(110): n is a, c, g, or t
  misc_feature (112)..(114): n is a, c, g, or t
  misc_feature (147)..(147): n is a, c, g, or t
  misc_feature (149)..(149): n is a, c, g, or t
  misc_feature (231)..(231): n is a, c, g, or t
  misc_feature (240)..(240): n is a, c, g, or t
  misc_feature (247)..(247): n is a, c, g, or t
  misc_feature (253)..(254): n is a, c, g, or t
  misc_feature (256)..(256): n is a, c, g, or t
  misc_feature (260)..(260): n is a, c, g, or t
  misc_feature (264)..(265): n is a, c, g, or t
  misc_feature (267)..(267): n is a, c, g, or t
  misc_feature (312)..(312): n is a, c, g, or t
  misc_feature (314)..(314): n is a, c, g, or t
  misc_feature (353)..(353): n is a, c, g, or t
  misc_feature (407)..(407): n is a, c, g, or t
  misc_feature (552)..(552): n is a, c, g, or t
  misc_feature (602)..(602): n is a, c, g, or t
atcagattaaatgttttaactaattgctccactagtcaaaatatncatttccttttatgagagaggcctttaaaaactgcccccttttctgaatggnagggatatnngantnnncttctgggcaaataatctcagtatgacaagatntntctgtattattcaatttcccgagcgtccaaattttagtatcattctaatatctttccatcatgaaaccaagaaccagaatanggtggtgtntttcggnaggggnngncgcntctnntntggggggtgcgaaagctataacccttctttacctaactatccacnantgcgagacagacatgtgtgggttatccctgagttttgtntctcactcctgagcaaaatgaactacaatatggctgtattaggcctcctttgtnttcaaaaagattcacaaaattttgtgaatattattttaaattatagtaattgcttctgggaccaaaaggacattaactttttaatgtgacaaaaatgcaccattacaatctgctacagttcatcgataagcatgatatacttgcntctgatttgttacatgtttattaactacaaaatttaaagagaagattacntggacagacattc

SEQ ID NO: 644462 - DNA, 185 bp, Homo sapiens
aggcatgcagcttgggttgctgcagagctctccactaaaaagtaacaggagaatagacacgtgccaaaaaaaaaaaaaaggtataattggggtttcaaaattaaaaggggcaggggggtctccccgggtccgaatcccccggttttaaaagaaaaggggtctaataatccaaaatttcccccttt

SEQ ID NO: 644463 - DNA, 174 bp, Homo sapiens
ttgcctattcgtacttatctctccattcaaaatggactagctgtgaggaaatctttactagtatagagcatgccattgtcttcaatccttgatcttagatccacgggaaatatcatcgatgactccatccctgtacatctatagtctgatggagtagagatccaatcttccggg

SEQ ID NO: 644464 - DNA, 808 bp, Homo sapiens
gtatgtttattttttaagtctcagtttaaattacctagctgtctactgcttctgtgttgtctttttcctattaaaacgtcttcctttatttttcgttaagagaaagtggaacatttaggttaaatgtcttgaaattttaccacttaacaacattacgatgctcttaaaatatatccagtcagaactgtattttgaaagatccccttgcaaatgatgatatcagggttaaagattgacgtgtgtatggtttctgaagtttgcgtcctgaaaactatgtttgagcactgaaaggttacaaatgcctaataggcatttgagactgagcaaggctattgtgttatcgtcatgaaatgcggtgtggccgagttatttgaatagaaaatattttaaagtatcaaaagcagatcttagtttaagggagtttggaaaaggaattatatttctctttttcctgattctgtaactcaagcaagtcttgatggagttaaaataatctgcttttattctggtgagccgtgctagctaatataagtatggaccaggtaatagttgtcatctttactattagttaaatgacttagatattatgaggattacacactaattttatacgggttgtactttaattgggggacctaaattgataggggggtggaaatggaaaaaatgaagacagcggcagtttttgtgtgatttaaaatttttttgggtcatatgggcgaaaacctgggggtttaacgggaccaattggccaatattttaggtgaaagaatgttggggccaaaacatgaaatttggagcgaatggg

SEQ ID NO: 644465 - DNA, 87 bp, Homo sapiens
cggcacgaggggaaatggaaaacattgcagtttggtcttaatttccacatgaatatcaagtgtaatttttaataaattatttggaga

SEQ ID NO: 644466 - DNA, 1602 bp, Homo sapiens
  misc_feature (1152)..(1152): n is a, c, g, or t
  misc_feature (1163)..(1163): n is a, c, g, or t
cgtgcttttgtgtgagtgttgtccgcaccaggcggtgttgcttctccggcgggtgtagattctcccccgccagcgtgttggtttagtgataagagacgtgtggtgttattttcttccccctctacagagtgttggccgccccagcggttgtggcccccctttcttaccgagggcttcctcttctggggagttgtgggaaccccctcctgtgcgcccctcttctctttgagggggttctgtttatcacaaacagcgggggcggcggcccacacatcgctcctaccagggtggcccgagtacttttgtgtttggggcccactaatatcccaccaccaacggagaattttttgtgctccttcgacagcagtttgttttgcgcccagcttttttgctgttgcgtcctgctttgtttgcgagtcactagagtctcccctgcggccacaccgagagtttgttgttcttccctcgtgcggaaatttctcttcgccgaacgagaggtgttgatagccccccccttctcaacacgccttttatttgggggagaaaataatacgcccccctctggggggtgttggttggtgggccacgagaaatgtaaaacacgaccggcggggtgccgccaccggggattttgtgagtgaggaggcccccacccctcttcaacggagagttgtgggcgcttgtgttccttataagttgggctgttcccccccttttttctttcggcccccccacaatgacacggtcacgtcgacataccccgctctagtgtcactagcgtgtctctcccctctgctgtgggccttcggggggacacccaacgacttcgggtgctcaaaagagtgaatttgggagacaccctcggggcctcagaactcggccacaaaggctctgatatagagtctctcacaccacacactctgggcgccacacacacacaggcgttattttctcgagacacacccgcgtgtgagactcgttgtctctctctccacacggattggagtttcccctctctctgtgtgtctcttctctgagagaggcccacacagcgagtttggtctcacaggccacatcgtatatataggggagttttctctccaccgcagagaggggcacaaaacacacctcttaaacacacgcgctatagantcgtgtgtggnggagacactgatcacttcacacacgcgccccctcgtgggctgttcacaggccgctatacaccgcgctatatctcgggctctgtgtgggctggcccacacacagggcgcccacagcacttcacaagaattctgggagattttatagagaggggagaaagaatccacattgtatagagatgagaacttgagaagcacacagagaagttatatcacagtatccaccgcacgcacaaggcacagagaaccacccccacgtgcacacctcccctcggcctcggtttcgctgagtggccacgaactctcgtttgctcggctaacaccggagcacacacctcggtggcgaagtgtggcacaggtgagccacattggcacacacacgcctagaaagtttatcggcacgagctttaccaaataaaaaaaaaactggcttttttgacca

SEQ ID NO: 644467 - DNA, 214 bp, Homo sapiens
ccctacgtttgttattgcactatcttatcttgcttctaaatctcatggcttctcaccatttacaaatgcctccctaacccactcattcagtgagacactgaattcttgctaaaaaggggatacttcagttagaatgtatatggtgagtttgagagtttggaactcaggtttagatgtaaacattgccctcctgactgctctctagtccagtgat

SEQ ID NO: 644468 - DNA, 406 bp, Homo sapiens
atggactgaaataggctctgttacatggtgcattactagattagtgcctatatatatcatatttatatcatatttgaaaaccaaaacaaacataaagttgcaagtttacagagtgtgtgacttgactagtattcatgattaggcacaaaagcatgtgctccataaccttgtattggtttaaaccttaaaagcaaaaacaacttgatagtctattaaaaaagaaaaatcccaagtagatcttagaagttaacatctgacaaggttttgacctttagtattgtcagatatttgattgaacgtcagtcctttagaaagatacattcattagaatattttagtaatgtctgtgtgtatgtgtctctctctctctctctctctctatctctctctctctctctactctcta

SEQ ID NO: 644469 - DNA, 475 bp, Homo sapiens
tgggggctcaaagtgtttttattctgccccagcaaaaaagtgcaatgctgaaaaggggaaacttctgtgctgattatgctgaaaaaggcaaaaccccttgttggtggaaaggcggcgtgggccactcaccttggcaagaaaacaaaagtgtgctggtgaagcaggaaagtacatagcactccgtgtacttccataccgcctcaagtgcatctctgcaagcttatcccaagtgtgctgcctcatctgatctcaccacaggaatcacagcacacattctcagatacaggaaaaggaggtcaggggctggggttcaaagtctccccacagcagttaggtgggggtcaaagatgtgcaagtgagcattgtctcttcttccgtgcccccagattgatgggcccttaccaaggccaaggaaagcttaaggtgggtcatcaatcccgtggctttccttaacacatcagcaggcgtgcaacag

SEQ ID NO: 644470 - DNA, 222 bp, Homo sapiens
cactcgtggtcacagattgacgcatgtatacgcattgtggagcgggattgctcagctgaagccgcggctctaaagccggctgcagagccagatgagcgggcagccgccttgtggaacagagccacgtggtgctcagcaccaagcaccagcacgaattcccttagcaccagcacgaattcccttagcaccagcacgaattccagcaccagcacgaattccctt

SEQ ID NO: 644471 - DNA, 810 bp, Homo sapiens
  misc_feature (516)..(516): n is a, c, g, or t
attttattttttatttatttatttttgagatggagtcttgctttgtcgcccaggctgagtgcagtgggtgatctcagctcactgcaacctccacctcccgggttcacgccattctcctgcctcagcctcctgagtagctgggactacaggcacctgccacacgcctggtaacttttttttatatttgagtagaaatggggtttcaccatgttagccaggatggtctcaatctcctgaccttgtgatccgcctgcttggctcccaaagtgctgggattacaggcgtgagcccattgcgcctggcagaccattttagaatgtgggaaattttagtggagaaaaaatgcagtgtaaatatgcttagtttaattcagtgtgggatgcaaaaaactacctagcgaaaatttgggaggaaaaaactttaatttttatttaacctttttccctttccaagggaaaaggaaaaaattttttaatttctgtttggggggacaccacccaaataattttttctccnttttgaaaccatcgtctgtgtgcgggtggggggcgttctttcccccccacaacaggttttttttttttctctccccccccgcccccgaacaaaaacaatttttttttggtcgggagggcgcggcggggcggcggccccccccctttttttttaatcacaaacaccacgctttttttttctcatcacaggcatcaccagcgatattaatcatatctatcctagaggttatcatatgcttatgcattcactacatcgctctctcatcctcgtatatcttccccccaccacacacca

SEQ ID NO: 644472 - DNA, 1797 bp, Homo sapiens
tctggtttgctacttttgttgttgttttggttcttcatcacatatatataattacaacaaaacacgagagattgacctagaatgctttatcttcggcgtgttatgtctgcttatcgattgctgtgttctagacgattgcgtctggtgagttacccttgctcgcgtcggtgacctccctcaattcatccttgtgtgtctgttagtttctttcgagttgtctacgttgttggtctcttcgtattggtatgttcgctgttgtcgcgacttatcatggattcgctgctgtctttctcttatttacgttcatgtgtttcgcctgtgtctgcggcgcgttgtatcgttcttcctctgtgtatgtgtatctctatttgtcggctgtctgtccgtggtgctctgccgtcggcccgttctgcttcggttcctcgtgtgtccctctgtttgctctttatgtctttccgttgtgtggttccctcgtttggtctctctcgtcttacttttcctctgttgcggttgctctgtgtctcttctgttgcctcgtgtcgcttcttgtctgtgtgtgctccgcggtgctgtgtgctgttctttgttgtcttagtgcgtgccccatctgcttttgttcgccctctcctctctcgtgcggtcgtgtctgtttctgtgtgttactgttcccatctgtgctgtttccgctctgcatttgctggttctcttctggtctttgttgcgttttgcttcctgctgctttgctccccctctcgtgtcttgtctctttgtgtgtcttcatcttggctctcgtatcttcccttcaatgagtggatatggtcctcggaccctttttgtgatgcttcgttgctcctcccgtgtctttgtcatgcttctgtcgtcttactgtggtgctttgcgttcattgtattggcgggtgtctaagttgtctccctgtttctgagttcttcgggtcccctgtgcgttctccattcatgggttgtgttctgttgccgaccgcatgtggattcggtgttccctcctgtgtttgtgtctgccccttttgttccctcttcttatgtgtctcttctccctgcttcgtgtgatctttctgggcgtccttccctttgtttgtccccgtttagttgccttgcggctccatgtctcttctgtttggtgcatcttcgcgcgtggccttcgcatcttccgcctgctgtcccctgatcgtcttgtgttgggtttttggtctgatgacgattgggcattgggcatggcagggttgcttgctatcgcctgcccggtgcgtggtcccccctttttggcccccgagatctccctcgggcatccgcgcggcttcaggtggacccatcttgcaatggcaccctgcatgttgtggtccattactggcctctgctctggctctgaggtctcgctgatgctgcgtgcttgtggttctatccccatctgcccatggatcggtggccatggccaggtgggctgggcagcatcagtcaaggagtgctggtctgggtgctctatcagtgtgcccctccatcctggccctatcatgtgtacccccgtcccaggctggccagcacccacagcccacgtctctgtcagtagcctgcctgcactcgcccagccgcatgccaccctcgtgccagtcgcgctgcctgatgtggtgtcgcgccttctcccccccggggctgggttggcgcaccctcccctcccgtctactcattccccggggtgtttcattgccgagttttgaatgtgatttaaagaaaccaagggactatgcttattttttgctttcct

SEQ ID NO: 644473 - DNA, 206 bp, Homo sapiens
  misc_feature (162)..(162): n is a, c, g, or t
agaggccgagtgtggaggtagtggtgatgtgcttggagctcagtgctccttaggaggtctaggacccacctcgaatcttctgggctatgcgagccaggaagagaggcaggtgccttggtgggtggcattagatgctccagccctgcctggaactaccttggnggtcgggccacagccaagaagagtgctgttttgcctgtgctaag

SEQ ID NO: 644474 - DNA, 366 bp, Homo sapiens
tactaccaagggaaacttcttagctgaatttagtgttatttaattttatacttttaagctgagtttgaaaatacacctgagataatagggacaggcaggatggttaaggacatttttcaatacagtagctcagtcagcagctctgtctgaccttgggcatatttaccttttttgttcctgcagatgtttatctcacgtaggtcataattaactgtccatagtcagtaattacacttattttttcccataagatataagaattaagtttagcctaataataaagtaagaatgaagatcaacctaccagttgctctagtcttcctgagtgactcgtttcattctaagaaacctgatactgtgtcgacg

SEQ ID NO: 644475 - DNA, 625 bp, Homo sapiens
gcatttaagatgaggcttctgctgcttctcctagtggcggcgtctgcggatggtccggagcgaggcctcggccaaatctgggcggtgtgccaggcaagagattaaacgatgcagtacgccacggggccgctgctcaagtcccagatttgtgtccctgaggtaatagcgcgggtgtttcgacggagtacatggcggggttattaagccaggcggtacccagacatccgcattgaaggagagaattacctccctcaacaatatataggaccacatagcatctttccgtgtcagtcttcaaaagctagtatcacctaggcttaactactgtgtgggcaaggatccttttgctttcttgtgcattgcaagctcctagcatcttggcagttggggcccaagaaaaatcaagcgttaatgcatggtatagactgggttcctttctgtgaggcaacattgacttggagaacccagctgtactgtccaaccaggtttccattttgagactacacttttacattgactgtaccctgtgtggtcctacaagctggaatctggtccacctttccatccatgccaaaaattgggttcaattcctggaccatgagtgacctccatgggcctttggtcc

SEQ ID NO: 644476 - DNA, 323 bp, Homo sapiens
  misc_feature (196)..(196): n is a, c, g, or t
  misc_feature (199)..(199): n is a, c, g, or t
  misc_feature (230)..(230): n is a, c, g, or t
agtgttgggatacaaggtgtgagccactgtgcaggacaaatttttgtgttattgaaaaaaaatgtttaagagctacagtcgtgacacacaaatttaatgtgcaatcaatattttgtccatcactatgaagtctagacaatcagcaaaaattaagcattgatttatatacagcatttgtcaatttccacgatgtaantancagttgggccaggcatggtggctcacacctngtaatcctagcactttgggaggccgaggcaggcagatcacaaggtcaggggttcgagaccagcctgaccaatatggtgaaacctcgcttctac

SEQ ID NO: 644477 - DNA, 1447 bp, Homo sapiens
  misc_feature (775)..(775): n is a, c, g, or t
  misc_feature (786)..(786): n is a, c, g, or t
ggatggcggcagagggggaccagctcagcctgcctccccaagggacctcagacggccctgaggacacgccccgggagagcacggagcaaggccaggacacagaggtgaaagccagcgatcctcacagcatgccagagctgcccaggacagccaaacaaccccgcagtcccgccccccaggtaagaaagatggatctctcgacaacatggcctcgatccttcccagcgtcccttagagaacgcatgagcgtctgcacgacaggctgatggcctttgtgagacacgcgcacgccgggtccaccgcaagagagggccaaagctcctgcattctcaggctgggacatcagcacaccatccatgctcccaggcccactgcctcgattcctcgagagctcatccaggagttccaagggctcacctggcctcacctctcaagacagcttgggggtgtcatgtcaattggccaccgaccaggactcctactccacccagcagcacggcaggaggagctggagcagttcagcagccccagcgtgaagaatgaagccctcctatgatcctgggcaaggcgtcggcaccggctgagctttgccagtttcaggcagcagtgttccacgctttcctctccaacaatcgcaagctgtacaagaaggtggtggagctggcgcaggacaagggctcgtactttggccagcctggtgcaggactacaaggtgtacagcctggagatgatggcgcgccagacctccagcacggagatgctgcaggagattcgnaccatgatganccagctcaagagctacctgctgcagagcaccgagctcaaggccctggtggaccccgccctgcactctgaggaggcagctcgaagcaattgtagagtctgccttgtacaaatgtgtcctgaagccccttgaaggaagccaatcaaactcaattgccctgtgcaattcaaggaattccaacgcaggcaagggattgggttccggtttgcaaggaagcttcagggaagaaaccaagtaagggatccttgggccacaacaaccattgacctaggtgtgaccaccagcgtgccggaggtgcccatgatggagaagatcctgcaagaagttcaccagcatgcacaaggcctactcacctgagaagaagatctccatcctgctcaagacctgcaaactcatctacgactccatggccctcggaacccaggaagccctatggggcggatgacttcctgcctgtgctcatgtatgtgcttggcccgcagcaaactcacggagatgcttctcaatgtggagtacatgatggagctcatggaccccgccctgcagctgggggagggttcctactatctgaccaccactacggggccctggagcacatcaagagctacgacaagatcacggtgaaccggcagtgagtgtggaggtgcaggatccatcacgtgg

SEQ ID NO: 644478 - DNA, 639 bp, Homo sapiens
ccatgctgttctttcacgatggaactcgggaagaagcagatcaagtataggaaccagttggctcggctggtctcatcgggaacaggtggctctgtatgtgtacctggcacgacgtatcctaggattacccctacgttggtggactcaatttgtgaaaatgccaggcgctacgcgaagctctttgctgatgccgtacaacagctgctgcctcagtacaaagagagggaagtggattcataaagatttcctgtacgtttatattgaccatcggctaatgatcgagcagcggagtcgtgactctgagatgcctcgaagcccccagaaccagtaccctgctgaactcatgcgcagatttgagccgtattttcaaggccctagcagcagcaagcctcgtgtgatccgggaagtgcgggctgactctgtggggaagttggtaactgtgcgtggaatcgtcactcgtgtctctgaagtcaaacccaagatggtggtggccacttacacttgtgaccagtgtggggcagagacctaccagccgatccagtctcccactttcatgcctctgatcatgtgcccaagccaggagtgccaaaccaaccgctcaggagggcggctgtatctgcagacacggggcccagattc

SEQ ID NO: 644479 - DNA, 268 bp, Homo sapiens
ctgtcatgctgccccagtgagatagtgagtggtcaccaggcttgcaaatgaacttcaggtgttcgagaccagccaggccaacatggtgaaaccccgtctctactaaaaatacaaaaaaaaatgagccgggcatggtagcaggtgtctgttatcccagttaggaggctgaggcaagagaatctcttgaacctgagaggcggaggttgcagtgagccaagatcgcgccattgcactccagcctgggggacaagagtgagacttagtctca

SEQ ID NO: 644480 - DNA, 138 bp, Homo sapiens
  misc_feature (100)..(101): n is a, c, g, or t
gggggtggccctggaggtcctggagcagaagctaggttcccgcagagctccgctgcacgccgctggcgatcgggctgggtcccattttccacgaaaaagnntgcttcggccgcggaggtgctggagcctttgcgctca

SEQ ID NO: 644481 - DNA, 151 bp, Homo sapiens
gcactgtctgtcatagccatatacggtcgcgtgtgcgctgtaggctctacgcctatacgtgctaccaaacggtgtccagctttgacatcaccctgtgatcgccgtcagcggtgtcatttggcacataagttggcggtgtacccatagccat

SEQ ID NO: 644482 - DNA, 911 bp, Homo sapiens
  misc_feature (7)..(7): n is a, c, g, or t
  misc_feature (118)..(118): n is a, c, g, or t
  misc_feature (135)..(136): n is a, c, g, or t
  misc_feature (139)..(139): n is a, c, g, or t
  misc_feature (141)..(141): n is a, c, g, or t
  misc_feature (147)..(147): n is a, c, g, or t
  misc_feature (151)..(151): n is a, c, g, or t
  misc_feature (153)..(155): n is a, c, g, or t
  misc_feature (168)..(169): n is a, c, g, or t
  misc_feature (174)..(174): n is a, c, g, or t
  misc_feature (176)..(176): n is a, c, g, or t
  misc_feature (182)..(182): n is a, c, g, or t
  misc_feature (200)..(200): n is a, c, g, or t
  misc_feature (202)..(202): n is a, c, g, or t
  misc_feature (209)..(209): n is a, c, g, or t
  misc_feature (217)..(217): n is a, c, g, or t
  misc_feature (219)..(219): n is a, c, g, or t
  misc_feature (223)..(223): n is a, c, g, or t
  misc_feature (229)..(230): n is a, c, g, or t
  misc_feature (232)..(232): n is a, c, g, or t
  misc_feature (234)..(235): n is a, c, g, or t
  misc_feature (242)..(242): n is a, c, g, or t
  misc_feature (251)..(251): n is a, c, g, or t
  misc_feature (255)..(255): n is a, c, g, or t
  misc_feature (259)..(260): n is a, c, g, or t
  misc_feature (266)..(266): n is a, c, g, or t
  misc_feature (270)..(270): n is a, c, g, or t
  misc_feature (277)..(277): n is a, c, g, or t
  misc_feature (279)..(279): n is a, c, g, or t
  misc_feature (289)..(289): n is a, c, g, or t
  misc_feature (291)..(296): n is a, c, g, or t
  misc_feature (306)..(306): n is a, c, g, or t
  misc_feature (310)..(310): n is a, c, g, or t
  misc_feature (316)..(316): n is a, c, g, or t
  misc_feature (330)..(330): n is a, c, g, or t
  misc_feature (344)..(344): n is a, c, g, or t
  misc_feature (363)..(363): n is a, c, g, or t
  misc_feature (375)..(375): n is a, c, g, or t
  misc_feature (386)..(387): n is a, c, g, or t
  misc_feature (391)..(392): n is a, c, g, or t
  misc_feature (396)..(396): n is a, c, g, or t
  misc_feature (407)..(407): n is a, c, g, or t
  misc_feature (409)..(409): n is a, c, g, or t
  misc_feature (414)..(414): n is a, c, g, or t
  misc_feature (423)..(423): n is a, c, g, or t
  misc_feature (430)..(430): n is a, c, g, or t
  misc_feature (435)..(436): n is a, c, g, or t
  misc_feature (444)..(445): n is a, c, g, or t
  misc_feature (450)..(452): n is a, c, g, or t
  misc_feature (456)..(456): n is a, c, g, or t
  misc_feature (458)..(458): n is a, c, g, or t
  misc_feature (464)..(464): n is a, c, g, or t
  misc_feature (473)..(473): n is a, c, g, or t
  misc_feature (475)..(476): n is a, c, g, or t
  misc_feature (516)..(516): n is a, c, g, or t
  misc_feature (779)..(779): n is a, c, g, or t
  misc_feature (789)..(789): n is a, c, g, or t
  misc_feature (837)..(838): n is a, c, g, or t
  misc_feature (843)..(844): n is a, c, g, or t
  misc_feature (875)..(875): n is a, c, g, or t
  misc_feature (886)..(886): n is a, c, g, or t
  misc_feature (897)..(897): n is a, c, g, or t
  misc_feature (907)..(907): n is a, c, g, or t
ggggtgnccctgctgctcctcagaatcctggtgccttgaagttctctgtgcatctgtccatcctccctatggccctggccagagctcagcatgggcaggggttctgggtaggacggtnactgtctttctcctggnntgntnttcccngccntnnnccctgccccaggnngcccncngcctcncctgctgctgcccctatngntctgagnagccatgncntgcngggccnngngnnactgtcnttcccctcntccncccnngccccngccngcgctcntnccctgtcctntnnnnnnaacccaaagngaanagaggnaaggcctcctgtcnacagcagcttcctnagtttccaactgccttagnaggcccctgctngtgctaagggnnggcnncttnatgggcatgtncntgctngagcggtanggtttgntcccnnctctgctnngtttnnncagntnagggtntagccctgntnngaacagaaaagtgtgtagaccttcttcctgctagggctgnactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaacctggccctgccccagnctgtgtagcntcgttcctgcatgtggatgctgcatgtctggtctggggcttggatgtnngcacnngcacccagctgccgtgtcaccttctggtagnaataaagaacntcttaatgccncaaaaaaaanaaca

SEQ ID NO: 644483 - DNA, 914 bp, Homo sapiens
  misc_feature (7)..(7): n is a, c, g, or t
  misc_feature (118)..(118): n is a, c, g, or t
  misc_feature (135)..(136): n is a, c, g, or t
  misc_feature (139)..(139): n is a, c, g, or t
  misc_feature (141)..(141): n is a, c, g, or t
  misc_feature (147)..(147): n is a, c, g, or t
  misc_feature (151)..(151): n is a, c, g, or t
  misc_feature (153)..(155): n is a, c, g, or t
  misc_feature (168)..(169): n is a, c, g, or t
  misc_feature (174)..(174): n is a, c, g, or t
  misc_feature (176)..(176): n is a, c, g, or t
  misc_feature (182)..(182): n is a, c, g, or t
  misc_feature (200)..(200): n is a, c, g, or t
  misc_feature (202)..(202): n is a, c, g, or t
  misc_feature (209)..(209): n is a, c, g, or t
  misc_feature (217)..(217): n is a, c, g, or t
  misc_feature (219)..(219): n is a, c, g, or t
  misc_feature (223)..(223): n is a, c, g, or t
  misc_feature (229)..(230): n is a, c, g, or t
  misc_feature (232)..(232): n is a, c, g, or t
  misc_feature (234)..(235): n is a, c, g, or t
  misc_feature (242)..(242): n is a, c, g, or t
  misc_feature (251)..(251): n is a, c, g, or t
  misc_feature (255)..(255): n is a, c, g, or t
  misc_feature (259)..(260): n is a, c, g, or t
  misc_feature (266)..(266): n is a, c, g, or t
  misc_feature (270)..(270): n is a, c, g, or t
  misc_feature (277)..(277): n is a, c, g, or t
  misc_feature (279)..(279): n is a, c, g, or t
  misc_feature (289)..(289): n is a, c, g, or t
  misc_feature (291)..(296): n is a, c, g, or t
  misc_feature (306)..(306): n is a, c, g, or t
  misc_feature (310)..(310): n is a, c, g, or t
  misc_feature (316)..(316): n is a, c, g, or t
  misc_feature (327)..(327): n is a, c, g, or t
  misc_feature (355)..(355): n is a, c, g, or t
  misc_feature (357)..(357): n is a, c, g, or t
  misc_feature (378)..(378): n is a, c, g, or t
  misc_feature (389)..(390): n is a, c, g, or t
  misc_feature (394)..(395): n is a, c, g, or t
  misc_feature (399)..(399): n is a, c, g, or t
  misc_feature (410)..(410): n is a, c, g, or t
  misc_feature (412)..(412): n is a, c, g, or t
  misc_feature (417)..(417): n is a, c, g, or t
  misc_feature (426)..(426): n is a, c, g, or t
  misc_feature (433)..(433): n is a, c, g, or t
  misc_feature (438)..(439): n is a, c, g, or t
  misc_feature (447)..(448): n is a, c, g, or t
  misc_feature (453)..(455): n is a, c, g, or t
  misc_feature (459)..(459): n is a, c, g, or t
  misc_feature (461)..(461): n is a, c, g, or t
  misc_feature (467)..(467): n is a, c, g, or t
  misc_feature (476)..(476): n is a, c, g, or t
  misc_feature (478)..(479): n is a, c, g, or t
  misc_feature (519)..(519): n is a, c, g, or t
  misc_feature (782)..(782): n is a, c, g, or t
  misc_feature (792)..(792): n is a, c, g, or t
  misc_feature (840)..(841): n is a, c, g, or t
  misc_feature (846)..(847): n is a, c, g, or t
  misc_feature (878)..(878): n is a, c, g, or t
  misc_feature (889)..(889): n is a, c, g, or t
  misc_feature (900)..(900): n is a, c, g, or t
  misc_feature (910)..(910): n is a, c, g, or t
ggggtgnccctgctgctcctcagaatcctggtgccttgaagttctctgtgcatctgtccatcctccctatggccctggccagagctcagcatgggcaggggttctgggtaggacggtnactgtctttctcctggnntgntnttcccngccntnnnccctgccccaggnngcccncngcctcncctgctgctgcccctatngntctgagnagccatgncntgcngggccnngngnnactgtcnttcccctcntccncccnngccccngccngcgctcntnccctgtcctntnnnnnnaacccaaagngaanagaggnaaggcctaacntgtatcccgaaacttcctcagtattcancntgccttcggcgaccactgctngtgctaagggnnggcnncttnatgggcatgtncntgctngagcggtanggtttgntcccnnctctgctnngtttnnncagntnagggtntagccctgntnngaacagaaaagtgtgtagaccttcttcctgctagggctgnactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaacctggccctgccccagnctgtgtagcntcgttcctgcatgtggatgctgcatgtctggtctggggcttggatgtnngcacnngcacccagctgccgtgtcaccttctggtagnaataaagaacntcttaatgccncaaaaaaaanaaca

SEQ ID NO: 644484 - DNA, 267 bp, Homo sapiens
cgacgttcgagctcggacccctcctcagcagacgcagctcagaggtcggcagcccctgcccacgagctctagtcgtccctgcatggccttatgctggaacggctctggaatcttttccctttctttctgagttggctgtgtcggggtggtctttgggaagcactatcatccaagggtccctcactccgtggctctctctctgcccttccaggctgagcagcgtgttatgtcccgggtacactctctggagctgcgtctgctgaggag

SEQ ID NO: 644485 - DNA, 553 bp, Homo sapiens
  misc_feature (277)..(277): n is a, c, g, or t
  misc_feature (301)..(301): n is a, c, g, or t
  misc_feature (317)..(317): n is a, c, g, or t
  misc_feature (380)..(380): n is a, c, g, or t
  misc_feature (388)..(388): n is a, c, g, or t
  misc_feature (412)..(412): n is a, c, g, or t
  misc_feature (468)..(468): n is a, c, g, or t
  misc_feature (484)..(484): n is a, c, g, or t
  misc_feature (546)..(546): n is a, c, g, or t
tgaaactgggcccatctgtatacaggctcaaatttacgtttttaaaggaagaatctatgcagctgaggcttattgcaggaaatacttcatttgtatgtaaatattattgtaaataaataggaggctgtatatttttgaagttgttgatccgcactgaaatagaagtctctaggatctgcatataaacaataaatgtttcctagaaattagtggttttgtttgggaattagatttacattctctcccaggtaacatagttctctcaatgtaaacttgnaacctgaaaccctacttaatttanagaaagaaatgctganaaatagttcccttgattcttatgctgcattaagatcaattatttacagatagcctctgagatncaagtaangaatatttagacccaaatccttgnctatagaaacagattacccaaatgacaaatgttctcataatgacttcattttaacntgtccctaccagacantgcagaactgggagaagaatgtttttccaattgatgctgattctaacttggacttgaagcgngggactg

SEQ ID NO: 644486 - DNA, 103 bp, Homo sapiens
gtggggcagaggtggtgaagctggggatgctctgggggaactcagtgagctcccgcgcggtctctgtgccctcctccacctggtagtggcgggggggagagaa

SEQ ID NO: 644487 - DNA, 173 bp, Homo sapiens
  misc_feature (25)..(25): n is a, c, g, or t
  misc_feature (32)..(32): n is a, c, g, or t
  misc_feature (101)..(101): n is a, c, g, or t
  misc_feature (108)..(108): n is a, c, g, or t
  misc_feature (111)..(111): n is a, c, g, or t
gacatgatgacagaaccactaaaanaccctgnaaatcatcaccagaactagaagacaccgcaacaagctcaaagagacggcccagggtcacgtgcccaganagtatangtnaaggaggagctgttagcagttggcaagctcacacaaacctcaggggagagcacgcacaccga

SEQ ID NO: 644488 - DNA, 1117 bp, Homo sapiens
gagcgggaggggaagggagcgcacgccggtcggcgcggagtgccggctctgcgcttcgtggccgccccctcccgccaccccggtgtcgcacccgtgcagcttgacttcggctgtctccgcatgctcctcacagacggagacgcagctcactcaggctgcccggcggtatttgtttgggtcggctggcgtcagggattctgcagtggcctgtggtccggcgtcgtcctggccactggtgcagccccctgtggcaggcagagctcacgctcctgtaccccggctggtccggggtttgggcgccgctgtcaacggcggctccgccaggactgcgcagacctgggcccgtcaggccctattgccccgaagcggacttgcagttattgacgggcaccttgctttactttcttgcccggggctcacaagttggtagcggaggcctacgagccgcagtgttccaaagcaggctgtgggcaattcccccagaagcgtaattttcactgaagcaaggtggtagcataaatcttaccagctgataattattccacttggatacttagacctaatgcgtagggccaagaagcttggggacaaagctggacgatggttcccatacagactgcatgcataggaggcaataaggaagtgcgaaagccgcagtaatatacaccaagcgaatctacggaaaggaaaaggacataatggagacaaccagcaaatagtgcatggcatacaccttcacaaaagcagtgcactatctactgagggaaaaattcctgcataagtgatggtaccccatatggggaattaggactataccttggtagaaacccaggtaacgaaaagcgaaaaaacgtgtgggtaaattgcgttgtatgagcaagtacgagctttaactagcaacccagcacaagagtacccaaaggggtgggtactttaatttggaaaagcaacaatgctctcaggagaacaaacgcagcagatacagaaagatacgacgacaagaaaagacaagattagagaacgacaattccagcagaagaaaacacactgaaaagcgctcaccggcgacgtgtagcatacgacgaaccgcagcacctaagtgacaacgatgtaggca

SEQ ID NO: 644489 - DNA, 418 bp, Homo sapiens
ttatataatgtctcagcaattttgcttcatcagcaggagtgaatgggtgtggggatggtggcacagatagcctcgctacaaagtattgtgagtcaagggtctatattcatatgtgagcttgaaatgaagagtcagtgtaagtcaaggcagagaaactgttcaaaaagtcgtctcttgagttgctacgtgagaagatttcaagctataaaagtagagttatggcattgtgaactttacagactactgagtggtttacaacaatgctcccatatatgtaaagtgggagaacccttgtctataccaagacactttatgtttaaaccatctacttccaggttttctacttcaaagtaaatatttatataggttgaacatccctaatccaaaaatctgaaattctctaaaatctgaaactttc

SEQ ID NO: 644490 - DNA, 902 bp, Homo sapiens
  misc_feature (900)..(900): n is a, c, g, or t
gctaggaggtgtgggcctcgggtgaggggagacccagctcttagacctgggagcccagacagaggtggatctgcccaccttgcagctccaaggtagattcttcttgtggctccagatgctctggcgaatgcaggagggggaggctcttttctcctttgcaccccagcaatctggagtgcaagaccgtttgcgggagggggcttagtcggctgtttcgaagaggcagcctcccctcccttttatccatcaagccccctatttcctggtgggggcacagtgactgccaaggccagtaagcacctcacttaacccttctctccctgaggaggtgcatgctcctctcccagaggtgcctttggctgagagtggatccctggttcctagtagccctatagggaaacatttggaggttgggtgggtttggaaccctgtacaacctttaggtcctccctgttcagaccttccacgtgcaggcttttcttactttctccgcgggtgccctacagaggactcctgctgccttgtaccagttgggaaaaagcaaaattcagagcagttcctttttctgggtccctcgccttggccacatcggaggaaacgtcgactcgccagggctcccgggagaaatcccgaggtcagtccctcccattctggggcacccctggagcagctagctccctgcctagcggtggcaaactccagagccccaaggagcagaacggggattccctgtgcgcaggctcctggtgcagctcctgagcacaaaggccacaccctcacagaccaggcctggtgagagagccgggcttcttcagaagtactggatactgaggtgccaagcaaggaagaatattgaagagacactgtttttagttgcagcttttgaaacacgcaagaagntt

SEQ ID NO: 644491 - DNA, 719 bp, Homo sapiens
  misc_feature (257)..(257): n is a, c, g, or t
  misc_feature (694)..(696): n is a, c, g, or t
caccaccatgcccagctaattttgtatttttagtagagacagggtttcaccatatggtcaggctggtttcgaactcctgacctcgtgatctgcccgcctcggcctcccaaagtggtgggattacaggcgtgagccagcgcacccggcaacaataacatttaataggcatgtctcattctaatgatatataccttctacctagtgggcacttgtacatatttattttttattttatttattcattttttttgagacanagtctcactctgtcaccaagttggagtgcagtggcacaatctcagctcactgcaacctccgccttccaggttgaagtgattctccagcctcagcctcccgagtagctgggactccaggcacgtaccaccatacccagataatttttgcatttttagtagagacggggtttcaccatgttggctaggatggtctccatctcctgacctcgtgatccgcccaccttggcctcccaaagtgctgggattacaggcatgagccaccacagctggccgtaaatattttttgaatttgaatctgttttggaagccaaatatgttttggaagccaaacaattaagagaagtaaaattttaaccctagtaggtttcgcagattcatccccagatatgtttttgtttggcttgtgttattaacaaataaatgagtgtctttcaaannnaaacaaaaagggggggggggttg

SEQ ID NO: 644492 - DNA, 550 bp, Homo sapiens
gactcctagagtatcacaagctctggaaaaggggacgataggctcacttcgcaaggccgtgcctcgggtaagcataacacttgcaagggtgtgcaaggtccaacatcagtagtaagggggaagtctgcagtcctgaggtcagtgctgtgtttctcgttttctgctttgtcctgagatttcgttacaagtacacagtagatgaatttcctgtgaaactaatgaggcttaagcatcaagggaccctagttgcctgcgagggaccctaacaaagtgtgcacaaagctgttacactagcgcccttttgtaatgggcaaaagtcagctgttttgactgtagatctaaccttgtgcctttccacttaaactgtccttccatcagactttgcatcaggtggcactggcgtggatacagccagtgtgggctaaagataagctgagtagataaactaactttgcttcaatagggtttgcagtcacatttctctgtaagttactgagagccatccagtgtagaaagggcttccaggcataatcccctttttcaaagcctt

SEQ ID NO: 644493 - DNA, 265 bp, Homo sapiens
acaaggccacttgtaccagcagcgtgagtcagcaagatagcagaagcaggaagagagccggccagaagacacctaccctggccggaagacacgtacccctgaagatcgagaaacaggccatctgggtaccacatagcagttacatcagactgggacaattcctgtttacggaagactataaaaccctgccccctactcatttggtgacgccattttagccttagcctcctcacccaggcgctcattaaaacagcaggttgctcca

SEQ ID NO: 644494 - DNA, 477 bp, Homo sapiens
actgctttctggccaggtatggtggctcatgcctgtaatcccagcaatttggaaggctgaggtggggagatcacctgagcccaggagttcaagacctacctgggcaacacatcgagaccccctctctctacaaaaaagtaaaaaaattggctgagtgtgatggcatgcacctgtgggctcagctgctccggagcctgaggtgggaggattgcttgagctggggaggctgaggctgcagggagctgtgatcacgccactgcactccagcctgggcaacagagaccctatctcaaaacaaaaacctactgcttgcttaacatttataagcgaagccattgtggtggcacacacctgtagtcctagctgcttggggggttgaggtgggaagatggcttgagctcaggaggtcaaggatgcactgagccatgataaaacccccgaactacagcctgggcaatagagacacagtctccaaaa

SEQ ID NO: 644495 - DNA, 138 bp, Homo sapiens
gagcccatgagtggctagggaaaatgggaagagaattggcatggctggccatcattgtttgttgcttggatagatcatatagctaatgagtttagcaggggagctgttttttgaagatgatgaacctaaatgttgaag

SEQ ID NO: 644496 - DNA, 444 bp, Homo sapiens
cgaataggaggggtttgaaaagaagttgattaatgggtataaaaatatataatagaaggaataagatctagtgttcattatcacagaaagtgactacaacaatttgttgtatatatatatatatttaatttcaatagtttttagggaacaggtggtattttgttacatggataagttccttagtggtgatctctgaaattttggcgtacccatcatcaaagcagtttacccaatgtatagtcttttatctctcaccccctcccaccttccccctgagcccccaaagtccactgtttcattcttgtgcctttgcatcatcatagcttagctcccacttacgagtgagaacatgcaatgttttggttttccattcctgagttacttcatttagaataatggtctccaactccatccaggttgctatgaatgccattattttaattc

SEQ ID NO: 644497 - DNA, 300 bp, Homo sapiens
  misc_feature (4)..(4): n is a, c, g, or t
  misc_feature (12)..(12): n is a, c, g, or t
aaantgtggagngctaagtcccttgcagtggagagtgtgcatcctgggagcagtcagtgcttccccagctgttcctgggtaaggtgaagagacatctaactgggtagctgggcacaagctgagccttcctcagaggtgacagtggtctacagacattctggcttcctttgaggacaactgtcactttagcatgtagagtactcttaccgaccccatgtgaccttccagctctatgatgttccatgattgatttgctgttgacattcccatgtgaagagagatatatcacgctgctgacga

SEQ ID NO: 644498 - DNA, 108 bp, Homo sapiens
gtcattgacagtgaggtcccacccctcatctctcctggccatatagtttgtgccttgtcttgaagtggggttgctccccttgccaacctcacactgctatgtattgcc

SEQ ID NO: 644499 - DNA, 789 bp, Homo sapiens
tgcccatccatcctgtcacgtcgggctaggaggggccaagccgatgagccacccgggccacagttcctgtgcctgccttccccaccccagcagtggccgctccccatcccctccctctgtgcgtcccgtatgatgacaggttgtttactggggtggggtggcgatatggtgctgtgagcgcgtgctctcagagcataaaggacgttcagggcccaagttgggagaatgctgaccaaaggtgtagccagatatttcatgaggttcccggatgatgcatagactgggccacgaaagagacgggtctggcggcctgggtcactcgtgcactctcatccgtgtggtctggcctctgtctccacttcagctcccgtccatgtctggttttggagagcaggggctgtactgcgagcacctctagtggccagggcagtcgcgagatacctgtctgcttccactctgcgttttgcacctctcctggagctcgatgcctttactacacggctttgtgcgctgctccttgcggggcgcgggtcagctttcccagggccatgccagaggtggccatctatgctagggctgtggaagctgatcggctgtgccggcaagcatgtgatgctgctggtgcgtgtcgggttggggtcgcgcgtggtgtgcgagcgccttacgctgttctggcttggggccctttcccaggcacggtttcggccctgtccccttggcctgccgccccccttgtggtccaaggctccccgggatcttaggctcttctagccatttgtcctgccggta

SEQ ID NO: 644500 - DNA, 1168 bp, Homo sapiens
ctttagtgttaagctaaggcattgattcatgtatctgtccttataatgaattaataaactattttccaaaaaaaaaaaaaaaaaaaaaaaaaaaaaaaaaaaaaaaaaagaaaaaaaaaaaaaaaaaaaaaaaaaaaaaaaaaaaaaaaacaaaaaaaaaaaaaaagagaggggggcggcggaggcgacagaatacaccactacaagggagcgggcgcggcccgaaatcgacagcgagcacgtaccccaaagaagcaggagacaaaagagagaggaggcgcgcgacacaacaagagagggaggaagcagttcgtatataaacagaaccgcagagagagggggcgggggcgaaataacacaaaaaagagagaaagggggcgagaacaagaggcggcaaaaaggagaggaacaaacagcgagagagaaggagaggcgcctccaacaataaaaggcgggggggaggggaggaaaacaaaaagagagagggagacaacccaccacacaacaaaaagaaaaaaaactccaaccacgcccacgcagcagggaatcaaaaccaaacaaaaaaaaaaaaacaagagatgagacggcatgccagcgagagagagagaaacaaaacaagaagaaagaacaagacaataaaggaagcaagcaaaaacgcgaagaaacacaaaataaacaagaaagcagagacgagcgacaacgcgctgaggaataaacaaaaacgaacacagcaccgacacatccactaccactactcaccgacgcgagacgaggcacgcaccaagaggatagacaagagaacacaaaaccaaacgaaacatacgaaaaaccaaacagaaccagacatacaaaaaaacgaaagaaaaacgaagaacacagacacagacacagaaaccgagcaaccagaacccaacaaccaacacagccagagtaagcaaaagatgaaggagtaaaaagagaggaacagagagagaaagcagcagaagacgcgcaaccaaggacacaagcaagataaaagcgggagaaggaagaaccaagaagaaagaacagaaagagaataagaagacaccgcaacggaaaggaagcaccagaagagagcacatacaaacgacaagagagacacaacaacacaaacgacaaacagcaaacaacacaaaaaaacacaaaa

SEQ ID NO: 644501 - DNA, 334 bp, Homo sapiens
  misc_feature (23)..(23): n is a, c, g, or t
  misc_feature (60)..(60): n is a, c, g, or t
  misc_feature (76)..(76): n is a, c, g, or t
tgtggtggtcctcccatcccacnatcccaggatccacccatggatatggtgtgtggtctncttggtgacctttcanacctgaaattgtgtagatggggtatggtggtctccatccaccatcccaggatcaccatggatatggtgtgtggtctcttggtgacctttcatacctgaaattgtgtagatggggtatggtggtctccatccaccatcccaggatcaccatggatatggtgtgtggtctcttggtgacctttcatacctgaaattgtgtagatggggtatggtggtctccatccaccatccaggatcaccatggatacagctgcatgca

SEQ ID NO: 644502 - DNA, 780 bp, Homo sapiens
agcctcgtactcctaccatttatccgacatgataagtgccagagcgagctagcagcagcccgtactacgtgggcgccgcagctcccggggccctacggccgcccgccaccaggatagctggaatggccttagtacatagaggcttattagacttgtttcaaggcgggcttatgcatcagacgcactcaagggagcagtatgtatggtatatagatatatagggtactaccaactcctgcgtggcagttatggaaggtaaacgagcaaaggtgctaggagaatgccgaaggtgccgagaaccaccccttcagttgtaggcctattacagcagatggtgagcgacttgttggaatgccggcaagcgacaggctgtacaccaacccaaacaatacatatttatagctaccaagcgtctcattggccggcgctatgatgatcctgacgtacagaaagacattaaaaatgttccctttaaaattgtccgtgccctaccaataggtagatgcctagggttgaggctcatgggcacattgtattctaccgcagtcagattggagcatattgtagtagactgcaagatgccacaggagacttgcagagacattacttggaggcgcaccagcaacaaaatgcttgtgattcacagtcccaggctaattacaatgactcggcagagacaggccataaagctgcggccgatttctggctgactgtgctacgggtgaaattaaccaagtgtagtctagctatgctagacaatgacagcagtttggttactag

SEQ ID NO: 644503 - DNA, 453 bp, Homo sapiens
  misc_feature (71)..(71): n is a, c, g, or t
  misc_feature (138)..(138): n is a, c, g, or t
ttacagcgttctcagtgtcaacagccagcagaaaataagctgtccgattagttggcacccatgctcagagncagatcaagagagaggtgagtgaacctttcgggagcagagaaccgaggcgagcaaggttgtggtaantcaccatgtgcagctgatcaggcgacaaggtatcgcaggtccgctgggccgtgggaggtggtgcgtaaattgggcgtcaccccaaagcgcatggagatccccctatattaaatggctagccacagaggcaagaatattggacacgatggcaatgggccccaggcccccgaaatggggttaattttataaaattttaatgccaaataaagaattgcgccgggaagggtttcccccttgctaagaaaacgggaaaggttaatccgaaaaaaaaaggggaattagggttgggggaaattaccaaggggaaaagggcta

SEQ ID NO: 644504 - DNA, 563 bp, Homo sapiens
acatttcctctagacgccatgtgatagtttgtaaatgttaaaccagaatttagtagtatgcacctgtcacagcagcgggaagctttgtgctttgtggaagtaaggaatagcaaatgaacttgaaaacaaatgaggagacacaaatattaggttaacagccagctggatgcctatgtgaattaatcatttgctttccacccacggtgattgaggttgacatgaaatctgaggaacatgtagaaatcatgtggtgattacatagactctggcagggttgcaaaagaacatccatgagtgggtgaagttgcatctcaagaggtcagtgcacagaaataggaaagttctgaggtttgcataatagatatcaaaggagatataaaatactaactaggaaaaaagtcaaatgtcaacagaatgctatacttccttaccatgtacatagggagatagcaaagaacataaataacaatggcatatgtgcacatcatacacagagcttctcttaaaatgatctaacagctcattgcccaattactaacgtgtaagtgatgtagtaaaatgtg

SEQ ID NO: 644505 - DNA, 331 bp, Homo sapiens
  misc_feature (79)..(79): n is a, c, g, or t
  misc_feature (107)..(108): n is a, c, g, or t
gggggggggggggtttttagggttttttagggttgtttttttccccccgggggggggggcccccccagtttgggggtgncggggaaaggaaattaaaatttgtttgnnaattggcccacccccccccccaacaagaggggggtcccatttttggggtttggagggggaagggtttccttcaagccccccgggtcccgaaaaaaggttggattttttttttacaaagggttttatgattaaaaaaatttcccggcctttaaggggccattaactgggaagggaaaaaaatttatggggggcaagggaaaaaaagggggtttttacccctgga

SEQ ID NO: 644506 - DNA, 594 bp, Homo sapiens
attgatttagactacggaaaagcaatgaaataaaaagttggtttatgaaaagagaaacaaaatcgaaaaacttcagctaaactaagaaaaaagtgaagacccaaataaaatcagaaatgaaaaggagacaaaacaagtgagaccaagtgagaccataaacacaaagaatcattagagactattattaacatctatatgccaacaaattggaaaacctggaagaaatggataaattcctggacacatacaacctatcaagattgaaccatgaagaaacagaaaaactcaacaaaccaataagaaatagccagattgaagccgtaataaaaagtctcccattaaagaaaagctcaggacctgatggcttcactggtgaattctaccagacattcaaagaataccaattctgctcatactcttccagaaaactgaaggagagggaatacttcccaactcattctacacagccagcattaccctgattccaaaaccagtcaaggacacaacaaaaaaagaaaactatgggccagtatcactaatgaacatagacgtaaaaatactagaaggtctaaatgcaatcaggggatcctctag

SEQ ID NO: 644507 - DNA, 131 bp, Homo sapiens
cataatggagatgcatacaaagtacaaagggagaactaacaggtactggaatctgccaaggggaaatagtacaagctttagtctgaaacttgtctcaaggactagaaagagcatacaaggaagatccccag

SEQ ID NO: 644508 - DNA, 660 bp, Homo sapiens
  misc_feature (503)..(503): n is a, c, g, or t
tcctcctccccagacatggtgtgcacgtacgcgggcttctgctacatgctggcgctgtctgctcactgccgcgctcatctatctgtcggccatttggccagcattactagactagtgtcgagtgagctgatagacgtgatgtactaatgaatccgtataggaccaggtgtaactagccgtgaatcccctagatagtcccagaggtacctcatccacagctgtgtctgtctgatgtcagtgtgatcgtatgtggcagcaagaaggtggccttatcactgggatctcagatatgcccgctctgggggatatcatatctggacggtatactagagtaggacgcaagtgagtgagtgagcccatggactcatatagagcctactaagcatcatagaattgcaagatattgctacgcatattgtcaagaaaggaaggactggtgcaagttaagctatttaatctgctagcagttttattatactagctatatggcatgatctatgttntggggagcgcttagaataagacacagaagaattggtcgagttagagtgcatgcgaaaagcgacaaagtgagagggattctatccagcaagatcctgtccaagagtagcctgtggaaatctgatcagttactttaaaaaatgatcgttattctaaatg

SEQ ID NO: 644509 - DNA, 390 bp, Homo sapiens
  misc_feature (3)..(3): n is a, c, g, or t
  misc_feature (21)..(21): n is a, c, g, or t
  misc_feature (38)..(38): n is a, c, g, or t
gangaattactttgcctaaancccctgtttaattcctnccaactggactcataaaagtacggacacggtgggttgcgagatctctgtgtagtcatgaccccgcaattatacttgacgagagcggtgatgatgaacgggcggtatggaaacctgtccttctttggtgtcaattgagcacactgagaagagattcagaatggcctgtatctcaacctgatggtactgtttttctgctctgatctttaggaaagagtgaagctttcccgtgcattcccgccacttccttgcagttttctttttatacttttcggttaactaatgtatttattaatttatttgagatggagtctggttctgttcatcacggccatggcgcggtatcgggccact

SEQ ID NO: 644510 - DNA, 186 bp, Homo sapiens
  misc_feature (70)..(71): n is a, c, g, or t
ggatacgtgggtgagaaaggtcctggtccgcgccagagcccagcgggcctcgttggccatgcctcggaannttgaggaattcaaggacttcctcttcacagcccgacgaaaggatgccaaatctgttcaagatcaagaaaattatggccaacgtgaagtttaaagttcgatgcagcagataccttt

SEQ ID NO: 644511 - DNA, 703 bp, Homo sapiens
caggggagaggcacagtcgcgatggacgtgtcctcatgatccgggccacaagacacatctcacggacgccagggatccacacggtgttcgaactgaagcgcatcgatcgcagggcatcctcaagcggcgtcctgacgagcagtggatgtacacgggtgaccaacctcttggttgatggcaagaccactgggcgagtgtggcttcaccaggggcaaacagcacggcacaggccccagccacagtggggctgttcttccgggcagagtgacactttgaggccctgtgcatcgagccgttttccagcccggcagagctgccgatgtgatgaagccccaggactcgggaagcagtgccaatgaacaagccgtgcagtgagaccccaagaggcccatttcccccaataaaagagatttgggacacaacaacacttgcaaattttcagacacaccatcatcatgcacgaaaaaagacaacagagttgtgcgggacccacgaagcatctgcgaagaagcttttcccaaacccactcgtgttgaggagcgggcggcccaccgatgtgtagggcgaccgtggacacagggtcttgcacgagggaagacggcccagaaaggggctgtttcccacaaaaaaaggcgcggcgaacggcggcttcgaacaaacaaaggatgcgagacacgggtcacacaggacccgctgcttaatc

SEQ ID NO: 644512 - DNA, 162 bp, Homo sapiens
gagggacctgtcgtctatgtcagaacaagacggcaaagaatgtcagcgcattacaatgcaaaatggacttgtttgatatgcttttccaacataagggacatgagtcattggggcatgttacagagaggttcagtaacaattcagaaaaaaataataaatatt

SEQ ID NO: 644513 - DNA, 1547 bp, Homo sapiens
ccgtttgttcgcttgtatgtgtgttttgttgtgcccgtcgtgtggtagaaaaagaggctatatattgagtgcgggcctcgcgaccctccctcccccccgaccactctctcagaaagacgttggtgggtgtgtggataaatcatccctcatccacacgtgctgtgttgtggtggtgaagatgatattgtggtggggtggccccgatctgtgcgtgcccacaccgctcctttgtggttggggaagcaccccccccccctcccgtgagcctaccctcacaacaagggggccgccccgggaaagtttaatctccccgtcttcgctcccaccccgcggcctgtgttgggggcccgactagcgccacgtgtgggggttgcatatgtcgtccacccccgcggttggggtggttccttcccgcggaaagaatgtgtgtccccgcccaaatgagtaaagaaaaaggaggaagaaggggcgtccgtccgtaaaaatttgtaacagccccaacagaataattggccgccttttaagaaacaggcgggtgcgcccaccagcggagaagcccgccataaggggagcaccaccaccggcccaccggtgtgtatttacctctttttttgtcttggtgaagaaaaaatttggtggagatatttcttcctctcctcctccaaccatcaaccaacaatttgggtgcttgcacacacaaggagagccacagtcttccccgcgtggttccttcttggtgtggaagaacgaacagtccgtcgcccaccaccgccgtgttctgcttgtgggggcgccctccttctacaatcagaagattggtggccacaagttgcacaacgctcgtttcacatatgggcggccaccactgaggtgccacccaacaggtctcacttttcctcaaacaggaggaagtcttttcttttgtccacaagagggaggccatttctctctcgcgagagacgacacagtgttgtcacaacatgtcgcccaactagggtgttgtcccgccccccgggaaaaggccccctgtccccttcccacacacttgggggagacacacaacagagccgcagagtgggccacatgtgacacagagagatattgggagaggttctaccctcagagagggcttgagagagaggcacacacacagtgagaacggagacactccgcttcctctctcgagagtatattcaccgtcacggctacactccacgcgagatgtctcaccccgcccacagatatagagagagagagagagagagagattctctcgcgctggagagagagaggccgccacaagagaggagagggcctataaggcacagagagcccccacatcacacctccacggcgttgtctccacgtgtcccctctaagcccgttcttaactccacacctcgcccctgctttcctccttccctccacgagaatttgtggtgttgctcgcctcctattcttgtgtttttggtgttttttttttggggggggtttagaaccgtgcctggcacatagtaggcgcctccaataaaaaacttgtttgttga

SEQ ID NO: 644514 - DNA, 957 bp, Homo sapiens
attattatactagcatataacatctcacttctaggaagtactagacatgatcgctcgaaccgtcatatcctgccctactgatgcctagtaaggaataatacgtatctgcttgggcatgtatagctactcgtcataggcctcgaacagcgcacatcgccatcttagccaatgattgtgccgtattggcatactagtcttcggcgcctgcgaagcagcggtgggcctagccgctactagtctcaatctccaacacaatgtggtctagactacgtacataacctaaaactactccagtgctcaaaactaatcgtcccagcaatgatgttactaccactgatgatgacctttccaagagaaccaaggatcttacaagagaccactgaaataaccattcttcaacgtgatcagggtctcgcggaaagagagatttcaacacagcgatttccactggagcaccagcaggcaccatctttgaaagggacacagacgggcaacattaacggatcatgaacaaggcgaccgtgcttgatacaatagagtgggagcctgccatagatatgaacgccctcgtcaggcacacccgtcgtgtctctacaatgaagcagaggacgtgcggacagaataacggggcaatgagacaaacggccaccaggagagggcccggatacaaatgtcacgaccccgcacgcggagaccaatgccagtagagaagggcctgcaagccacaccaccaccgaccgaccaaaatcaaacaccagcacaaaggaaaacctaagccgaaccacaggaggacaacagaggaaaaacagagggacgtcctaaatcaagaacacgaccatagaggaacaaaacacagagaagcaacagaaaacagaatcaggacagcacagtgggaaggacatcgacaaacacacaacgagaaggaaaaacaaaatgaaacgcagactaaagaaaaag

SEQ ID NO: 644515 - DNA, 1641 bp, Homo sapiens
gcgaggaggaagaagaggaggaggaagaggaggactgaggacgaagacctggaggagctggatggtgcatggagagtgaagcccgcctgactggtactgtcctgcggccctcagtgcccacctgcgccctgacgcactggctgctgtccccatgatgtgacttctgagaaagtgacttctgtgcacgacgtgcgcccccggtggaacacccatgacacagagagcgacatccaccaccagagtagaacgccgagaggcaggaaagcacgatcatatgaggggacaccctgatgaccctggatgatcggtcagaaccaggatgacaccagacgcacaatcccaccagcatgatacatgcattgaccagaaagatactacgccacttcacagaggagatcaccatggaggggaacgaagagaaggcgcatcgctggggacccggagggcagttacgagagataagagagacgagcagaggagcaaaagatagcacaaagaggagaatggaggaagagaagacacaacagaataaaagagacagagataggaagaagaagaggagaacaagacaagaggagacgaacagaggacagacggaagtgaggaagcaagagacgacgcgagaccgcggggaaggaaagagatgacaggaaagagcaggagaaataggaagaaaaacacagagacacgaagagaggacagcagacacaggagaggagagcgcgcaaaagggaggtggcacagatgagagggagaacgagcagacagacgacgacagaggaggggagagggaggaaggggaggaacaggggagggaaagggagcaagggggaagaggaaggagagggaacagaggaaggagacaggcgcagagaaggagggaggaggagaaaggaggaagaaggagcagaaggagacgggcaagaaaaagaggagagggaagaaaaggaaggaggacggggacagaggagcaagcgaaagcaagcaggcgatagaggggggaagaagaacgaacgaggagaggagacaagaaagagacaggagaggagcggggcggaccgaacaggagagagagagaaacggacgaaagaaagagagaaaaggacaggagtgagacgaaaaaggagagaggaaaggagacgcaggggaggtagacggagaggcgagagaggagcaggaaggaaagaggagagagaggaacgagaaagagggagagaagggagggaggaaaaagggagacagacagcagagacgcagcgagagacgagaggaaagagacaagacaagagaaaggggaaggggagccaaggagagagagaaaggccgcagcgagagagaagcgagcgagagagcacggaggcgagagggaaagggagagaagaagaagcgaaaaggaggaacgaggagagaggagaaaagcagcacgaggaagaagaaacgaaacgagaacgacaaggaaaaggaagaagacgcaacaccaagaagaacgcaacagcagagagcgagacaacaagcagagaaagagagacgagagcgaagagaagagaaagagaagaaaaaagacaagagagaagaaaggaagagaagtagaacagcaagaaagacagagagacgacgagcaagaggacaagagaaagagag

SEQ ID NO: 644516 - DNA, 287 bp, Homo sapiens
tatgcatgctcgagcggcgctttgtgatggcatatctgcgagcacattcggcttccattgtgtgtttgccagctgcactattcaacagcataacactgcatagtaaacaactacaaaatgactgtgagtcagcagcacacagtgctgggttattagaagagcctgagacggtgtgtatatgtaccaacacttgaatggcggtgtaagccagtattgtggttttgtgatgatttaaccacaaatgtcgttccctatttaaatattccaaatcagtactgttagtacac

SEQ ID NO: 644517 - DNA, 1650 bp, Homo sapiens
cttggtgttcggctgagttagattcactgcgaacttgagatggggactggctgactacggacagatgtcgtacagcgagaatgctacagcattgggcacccggtgccccgcgatacttcaacagccatcaggctgctggcatgccaggattgggttcgagttcgacaacgatactcaacgctctgggtcgtagactacaatatggaacatagtattggttcgtggttcatctcattgttaaccccaatcatgtgaaccttgcacccgtatcgagtagtagcactacaccggaaagattcaatctggcatctctcaagcatgaataaggcgcgcaacgaacggacattcctaccgggaaatcgtcgaaacatggccccaaagggtgaacttgagggtagccttacctgggttggggaatatcgttcgaagatattccggcggtccactattccttaatgccccattaggggcgctcaaagaatgacggaccattaacaggtaaacatcggtacgcggacgcgcacttagggggagaaaccgcaaaatgggcacaccaattttgcaccttcttgcgggcggattcgattcgaacagaaaaaccacacccggtgatctagtgtctgtgtaacgaagcgccgacaattcgtggtgcagttcccaagcgtgcaatcgttacagcactagggggcgggcagactacccattctaaatatacacgggcgccctattgtacagcgttgggaacacacggcggtccgagatttgctcttacagcaattcacaacagggtgggtgggccccctatacatctacataatcacgttcgccaaacatctgggaaactgcacaacgatctacacacggcggaggctatcactatacccaattatcccgggagggacaggagaaaatttatcatactcgatgggggcttgagccaaatactttggatagcgcggttacccccgtcattggatctacggggcgacacgccggtcatactccgaatggccatgtgtcgtcacctatgtccagcacaacacataatgatggcgaaagcaaacctattaaccgggatctcccaagcgtgggcgccctattatacggcacaagcgtttattcccctcttgtgtagcgcacacacagcaagttgggcgcggaacaacacctgtgattcgctcggcaccacggaccagtggcgacctgatgggcaaaaagacccccatgcgccacgcggactggacaatagcgcacatctgagagagccccggggaaggggtcccccaagagaaagcaaggcccgcaacgagaagccaactttccccgccaccaaagctggccaagacaagcggtgacagaccgggcatgcgcggccgagcgcattccaacggggcggccacacaggcattgacagcacactagcggccacccccccgcacggtgcacaagagcagcaagaaaaccctaccatacccacgggaggaacacacccaaagagactgccacccaagagaacgcagaacaggcaccaaccagagcttcaatgacagactacagacgaccccagacagtgtcgcaggggccttcattcaacaacgcggcgagaagcaccgattcaatacacgcagcggcgagcgagtaaaaacacac

SEQ ID NO: 644518 - DNA, 361 bp, Homo sapiens
  misc_feature (81)..(81): n is a, c, g, or t
  misc_feature (97)..(98): n is a, c, g, or t
  misc_feature (139)..(139): n is a, c, g, or t
ttcattacgcaaatggcaaattctttggtctcccatcagctggaattaagtaggtactgtgtatctttgagatcatgtatntgtctccactttggtnngatacaattaaaggataggcacgtaacagtctgaaaaagangggtatcacaccgctccagctggaatccagcatgaacctctcagcatgccactagctgaacactttaaacaggaaatcacggacagcttcccttcatttattttgatgtgcccattcgtttgaaagtgcatcaatcgtccttatttgttttccctatcatttagaccttctacctatgacacaaaatcccttttctattttataatacaccacactgaaatt

SEQ ID NO: 644519 - DNA, 451 bp, Homo sapiens
  misc_feature (178)..(178): n is a, c, g, or t
gcacgaggctcagcaagcaccgtggtgtgggggcgtgtcctgggagcgaggctgagttcacggagcatctgctgtgtgccgggccggtgctgagtgattcccaggtctagcgccagtcccaacacccaggaggctggtgtctacggggccacatgtctgaggtcaccgtcagtcagcngcagagcccccctccacgccctggtgtgtgtcaccttgacaggcaccatccatttccctccctggtgtgtgtcaccttggcggtcagggtctccctccctcccctctggagtgcgttcacctctgtacccttctcaaagagactcacaacctaagattagacgagccccagcccagtgtcggtgacctagtgccctcctcgctggtggctggaacctcaccgggtggctctgcggtgccggcttcagaacccaccacgccgagccctatgcag

SEQ ID NO: 644520 - DNA, 81 bp, Homo sapiens
attacgagtttgtgtcttgttcctttatgcttttggtaaatatatctataatgagttgggattaaaatagattatccgcat

SEQ ID NO: 644521 - DNA, 173 bp, Homo sapiens
tcagttaccaactgtatactaaaggtatctttgcctcattatactatctctggatagccatatcctcttctaaaattgacggatgcctgcctacaaaatctacgggacacttattgtgtaggtgtcaaacactttaaaggcccactaaagggcatctataattccatgagtgc

SEQ ID NO: 644522 - DNA, 1075 bp, Homo sapiens
ggcatggcgctggacggcgttggtatgaagaacttcagcgttgccctggccggagcaagagcacaggccctcggggatggaggtctttggtttcataagagcctgagagagatttacataagatatgtgtaacacaccaagcgtactgtgacctaggcacaggctgctaaggatgtcttcaacaaaggcatatggctataggcatggtcaagcatagcaccctgcaaacaccaagtcttgtacgtggcgtggcatttctcacattctgggtccatgcttacacatgatacaagggcaagcatcaggcaacctagaaaccacatatcagggtctgtacactcatggccttaccttcacccagaacatggaacacagcacaatactctagggacagaaatctctggggagaataacgttggctgaagggttgaaaatgattcttggataccaatattagtaccgaaacacaggaaagcacagagtgaggaaattgaaggccatcctataaacgggatggaaaaagatgttggacagtaatgatgatatagatatatctggacaaacatctatggcatggggatgtgatggacattcgaagggtgaattgtagacatctcccagaatgcacgatatagacacaaagccaacatacaaacacttggccaaagaaatacctgtccgccctgggatcacaacggttcgaggacctccacggtggcaccacaacttgttacacagatgagactgacattggaagaaaaacaaacacgaacgtgaaagaaacagcagtgacaaaacacaataaccagggcatcgggcaaaccgtggcaagaacaacaagaccccgaactgtgaacatggagagaaagaacatcagtgggtgtgcaacagccacccaccctcagtacagcgcaaaaacagccacagcgaaaggacggagaagacaaacgaccctgatgcaggggaccaaccagagcttaaagaacgaccgagggagcaacctgcgtcccggccaaccggagacaacgacagcgaacaagaggtgagagagatagacgaggaagcaaacaacacg

SEQ ID NO: 644523 - DNA, 399 bp, Homo sapiens
  misc_feature (27)..(27): n is a, c, g, or t
  misc_feature (68)..(68): n is a, c, g, or t
  misc_feature (87)..(87): n is a, c, g, or t
  misc_feature (107)..(107): n is a, c, g, or t
  misc_feature (114)..(114): n is a, c, g, or t
  misc_feature (125)..(125): n is a, c, g, or t
  misc_feature (130)..(130): n is a, c, g, or t
  misc_feature (132)..(132): n is a, c, g, or t
  misc_feature (136)..(136): n is a, c, g, or t
  misc_feature (173)..(173): n is a, c, g, or t
  misc_feature (222)..(222): n is a, c, g, or t
  misc_feature (269)..(269): n is a, c, g, or t
  misc_feature (286)..(286): n is a, c, g, or t
  misc_feature (301)..(301): n is a, c, g, or t
  misc_feature (304)..(304): n is a, c, g, or t
  misc_feature (308)..(308): n is a, c, g, or t
  misc_feature (350)..(350): n is a, c, g, or t
gagagtttctttttaagtaaattaaangaaaataaatcttcattttcacattttttgttgcagtccanaggtaactagttggttagnggctatgtccacttggacanatgctanggggggggggntttcncntggnagcactcagaaatacggcatctgtcagggctcacggnactgggctgctgaatgcactgtcgtttgtaaataacagcaagtggggantttaaaacatcatggatagataagagttataaatagaaaactggtanggttaagaggcagaggntcgttaaatacaganggntatntatatgttgcccatattccacaaactctgggttatgtttggnacttttaaataaatgatctgcatctaggttagagactggattggatttg

SEQ ID NO: 644524 - DNA, 147 bp, Homo sapiens
ctgtgttgaggagatgtttcatgtacttatactaacattagttcttctatagggtgatagattggaccaattgggtgtgaggagtcagttatatgttgggattttaggtagtgggtgtgagcctaaaagcagccaccaattaagaaa

SEQ ID NO: 644525 - DNA, 1724 bp, Homo sapiens
agcggagtatttctccggggggtgttcgagtggaggaatactcttacgtgaaagtgctcagtacaccactgcggcaggaaggaggaagggaagaattccagatggggagaaagtaatattttgcagcacagtacagggtaaactgggtccaggtggcgtagccgccgcgacaccttcacgtgaccgcggacagcttaaggaccccgcatccagtgcgcctgcgctggagctcccggaagttgccggacccggaacgcaggcggagcgcaagtctgtcagccagtcagtccgccagtccgccagcccagtacctctctctcctcggccctcgtaagctgtccgcggtctgtttggcccgaacggcggcggaggcgctgatcatggcgacattcatctcggtgcagctgaaaaagacctcagaggtggacctggccaagccgctggtgaagttcatccagcagacttacccaagcggcggggaagagcaggcccagtactgccgcgcggcggaggagctcagcaagctgcgccgcgccgcagtcggtcgtccgctggacaagcacgagggcgcgctcgagacgctcctgagatattatgatcagatttgttctattgaacccaaattcccattttctgaaaatcagatctgcttgacatttacctggaaggatgctttcgataaaggttcactttttggaggctctgtaaaactggctcttgcaagcttaggatatgaaaagagctgtgtgttgttcaattgtgcagccttagctagccaaattgcagcagaacagaacctggataatgatgaaggattgaaaatcgctgctaaacattaccagtttgctagtggtgcctttttacatattaaagagacggttttatctgccttaagtcgagagccgaccgtggaccatatctccagatactgttgggaccctcagtcttattatgctggcacaggctcaagaagtattttttttaaaagccacaagagataaaatgaaagatgccatcatagctaaattggctaatcaggctgcagattattttggtgatgctttcaaacagtgtcaatacaaagatactctccccaaggaggtgttccctgtcttggctgcaaagcactgtatcatgcaggccaatgctgagtaccatcagtctatcctggcaaaacagcagaagaaatttggagaagaaattgcaaggttacagcatgcagcagaactgattaaaacagtggcatctcgctatgatgaatatgttaatgtgaaggatttttctgacaaaatcaatcgtgcccttgctgcagcaaagaaggataatgacttcatttatcatgatcgagttccagaccttaaagatctagatcctattggcaaagccacacttgtgaaatctaccccggtcaatgtacccatcagtcagaaatttactgatctgtttgagaagatggttcccgtgtcagtacagcagtctttggctgcctataatcagaggaaagccgatttggttaacagatcaattgctcagatgagagaagccaccacttgggcaaatggggtgctagcttcccttaatcttccagcagcaattgaagatgtgtctggagacactgtacctcaagtctatattgactaaatccagatctgtgattgaacaaggaggcatccaaactgttgatcagttgattaaaagaactgcctgaattactgcaacgaaat

SEQ ID NO: 644526 - DNA, 729 bp, Homo sapiens
  misc_feature (643)..(643): n is a, c, g, or t
ttattttgttccgttaaagtcatcgtgtgtttataaagatgaataagatagtgtttatgattaccaaggcagaatgaccatttgaaatatcccagtgccagtattttactttttttagatttcaatttaaaaggagaaggaaaggaagttgggtggttataggagataatattttgagcttttgtcctttttttcatggtggatttttcttcaaagaagacttaatatttaatgagattcaggaaggttacctaattttctgttttctttcattctatccagatctgcttgacatttacctggaaggatgctttcgataaaggttcactttttggaggctctgtaaaactggctcttgcaagcttaggatatgaaaagagctgtgtgttgttcaattgtgcagccttagctagccaaattgcagcagaacagaacctggataatgatgaaggattgaaaatcgctgctaaacattaccagtttgctagtggtgcctttttacatattaaagagacggttttatctgccttaagtcgagagccgaccgtggaccatatctccagatactgttgggaccctcagtcttattatgctggcacaggctcaagaagtatttttttgccacagagattaatgaagattnctctagctgaatggctatcgggtcgatatttggggagcttcaaccggttgtcgattttccaggtgtatggttttacctgttttgct

SEQ ID NO: 644527 - DNA, 381 bp, Homo sapiens
tgccggcccagatatttctatgtttcatgggtagtgcagatgtcagaatgccatttcaaatagcctatgatctaagagattagccctacacaatttcagtctgacctgaaatccactgtatctccccattctgttttccagcttttctgtccatgttcacccagaaaaaatactgtgactctatcatcagcactgagaataaaagaaagacgtatactcaccaaacaagaaggcagaagtttgattagacactgaaaatctttatctgacaaatacttgtctgggccaaggtcagcctgaaaacatggaagggaatatcagggtactgttttggtcaccaaaagaaaaattccttgtctttccctttaattttattatcca

SEQ ID NO: 644528 - DNA, 1792 bp, Homo sapiens
agcggagtatttctccggggggtgttcgagtggaggaatactcttacgtgaaagtgctcagtacaccactgcggcaggaaggaggaagggaagaattccagatggggagaaagtaatattttgcagcacagtacagggtaaactgggtccaggtggcgtagccgccgcgacaccttcacgtgaccgcggacagcttaaggaccccgcatccagtgcgcctgcgctggagctcccggaagttgccggacccggaacgcaggcggagcgcaagtctgtcagccagtcagtccgccagtccgccagcccagtacctctctctcctcggccctcgtaagctgtccgcggtctgtttggcccgaacggcggcggaggcgctgatcatggcgacattcatctcggtgcagctgaaaaagacctcagaggtggacctggccaagccgctggtgaagttcatccagcagacttacccaagcggcggggaagagcaggcccagtactgccgcgcggcggaggagctcagcaagctgcgccgcgccgcagtcggtcgtccgctggacaagcacgagggcgcgctcgagacgctcctgagatattatgatcagatttgttctattgaacccaaattcccattttctgaaaatcagatctgcttgacatttacctggaaggatgctttcgataaaggttcactttttggaggctctgtaaaactggctcttgcaagcttaggatatgaaaagagctgtgtgttgttcaattgtgcagccttagctagccaaattgcagcagaacagaacctggataatgatgaaggattgaaaatcgctgctaaacattaccagtttgctagtggtgcctttttacatattaaagagacggttttatctgccttaagtcgagagccgaccgtggaccatatctccagatactgttgggaccctcagtcttattatgctggcacaggctcaagaagtattttttttaaaagccacaagagataaaatgaaagatgccatcatagctaaattggctaatcaggctgcagattattttggtgatgctttcaaacagtgtcaatacaaagatactctccccaaggtcagttattgtttttataaacacttgcttactttgcatgtgaaatatttagacttttttgtgtataagaagcaagttgaaacttataaagaaatttgaagttttaatagagttatctgaagtatatagtagaaatagtttttttttttttttaatttaagatgcatgaacaattcttttatgtttaggggatgcctttgtctttaccttttactaaacttgtttttccaagctagaactctttctggaaaatgttgaccatctgttttcaatacttttatcaaatcaaggcattgtgtagttctgaatcattggtgatttggtacaagcatgtatacttgagcatgttgatgattcacacttttaattattgtcctgttttcttaaagatgagccttaaagcgcaaaaacagacataaagaaaaaaggaaaagaaaacttaacaaattcatctgatactttgattagaattcagttttgccaacagggataaaaaattgggctgctaatggacagctaaggaaagcaaccatcttaaaccacatatcacaggaagtataatgttttaatgtaaacctttctgaagtgacaattgtaaagactattcagtgatgatcatttgttaatgacaaagcaaatcactagtaaatttggaatgattaataaagaaaacttaaagattgaaaaaaaaaaa

SEQ ID NO: 644529 - DNA, 1406 bp, Homo sapiens
agcggagtatttctccggggggtgttcgagtggaggaatactcttacgtgaaagtgctcagtacaccactgcggcaggaaggaggaagggaagaattccagatggggagaaagtaatattttgcagcacagtacagggtaaactgggtccaggtggcgtagccgccgcgacaccttcacgtgaccgcggacagcttaaggaccccgcatccagtgcgcctgcgctggagctcccggaagttgccggacccggaacgcaggcggagcgcaagtctgtcagccagtcagtccgccagtccgccagcccagtacctctctctcctcggccctcgtaagctgtccgcggtctgtttggcccgaacggcggcggaggcgctgatcatggcgacattcatctcggtgcagctgaaaaagacctcagaggtggacctggccaagccgctggtgaagttcatccagcagacttacccaagcggcggggaagagcaggcccagtactgccgcgcggcggaggagctcagcaagctgcgccgcgccgcagtcggtcgtccgctggacaagcacgagggcgcgctcgagacgctcctgagatattatgatcagatttgttctattgaacccaaattcccattttctgaaaatcagatctgcttgacatttacctggaaggatgctttcgataaaggttcactttttggaggctctgtaaaactggctcttgcaagcttaggatatgaaaagagctgtgtgttgttcaattgtgcagccttagctagccaaattgcagcagaacagaacctggataatgatgaaggattgaaaatcgctgctaaacattaccagtttgctagtggtgcctttttacatattaaagagacggttttatctgccttaagtcgagagccgaccgtggaccatatctccagatactgttgggaccctcagtcttattatgctggcacaggctcaagaagtattttttttaaaagccacaagagataaaatgaaagatgccatcatagctaaattggctaatcaggctgcagattattttggtgatgctttcaaacagtgtcaatacaaagatactctccccaagaagatgagccttaaagcgcaaaaacagacataaagaaaaaaggaaaagaaaacttaacaaattcatctgatactttgattagaattcagttttgccaacagggataaaaaattgggctgctaatggacagctaaggaaagcaaccatcttaaaccacatatcacaggaagtataatgttttaatgtaaacctttctgaagtgacaattgtaaagactattcagtgatgatcatttgttaatgacaaagcaaatcactagtaaatttggaatgattaataaagaaaacttaaagattgaaaaaaaaaaa

SEQ ID NO: 644530 - DNA, 985 bp, Homo sapiens
  misc_feature (56)..(56): n is a, c, g, or t
  misc_feature (160)..(161): n is a, c, g, or t
  misc_feature (182)..(182): n is a, c, g, or t
  misc_feature (198)..(198): n is a, c, g, or t
  misc_feature (218)..(218): n is a, c, g, or t
  misc_feature (239)..(239): n is a, c, g, or t
  misc_feature (247)..(247): n is a, c, g, or t
  misc_feature (258)..(258): n is a, c, g, or t
  misc_feature (261)..(261): n is a, c, g, or t
  misc_feature (270)..(270): n is a, c, g, or t
  misc_feature (273)..(273): n is a, c, g, or t
  misc_feature (301)..(301): n is a, c, g, or t
  misc_feature (313)..(313): n is a, c, g, or t
  misc_feature (322)..(322): n is a, c, g, or t
  misc_feature (326)..(326): n is a, c, g, or t
  misc_feature (985)..(985): n is a, c, g, or t
gcgtgacacccgttttctatggggtcttcatttcccagtggcacaggggaactacngaaggctctgccgtctgtgtcttcacaatgaaggatgtgcagagagtcttcagcggcctctacaaggaggtgaaccgtgagacacagcagtggtacaccgtganncacccggtgcccacacccggnctggagcgtgcatcancaacagtgcccgggaaaggnagatcaactcatccctgcagntcccagancggtgctgaanttnctcaaggancanttcctgatggacgggcaggtccgaaccngcatgctgctgntgcagcccnaggntcgctaccagcgcgtggctgtacaccggctgtccctgtgcctgaaccacacctacgatgtcctcttcctgggcactggtgacggcggatctcatgaaggcgagtgagctgtgggcccccggtgtgcatcatcagttgaggagcctgctagatcttctccatcgggacagcccgtgcagaatctgatcctgtgacacccacagggggcctgctgtatgcggactcacactcgggcgtagtccaggtgcccatggcaaactgcagcctgtacaggagctgtggggactgcctcctcgcccgggaccctactgtgcttggagcggtccagctgcaagcacgtcagctctaccagcctcagctggcaccaggccgtggatcaggacatcgagggagccagcgccaagggacttgcagcgcgtcttcggttgtgtcccgttttttgtacaacagggagaagcatgtgagcacgtcagtccagccaaccagtgaaccctttggctgccgttctcttcaactgggaccgatttggtacgccgggccccgtcatgctcgctctgccgtgtccctggctggtggggcccccctggggttcctgcgcgcctagggtcgccggtgcctgccggggcgggggccccgggggccctccttgcggcgcgggcn

SEQ ID NO: 644531 - DNA, 150 bp, Homo sapiens
tctcatcgcgtttgtgatgtaacgtttacatgtttccgtgtgcttttcagtaacgttaggatctgggtacgtcacgcatttacccacgttatccaatagcaccggtccggttttttaaatcgtaattttggttgcctcctctttagtaag

SEQ ID NO: 644532 - DNA, 613 bp, Homo sapiens
tacgaggagtccgtcacgcggtatccatcctatcaaagcctatagagtacgctcgtcatattcagttgtagggctcaggagtatgctcgctcttgggcagtgcgagtgactaatagcctagttagtgcgcctagggtgtagtgagtgtcaattagtgcgctaagtaagggaagggagcctacaagggagtcgactcggacgtatgtgcctgcgtacaggcgtactggctgatagcctcatcgggtaatgatcagccaaggcggggataagtgtgatttcgaagacgatctaaccttatgcttagttctgtggctgtgactgttctcattccaggacatttgtagggcagcttcagtcatagaacggtccagtttattttcgtgctcaatggttccctggctcaagtggcgtaggcttacccatgaatgtgaggggtacgagtccggtcgttcagtattcgccggggggtcgtacggcggtcggcggccccggttgaggacccactcactagggtcgagtagctatggttacccacataataggggcatcatcctattaattaagctgtggatagagtgttgatacccattctgtgtcccagccccgccctgcg

SEQ ID NO: 644533 - DNA, 1495 bp, Homo sapiens
agcggagtatttctccggggggtgttcgagtggaggaatactcttacgtgaaagtgctcagtacaccactgcggcaggaaggaggaagggaagaattccagatggggagaaagtaatattttgcagcacagtacagggtaaactgggtccaggtggcgtagccgccgcgacaccttcacgtgaccgcggacagcttaaggaccccgcatccagtgcgcctgcgctggagctcccggaagttgccggacccggaacgcaggcggagcgcaagtctgtcagccagtcagtccgccagtccgccagcccagtacctctctctcctcggccctcgtaagctgtccgcggtctgtttggcccgaacggcggcggaggcgctgatcatggcgacattcatctcggtgcagctgaaaaagacctcagaggtggacctggccaagccgctggtgaagttcatccagcagacttacccaagcggcggggaagagcaggcccagtactgccgcgcggcggaggagctcagcaagctgcgccgcgccgcagtcggtcgtccgctggacaagcacgagggcgcgctcgagacgctcctgagatattatgatcagatttgttctattgaacccaaattcccattttctgaaaatcagatctgcttgacatttacctggaaggatgctttcgataaaggttcactttttggaggctctgtaaaactggctcttgcaagcttaggatatgaaaagagctgtgtgttgttcaattgtgcagccttagctagccaaattgcagcagaacagaacctggataatgatgaaggattgaaaatcgctgctaaacattaccagtttgctagtggtgcctttttacatattaaagagacggttttatctgccttaagtcgagagccgaccgtggaccatatctccagatactgttgggaccctcagtcttattatgctggcacaggctcaagaagtattttttttaaaagccacaagagataaaatgaaagatgccatcatagctaaattggctaatcaggctgcagattattttggtgatgctttcaaacagtgtcaatacaaagatactctccccaaggtcagttattgtttttataaacacttgcttactttgcatgtgaatactagaccctctgcgatacgagcaagttgacctataagaaaatgagttaataagtatctaagttataggaaaaaacttcttttttaataaaatctgaccatctttacttaaggaagcctttcttaccttaacaacttgttcaagtaaaacctttggaaactaccatgttcaaacttataatagccttggacctaacattggatgtcacctttccttgcactcaattcacttcatattcccttttaaaaacctagcgcaaccttctttcaaatcttgtcctaatttacgcaccttgctctgtataacacccgctcctgcatatccgtcaatagatgattatgtctctctgcct

SEQ ID NO: 644534 - DNA, 2325 bp, Homo sapiens
agcggagtatttctccggggggtgttcgagtggaggaatactcttacgtgaaagtgctcagtacaccactgcggcaggaaggaggaagggaagaattccagatggggagaaagtaatattttgcagcacagtacagggtaaactgggtccaggtggcgtagccgccgcgacaccttcacgtgaccgcggacagcttaaggaccccgcatccagtgcgcctgcgctggagctcccggaagttgccggacccggaacgcaggcggagcgcaagtctgtcagccagtcagtccgccagtccgccagcccagtacctctctctcctcggccctcgtaagctgtccgcggtctgtttggcccgaacggcggcggaggcgctgatcatggcgacattcatctcggtgcagctgaaaaagacctcagaggtggacctggccaagccgctggtgaagttcatccagcagacttacccaagcggcggggaagagcaggcccagtactgccgcgcggcggaggagctcagcaagctgcgccgcgccgcagtcggtcgtccgctggacaagcacgagggcgcgctcgagacgctcctgaggtgggcgcggggctgggagtgggtaggttgtctgccagccgtcgctcgccgctcctcttcccgtctccccccttccttcaatcctgtaacctgggcggagccgccccgtcccggcctgaccaggcgcgtaggtgtggtctgcattctttgctggtgagcaggacccgccctgcaggcccgctgtgactgcccgcttgtcctgcctgcacgtctgctctagcccttggtcggcgagggctccgtggatcagatacctgggagcagcagtctgccctgtactgatctcttttgccacatttacttagaactagtcttcacttttttgggtctctaactgaagcttcccctttcgccccatttttccatcactgtctttcttgggccacattttgatttcataatagtagttgcttgaaggcagtgggggaagtgggggaattgggacactggaccaaatgtctgatcagctcatcacattgtccacatgaaatggaccgtcttcctcagttcaaaataatcaaatgatagatggagaattctgaaagttaggagctacaactatttgaaataaaactctagttacatagttgaaccgttcaagatattatgatcagatttgttctattgaacccaaattcccattttctgaaaatcagatctgcttgacatttacctggaaggatgctttcgataaaggttcactttttggaggctctgtaaaactggctcttgcaagcttaggatatgaaaagagctgtgtgttgttcaattgtgcagccttagctagccaaattgcagcagaacagaacctggataatgatgaaggattgaaaatcgctgctaaacattaccagtttgctagtggtgcctttttacatattaaagagacggttttatctgccttaagtcgagagccgaccgtggaccatatctccagatactgttgggaccctcagtcttattatgctggcacaggctcaagaagtattttttttaaaagccacaagagataaaatgaaagatgccatcatagctaaattggctaatcaggctgcagattattttggtgatgctttcaaacagtgtcaatacaaagatactctccccaaggaggtgttccctgtcttggctgcaaagcactgtatcatgcaggccaatgctgagtaccatcagtctatcctggcaaaacagcagaagaaatttggagaagaaattgcaaggttacagcatgcagcagaactgattaaaacagtggcatctcgctatgatgaatatgttaatgtgaaggatttttctgacaaaatcaatcgtgcccttgctgcagcaaagaaggataatgacttcatttatcatgatcgagttccagaccttaaagatctagatcctattggcaaagccacacttgtgaaatctaccccggtcaatgtacccatcagtcagaaatttactgatctgtttgagaagatggttcccgtgtcagtacagcagtctttggctgcctataatcagaggaaagccgatttggttaacagatcaattgctcagatgagagaagccaccacttgggcaaatggggtgctagcttcccttaatcttccagcagcaattgaagatgtgtctggagacactgtacctcaagtctatattgactaaatccagatctgtgattgaacaaggaggcatccaaactgttgatcagttgattaaaagaactgcctgaattactgcaacgaaat

SEQ ID NO: 644535 - DNA, 138 bp, Homo sapiens
ttggttaagggaaggtatcattctcaattagccagacctctgctggcccatgtttaatgtcataatacaacaaaatattctgccactgccatagctactgctgactgctggaaccgacatagccaccttggtttcgtg

SEQ ID NO: 644536 - DNA, 195 bp, Homo sapiens
cactcacatgctcccagagcatttcatccatccatcgaagctctagacaatgtgtcaaactcatgttatctctctaagagtctagactgcctcattgaatgcgagggaatcctgcgagtaaatacgacagcgttttcccgtctagtgtgtcttcgttggatgccgtagacaagcatacactagtagcagatgtag

SEQ ID NO: 644537 - DNA, 800 bp, Homo sapiens
  misc_feature (16)..(16): n is a, c, g, or t
  misc_feature (92)..(92): n is a, c, g, or t
  misc_feature (108)..(108): n is a, c, g, or t
  misc_feature (228)..(229): n is a, c, g, or t
  misc_feature (231)..(231): n is a, c, g, or t
  misc_feature (252)..(252): n is a, c, g, or t
  misc_feature (256)..(256): n is a, c, g, or t
acagctggatagcggntgtcccccctctcgtggggtggttgttgttttatttaaatatagatcagaatgggaccacacagcagatatgtctnccccccccgtcggccnggggttgttgtttgtaagagagaacgaacaaggaacagcgagaacgatcctcctcatagtagcgaatagcatgggtgggctgaatatgagacatacggatgtgtgcctccccccgcgggnngnggggggacaaatttttttttntgtngcgaggatcagaatacgagacggaggagagatgagccgatatagtataaagtgctagaacatcactagatataagcggatgggccggcggaggggcagtcgggcggcgcgactggatggagggagggggcggggagtggtgcgggaggtgggggagcgggcggcgtaggcggagggggaggggggcgcggtgagcgtggcgaggggctggaccgcggcgccgaccggggccgcgggggaggcaggggatgagaggcctcgagggcggggcggtcgtgggggagcgcgtccgtcggtccgcggtgtgtgggggagggggggggggccgtgcgcctgagtagggggcgggggtgcaggaatggggctggagcgtcgtgtgggggggtatactgtcggtaggtgcgtgcaagagaggaagtcagggggggcgagtgggtaggggagggaggggatagattgagcggctcaggggggcgggggggggggtgtgtggtgggggtggtgtgcgtgtgagggtgggggtcggggtggtgtgatgtatttgt

SEQ ID NO: 644538 - DNA, 102 bp, Homo sapiens
catccacccctgattcaccccgtattcaggctaagagttatgtggcgtttactgtgccagactaatcagtagctcactgaagcattgcaacacggtctctca

SEQ ID NO: 644539 - DNA, 263 bp, Homo sapiens
  misc_feature (20)..(20): n is a, c, g, or t
gagcctcaggactgtggacnaaggatgtggccttgggcattttttccgtttcccacatgggcctggtccctccctcctggccccaaccccaactgccaggcctgacatggccttgcctttcctgcagttttggtgacttaaacccttggggggggcttcccagctttgcaggccctcctggccttttttgcaggggggacccagggtttgtgtgtgggcaacagcccctgtttttcagcaaaaataaaacagcttcctgtgca

SEQ ID NO: 644540 - DNA, 1026 bp, Homo sapiens
  misc_feature (6)..(6): n is a, c, g, or t
  misc_feature (84)..(84): n is a, c, g, or t
  misc_feature (603)..(603): n is a, c, g, or t
  misc_feature (606)..(606): n is a, c, g, or t
  misc_feature (616)..(616): n is a, c, g, or t
  misc_feature (619)..(619): n is a, c, g, or t
  misc_feature (628)..(628): n is a, c, g, or t
  misc_feature (631)..(631): n is a, c, g, or t
  misc_feature (734)..(734): n is a, c, g, or t
  misc_feature (762)..(762): n is a, c, g, or t
  misc_feature (783)..(783): n is a, c, g, or t
  misc_feature (795)..(797): n is a, c, g, or t
  misc_feature (804)..(805): n is a, c, g, or t
  misc_feature (851)..(851): n is a, c, g, or t
  misc_feature (917)..(917): n is a, c, g, or t
  misc_feature (924)..(924): n is a, c, g, or t
  misc_feature (939)..(939): n is a, c, g, or t
  misc_feature (965)..(965): n is a, c, g, or t
  misc_feature (988)..(988): n is a, c, g, or t
  misc_feature (993)..(993): n is a, c, g, or t
  misc_feature (996)..(997): n is a, c, g, or t
  misc_feature (1000)..(1000): n is a, c, g, or t
  misc_feature (1006)..(1006): n is a, c, g, or t
  misc_feature (1008)..(1008): n is a, c, g, or t
  misc_feature (1022)..(1022): n is a, c, g, or t
tggaanttacatcctctttaaaccctgcctggcaatccctaacgcaccgccgttatgcccatggaaaacagggcgaccttgaantccaactacttccttaaaatcatccaactatttgattattatccgaaatttttcatttttggaacaaacaatttgggctccaaacaaatgcagcaaatccccatttcccttcccgggaaagctgttgtgctgatgggcaaaaacaccatgatgcccaaagccatcccagggcacctggaaaacaacccacctcttgaaaaactcctccctcatatcccggggaattttggcttttttttcaccaaagaggacctcactaaaatcaaggacatttttctggccaataatgtgccaactgctgccctttctggttccatttccccattttaagtcacttttccagcccaaaacactggtctcgggcccgaaaaaacctcctttttccatgctttaagtatcaccactaaaatctccaagggcaccatttaaatcctgattaatttgcaactgatcaagactggagacaaagtgggagccacccaaccacgctgcttaacatgctcaacatctcccccttcnccntggggcgggncanccagcaggnggncgacaagggcagcagcgacaacccggaagggcgggagagcacagaggaaacgcggcaggcgcgcggccgggaggggggccgcaagggggccaagggcgggcgncaaaggggcgacccaacgggggcagcangaccccaggcgagcagcaacngggacaaacgannncgggccnnggcgggggagacggaggacaccggcccacgggcggaaaaaggcaangccggcggggcggagccagcggccgggggggcggcggcccgggggcggcggcaccacaacggcgcngcggcgnggcaccccaacgaanggggaaccaaagaaaagcggagaagnggacaagagaggggagggggggngggangannacnaaaaanancaaggaccaggggngggc

SEQ ID NO: 644541 - DNA, 898 bp, Homo sapiens
tacaaatgaggcaatttattaacccagcagggttggtcctaatgcttctggtgggcagctgccaccggtccgggcgattctggtgccagatctctttggtccctgaggtggtcagtttggcgggccgccatctgggtccttttccaccattttcagcccctccagggcttgggaggacccggggggccaaattctgggagcctcggttggaatgtgggctggggcatagacgccgtttactctgaagtcccccataaattctgggtcatgggagccaaccccagggccaccccggaggtacacggtgccgcgctggggaagcagctcgcgttgtagaaccagttctcatcgtagggagcaagctcttggggctgggccagtttgacggtatccacccattcggggactttcagcttcccggacttttggaggaacggtgcaaagctctgacgaactccggcggggtacacgtctttaccaggtaactccagggcatcgggcgggctaaactggagcatggcattcctggatccaaccagagtgactaaacgcgttggtatcaccaaaaggaaccgccggggaatacccgtggagcccccccgagaaccccacacacacacggaagagacacgatcccaccacgacaccaaccgcacacacccgcagcgcaacaagaaaccatacaaaacaagagcgacaccaatacgacataaagtaatattctaaaaagtactaataggtatcatctgaacaccaaacacagacctcgatagtgcaaaccacaacccaacctcaccacccaaaacacccacgccaatcaccgcagctcttaaaacacagcccactcaccacagacacatacacactatacactaccaatgaaactaataacacgacc

SEQ ID NO: 644542 - DNA, 1249 bp, Homo sapiens
agcgggtgcctggcgcgcccgaggccctgcgggcgctgcgagcccgcggcaagcgcctgggcttcatcaccaacaacagcatcaagacccgcgctgcctacgccgagaacgcttgcttgctgcctgggcttctggctggcccccgctggggcccggcgccagcctggatggtcttctgtgcacgggcctactgcaccgcgctctacctgctgccaagcgccctggccgggcgccccctcgtgccctaagggcctacgtgctgggcaagcccagtacctgagcccagagagagctggaaggaccgtgggccgtcgccagcgatggagcgtgggggccccgaagaccacgtgaaggacagaagggttccccgagacgactgggcatgcagcggacgcccgaatggaagcccgaaacagtgccgcggcggatggatggatgaggctttggaccccggccaccttccagcttaccagttgacaggctcacccaagggccccttgagcgacttacccttgcaaagccaagccccgggcttgcccatagaatccgctggagcaacccacaccatttggaccaacgccgaggtttccagcgctttgaaggaacacgggcacaggctatccaattcagccgggcgggattcaccggatgagcccagacccaccagggggcggcgggacgggaagaagcacctgtgaagcggagtgcaagcgacgacgaggatgaagaagacccaccagcattgcacacatggaacccatttatgagaccaccgaaggatacccacaatggtggacccccccgaccagaagaattaaccacgagaggatggaaatacatagcggaacccaggaagaccacgacgtggaagagaatggaacacagaaacacagaaacagacccacaagggagctaccgaagcatgttcacagttcccggggaaaagagccgcccatagagccacggggctttccaaatgttattacccgggagcagacggctatgattgtataccccccagagggggtcaatgtaacccagtgcaggagattctagcaccgccccccgggaaggccggaccaccccctggcacaaaatttcgcgtttgggcgaggaggaccctagggacccttagggacagaacgccagaacgagtatccctttcacctatacgaggtaggccaccaccacttagtatgtgaacgccttccgacaaacgaacccaagtacaccatggacagccccagta

SEQ ID NO: 644543 - DNA, 402 bp, Homo sapiens
  misc_feature (280)..(280): n is a, c, g, or t
aggatccgagctttaccgcacttatagcagcattacataacagcaaaaaaagaagaaacaatccaaatgcccatcaactgatgaatggatcagcaaaatgtgaaatattcatacaatggaatattttcagctgtaaaaaggaatgaagtgcagatatatactgtagcttggatgaaccttgaaaacattattctaggtaaaagaagccagacactaatggccacatagtgtatgatttcgtttatatgaaatgtccagaataggaaaatccatagagatnaggtagattagtgtttggcaagggcagaggggacgctgggggaatgagagtgactgttaatggatacaggatttctactgggggatgatgaagtgttataaaattgattgcggtaaaagctt

SEQ ID NO: 644544 - DNA, 295 bp, Homo sapiens
gcaggtgagcggcaggggggtggatcgctggtgtcagggtcgggacagcctgggcaacatggtggggccccgcttcctgctgagaatgcgcgcatcggcgcatgcctgtggtcccggctgctcggggggctggggcaggagagtcgcttgaaccggggacttgaggttcagtgagccgagatcgcactgttgtactccagcctgggcgacagagcgggactcccgtctcggagaagaacagaaaacaacatttagcacaagcagagagaggaacttaaaagccacaaggtgagtc

SEQ ID NO: 644545 - DNA, 765 bp, Homo sapiens
  misc_feature (765)..(765): n is a, c, g, or t
ttatcaatttatatttgggatatggagactggaagatgcaaattaggataatacaccaagcagatgatggagtctcctgtccgcagattggagtgcagtggcacgatcctggctcactgcaacctctgcctcttgggttcaagcaactctcctgccccagcctcctcagtagctaggactacaggcctgtgccacaatgcccagctaatttctgtatttttagtagacatggggtttcaccgtattggccaggctggtcttgaactcctgacttcagaattggaaaaatgaatgtaatttgacatatgtcttgagtctggttggcttctgaggaacttgtgtgcatctcatcagtatgcatcttaagaactgaaatgaccctacttcagcattgtgggaagacatgcattctcttcgtataaataatgtggatcttacatgtaaagtattataaagattagctgtttaacaacttaaataagcttgtgaataataaattaataacaatgttatgctaatacgtaactatgatatttgctgaacaaaataaatttgcctactttggaagcagattgggtggtttaatatatcagcaaaagagtgtttttaaaaaatatcaaagttctgttaatcaaaacgtttattgtaggacagttagtaatgttttgtttgccaacttatattacaaagtctctgtcttaagtgtttccttgcaaataaaatgatggcctcgttggcctcagcggtggagctctgcggccggan

SEQ ID NO: 644546 - DNA, 117 bp, Homo sapiens
  misc_feature (112)..(112): n is a, c, g, or t
tggtagcgctcggattaagacagcagctttagcatctctaaagaagtatggcgtggggacttgtggacccagaggattttatggcacatttgatgttcatttggatttggangaccg

SEQ ID NO: 644547 - DNA, 152 bp, Homo sapiens
atgagcatgagttgaggctgggaggaagcagtggtgctgttggggtaggaacagagctgctgtgctcttgctgtgagcgaggttgctgttggggctggtcagcagaaggtgcagcatggaagtgaaggctgcacttgtatggggaagttgtg

SEQ ID NO: 644548 - DNA, 624 bp, Homo sapiens
  misc_feature (624)..(624): n is a, c, g, or t
tcttgctctgttgccctggctggagtgcaatggtatgatcatagctcacagtagccttgaactcctgggcccaagccatcctcctacctcagcaaccagagtagctgggattacaggcgaatgccaccacacctggaattggaaaaatgaatgtaatttgacatatgtcttgagtctggttggcttctgaggaacttgtgtgcatctcatcagtatgcatcttaagaactgaaatgaccctacttcagcattgtgggaagacatgcattctcttcgtataaataatgtggatcttacatgtaaagtattataaagattagctgtttaacaacttaaataagcttgtgaataataaattaataacaatgttatgctaatacgtaactatgatatttgctgaacaaaataaatttgcctactttggaagcagattgggtggtttaatatatcagcaaaagagtgtttttaaaaaatatcaaagttctgttaatcaaaacgtttattgtaggacagttagtaatgttttgtttgccaacttatattacaaagtctctgtcttaagtgtttccttgcaaataaaatgatggcctcgttggcctcagcggtggagctctgcggccggan

SEQ ID NO: 644549 - DNA, 157 bp, Homo sapiens
  misc_feature (152)..(152): n is a, c, g, or t
gtacatgtattatgcttaaataacttatgtcactacgggatgcctgtaatcctttctgaatagcaaagcaggcatctctaaagaagtatggcgtggggacttgtggacccagaggattttatggcacatttgatgttcatttggatttggangaccg

SEQ ID NO: 644550 - DNA, 418 bp, Homo sapiens
  misc_feature (21)..(21): n is a, c, g, or t
  misc_feature (40)..(40): n is a, c, g, or t
  misc_feature (96)..(96): n is a, c, g, or t
  misc_feature (389)..(389): n is a, c, g, or t
  misc_feature (393)..(394): n is a, c, g, or t
  misc_feature (399)..(399): n is a, c, g, or t
gtggtccccaaggttccccgntccttggtccctttccgantggtgccaattttattttccaaccttttggagttgccgtaattgtagaaaaacccngaaaatatccaaatatttcttttaaagaagaaaaatccaggccaggccacagtggctcatgcctgtaatcccaacacactaggctgagtcaggaggctcacttgagtccaggagtttgagaccagcctgggcaacacagtgagactctgtctttacaaaaaataaaaaaaattagctgggcatggtggcaggtgcctgtagtcccagctacttgggaggctgaggtaggaggatctcttggcctgtgaggccaaggctgcagtgagccatgatcacaccactgcactccagtnctgnngagangagcaaggctctgtctcaa

SEQ ID NO: 644551 - DNA, 995 bp, Homo sapiens
  misc_feature (637)..(637): n is a, c, g, or t
ctggcctggagcgcatgggccccgtgatggatctgcattgccacctggcctggagctgcatgtgtgcgccaacaatctggagcggatgggcctggatgcgcatggtgcgccaacagcctcgagcgcatgggcctggatgctgcatgtggtgccaacatgcctcgagctgcatggtgcccctgtcatgggccctgtgcctgggctgctggcattgagctgcatgggcctggccatgggtggctggtggctggtgccagcttttgacctgtgccatcgagatggagcgtggcaacttcggaggaagcttctgcaggttcctatatggtggagcttggactgccatgctcctggggtggccagtgaagtgctgccagatatttcgtgagaaatctgtcattcgatttcacatggcaagatgctaacggacaaattccaacgatgtgcggacacgtgctgtacgccgacatcacgatggacaatgggaacgtccaaggcggtgctggctgctggcatccgcttcgacgtcgccagacgctggccgacgcagcagcctgcccgcgatgaatgacatggcatgaaagctgagttggccgaggagactagacggtccgcaattgactagaccccgccttcagcnggttgccgtaatatccaaaccatcgattacgagaacctcctgacactcggcctagctaccttggtaagccactctccaacttccggagcggctgcgcactgctatacacgcacttcgtcaacaccaacgtccacgcactcgctcacccgagacgacacactcgacactttcacactagcacacaactctgcgcctagcgcaggcataccacaatgagcaccgatactacgcactatgacacttcggcacatgtctgcgaacaacatatcactactcgacgattctaggacacactcgctaagagactcgcgctcacagcctctcgcgaaaccacccatatcccgtccctcgaatgacc

SEQ ID NO: 644552 - DNA, 145 bp, Homo sapiens
cctctctgcggtgcttcagacggctcccctgtggctggcgccgcggtcccgacggacttcacgctgacctgaccttcggcgctggttgttgtgcacccggcgtgctgcgacgtgtgtgcctgcctgccgggtttcctgctgaccc

SEQ ID NO: 644553 - DNA, 438 bp, Homo sapiens
  misc_feature (84)..(84): n is a, c, g, or t
  misc_feature (125)..(125): n is a, c, g, or t
  misc_feature (397)..(400): n is a, c, g, or t
  misc_feature (426)..(426): n is a, c, g, or t
gtgctagtgccgcagaacatcaaaggagctgcaggctggccattagaactcaggtgatttgaggatggaggagttcgttttcantctacatatgttcctaagtatgttcccttggcagacgtcanagtgagaaaatacaaaaaaaagggacgctccattcctgtatggataaaaattttgctgtttgttgttgtggcagtttttttgtgtgtgtttggtctatcaagctatggaaaccaaccatgtaaatcccttctctaatattcttcctgatgactctagaaaacccaactgaatggtatctctttggcacattcaacttggtcttgtatttttagtaactgtgttgaagaacattcgtgtacgctttttgactccaagaactaaaaataatgtnnnnttgcctcaataaacgtagtattccantggaaagccaaa

SEQ ID NO: 644554 - DNA, 759 bp, Homo sapiens
  misc_feature (1)..(1): n is a, c, g, or t
  misc_feature (259)..(259): n is a, c, g, or t
ngaaaaacagggggttctccctcgcgcaagccgccccaactccgcgtggttggaagaggcgcctttttccacgagggcagtacctccacacccctgggcgggggcgcaaccttgtttccgcgggtcttgcgggtcaatcatcatgggatccacaggagcacatgctccaaggagtggggtgtgtcacaatcacacaaagcccactcacgggggcacacacaaaagagcgtctccgtgcgagagcgctgtgcacaacagngctcggccacaatgctcggtgccccccgagacagcccgccttcagagagcgcgctctacactcgcagtatgtatatcgctccctacatgctcctcgcgccccgccccctctcgtagaatcccattggggttggaaaaagacccgcctgttctctcagaccttgtcttggtttgtcaaaacagtggcgccctgattatacatggtatgagttgagcttatacaagaacccgggtgtttatatgaggaacaaccaagggctcttcgttacaaccgcgctccgacgaaggagacagtagaaatatttctttcgggcacccccgttggcgatttctttgattgtggcgtgggcgcccatgtttatatagtcaatgtataggaccgatgataagactccgctacgtgattctatatgcgaggacccatctggcccgcaagaagattgctcgccccagagcaaggtttgagagagcccctgtatacacaaaacgacaaacaaaaca

SEQ ID NO: 644555 - DNA, 856 bp, Homo sapiens
  misc_feature (472)..(472): n is a, c, g, or t
  misc_feature (490)..(491): n is a, c, g, or t
  misc_feature (505)..(505): n is a, c, g, or t
  misc_feature (517)..(517): n is a, c, g, or t
  misc_feature (533)..(533): n is a, c, g, or t
  misc_feature (535)..(535): n is a, c, g, or t
  misc_feature (542)..(542): n is a, c, g, or t
  misc_feature (545)..(546): n is a, c, g, or t
  misc_feature (555)..(555): n is a, c, g, or t
  misc_feature (561)..(561): n is a, c, g, or t
  misc_feature (572)..(572): n is a, c, g, or t
  misc_feature (576)..(576): n is a, c, g, or t
  misc_feature (589)..(590): n is a, c, g, or t
  misc_feature (610)..(610): n is a, c, g, or t
  misc_feature (620)..(620): n is a, c, g, or t
  misc_feature (628)..(629): n is a, c, g, or t
  misc_feature (637)..(637): n is a, c, g, or t
  misc_feature (641)..(641): n is a, c, g, or t
  misc_feature (682)..(682): n is a, c, g, or t
  misc_feature (848)..(848): n is a, c, g, or t
tggagtctgacattagaaagccagcgagaaggaagattcaaacaaccaaccctgatttcctgcttctccttttcatgagtgttcctgtggtctctgcacctcctttctgtcccccggcagagggcagtagagatggccggcccaaggcctcggtggcgcgaccagctgctgttcatgagcatcatagtcctcgtgattgtggtcatctgcctgatgttatacgctcttctctgggaggctggcaacctcactgacctgcccaacctgagaatcggcttctataacttctgcctgtggaatgaggacaccagcaccctacagtgtcaccagttccctgagctggaagccctgggggtgcctcgggttggcctgggcctggccaggcttggcgtgtacgggtccctggtcctcaccctctttgccccccagcctctcctcctagcccagtgcaacagtgatgagagagcgtggncggtgggcagtggggttnncgggtgtgttctcngtgatggtgggnaggggggctgggggcncnttccccnccnngtgtgggantgggtncaggtctaccncccnggggctgggtttnntagtctggggcagcgccagncctttactcncctcttgnntcatagcntggntgtgttccctctgagggctgtagagggctgagagcaagctngagagctgctaaaggcttacgtgattgcaagggttcagttccaaccatggtcagaggtggcacatctgctcagccatctcattttacagctaacgctgatctccagctccagcgatggaaccactacagaggaggtggggcccctgtgtcaaagaggccgaggggnagcaaggg

SEQ ID NO: 644556 - DNA, 289 bp, Homo sapiens
  misc_feature (210)..(211): n is a, c, g, or t
  misc_feature (213)..(213): n is a, c, g, or t
ctgttgttcccatctgcgccggcctccgtcatgaatgccttccgggccgggcggaaggggacgcggcttgtgccttacttaagtcgggggttgtaagggttcgggtggagtttcgaaagctgagaccctcgctacggggtgggggttgtgcacacacaccggtcaccgagacggctggacctgcacgccaccgctgccttttgctgctgnncntggcgaccgccgcagggacggggactggccctccttgcaggtcggtttggtttgttgtaaataaaagtatttaatt

SEQ ID NO: 644557 - DNA, 129 bp, Homo sapiens
gctggctgcgttatctgataacaactctggagatcacaattttaaggattacataatcataacaatattgtttgttctgccgaagatgattaatctgaccaagtgactgaattatcttggggactctcc

SEQ ID NO: 644558 - DNA, 393 bp, Homo sapiens
  misc_feature (86)..(86): n is a, c, g, or t
  misc_feature (153)..(153): n is a, c, g, or t
  misc_feature (159)..(159): n is a, c, g, or t
  misc_feature (177)..(177): n is a, c, g, or t
  misc_feature (183)..(183): n is a, c, g, or t
  misc_feature (214)..(214): n is a, c, g, or t
tcatctgagtcaactgccatgagcggtggtccacatcatcacacaagctcttttggtgagaacttggactcccaatgaacgccggnggtggtgagcctccttctggtgctctctccaaagccatcaacgagagcttcggtagcctcgagaatnccaggnccagatgaacactgctcncgccgntatccagggaagcggctgggcctggctggtncaggacaagcaaactggcagcatcgccatcaagacctacgcggtaagttgatactgggtttctcgtggtggcagagacgtagttacttatccaagtcgcatttcagaaccaggaccccgttgttggacagttcaagcccctccttggtattgatgcttgggagcacgctattatctgaa

SEQ ID NO: 644559 - DNA, 146 bp, Homo sapiens
tacaggtttattactcgggcacattttcttcctagtaattccgcatgcagatccccagtgctgacagtcgtcgtggcactactatcacactgaatcatgaggtcatttccctcctggacctcacagatcccgcgtaccacctcgaa

SEQ ID NO: 644560 - DNA, 100 bp, Homo sapiens
tctggcgtgcacagtgtctaagaaataggttcagactctgttagaagcatcttgtaagagattccgtgctggccaagtttggaaaaacgaggatgcccca

SEQ ID NO: 644561 - DNA, 385 bp, Homo sapiens
cacatggaaattacgggagctacacgatgagatttgggtggagacacagagccaaacttcatcaaatagttcttaaaagccaaagaagcagttaataactttgaagcatttagctaacctagcatttgacctacatgattcagcccacatatttacattttaaagacatttgtattttaccaattatttttaaaacagcctttatttcttaaagattatagtcatgtgaactgaaaaggtattacagcttttatttttcttcaaaaaatatttgatctaagtgcttattttcctagagcttttttatataaacatcacgccataagaaatataaaattacacagatgaacaaaggcaaattcagtacttgtaagatttttcattt

SEQ ID NO: 644562 - DNA, 473 bp, Homo sapiens
  misc_feature (18)..(18): n is a, c, g, or t
  misc_feature (70)..(70): n is a, c, g, or t
  misc_feature (77)..(77): n is a, c, g, or t
  misc_feature (137)..(137): n is a, c, g, or t
  misc_feature (430)..(430): n is a, c, g, or t
  misc_feature (450)..(450): n is a, c, g, or t
  misc_feature (457)..(457): n is a, c, g, or t
aagtaagcagaaggaggngaaattaaaattggagcagaaattcaatgaaattgaaaacaggaaattaaantgggganaattcaatgaaacccaagagttatttctgagaagatcagtaagccctcttaccaagcttnataaaagagaagaccacaaattactaataccagaaacagggcatatctagctgggcatggtggctcacacctgtaatcccagtactttgggaggccgaggcaggtggatcacttgaggccaggagttcaagaccagcctggccaacatggcgaaaccccatctctactaaaaatacaaaaaaaaaaaaaaagccagcgtggtggtgcatgcctataatcccagctactcgggaggctgagacacaagaatggcttgaacctaggaggtggaagtagcactaagccaagatcgnccactgcactccaaccttgngtgcagncaaagctctgtctcag

SEQ ID NO: 644563 - DNA, 137 bp, Homo sapiens
tggacagcacagaaggaggggtcatcctcatgaaaaccagattgcttgtagaggtctgggggtctgtctggtacgtctgtgcgtgtctggtgtaccgagcctcgcaacttcgtaactcatggatcattagcttgttt

SEQ ID NO: 644564 - DNA, 673 bp, Homo sapiens
gcaaagttggttgatggtgaccaagcttgcttcactgccatcagaggatgactatccagtttttgtttaactgtcctatcacggcctctccgtgtcaccccttttgaagagtggccagaacttgaaggtccacttcctctgtaaatatcccagtattaagccccggaacttttaggataaccccgatgcgctttaatttgttgtttaatatgttttgatccccaggacttctagaataaaccccagatgctctttcatattcttttaatacatcttgatccaccagctgggggaaaaaaagctttttaattctataccttcctagtagataagtgaagagccgggaaagagaccctttaaataattttgctataaaaaaatttgtgataagtttctatccaaaatggggagattgccagaaaaggcttcccttggctccccaggaggtgtagccggtgtgagccaatattagtgccctgtgccctttcacaccgggtttgccatttatccagtctgttttcccgatgatgtgtacatgaaagagtaccccatgtgaagagaagagagaatgattgaaaatgttttagtataggactcttcttgccgtgggttgctatttttctagattttactttttagggaaccaaattaaatccccttgttaaaactggga

SEQ ID NO: 644565 - DNA, 720 bp, Homo sapiens
  misc_feature (24)..(24): n is a, c, g, or t
  misc_feature (137)..(138): n is a, c, g, or t
  misc_feature (148)..(148): n is a, c, g, or t
  misc_feature (172)..(172): n is a, c, g, or t
  misc_feature (270)..(270): n is a, c, g, or t
  misc_feature (291)..(291): n is a, c, g, or t
  misc_feature (315)..(315): n is a, c, g, or t
  misc_feature (404)..(404): n is a, c, g, or t
  misc_feature (410)..(410): n is a, c, g, or t
  misc_feature (456)..(456): n is a, c, g, or t
  misc_feature (476)..(476): n is a, c, g, or t
  misc_feature (485)..(485): n is a, c, g, or t
  misc_feature (503)..(503): n is a, c, g, or t
  misc_feature (521)..(521): n is a, c, g, or t
  misc_feature (537)..(537): n is a, c, g, or t
  misc_feature (544)..(544): n is a, c, g, or t
  misc_feature (551)..(551): n is a, c, g, or t
  misc_feature (553)..(553): n is a, c, g, or t
  misc_feature (606)..(606): n is a, c, g, or t
  misc_feature (617)..(617): n is a, c, g, or t
  misc_feature (625)..(625): n is a, c, g, or t
  misc_feature (705)..(705): n is a, c, g, or t
gcctacctcgggggactgtctgtnctcaaaacgggctgagaaggcccgtcagggcccaggtcccacagagaggcctgggatactcccgccaagcccgaggggcagactgggcagttgggagcccccattgtgccccnnaggtgtgtcncaggctgaaggaggggcctgaggnaccgcatgcctgcaacccccagggctgcggttcactaactttttacagaataaaaggaacatggggatggggaaaaaagcaccaggtcaggcagggcntttgggccccagatcccaggngggccagggctcaggatgccagcnccaccctagcagctcccacagctcctggcacaggaggctgccacggattggcacaggccgctgctggccatcacgccacatttggagancttgtnccgacagaggttagcttggaggagctcctcatgggcacacactgtncgaacacagatcttcttgtnaatgacgtncacacggcggaggctgtngaagcagacctcgttganacactgtctgcaaggnctgtctntggagtngnggcgggtgcccgggtactgttcctcacggcagtgaagaggcccaggctctgtnggctccagcgntgcatttnctggttctggggttggggctgggatgacttcctgttggacttgctgctgggactggaactggaactgttcctcggagggncgaggagtgacctct

SEQ ID NO: 644566 - DNA, 572 bp, Homo sapiens
agttccgggtcccccactccgtacggtattttggccattctggccgtagctagaggtgctgggggggttggttaacatgggaactactcagctttctttcagtcaacccataagcaaatcagataacccacggactatgagaattactttatatagataattctggacggtaaaacatttggaccagggttttacaacatgtacataagaatacacataattcaactagagattggaagaatgggctggtctcgttataacaaccacagtacgaaacatttctacttggagagaatttcaactattctcttaatgtggtgtcacatggattaggtaactaaaaagcgcaaatggtgggcaggtttggctggcccatggtcctatgtcttggtgggctgggtggtattttcataaactaaagcggcctatgtttctttttaaagctcgcattcccagaatcagattaggcttctatgaattcagccggtttctaaaagctgaaaatctcagtttacaaatcaaaatgttaacacaaagctaagattcatcagagcccaccctatgctacggac

SEQ ID NO: 644567 - DNA, 640 bp, Homo sapiens
  misc_feature (5)..(5): n is a, c, g, or t
  misc_feature (64)..(64): n is a, c, g, or t
  misc_feature (118)..(118): n is a, c, g, or t
  misc_feature (185)..(185): n is a, c, g, or t
  misc_feature (219)..(219): n is a, c, g, or t
  misc_feature (228)..(228): n is a, c, g, or t
  misc_feature (286)..(286): n is a, c, g, or t
  misc_feature (288)..(288): n is a, c, g, or t
  misc_feature (294)..(295): n is a, c, g, or t
  misc_feature (304)..(304): n is a, c, g, or t
  misc_feature (312)..(312): n is a, c, g, or t
  misc_feature (317)..(317): n is a, c, g, or t
  misc_feature (324)..(324): n is a, c, g, or t
  misc_feature (331)..(333): n is a, c, g, or t
  misc_feature (342)..(342): n is a, c, g, or t
  misc_feature (348)..(348): n is a, c, g, or t
  misc_feature (350)..(350): n is a, c, g, or t
  misc_feature (378)..(378): n is a, c, g, or t
  misc_feature (381)..(381): n is a, c, g, or t
  misc_feature (383)..(383): n is a, c, g, or t
  misc_feature (385)..(385): n is a, c, g, or t
  misc_feature (391)..(392): n is a, c, g, or t
  misc_feature (395)..(395): n is a, c, g, or t
  misc_feature (399)..(399): n is a, c, g, or t
  misc_feature (409)..(410): n is a, c, g, or t
  misc_feature (413)..(414): n is a, c, g, or t
  misc_feature (416)..(416): n is a, c, g, or t
  misc_feature (427)..(427): n is a, c, g, or t
  misc_feature (438)..(438): n is a, c, g, or t
  misc_feature (445)..(445): n is a, c, g, or t
  misc_feature (454)..(455): n is a, c, g, or t
  misc_feature (468)..(468): n is a, c, g, or t
  misc_feature (478)..(478): n is a, c, g, or t
  misc_feature (487)..(488): n is a, c, g, or t
  misc_feature (492)..(492): n is a, c, g, or t
  misc_feature (495)..(495): n is a, c, g, or t
  misc_feature (497)..(497): n is a, c, g, or t
  misc_feature (516)..(516): n is a, c, g, or t
  misc_feature (521)..(521): n is a, c, g, or t
  misc_feature (558)..(558): n is a, c, g, or t
  misc_feature (563)..(563): n is a, c, g, or t
  misc_feature (574)..(574): n is a, c, g, or t
  misc_feature (629)..(629): n is a, c, g, or t
tgacnagttgcatcgcttctttacaatgacttcattttgtcacattagtcttttgctgtcaggnaaacaatctacagtttctctttagatctctcaagaaaaaagaaaagcgaaaggnttgttcttcaagaaaacttcctgtgtgtatcaaattcaaccatattttaaagctattctgactgtgnaaatgagcattattcataagttgccttaaaaaanttcaaggtngtttggtttttaccactgtatcaaatagtacttggcttcctattagggggtgggtttntnataagnngttatgagncattgatnatttntttgggntgcttgnnnctcttttcnccttangngtcactgtttttttcatgtttcatttgntgntngntcctgnnttngggnatggcggctnnttnncntcctcttcctngggttttcttnggctccnagggttgcnnttctcagggcgcngcttgggggnaactgcggnngggnctnanctctcacctcctttcgccncccgnttactcaataaaggtgtaaaaatgctatacaaatatntacanatatatttggncagcatatgtacgtatatatgtatatatattacatacagagttgttaagggagancaaagtcacgc

SEQ ID NO: 644568 - DNA, 806 bp, Homo sapiens
agagctcgcttgtccctgccaagcccgcggatgtccggcctcaggatagctgcactccgacggcttcgctcctccttagccctactgcgcctctgtctggcgcctcaccgttaccgcgggtcggccatgacaagcacatgactaagggctgaagaagtggtcgacccctcggggagcgagatgcgctgagctggtcctgggggccctgcaacccctcagcatgcataggattcgcggtcgtgaggtcttccgacgacgggtcacctgacgggggcaccagaccctagcgcattccggtgcacgggtgcccgtgcaaactggaagtataggagtttggaacctgacctgcaagtacaaagtgttgagaacatggcggtgcagttgtgatgggggcacaggctacacaagagtccgctcaaggcacccttgaagataggcgcgctacaatgcgtctagtgaccaggagaccatccgcgtcaccaagccctgcacccgccaagaccagagagcaaaggcacaaagcgcaagaaacgggaaggcgaataggagcatagatcgccaagccggtgggactgacagaaggaggcccgcatcgcgatgtcactactggggccatggcccacgccctccctgctctcaggccacgagtatgtgacacagccagtgccttctgtctgctcgttagctgtaatcaatcatgccctgccttgtccctctcactcctcagccccacccctaagtgcccaaagtggggagggaaagggattctgggaagctagagcctcccccaagcatggaggcccata

SEQ ID NO: 644569 - DNA, 434 bp, Homo sapiens
ctcggctaactgcaactccacatcctgagttcgaatgattctcctgcctcagcctccccagtagctgggattacaggcgagtgccaccatgcccagctaatttgtattttaagtagagatggggtttctccatgttggtcaggctggtctcatttcttttctcatcatgatggcaaaatgatggtacaactctttttcaaagtaagtcttatgccacctgtagtgtcatttgatctaaatgactttatcttatttagttttattttacccatcacaagaaccatgcatgtacatttatagaaaatcaagacgaacgaacaattaataattcacccatagacctacccaaagacaacaactgtaagagtaagggaccctttctcactagtccgtatttcttttctccatgtagctataagtaaagtacacgtgat

SEQ ID NO: 644570 - DNA, 136 bp, Homo sapiens
attcgcggccactactaataaatttatcattttgaaataaaaatttattgtctttctggcctatggactcagctgtagatgactgaagtcgcttaacaggacggatttaagtggaggtgatatgtccagtcaccgg

SEQ ID NO: 644571 - DNA, 278 bp, Homo sapiens
  misc_feature (16)..(16): n is a, c, g, or t
  misc_feature (273)..(273): n is a, c, g, or t
tgggccttgaacctcnttggcccctcaagcagtccctcccttccctaggccttcccaaagtgctgggattacaggcatgatcccactgagatgatatctcattgtagttttgatttgtaagaagtggaaagttttgatttcagattagtacacactggttttctaacaatgaagaaaacacaaaacctgacatgtggaaagagtcaagccagagagaggggacattagtgatctctggttttcaaatggttcatgaaaaccttcccctttatntgaaa

SEQ ID NO: 644572 - DNA, 142 bp, Homo sapiens
acgcaacgatcgaagtattaatcccagcaagcacaactagcagctgttggagaaattcaaagttcaaggtgaagctgtctcaaagcattcaagaaaacacacagaactcccaactgtcacaagcaggcagagtgtaagcagg

SEQ ID NO: 644573 - DNA, 153 bp, Homo sapiens
taacacgtctcagtaataactgttcaactgattgtgcaatatccccgagaaatatcccaatgggctcattcttcctcagaaggccgataggctactagactctactagtccctaactcttatccacgtgtcactgaaagggtttcccgagcat

SEQ ID NO: 644574 - DNA, 938 bp, Homo sapiens
gcgggacccgcccgcccgcgggagaaatgtgctgaagtgctgctgaaagggccagagatgcaaggattgggatacattttgaacctttaagctgtctgacattgacctcctttcattattaataaagaagaatcaggagcttaggatgtattaacaccaactcattaatatactcaaccggcacaatgttctcacaacaccaaattctcaccattgtaaaaggactggcattggcaccaacaatcaacacatcaattttcattttattccagcttcatacatcatgcacctcgcatggcaggcaacacatttgcatcacagccatgcagcagcaagcaccattccttcttccatggtccgggttcaccagccaatggcacagcttcttgccttagcagctgggccgttggaaggggcaacgtctatgtaaatcacggagactgccgcgctggcgtgtcacttctttgaagctgcagttcaagttggaactgaagacctaaaaacacttagcgctatttacagccagttgggcaatgcttatttctatttgcatgattatgccacaagcattacgaatatcaccatcatgatttaacccttgcaaggactatcggcagaccagctgggggaagcgaaagctagtggtacactctgggaacacacccttaagaagttctcggggaatctgaacgaagccataggttcggtgtccaggcgctccctagtatatttcccgatgagtttactggacctggctgggttgacacgccggaaggccctgcccatcctggggaaccggtgtcctggcctcgcggatcagagtttaggtctgggccgtgcgtctcttggatggttggagtatgttccgtcatacttgatccattttccttttggacaccttgatttcttgtggcacaaccatcattcggcatgcaggg

SEQ ID NO: 644575 - DNA, 743 bp, Homo sapiens
  misc_feature (365)..(365): n is a, c, g, or t
ggtcggtacctactttccacaggataaaaggtttctagctctgttctggctggaaagtgcacgaaagctgagtttaatcaataaataagagttgtagctactaaattcctctccacctggccccagcaaaggatacatttacatctcattccccaaatgtaggacatccaaagaccagaggtcccatgagacgccacttcttcaaatgccgacattttgaagaacacacaccaagatatttccaaagccctgaccacatacgtggtcagggaaaatgcttaaagcttcagctcctttcagaaaagcaaaaatcaaaccagacttatagcactatcggccagtaatggttaagctcacatgatgtncaaggcattcactgggctaggagggagaaataaagaaatagccctgtctgcaaggagcagatgatctcaatatcattataaggcccaaataaatgaattatggtcttagacaagtcaacggctccccacaagatgaaagcacaaggtcacactcaatgaaatagagatgaactgaattcttgtgaggacataggaattcgaaaaggaatggcatcatgagctgggctggctggagacagatttaagctttgaaaactgtggtcaagcagaaaagagataagaggacatacggagagaagtaaaaaggggaagtagaagaagcggcccctgagattccagggaacttggttccaaatggtaggacaagtggccagcggc

SEQ ID NO: 644576 - DNA, 177 bp, Homo sapiens
  misc_feature (63)..(63): n is a, c, g, or t
  misc_feature (94)..(94): n is a, c, g, or t
  misc_feature (135)..(135): n is a, c, g, or t
ctgctaaactaaaagtaaatggaagaaaccaagtctagtaggttttttctttttttttgtggnggtgggatgggggaggttagttacacttaanatatcttctccagagactgtatgctccaatactagactgtnagctctttgagggcagtctgtcagatttatctttgtatcttc

SEQ ID NO: 644577 - DNA, 270 bp, Homo sapiens
accgactggtacccaaagtgctgggattacaggagtgagccaccgtgcctggaccaggttatacttataaactgtacagaccatctcacattgcatccttcgctcatgcactgtaatgttcaatctataccttatctctaccacatcatcttacaagaaccacccaggtggtatgtactcactgacgtatccaccattccccttagacatgatctctctcctctgatttcctgtggtataatcacaacatgcatgataatctttaccaca

SEQ ID NO: 644578 - DNA, 265 bp, Homo sapiens
tgcttgcccgctccagaatctcagttgttcttggagaatcaacgacctcacccatcaattcagagctcaatggaaacaagagcgttacccgaaaataacacaacgccatgtactcaatgaaaaatctaccactttccacagataacaacaaatcaacaacacacaacactctcacctgctaacacgacaagctaaggcgtcagtgaagaatccaccacctcccacagtcgaccattgctcaatgcacacaacatcattccctgac

SEQ ID NO: 644579 - DNA, 152 bp, Homo sapiens
agaaacagagaaatttcaagagaggagaagcagaacactgagagaaaaagctgcagcagaagagcctgctggcagaacagtggtcagatctgctggctcacttggagaacacacacagtgaccacttcataaccctcaggtggtgtgactcg

SEQ ID NO: 644580 - DNA, 144 bp, Homo sapiens
gacccgtctgtggagcgagatgtgtagacagtctctgaacactcactgctttcacataataaccactctagaacatctctgacttacctttacttcctctcccactcccaaggtcgagactgttcgaactacaacgcctcactc

SEQ ID NO: 644581 - DNA, 533 bp, Homo sapiens
  misc_feature (8)..(8): n is a, c, g, or t
  misc_feature (190)..(190): n is a, c, g, or t
  misc_feature (204)..(204): n is a, c, g, or t
  misc_feature (297)..(297): n is a, c, g, or t
  misc_feature (313)..(313): n is a, c, g, or t
  misc_feature (351)..(351): n is a, c, g, or t
  misc_feature (394)..(394): n is a, c, g, or t
  misc_feature (426)..(426): n is a, c, g, or t
  misc_feature (521)..(521): n is a, c, g, or t
aaggcttncaatgacattgaatacattttcaagaaattaatatgaaacattaaaatttacttcaaaaatccaaagttttctagatcattcccatctcacgctgctttagaggtcagtccacacctgctgtgtccagatgagcggctggaatgctgaacactgccgtgttccagccctaacgctgggcgcnggtccctctctccnaagcccacggctgggcttcccctgtccccagggtcatggcggacttcaagccagggcggctgcccagaatcacactcagggtttttggacgcncaagtgcacagaggcngaggtgcccagacgagggtgagcggggagagagaggcntgggagaacgtgcccaggctgggccagggggctgcgggaagcncctgacgggcagaggagaacgtgtggggcctnccttatcgatctccagcagaggagggcaactgcgtgtgccaaactcagagagcagtgactcaaaaaaaagaaaacagggcagcagtgaccagganaacagggtccga

SEQ ID NO: 644582 - DNA, 762 bp, Homo sapiens
  misc_feature (271)..(271): n is a, c, g, or t
  misc_feature (378)..(378): n is a, c, g, or t
  misc_feature (408)..(408): n is a, c, g, or t
gattcaatcttgcctatttggtacagcgaagggaatgagactctgggaagatctagatgacctgggcccgtcgttatcgcatatgatatttgctagcctctctgctgacgagtacacctataaccatggccttgccgtccgcttatagatgactagaaactagaatttcgtgcacacaacccacgtagatctcttatagatagttatcgagctgggtaagagggcagtttactaacagcagtaacctggattccagtcgaacgtgttcgtntagtgctgctgcaggtttgtcgccctggagtgcaatccttacaaatacattcggtattgaccgttatttaacagcgcatactagttaacataacgtgttactttgtntggcaactctaacaccaccgtattgcgtanctttactttgggcatgtcaagttatatacgtgacattctaatagagaggcgcttgtaatttcatccgaaaaatctcgtcattaatcagaggtgttaagaatgcatatgactcaagggtcgtatagacatttggcaaatctattttcgaatgataccctagtggtgatcagtggcgttctaaacttctaatctttgggatttaggcattaaagaattttctattgtgatacaatgctctgggaatagacacctgcgcatagtataatatcaggtcattattctttgggaaccgtggatttggaacgtcctgaaaggaaccttatacattattcttgtggttgtgctttactagag

SEQ ID NO: 644583 - DNA, 338 bp, Homo sapiens
  misc_feature (22)..(22): n is a, c, g, or t
  misc_feature (237)..(237): n is a, c, g, or t
  misc_feature (274)..(274): n is a, c, g, or t
  misc_feature (280)..(280): n is a, c, g, or t
atgagatggaatctagctcttncgcccaggatggagtgcagtggcgcgatctctgatcactgcaacctccgcctcccgggttcaagtgactctccagcctcagcttccagagtagctgaaactacaggtgagtgccaccacgcccggctaattttgtttgtatttttttagtagagacagggtttcacagtgttagccaggatggtctcgacctcctgacctcgtgatccgcccgtntcggcctcccaaagtgatgggattagaggcgtgacanccgtgnacggcggaaaacgagatttttagatcaactttacatgccaatgcccatggtatttcct

SEQ ID NO: 644584 - DNA, 492 bp, Homo sapiens
  misc_feature (111)..(111): n is a, c, g, or t
  misc_feature (119)..(119): n is a, c, g, or t
  misc_feature (139)..(139): n is a, c, g, or t
atccattgtggacacatgtgcctctcctatcagagactgctatccagacattcatcttccacctaaaaatgcacttctgctgttgactgcaggccaatgttcccaggatanacagggtnacatccaactgtacttgccncaacttgcctttggggatcaagaaggaagttcccccgggtgggtggtagaactggaagtagtgtcacaggccatgggctcttttgcatttctcttactgtctctcacttggcctgaatgatttatcacacgatcagttgcaactgccaaagtttgggagcactacattgatgtgaagttctggagacaaaaagggacacaaacagataaaggtagagaagacaaaagggtgaaagagagggctaacgactgggagaaagagagcagaaaaaaaaagaaaaagtcgacgcggccgcgaatttagtagtcatgggcgggcggtctagagggaccacgcttacttacccgtgcatg

SEQ ID NO: 644585 - DNA, 291 bp, Homo sapiens
  misc_feature (13)..(14): n is a, c, g, or t
  misc_feature (46)..(46): n is a, c, g, or t
  misc_feature (54)..(54): n is a, c, g, or t
  misc_feature (88)..(88): n is a, c, g, or t
  misc_feature (97)..(97): n is a, c, g, or t
  misc_feature (111)..(111): n is a, c, g, or t
  misc_feature (153)..(153): n is a, c, g, or t
  misc_feature (160)..(160): n is a, c, g, or t
  misc_feature (164)..(164): n is a, c, g, or t
  misc_feature (175)..(175): n is a, c, g, or t
  misc_feature (180)..(180): n is a, c, g, or t
  misc_feature (208)..(208): n is a, c, g, or t
  misc_feature (218)..(218): n is a, c, g, or t
  misc_feature (224)..(224): n is a, c, g, or t
  misc_feature (243)..(243): n is a, c, g, or t
  misc_feature (248)..(248): n is a, c, g, or t
  misc_feature (258)..(258): n is a, c, g, or t
ttaaatcagagtnnctatcaactgattcagcgttttgttgttttgntcttggcnataatacttgtggcgcatgaagaattatgttganaaacagganaaattccacatgcnttttatttcccagtgagttgtataaactttatttttgttgangggtgtntgtnaaatcaatgtnagcantgcttatatcacttcttgagaaggaagntccgatttgnaattgnatcatttccttcaaaatgnagggnagtgcttagntaaataaaagattgatgatatcttttaagccag

SEQ ID NO: 644586 - DNA, 261 bp, Homo sapiens
attctgtgcctttctaggcccagtctactctggaggctgaggtgggagaattgctttagcacaggtagttgggatgctgcagttagcttatatcgcaccattgtactccttcctgggctacagaccaagatccggaagctcagtgagatactcaggaatacagacggactatactgtgaaatgagaaatgctatccaggatatatgatgagacattttccaaaaatagcttataaggaaaaaatgcaaactgaattttctg

SEQ ID NO: 644587 - DNA, 201 bp, Homo sapiens
  misc_feature (51)..(51): n is a, c, g, or t
ccttcccggtttttcaaaaagggggccccgtggggaagtccgtgggccccncaaaatgttttttgggttccgcccccccccccccccccggggggtgggggtggggggttcccggggggggggttttttttggtttcccaaccctttagccctttttgggggggccggggaaccccccattaattttttttttggcccgga

SEQ ID NO: 644588 - DNA, 445 bp, Homo sapiens
cgggtgtgcagacaatatagcagtggtgcatctcggctcacgcagctcaagcttccggttccagtgatcctcccacctcagcctcccaagtagcgtggaaccacaggagggtaacaccacaaccagctgattttgtattttaggtagaggtggggtttcactacgttccccaggctggtcttgaactcttgaactcaagtgatccacctgcgctggcctcccaaagtgctgggattacccgcctgagccactgcggccagtccagtgggcagtgttttcttttttttcttttttcttttttttttttggagagggagtctcattctgtgtggcccgggtgggagtgcagggccgcaatggtcgggctcacagccacctcggcctcgggtgtacaggcgatcccgggcaacagcctccaaggcagcgggggtaacgggaccaacaa

SEQ ID NO: 644589 - DNA, 291 bp, Homo sapiens
gtttcccctctgaacaggctgaggagtgcttcttggtgtcaataactgaggcaaagtaaaattgttttttccctttcaacatgaccaattttctaagactgaatatagaactggaaatctgcagggtgtgtttcttttgcggcaacggtagccaaggttactgctttgagttggtctgcagggacagaggattaaaatttactgtctataaacagaagaaggcctaaagccagagctcctttatttccagcttgtgtcatggttttataaaatgaaggacccttaccacaa

SEQ ID NO: 644590 - DNA, 856 bp, Homo sapiens
  misc_feature (15)..(15): n is a, c, g, or t
  misc_feature (80)..(80): n is a, c, g, or t
  misc_feature (88)..(89): n is a, c, g, or t
  misc_feature (98)..(99): n is a, c, g, or t
  misc_feature (104)..(104): n is a, c, g, or t
  misc_feature (121)..(121): n is a, c, g, or t
  misc_feature (152)..(152): n is a, c, g, or t
  misc_feature (158)..(158): n is a, c, g, or t
  misc_feature (161)..(161): n is a, c, g, or t
  misc_feature (165)..(165): n is a, c, g, or t
  misc_feature (179)..(179): n is a, c, g, or t
  misc_feature (183)..(183): n is a, c, g, or t
  misc_feature (185)..(186): n is a, c, g, or t
  misc_feature (188)..(188): n is a, c, g, or t
  misc_feature (203)..(203): n is a, c, g, or t
  misc_feature (206)..(206): n is a, c, g, or t
  misc_feature (208)..(208): n is a, c, g, or t
  misc_feature (211)..(211): n is a, c, g, or t
  misc_feature (214)..(214): n is a, c, g, or t
  misc_feature (216)..(216): n is a, c, g, or t
  misc_feature (219)..(219): n is a, c, g, or t
  misc_feature (222)..(223): n is a, c, g, or t
  misc_feature (225)..(225): n is a, c, g, or t
  misc_feature (229)..(230): n is a, c, g, or t
  misc_feature (233)..(233): n is a, c, g, or t
  misc_feature (235)..(236): n is a, c, g, or t
  misc_feature (239)..(240): n is a, c, g, or t
  misc_feature (242)..(242): n is a, c, g, or t
  misc_feature (244)..(246): n is a, c, g, or t
  misc_feature (248)..(249): n is a, c, g, or t
  misc_feature (253)..(253): n is a, c, g, or t
  misc_feature (259)..(262): n is a, c, g, or t
  misc_feature (264)..(266): n is a, c, g, or t
  misc_feature (271)..(272): n is a, c, g, or t
  misc_feature (274)..(274): n is a, c, g, or t
  misc_feature (278)..(278): n is a, c, g, or t
  misc_feature (280)..(281): n is a, c, g, or t
  misc_feature (283)..(283): n is a, c, g, or t
  misc_feature (289)..(289): n is a, c, g, or t
  misc_feature (291)..(291): n is a, c, g, or t
  misc_feature (293)..(294): n is a, c, g, or t
  misc_feature (296)..(296): n is a, c, g, or t
  misc_feature (305)..(305): n is a, c, g, or t
  misc_feature (346)..(346): n is a, c, g, or t
  misc_feature (349)..(349): n is a, c, g, or t
  misc_feature (352)..(352): n is a, c, g, or t
  misc_feature (356)..(356): n is a, c, g, or t
  misc_feature (358)..(358): n is a, c, g, or t
  misc_feature (366)..(366): n is a, c, g, or t
  misc_feature (384)..(384): n is a, c, g, or t
  misc_feature (386)..(386): n is a, c, g, or t
  misc_feature (391)..(392): n is a, c, g, or t
  misc_feature (400)..(400): n is a, c, g, or t
  misc_feature (409)..(409): n is a, c, g, or t
  misc_feature (414)..(414): n is a, c, g, or t
  misc_feature (416)..(417): n is a, c, g, or t
  misc_feature (422)..(422): n is a, c, g, or t
  misc_feature (431)..(431): n is a, c, g, or t
  misc_feature (440)..(440): n is a, c, g, or t
  misc_feature (442)..(442): n is a, c, g, or t
  misc_feature (449)..(449): n is a, c, g, or t
  misc_feature (455)..(455): n is a, c, g, or t
  misc_feature (457)..(458): n is a, c, g, or t
  misc_feature (461)..(461): n is a, c, g, or t
  misc_feature (467)..(467): n is a, c, g, or t
  misc_feature (478)..(478): n is a, c, g, or t
  misc_feature (480)..(480): n is a, c, g, or t
  misc_feature (482)..(482): n is a, c, g, or t
  misc_feature (484)..(485): n is a, c, g, or t
  misc_feature (490)..(490): n is a, c, g, or t
  misc_feature (494)..(494): n is a, c, g, or t
  misc_feature (497)..(497): n is a, c, g, or t
  misc_feature (499)..(499): n is a, c, g, or t
  misc_feature (501)..(501): n is a, c, g, or t
  misc_feature (521)..(522): n is a, c, g, or t
  misc_feature (667)..(667): n is a, c, g, or t
  misc_feature (669)..(669): n is a, c, g, or t
  misc_feature (759)..(759): n is a, c, g, or t
  misc_feature (834)..(834): n is a, c, g, or t
accgcagcggcggcnacggctactgggacggcggcggggccgcgggcgctgaggggccggcgccggcggggacactgagncccgcgcnnctcttcagnnccggnacctacgagcgcctggngctgctgcagggctccattgggctgctgggngaaggnaanaacntgctggtgctcgtnctcnannanaagttcaagaggctncgnantcncantnaantcnncntggnnaanannagnntnannnanntgcnggtgtnnnncnnnggggnnancttnanntncgtgtncngnntnaagaacggntgggtgtgggaaaccagtagggaagcgtgtgggaagggttnaanggnagcntnttcgaatnattgtgaggaaaaaatananaaaannaaagtaanaaaaatttnaaaanannaaaanaaaaagganaaaaaaagnanaaaaaanaaaaanannttnctggtntgtaggatgcntnananngaaanaagnatnangntggttaaaagtaaaggtcanntggaaactccaacaatatctatagtatcgtacctctttgctaaatcgaacactgtatacaatccagtgatttatgtcttcatgatcagaaagtttcgaagatcccttttgcagcttctgtgcctccgactgctgaggtgccagangnctgctaaagacctaccagcagctggaagtgaaatgcagatcagacccattgtgatgtcacagaaagatggggacaggccaaagaaaaaantgactttcaactcttcttccatcatttttatcatcaccagtgatgaatcactgtcagttgacgacagcgacaaancaatgggtccaagttgatgtaa

SEQ ID NO: 644591 - DNA, 111 bp, Homo sapiens
gaggaccgaggaatggcgcctgttgtgcagaccctgcctcgctcacgcccccacgcacctggtctgactgctgctcaatggggtccgcctggaggtcctcctctgtgctgt

SEQ ID NO: 644592 - DNA, 1687 bp, Homo sapiens
  misc_feature (158)..(158): n is a, c, g, or t
  misc_feature (335)..(335): n is a, c, g, or t
  misc_feature (939)..(939): n is a, c, g, or t
  misc_feature (1440)..(1440): n is a, c, g, or t
  misc_feature (1477)..(1477): n is a, c, g, or t
gagttcggagcgcgcgccctgagccgcgcgtggcctgggagggaggctccggaggacggcactcgctagttcttggtctggtgaggcagacggcggtgtccgtggtccggagccggtcatcggcatcctgggctccgggccccgagtctccgtacgtncaggtgctctgcggccggtcgccagacgggacagatcgaggctcgtgagaactgcccgaggcagtccgtctcctggaagttcgtagtgcccgaatgaccacacacgatgttggcggcgcgtgtctaggtcaagaaggacgcactcgaatcggatctataatcacgcaggggatcggntagggactcctaaatgctctgttcatcacgcgtcgcccagacttgatcgcgaaatcaacgcatcagtcagtgagagtcctatggtgcacttggcgcgtgtctcttccttctgcgacgagcacatgacagagattctgtatgacaccccacttgagtcgaccgcgggattggcattaacataacagggacgcgagctcgtctctgtgccaacaggaccgaccaaccaaaggcggttttcccccacttgggccccaatttctcgctctagccctaagtccagcgtgcgccatgtttagccccagtagaagccccccattggattcgggcgcctggcattgttcgccatgtttttccaccgatggggcgtatcgcgcagacgggagggccgtggtgggactcgaccccccggacaacgcaaacctcgggggagaagaagctgcgctctctcaaagttcaccatggtgttcccgaagagccgcttctcctcccttatcttacggcctccgcgcgccgtgttgtacgggaccaccgccgtggggcgttcatttctgtggagcgccggttccattatccccagttcacttacgggcgcccccaaaggggncccccgccaaccggaggcctggccttttggcccatttttggggggcctttttcctggaaagccgaggggggcccttggcctttggggcggaggggcccctacgtcagcgattggaacccttttgttggtgttacccggcggcattgccatctttacccgccctccgaggagtagcgcgcttggagtgggcgcttcccccatttgaaggcttcctatcccgcctggaattggcgccggtgccccccccccaatgggggtggcttcccccttggatatagaggcaacaagaaacggttcggcctcctttgcgaggttgggggcacctcctgcgaagcggttaagcgaccaatttggtataccctgtcaccttttgcgcaccccctttgtggggcttcaaaaactatactcttctccttctcccaagagaagccaccaaaaggcgcgcgcgggaaagagtatgggaacaacccattgtggtgagacaaaaaccccgcggctgtntgggtggaacacacggcacagacacaggattaatacngcagcgtcttggtcacaccgaggcggaccacggaaacacttccttttttgtgtgggagaccgatgagccccggagaataggtcctttgtgagaggataaaacccattatgtagagaggctttatactgcgcctacgtaaaatattcgcacctttgtcgagccccgcatttctgttgtgtgtgacaaacagcggaccgtcacacagttgag

SEQ ID NO: 644593 - DNA, 228 bp, Homo sapiens
ggtcccccgcaggtgcggatatggacgtaggcttcatgcgactggctgacctcctgaatggcgatattttgatgccaggcgacgcgggctgcgccatcaggcaggcgctctggtgcccctcgccgacgctttcgagcgtcggtttcacctcggcgcacaccgctctggcgtgcgggcagcggccgcccctctttttctcgctcgcctggaccgtatttaaatgagacg

SEQ ID NO: 644594 - DNA, 104 bp, Homo sapiens
tattttccacagggtaaactatgatttaattttgatagccctgactcagcagcagaactagtacggtaggaaaaacgtatgtttgacgccctatgtaataactc

SEQ ID NO: 644595 - DNA, 640 bp, Homo sapiens
gagaatggctgtaagctggaagcggataatatgtagtgcactatgtacaatccactatcgtagtaattgaactgaattcgtgatttccttgagaatcgaaccttggttccctatccctaattgatgacgaggctcgctgctcggatggtgtgtacaaactcacctgaatgggtactttatttagacagatcttcatgaccatgttcgcgcaccgccagttgcatcatcatctcttgttacaccaatacaggtactgcagggtcgtggtaatctgtatctttcgtgccatttaggggtggagaaggtggatgtgatgacgccaataattcaggacttattaccttcttgtgtagtgtctatttatttggcaccttgcgaccatgagttatgacagataggactgtccaggagctccagcgtatagagcttggagacgtgtctgtgtgattgtaatcacttggtggctacattcagaatctaatatgggacttctgtcgtattctacaccactcagattcgtattatatagcagttaaactgggtacactgttacgagtcttccatttagccggaatcagatcctccccttgcaatatgctgtaattaacaatcacttagaaaagttgactctatatgaaac

SEQ ID NO: 644596 - DNA, 407 bp, Homo sapiens
cgtcgacgcgacacctggcacaggatagctttgtcaatgatatattttgtggcaagatctctgtgatgccctccaaggcatggttggtacctttgccacattattccagaagttttgaagcctggagtcctccagagaccacccagtctgtgcccttgtcctgaagggcatcctccctctgctgtctctgctggctactacattcctgggggatttctcccttgtgagtcagtgtggtgcacctgactgtataggtgtgtgcttctgtgtgtataagtgtgtgtgcctgtgtctgtgtatgtgtgtgtgcctgtgcccgtgcgtgtgtgtgtgtgcctgtgtatatgtgtgtgtctgtgtatgtgcctatatatgtgtgcatgtatgtataagcctgtggtcgacgc

SEQ ID NO: 644597 - DNA, 1236 bp, Homo sapiens
gctggccctgagcgggaatctgcagtggccgaggctgagcggcagtgcggatctgccccgaccctcactcctggcgtctgagtctctggcgtagcccatgctgagtgggctgggctggtcctgggtctggtctccatggctaggcctgcagttgtgtttgtgccagtgcagctgcggggatcctggggccatcgtgtccgtgtgtgagagtctgtccattctgcacgaagttgtgagtgaggccctgagccccgaggtgctagagcttcgcaacgagagcggtgtgcacgcgtgtccctgcctgggacagtgagactcacttcctgcgtggctgtgtgtgagctactcggtttctgacggtgactgagcccccacatacaagcgactagccggacatggttccacgacaggcgctgtgccagagggagcttgggaggtccgtgtccatgcgctgggcccatccaggcacggacccccgaccagtggagagagaactcgtcagctggaccactagccccgccaattgccatgggtgggaacaaggaaaacctctaggaaaccccctgaaccccaaagagagggaggaccaggatccgaatgggctgggtgagcacgaattacccgaggtccttccctttggatacagtcccaggatttgtaagggatgaaagagcccgtggagcgcccaattctgcttgggcgtacaatacagtactactccgaagtactagcaacacttgcgtatacagtgttcaacagatgatacccgatgcagaaatgagcacggccatcgagcgtcacgtaacttgctcttgtgccccttggtaccgtatttccaggacacgtggccacgccgggactgtatccgaatgttacaaactcgcgtgaacagaacttcgaaccaggacacgtgcatggaggttgtgaacacacatcctaatagcccatttaaacgggtaaaaagctaaaacagtttatcacacacaaagacaacgacgacgaaaacaagcgcacataggctagctgagacacaagatgtgggccgggtcggcatgatcatgtgagagcgctacaggcaggagaggagacgagccccgcgcgcaccgctggccccctactgtaggcatgggcacacgctagtgcggatgggagggcggcagcgcaagagaaggaaagcccacggacgatggctagcggtagtaaccaacagacgacagcaggtgacccccgggtcac

SEQ ID NO: 644598 - DNA, 85 bp, Homo sapiens
caagccccctccaccccccactcagtgcctccacatgctgcctggcacagaccaggcctttgacaaataaatgttcaatggataa

SEQ ID NO: 644599 - DNA, 1550 bp, Homo sapiens
cggacgcgtgggtcatcttttgctcattcactttctaggttctatatgctattctccttacgtaagcgttaaatagatcctttaatttgataggttcagttagtttgtgcttaattcgttgctttccaatatgcattcgttattgtagctatttagtattacaacagattggcagtacagaggtcaagtatcgtatatttactgtttgtgatcttgtcttaactatgattcaatgatatggctcgatacttcttgtggaacacttatcgagttctaaggtacagatatgtcatcaaaggtggtcagtgaacatctatgaagtagttataagttcagtaccatacatcagcaagatatagtcatatcaaccaacatcgttctattagggtataaatcttgtactactcacgtattggccgaggcattgcattaagtttattcaccaaggtagcaaaggagcacccaacactgatgtaactggtaccgtagtaatcttctgatggagcaatagaagaagctcgccctggagcaagagcgtcttcaccgtatgagagaaaacaatacacagagaaacaataatagaagcacaagcaccaatacaagacaacaagaaagaaagaagaagcgacatgatacatcaaagcaacacaaagaccacaacgaaaaagcacatcgataagcgcgcatgcaataggcgaggacagacaattacacagaaaaaaaccaacaaccacaaccagagacaacatacccgagataagatatacccaggaccacgagaagagacaatacagaaaagcacaagagacacacaaaagcaacatagagagaaagaaaagcaaaaaagagaaaccagcccagataccgtgacgagaccaccacacaagagaacaaagagaaacaaagacaggagcaaagagacagaagaacaaagagaagagagaagaaaaaacaacaaaaagcaacctagtaaaagaacaaatgaaagaagcaagaaacgaaaataaaaaacgtcgtctagctacccgggagaagaaaagaggaagacagagaaagggagcaagaaagaaggaggcagagatcgaaacagaggaataaggtaaaacgcagagccaaaaatagaaaagggagacaatataaagataacgcagaagacagaaaagagagcgtagccgaagaaagcaaaggagagacaaacaacaaggacagtaaggaagagacgaaaaagacaagatcagaagagacatagaaacatagcgaagccaaatcggaaaacaaacggggagcagagtaggaaagactcgcagagaggagacgagaacgtagaaaagagagaggaagaaaggagaaggagaaaagacaaagaacaaaaggggggcagaaatagaagaagagaagcggaacaagaaagggagagcgacaggaaagaaagcaaacagacgaacgcaggagcagcaagaaggaagaaagaggtaaacaggaacaaatggagaagataagaagagaggacaagaagacgaagcagagaaagacaaaagacgaaagaaagt

SEQ ID NO: 644600 - DNA, 207 bp, Homo sapiens
cttctgccaagattgtaagttcctgaggcctccccagaagccgagcagatgccagcatcatgctttctgtacagcctgcagaaccgtgagccaattaaaactgttttcttgactgactgtgctgctacaatctccatgttgagtccaagtactgagagaggatgtcctgtatcagttcgttctcacaccgctataaagaaatacctg

SEQ ID NO: 644601 - DNA, 479 bp, Homo sapiens
taaggttgagggggaatgctggaaatggtaatgggtatggagacatatcatataagtaatgctagggtgagtggtaggaagttttccataggaggtgtatgacgtgggtcgtagcggaactcgggggtatgctgtctcgaattcataagaacagggaggttacaagtaggggtctgggtgacacaaaatatgttgtgtcagagtctcaggggacgagtgcgtcatatgttgttcctaggaagattgtagtggtgagggtgtcatatatacataactgtaaggggtatacggagatatgaacgaaatagggcgaaaggggcctgacggcgtatacgatgtagcaccccgagactagtacggactaccccatcggaaaggcacgaagggagatccggcagggcctatgaaacatgtggacataaacatcactatcaagggccaagagaacaatgaatggcaggaagaacaccagagcgtgc

SEQ ID NO: 644602 - DNA, 433 bp, Homo sapiens
ctctcgggagtcagaatgtctgagtggtatgtagaagaatgaatcctttcgagaaggtttctcgatttactttgcctcagatccatcaactgtagtcttacgaaatatatttcttaaataatcagacttgaaagtgaaatttattccttgacccaagggctgcagaatgaaagatgccttagcaggcatgaaagtaatattaactaccttgaacatctccatcagtctagggtgaggatgtgcattgtcaatgggcagtaatattttaaaagaaatctttcttttcctgagtagtaagtctcaacagtgggcttaaaatatttcagtaaaccatgctgtaaacaaatatggtgtgactcaggcttaatagtaccacttataggacacaggcagagtagatttagcctaattctaagcagccctaacatcatca

SEQ ID NO: 644603 - DNA, 923 bp, Homo sapiens
ggctggtcggtcgtctttgagctgcgaatgcgcgtgccggcggtttgcgggcgcgcggggcgggtgcccacccagcgctcgttgcggggttgggccgcctcccggtattgggggcgcctgtgggggggcattatggtctgggtggcgatttgcgaagggggaccgttcccgcatagtctcgggcgggacgcggggtcggtttcccttcggggcgagtgttgcggacgccccttcggcgcctctaggccggcgtggccgccttggggatctacgagaggcgttgtgtaactggcgtgattatctctgcgctcttggcccgccacgtatacgtccgcgtgtccaggtggtttcagggtgggtgatacctcgctggacatgtgatagattcgcgggagcacggagaccccttgagaggactggtatgttcgcttaggcgccacgtcatgcgcacgactgctcaattaggctatgagctctctaacagggggtctcagggcctcgcttgtgtctgccgctctaggtcagggacggtatttgccaacctggttggaggcgccgtttggggctgccccgtttgtctggagtcatctgggggtcttccgtagggtcgtccctcgacccatcgtggtcgctccatgggatggcgtgtcgaggagctgtactcagccgtggaggttctgtcccctggctctgtatcaggcacctttattaaagctgggcctcatgtggcggatgtgtttgtctcctgctcattctggagcctcggaaaggaaacgggcttcaggaggagctctgtgaggctggacgggaccagatggaggaggccaagcagctagccattgcacactggggtgatgggtgcgggcggtgactgccaccagacttgtttaacacgatttacagtataaacatcgtggggtgcg

SEQ ID NO: 644604 - DNA, 1753 bp, Homo sapiens
ggccatcatggcggcggccagaggcctgcccggctcccggaagcaggctgtgaggggcgggagcgctgctggaacccgagccggagccggagccacagcggggagggtggcctggcggcctggagccggacgtgtccggggcgtccccgcagaccggggcagcaggtcgtccgggggcccaccatgctggtgactgcctaccttgcttttgtaggcctcctggcctcctgcctggggctggaactgtcaagatgccgggctaaaccccctggaagggcctgcagcaatccctccttccttcggtttcaactggacttctatcaggtctacttcctggccctggcagctgattggcttcaggccccctacctctataaactctaccagcattactacttcctggaaggtcaaattgccatcctctatgtctgtggccttgcctctacagtcctctttggcctagtggcctcctcccttgtggattggctgggtcgcaagaattcttgtgtcctcttctccctgacttactcactatgctgcttaaccaaactctctcaagactactttgtgctgctagtggggcgagcacttggtgggctgtccacagccctgctcttctcagccttcgaggcctggtatatccatgagcacgtggaacggcatgacttccctgctgagtggatcccagctacctttgctcgagctgccttctggaaccatgtgctggctgtagtggcaggtgtggcagctgaggctgtagccagctggatagggctggggcctgtagcgccctttgtggctgccatccctctcctggctctggcaggggccttggcccttcgaaactggggggagaactatgaccggcagcgtgccttctcaaggacctgtgctggaggcctgcgctgccctcctgtcggaccgccgcgtgctgctgttgggcaccatacaagctctatttgagagtgtcatcttcatctttgtcttcctctggacacctgtgctggacccacacggggcccctctgggcattatcttctccagcttcatggcagccagcctgcttggctcttccctgtaccgtatcgccacctccaagaggtaccaccttcagcccatgcacctgctgtcccttgctgtgctcatcgtcgtcttctctctcttcatgttgactttctctaccagcccaggccaggagagtccggtggagtccttcatagcctttctacttattgagttggcttgtggattatactttcccagcatgagcttcctacggagaaaggtgatccctgagacagagcaggctggtgtactcaactggttccgggtacctctgcactcactggcttgcctagggctccttgtcctccatgacagtgatcgaaaaacaggcactcggaatatgttcagcatttgctctgctgtcatggtgatggctctgctggcagtggtgggactcttcaccgtggtaaggcatgatgctgagctgcgggtaccttcacctactgaggagccctatgcccctgagctgtaaccccactccaggacaagatagctgggacagactcttgaattccagctatccgggattgtacagatctctctgtgactgactttgtgactgtcctgtggtttctcctgccattgctttgtgtttgggaggacatgatgggggtgatggactggaaagaaggtgccaaaagttccctctgtgttactcccatttagaaaataaacacttttaaatgat

SEQ ID NO: 644605 - DNA, 432 bp, Homo sapiens
  misc_feature (136)..(136): n is a, c, g, or t
agtatataattcagtgaattttgtcaaatgtatagtcatgtaattaccacccaccacaatcttatatataacatttctatcacctaaaaatttccattttcccctttgtagtcaatcccttgcccccacttctacncccctggcaaccattgatctgctttttgtcacttttgttttgtcttttctagaatttcaaataatcagaatcagatatagtcttttgcgtccagcttctttcacttaacgtaatacttttgcggtactgatattgttacatgtattagtcgttagttcctgttttacttttcagtatttgcattgtatggtcatgccacagtttgttaattcacttattggttgatggacatttgagttattttcagttttcttttgcggttatgaataaaggtactatgaacatatgtatataag

SEQ ID NO: 644606 - DNA, 102 bp, Homo sapiens
cctagggcatccttattaaactctctgtagtctctagggaacacccaatgacaacagaggatattaacattaggataccacaggtaaagtttaacttctgct

SEQ ID NO: 644607 - DNA, 2558 bp, Homo sapiens
  misc_feature (1764)..(1766): n is a, c, g, or t
  misc_feature (1769)..(1774): n is a, c, g, or t
  misc_feature (1776)..(1778): n is a, c, g, or t
  misc_feature (2147)..(2147): n is a, c, g, or t
ggccatcatggcggcggccagaggcctgcccggctcccggaagcaggctgtgaggggcgggagcgctgctggaacccgagccggagccggagccacagcggggagggtggcctggcggcctggagccggacgtgtccggggcgtccccgcagaccggggcagcaggtcgtccgggggcccaccatgctggtgactgcctaccttgcttttgtaggcctcctggcctcctgcctggggctggaactgtcaagatgccgggctaaaccccctggaagggcctgcagcaatccctccttccttcggtttcaactggacttctatcaggtctacttcctggccctggcagctgattggcttcaggccccctacctctataaactctaccagcattactacttcctggaaggtcaaattgccatcctctatgtctgtggccttgcctctacagtcctctttggcctagtggcctcctcccttgtggattggctgggtcgcaagaattcttgtgtcctcttctccctgacttactcactatgctgcttaaccaaactctctcaagactactttgtgctgctagtggggcgagcacttggtgggctgtccacagccctgctcttctcagccttcgaggcctggtatatccatgagcacgtggaacggcatgacttccctgctgagtggatcccagctacctttgctcgagctgccttctggaaccatgtgctggctgtagtggcaggtgtggcagctgaggctgtagccagctggatagggctggggcctgtagcgccctttgtggctgccatccctctcctggctctggcaggggccttggcccttcgaaactggggggagaactatgaccggcagcgtgccttctcaaggacctgtgctggaggcctgcgctgccctcctgtcggaccgccgcgtgctgctgttgggcaccatacaagctctatttgagagtgtcatcttcatctttgtcttcctctggacacctgtgctggacccacacggggcccctctgggcattatcttctccagcttcatggcagccagcctgcttggctcttccctgtaccgtatcgccacctccaagaggtaccaccttcagcccatgcacctgctgtcccttgctgtgctcatcgtcgtcttctctctcttcatgttgactttctctaccagcccaggccaggagagtccggtggagtccttcatagcctttctacttattgagttggcttgtggattatactttcccagcatgagcttcctacggagaaaggtgatccctgagacagagcaggctggtgtactcaactggttccgggtacctctgcactcactggcttgcctagggctccttgtcctccatgacagtgatcgaaaaacaggcactcggaatatgttcagcatttgctctgctgtcatggtgatggctctgctggcagtggtgggactcttcaccgtggtaaggcatgatgctgagctgcgggtaccttcacctactgaggagccctatgcccctgagctgtaaccccactccaggacaagatagctgggacagactcttgaattccagctatccgggattgtacagatctctctgtgactgactttgtgactgtcctgtggtttctcctgccattgctttgtgtttgggaggacatgatgggggtgatggactggaaagaaggtgccaaaagttccctctgtgttactcccatttagaaaataaacacttttaaatgatcaaaaaaaaannnaannnnnnannnaaaaactttttcgcccccccggccccccaaaaacttttcaaacccttccgtgttgggcgcgcgccgtcgggcgccgctttagtgtgtacgtgtacgacctgtggcgccataacgctgtgttcccatgaggagaacaccccgggcgcctaagcgacataaggtgcgctcgggtcttctcccccaatataaaaaaccgcccgggggggcaaccccggacgctgtcttgagaaccaatctccccgagagagggggagacctccccgagagagggcaccacaaaccgcggcgacatccctatctcacacacggggagagttcctcgaaggcggagagctccgcgaaatattccaaaaaatatacgccccgccngccctcgcgggggggaaccagccgcgcaccgaccggcggacgaccacagcacccgaaacacaaggaaccaacacacacagcagcagacaagggcacgacggaaccgagacaccgggacgaggacgcagcgaggaagcacgagagacacaggaagcagaagggcgcagaaggaggcaggggaaccgccgggcaagggcaggggcaaacggaccagagcacagacggaacgcacggagagcgcgcagaacggaggagcacgcaccacaccaggagagcaggagcgaggaggagcagaacaggaaggcgtcgggcgaagggaaggcaacgagagacggatcgccaagaggagagagcgggaggagagaagagggcgagagcagcggggacgcggacgggggcggacgaagcccc

SEQ ID NO: 644608 - DNA, 761 bp, Homo sapiens
taggtttgagggggaatgctggaaatggtaaggggtatggaaacttgtcatataagtaatgctagggtgagtggtaggaagtttttcataggaggtgtatgatgggccgtacggaaccgggggtatgctgtccgaattcataagaacagggaggttagcaagtagggtctgggggacaaaatatgtggtgtagagttcaggggagagtgcgtcatatgtggtcctaggaagatggtagcggtgagggtgtcctatcatcataatgtggtgtatcggtatgaagaatagggcgaaggggcctgcggcgtatcgatgtagaagcctgaggattagttcggactcccctttgggccaaggctcgaagggggtcggtgggcactcggcataggtggtggaagataaatacatattagtgcaagggtcatgatggaaggagtaatcagaggtgtaacttggtgtaggaccaaggcgggaagaaggtcaacaggagcacctctctacaagtgtctgatagtaccacggatcggcgtcggaggacatacatacatgacacctgttggccgctactttcacagacaaatgcgacagaaacacggaccatcataggacacctagaaagtcaacaccttgtaccacacgacttgcgctccacagcgtatcgcagaccgtcgctacaacaatacagcacacagcataagcgcacagggcatagactaggcaaagaccaaaaacaccacaagctaacaacacctcggaaccaa

SEQ ID NO: 644609 - DNA, 2273 bp, Homo sapiens
  misc_feature (399)..(399): n is a, c, g, or t
  misc_feature (463)..(463): n is a, c, g, or t
  misc_feature (465)..(465): n is a, c, g, or t
  misc_feature (467)..(467): n is a, c, g, or t
  misc_feature (498)..(498): n is a, c, g, or t
  misc_feature (517)..(517): n is a, c, g, or t
  misc_feature (526)..(526): n is a, c, g, or t
gaacatagatgggagggagaggagcaggggatgaagtcagaggagtggcagagggtcagaggacagagggtcttgtaggccattataaatacttcggcttttacccttagtgagatgggaagtcatggaggctcttgaggagatgatacggaagctgtagagaggttaaatagtttttccaaggtaaaacagcttgtaagtggcagacaggtagggaattaagctccaaggctgaagttcttaaccccatgctgccactgaactttagccttctttatttgggcattgctatcctgtgacttcaaagaaactgggacactgggaagttatgcggttgcccaagccacacagctggtgtctggaccatactggcttctcttgcatggaggtcactgcagngggagaggaggcaaaccaaggagaccttctcggcttcgggcagcggtgctgttccttaggaagntncnacccttggctctaccggactgcgggcatctntcccgagcactgcacggangaaaagaanattggcacttatttcagggtggcccctcaggcatccaagagccagaggagcaggtgtcacgggatggcagcgagcgaggccaggccaggagaagcaaccgcagcctcctatggtcgccccttcccgacccaccccaggcgtcaggagttccgcgcccgggtcgtccgggggcccaccatgctggtgactgcctaccttgcttttgtaggcctcctggcctcctgcctggggctggaactgtcaagatgccgggctaaaccccctggaagggcctgcagcaatccctccttccttcggtttcaactggacttctatcaggtctacttcctggccctggcagctgattggcttcaggccccctacctctataaactctaccagcattactacttcctggaaggtcaaattgccatcctctatgtctgtggccttgcctctacagtcctctttggcctagtggcctcctcccttgtggattggctgggtcgcaagaattcttgtgtcctcttctccctgacttactcactatgctgcttaaccaaactctctcaagactactttgtgctgctagtggggcgagcacttggtgggctgtccacagccctgctcttctcagccttcgaggcctggtatatccatgagcacgtggaacggcatgacttccctgctgagtggatcccagctacctttgctcgagctgccttctggaaccatgtgctggctgtagtggcaggtgtggcagctgaggctgtagccagctggatagggctggggcctgtagcgccctttgtggctgccatccctctcctggctctggcaggggccttggcccttcgaaactggggggagaactatgaccggcagcgtgccttctcaaggacctgtgctggaggcctgcgctgccctcctgtcggaccgccgcgtgctgctgttgggcaccatacaagctctatttgagagtgtcatcttcatctttgtcttcctctggacacctgtgctggacccacacggggcccctctgggcattatcttctccagcttcatggcagccagcctgcttggctcttccctgtaccgtatcgccacctccaagaggtaccaccttcagcccatgcacctgctgtcccttgctgtgctcatcgtcgtcttctctctcttcatgttgactttctctaccagcccaggccaggagagtccggtggagtccttcatagcctttctacttattgagttggcttgtggattatactttcccagcatgagcttcctacggagaaaggtgatccctgagacagagcaggctggtgtactcaactggttccgggtacctctgcactcactggcttgcctagggctccttgtcctccatgacagtgatcgaaaaacaggcactcggaatatgttcagcatttgctctgctgtcatggtgatggctctgctggcagtggtgggactcttcaccgtggtaaggcatgatgctgagctgcgggtaccttcacctactgaggagccctatgcccctgagctgtaaccccactccaggacaagatagctgggacagactcttgaattccagctatccgggattgtacagatctctctgtgactgactttgtgactgtcctgtggtttctcctgccattgctttgtgtttgggaggacatgatgggggtgatggactggaaagaaggtgccaaaagttccctctgtgttactcccatttagaaaataaacacttttaaatgat

SEQ ID NO: 644610 - DNA, 152 bp, Homo sapiens
aagaagatgttgctccacattctcctctcctgaagctgagtgcattttgacagaaagagataatcaaggatcagctacattctgagtgcacttaatcaaggtatgcaaataatgagcatcttccgcaattactttagatgaggttgaactct

SEQ ID NO: 644611 - DNA, 1979 bp, Homo sapiens
  misc_feature (1)..(2): n is a, c, g, or t
  misc_feature (15)..(15): n is a, c, g, or t
  misc_feature (1185)..(1187): n is a, c, g, or t
  misc_feature (1190)..(1195): n is a, c, g, or t
  misc_feature (1197)..(1199): n is a, c, g, or t
  misc_feature (1568)..(1568): n is a, c, g, or t
nnttgcgaccagcanccaaagggaggaggccactaggcaaagaggatgtagaggcaaggcacagacatagaggatggcaatttgaccttccctgctgagtggatcccagctacctttgctcgagctgccttctggaaccatgtgctggctgtagtggcaggtgtggcagctgaggctgtagccagctggatagggctggggcctgtagcgccctttgtggctgccatccctctcctggctctggcaggggccttggcccttcgaaactggggggagaactatgaccggcagcgtgccttctcaaggacctgtgctggaggcctgcgctgccctcctgtcggaccgccgcgtgctgctgttgggcaccatacaagctctatttgagagtgtcatcttcatctttgtcttcctctggacacctgtgctggacccacacggggcccctctgggcattatcttctccagcttcatggcagccagcctgcttggctcttccctgtaccgtatcgccacctccaagaggtaccaccttcagcccatgcacctgctgtcccttgctgtgctcatcgtcgtcttctctctcttcatgttgactttctctaccagcccaggccaggagagtccggtggagtccttcatagcctttctacttattgagttggcttgtggattatactttcccagcatgagcttcctacggagaaaggtgatccctgagacagagcaggctggtgtactcaactggttccgggtacctctgcactcactggcttgcctagggctccttgtcctccatgacagtgatcgaaaaacaggcactcggaatatgttcagcatttgctctgctgtcatggtgatggctctgctggcagtggtgggactcttcaccgtggtaaggcatgatgctgagctgcgggtaccttcacctactgaggagccctatgcccctgagctgtaaccccactccaggacaagatagctgggacagactcttgaattccagctatccgggattgtacagatctctctgtgactgactttgtgactgtcctgtggtttctcctgccattgctttgtgtttgggaggacatgatgggggtgatggactggaaagaaggtgccaaaagttccctctgtgttactcccatttagaaaataaacacttttaaatgatcaaaaaaaaannnaannnnnnannnaaaaactttttcgcccccccggccccccaaaaacttttcaaacccttccgtgttgggcgcgcgccgtcgggcgccgctttagtgtgtacgtgtacgacctgtggcgccataacgctgtgttcccatgaggagaacaccccgggcgcctaagcgacataaggtgcgctcgggtcttctcccccaatataaaaaaccgcccgggggggcaaccccggacgctgtcttgagaaccaatctccccgagagagggggagacctccccgagagagggcaccacaaaccgcggcgacatccctatctcacacacggggagagttcctcgaaggcggagagctccgcgaaatattccaaaaaatatacgccccgccngccctcgcgggggggaaccagccgcgcaccgaccggcggacgaccacagcacccgaaacacaaggaaccaacacacacagcagcagacaagggcacgacggaaccgagacaccgggacgaggacgcagcgaggaagcacgagagacacaggaagcagaagggcgcagaaggaggcaggggaaccgccgggcaagggcaggggcaaacggaccagagcacagacggaacgcacggagagcgcgcagaacggaggagcacgcaccacaccaggagagcaggagcgaggaggagcagaacaggaaggcgtcgggcgaagggaaggcaacgagagacggatcgccaagaggagagagcgggaggagagaagagggcgagagcagcggggacgcggacgggggcggacgaagcccc

SEQ ID NO: 644612 - DNA, 2253 bp, Homo sapiens
  misc_feature (399)..(399): n is a, c, g, or t
  misc_feature (463)..(463): n is a, c, g, or t
  misc_feature (465)..(465): n is a, c, g, or t
  misc_feature (467)..(467): n is a, c, g, or t
  misc_feature (498)..(498): n is a, c, g, or t
  misc_feature (517)..(517): n is a, c, g, or t
  misc_feature (526)..(526): n is a, c, g, or t
  misc_feature (1459)..(1461): n is a, c, g, or t
  misc_feature (1464)..(1469): n is a, c, g, or t
  misc_feature (1471)..(1473): n is a, c, g, or t
  misc_feature (1842)..(1842): n is a, c, g, or t
gaacatagatgggagggagaggagcaggggatgaagtcagaggagtggcagagggtcagaggacagagggtcttgtaggccattataaatacttcggcttttacccttagtgagatgggaagtcatggaggctcttgaggagatgatacggaagctgtagagaggttaaatagtttttccaaggtaaaacagcttgtaagtggcagacaggtagggaattaagctccaaggctgaagttcttaaccccatgctgccactgaactttagccttctttatttgggcattgctatcctgtgacttcaaagaaactgggacactgggaagttatgcggttgcccaagccacacagctggtgtctggaccatactggcttctcttgcatggaggtcactgcagngggagaggaggcaaaccaaggagaccttctcggcttcgggcagcggtgctgttccttaggaagntncnacccttggctctaccggactgcgggcatctntcccgagcactgcacggangaaaagaanattggccttcgaaactggggggagaactatgaccggcagcgtgccttctcaaggacctgtgctggaggcctgcgctgccctcctgtcggaccgccgcgtgctgctgttgggcaccatacaagctctatttgagagtgtcatcttcatctttgtcttcctctggacacctgtgctggacccacacggggcccctctgggcattatcttctccagcttcatggcagccagcctgcttggctcttccctgtaccgtatcgccacctccaagaggtaccaccttcagcccatgcacctgctgtcccttgctgtgctcatcgtcgtcttctctctcttcatgttgactttctctaccagcccaggccaggagagtccggtggagtccttcatagcctttctacttattgagttggcttgtggattatactttcccagcatgagcttcctacggagaaaggtgatccctgagacagagcaggctggtgtactcaactggttccgggtacctctgcactcactggcttgcctagggctccttgtcctccatgacagtgatcgaaaaacaggcactcggaatatgttcagcatttgctctgctgtcatggtgatggctctgctggcagtggtgggactcttcaccgtggtaaggcatgatgctgagctgcgggtaccttcacctactgaggagccctatgcccctgagctgtaaccccactccaggacaagatagctgggacagactcttgaattccagctatccgggattgtacagatctctctgtgactgactttgtgactgtcctgtggtttctcctgccattgctttgtgtttgggaggacatgatgggggtgatggactggaaagaaggtgccaaaagttccctctgtgttactcccatttagaaaataaacacttttaaatgatcaaaaaaaaannnaannnnnnannnaaaaactttttcgcccccccggccccccaaaaacttttcaaacccttccgtgttgggcgcgcgccgtcgggcgccgctttagtgtgtacgtgtacgacctgtggcgccataacgctgtgttcccatgaggagaacaccccgggcgcctaagcgacataaggtgcgctcgggtcttctcccccaatataaaaaaccgcccgggggggcaaccccggacgctgtcttgagaaccaatctccccgagagagggggagacctccccgagagagggcaccacaaaccgcggcgacatccctatctcacacacggggagagttcctcgaaggcggagagctccgcgaaatattccaaaaaatatacgccccgccngccctcgcgggggggaaccagccgcgcaccgaccggcggacgaccacagcacccgaaacacaaggaaccaacacacacagcagcagacaagggcacgacggaaccgagacaccgggacgaggacgcagcgaggaagcacgagagacacaggaagcagaagggcgcagaaggaggcaggggaaccgccgggcaagggcaggggcaaacggaccagagcacagacggaacgcacggagagcgcgcagaacggaggagcacgcaccacaccaggagagcaggagcgaggaggagcagaacaggaaggcgtcgggcgaagggaaggcaacgagagacggatcgccaagaggagagagcgggaggagagaagagggcgagagcagcggggacgcggacgggggcggacgaagcccc

SEQ ID NO: 644613 - DNA, 133 bp, Homo sapiens
gtatatatcggctccagcgataggcgcgcagcatctcggtgcgtccggctcccaccagacccgccaggcccaacacttcgccggcgtgcaagtcgaacgcgagatctatggatatgccattttcgcggactga

SEQ ID NO: 644614 - DNA, 213 bp, Homo sapiens
aaatgaaaattggagaatgcagcatggatcagaactcatgccttcccataaaggcctttacacatgttttatcgatatgagtatccaatcacagcatatacagaaaagcattggacttattgtatgacatcatagtatggctctcgtgactaagcgcttctctcttaatgtctccgcgaacagctcaaactggactacaagccacgagataag

SEQ ID NO: 644615 - DNA, 325 bp, Homo sapiens
  misc_feature (309)..(309): n is a, c, g, or t
caggtggatcatgaggtcaggagatcgagaccatcctggctaacacggtgaaacctcgtctccactaaaaataccaaaaaaatagctgggcatggtggcatgcgcctgtagtcccctgtagtcccagctactcgggaggctaaggcaggagaatcgtttgaaccagggaggcagaggttgcagtgagccgagatcatgtcactgcattccagcctgggcaacagaggaagactctgtcttcaaaaaaataacagaaaagaattttcacttttggcaaaattatctttttttactgcacccttaagtgtntgacacaaaaggaatt

SEQ ID NO: 644616 - DNA, 100 bp, Homo sapiens
cacatctgctgggatagtacttgccgcagtactcttaaaactaggcggctatggtataatacgcctcacactcattctcaaccccctgataatgtgatag

SEQ ID NO: 644617 - DNA, 430 bp, Homo sapiens
aaaatctttttttttccattttgttctgtttgggggcttctgttttgtttggcgaaagaacgatggcttccgtggggagtactggggagccctcccggcaaacagggtgggggggacttgggggcatgccgggccctcactctttcgcctgttttgtgtttcacaagctttttctttcaaaattgggatccttccatgttgagccagccaaagaagatagcgagattttaatttttgccaaaaaaaaaaaaaaacttaaaaattaaaaacccaaagagcaaagcagaacttataaaattatatatatatatattaaaaagtctctatttttccccccccagccttcctgaacctgcctctttgaggataaagcaattcattttttccccccctcggccctcttgtttttaaaataaacttttaaaaagga

SEQ ID NO: 644618 - DNA, 332 bp, Homo sapiens
gcctctcagatttcagttttggacattgcacaactaaaaccttttaaacgcatttgcttgctaactcggaagacacatagtttgcagcaagacattcctatattgaaaaaatgagagaaaattttatgctgcctcaggtggagagcaaggctcaacggtggttgcattagttccctcggaagtattgaaaaaacttttaaatggaaaaaaatttttgcccctatgttttgaggaccaaatgtttgggtttttttttttgcattaaataaatgatcatgctcagtgtaacaaagggaattaaaagtttttccccagtccccttttaggggaga

SEQ ID NO: 644619 - DNA, 731 bp, Homo sapiens
aatcagcaaatgtttatttccaaagaggaattacattttcaaaggataaaagttaataggagtcatagtgctcaaaaaccacacgatataggaaaacctaccccactccaccaaagggcacatcttgctttgaacacttgatttcatattaacagttcatgagttattcaaagcaggggaatctcctgcaggttgggaaatatcctagtgcttttcatagccttccatgtcatggatcagggacacacacttgtgcacatgtgtgcacagacacaaaacagagagaatgcttaacaggagcacattttacaaaagtgagatcccaggcctggaaaatcccaaactcttataaattttacaaatccaaaatggaatattcaaaaagaactcaacctgtttctcttgagtaacttttcagactctcattacaggccccatgaggtcagtcagatttctgttctacaggatactgcaaaaagagaccagaaatttaaaaaggagtgatggtaccacacaaaatagtaaaaatgaaatagagaaggtgtgaagttagatccttgatttatgtgtggaaagctagtgccaagaatattgttatgggcctggtcctagaggcaagattgttagcaaaaactgtctctaaatatttatgctcagataataatgctaataattccggatcccagtgggattttggatcagggtagtaattaggaattggggcaaaatgg

SEQ ID NO: 644620 - DNA, 441 bp, Homo sapiens
tgagtagaggcggcagagtagtaagggtttgagaggggggaataaagaacggttaagggctacaaaaatacaattagataggaggaataagatctagtgttcggtagcacaataggacaaccagagttaaaaataatttattgtgtatttcaaaatcactaaagagtagaactggaatgttcccaacacaaagaaatgataaatgcttgaagtgatggatatcccaataactctatttgatcattatacattgcatgtctgcatcaaaatatcacatgtaccccatatatatgtgcaactattatatatccacaataatgaagtttctttggtgcttttttggttttggtttttgagaaggagtttcactcttgtggcccaggcttgagtgcaatggcgcgatcttggcttactgcaacctccacctcccaggttcaagtg

SEQ ID NO: 644621 - DNA, 767 bp, Homo sapiens
gtggcttgcggtggaggagggccgaggccatctacggcaacatgaagcaagttcatccgttacctcatctcttccaatgttggcgaggtcgtcgtgcatcttcctcacggcaattctgggcctgcccgaagccctgaatccctgctgcagttgctctgggtgaacctggtggactgacgggcgtacctgccacggctctggagcttcatacccagtgcagacctggtacatcatggcagaagctgccccggagtcccccgatcaagccctcatcagtggtctggctcttcttccgatacctgtgctatcggagtgtacgtatgcctggccactgtggactgccgccagcctggtggtttgtgtatgactgccgagggacctcacgatcaacttctaccagctgaggaacttcctgaagtgctccgaagacaagcccgcatctttgccggcatcgactgtgaggtgttctgagtcacgcttccccaccatgcatggccttgtccgtgctcgtgacctattgagcactgtgccctgccctctacagcgtctcggagaaccattcgctgctgcggatgccgccctggtatgaagccctggtctgcgtggtggctgtggcatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtaccttgtcc

SEQ ID NO: 644622 - DNA, 464 bp, Homo sapiens
ccccggaaaaccccccttttaaaaagggggtttttggaaaaccaaaaaaaaaaaaaaattcccccggggggggccccgggggggcccccccaaaaacccccccccgggggggaagatttgggggcccccggggcccccccccccccccaaaaaaggccggggggggggggggggggccccccccccccccagggggggggggggggggagaaccccccctggggggggggccccccccccggggggggcccccccccccccccaggccggggggggaggggcctgggcccccccccccctaaaagggaataaactgtgggggaaagaaagaaggggggaaacaaaaaaacttgggggagaaaaaaaagcgcccccccccccccaagagggccacatataaaaagcccccccgggggacccccccgccccccctcttttttgggggactcccccggggcggggga

SEQ ID NO: 644623 - DNA, 231 bp, Homo sapiens
  misc_feature (35)..(35): n is a, c, g, or t
gaaataagaaaaaagaaaaaaaaaaaatcactgantgcaggtcaccctaacagatataataatgaaaaagtctgagatgttgcgagaattaccaaaatgtgatgcagacacgaaatgagcatgtgctgttggaaaagtggaacagatagacttgctggagacagggttgccacaaagtttcaatttgtaaaaaatgtgatatctatgaaatgcaataaagtgaagtccaat

SEQ ID NO: 644624 - DNA, 583 bp, Homo sapiens
ggagtgccagaacaatatcactagcactggtgatacactccaaaggaatgaggagcactccaagtctctgcctctgactactggatgtgaggttgtcctccattcccaggtaccgaccccatcttcagtaaaaagggcaccagtccagacacaagctgagcaactaaaatagacaagcagtacctccagaaccgtgcctctaaacaggcttccaaccatccaaaatgcagaagatgccagcgcagacggcaagttgcttccacgtggcatgaaactgtccagtgtattagtgatacggaacattctaggctagtatccagtcaggccatacatctctgagttagagcaaaacctgaagtccctctgctatgttaatgctgcaccaggaagcataacgtgaggaaactgtactgtcccagtctgtgagggtctcccatacaaagtttcagaagatcggctcaggactaaaagctctagcactcacattcttaccctgggggaacaaaagtataatgcccaaggcacagtgtacctttgttgggtgggctggtacagatggggatggcagaactcaaaataccag

SEQ ID NO: 644625 - DNA, 320 bp, Homo sapiens
  misc_feature (19)..(19): n is a, c, g, or t
  misc_feature (21)..(21): n is a, c, g, or t
  misc_feature (135)..(135): n is a, c, g, or t
  misc_feature (137)..(137): n is a, c, g, or t
  misc_feature (139)..(139): n is a, c, g, or t
tcctgaaggggccagatgngnctgagctcagagcatcctccagggacttgtgatagtcctccttataggcctcactgatggcccggatttcagcattggtccgagaggccagtggtggaataagagttttttcancngngccggctccctccatggccttcttccactgcctggcatcgtaatgggcccccggcatcatgagccccagaatcagccttgccaggtctccagagatctcagacttcaggtcagtcattaagtcccggccaaagtgagacttgaaggtctgccggatctgctgccgctggacattgctgcgg

SEQ ID NO: 644626 - DNA, 108 bp, Homo sapiens
  misc_feature (95)..(95): n is a, c, g, or t
cagctctctctgatgttggcaggactcactggtcgcacttgcaggacagccagctcaggctgaagctccatagccactgctctgggcccgggccnctcgagcactcag

SEQ ID NO: 644627 - DNA, 161 bp, Homo sapiens
cgtctgcttactaaagttcccctgcatgctcaggagggtctgtacggctatttacacccctgaaggacaggagacccccagttgtaccccactcatcttatttcctaagcatctgaggtcagaattgggggaggacagtatgaatgagcatggcaaaagcg

SEQ ID NO: 644628 - DNA, 264 bp, Homo sapiens
catcctggataacacggagaaaccccgtctctactaaaaatacaaaaaaattagccgggcgtgggtggctgggcatcttgtagtcccaacttactctgggagtgctgcagcatggagaactggcatagaaccctgggaggctggatctatgcatatgatgccaatgatcactgccacttgcactccatgcctgtggctgacagaactgatgactcctatctcaaacaaaaaaaaaaggaacccaagggatattagaactaaaac

SEQ ID NO: 644629 - DNA, 322 bp, Homo sapiens
gaggtgtcctggtcaccgtttcaccatcatgctttgatgttcccctgtgtttccctcttcggctctcaagagcaaaggttcatttaaggccaaagaggtagtcactgccaactaatctgtccttgtctttaccttccttctctttttcagcgcaggcattccacgtccgtgtacagcaccgtgtttgggagtgtttttccgtgagccggactctcgggtccttgctgggtgagtgcaatccctccccttgctcttgtgaaaacactttgagcgctttaacagactagcctgagataatattaaatttcttttttattcaaaa

SEQ ID NO: 644630 - DNA, 125 bp, Homo sapiens
acgctgcacctggtgtcaaaccacgcccttccatcaccacccctgtcatcacaacctggactcccatattccagaagaagagcaggaacatcgagccaaatatgtggtataattctattaaaata

SEQ ID NO: 644631 - DNA, 913 bp, Homo sapiens
gtatagtcattccggcctccgaccatgaagtccaccggcactcttgcccttcctggtgctgctagccctggagcaactctggcactctcgcaggactgtggaaggctctggaaacggtaccttcaaaaggcactgtagtctgtcactcctacatgaaatactggtccagagacttaggattgacgaccaaaatctgagtgccaggaaatgacctggcatgatgtaccagcggaaccaagaagatgtcgtaccatgatacgcttgatgcccttcaaacttgcctggcaatacctgctgtggcaagtcgcacagtaagcctccatacatgagggacgcgaaagcgcgtgcgtgacatgatgcaccaggtgagcttactgggccatgagtgtgttgagtgcgttaaccctccctcaatgttctcttggtgacgactggatggctatgttgccaatctgttgagtggaacgttggttgcgactgggcaccttgtgtgcggaaaactcctgcagtattccctcgtgttcggaccacgtctctgatctcttcgttggcccatgcttgtgacggcagggccttctggcggatgctcaccttgtcgtcctcgtcgctggctcccacgggttctgcgtttgtgccaccccttgcacgtacgtttgggtctcccaatgcaaacttgtagtattccgtgccctccacggggggaacaccggtgtttgcggtagctatcaaggccactgggctttttgcaagcaaagatgctcaggtttgactccggctgtatactaaataaaagagcgaaagccctaaattttcggcggtttccaagaaggacacgttgacaccggcatagccaatccataccattacctcttggggggcccaccgtgtaggggcgccttgcagagggagattg

SEQ ID NO: 644632 - DNA, 452 bp, Homo sapiens
tttcattacgctgtatgaactgagaaatatttgtttcaaccaaagcagtaataaattttgaaaaataaaattcaaaatattttatcataactagttgtaaactatgaaggataagattgattcagagattaagaggagtgtaatagaagtagagtatgtctgaaaagagatgtactatagataatacagacttgggaattttggtttctgtttgtaaagaacacttttctttgacaattaagttctgagtagatgagaaaattttgagattcagcagataactagaagttgtagtttgggggtgcttgaacttttaagtctctgtagtaatttttgctataaccagaaattttcagaagtattccaaagggttgggagcaaataaaattatttaaggaatttgagaaaatattatggttttatatgggtctagagtgaaaccaaacagtctt

SEQ ID NO: 644633 - DNA, 143 bp, Homo sapiens
ggcttgtccctccaggcagagtgcggagccttaccccacagcgctgagccctgagctggcctcagccctgggaggagccttccttttccagagagactctgcacacagctcttccatggctccctggccttcacctacctcaa

SEQ ID NO: 644634 - DNA, 184 bp, Homo sapiens
tagacgtgaaagaagaatgtcattacatggagaatgcaaagcaagcaatggagaagctaaccctagagcgttttattcaaaagttgagcgatctgtataggatcttgaaaagggcatatgattggaagggggctctggcaagcagccgtgtgaagcatgttaatgactgaagtgacaaacggga

SEQ ID NO: 644635 - DNA, 337 bp, Homo sapiens
  misc_feature (55)..(55): n is a, c, g, or t
tttgacacaaccattcaatcaacacatcaattcagcacccatatcaggtcagcantcacatcacacagcacatcacaacagggcagccagcattccaacatcacaaccactacagccagcaaatgcaccacaggggcgcatcattcattcaaccacatcaccagcaacatcaccacacaatcacactcatccagcatcacatcattcatggccaccaccttcttcatcgccaccatcacacactcagcacacacatcttcagcacagcacacatggcatcacacattgttgttcaacaccactatcaccagaccgtcgcaccacagcacatgcacat

SEQ ID NO: 644636 - DNA, 230 bp, Homo sapiens
acctcctaccccacgggatgctgtgtgctccccaatgcatatggatgtgcctgtggaatatatataatttttgagacagggtgttgcagtgttgcctggctggagagcagtggcgcgatcacagctcactgtagcctcaaactctcaggctcaagccatgctcccacctcagccttccgagtggctgggactatagactacaggtgcataccactatgcctggctaatat

SEQ ID NO: 644637 - DNA, 764 bp, Homo sapiens
  misc_feature (16)..(16): n is a, c, g, or t
  misc_feature (76)..(76): n is a, c, g, or t
  misc_feature (79)..(79): n is a, c, g, or t
  misc_feature (82)..(82): n is a, c, g, or t
  misc_feature (99)..(99): n is a, c, g, or t
  misc_feature (109)..(109): n is a, c, g, or t
  misc_feature (114)..(114): n is a, c, g, or t
  misc_feature (121)..(122): n is a, c, g, or t
  misc_feature (124)..(124): n is a, c, g, or t
  misc_feature (146)..(146): n is a, c, g, or t
  misc_feature (148)..(148): n is a, c, g, or t
  misc_feature (160)..(160): n is a, c, g, or t
  misc_feature (175)..(175): n is a, c, g, or t
  misc_feature (272)..(272): n is a, c, g, or t
  misc_feature (392)..(392): n is a, c, g, or t
  misc_feature (398)..(398): n is a, c, g, or t
  misc_feature (414)..(414): n is a, c, g, or t
  misc_feature (416)..(416): n is a, c, g, or t
  misc_feature (430)..(431): n is a, c, g, or t
  misc_feature (433)..(433): n is a, c, g, or t
  misc_feature (505)..(505): n is a, c, g, or t
  misc_feature (518)..(518): n is a, c, g, or t
  misc_feature (521)..(521): n is a, c, g, or t
  misc_feature (525)..(525): n is a, c, g, or t
  misc_feature (528)..(528): n is a, c, g, or t
  misc_feature (755)..(755): n is a, c, g, or t
tgtcttagtgcttttntttaaaaaggaaagggtcaacattgaactaggacatgctctgcttccccacccccatttnggnggntagattggggggggggngttgggaganaacangatattnngntcaggtggggtggttatgtttngntgctattttgtntagtatatatttttntcaattgggaaaaaaatctaggtgaaaaaaattacctaacaagagaagtagtttacatagtcataacatttaaattgctgcccaaaaaatgtaaaanaaaatttaatgtaaaatgtcacataatttcaaaaaacttacctcaattgtctatcatttatcatgtactataagtcaacttcctaaataagattacagtcctttattataagcccctacnggtacnatagtatacatttaananacgctactacaaanntnttcttttctttttgtttttgcttattgtgtacttagctatagataatttttgggtacaaagcctacgggacntataaatgcgatngtnaacnganccggtttgcggaggtcctttttatgttccacaggtgacatcttttaatccagcatcttctcctgtttcttgccttcctttttcttcttcttagattctgcagttgcatcagtagacgaatccatctcccttcacccaaacactcctctctaccatcttctcaaactctccccactcctgtgtctccattttcccttctcttgaggtttgggcttggtcagtttgcanagggcttgg

SEQ ID NO: 644638 - DNA, 839 bp, Homo sapiens
ggactgatcattacacaggcggcatgaagcaaaaatatactgtgaaccaatgcaggcggcagtctgaggattccaccttctacctgggagagaggacatactatatcgcagcaggggaggtggaatgggattattccccacaatagggagtgggatagaatggagctgcatcatttacaggagcagaatgtttcaaatggcatttttagataatgggacgagtttcacataggctcaaagtacgagaaagttgtgtatcggcaggtatactgatagcacattccgtgtatcatgatggagatgatggaagctggatagaatgaacatctgggacttctaggtccacaacattcatgcacgatgttggagacaaatagtcagcctattatcttgtacagagaactattggtccacaagggcctactcgatacttgcccatggggtacgaacagagagttctacagttacatccaactattaccgaggtgaaacgtctcaagcttgacgtatggaataatcccagaatagatctggagctggaacagaggatgctgcttgtattccatgggcttatgattcagactgtggatcaagttaaggacctctacagtggcttaatttggcccctgattgtttgtccgaagagcttagtgggaaagtattcgaagtcctcagaaggaaactgggaaatttgccgcgttcttgtatctagttttggatgagaatgaatctgtggtacttagatgacaagattaaaacatatctgatcaccccgagaaatgttggcatgagatgatgagggattcatagaaaagcattaaaatgcatggtattaaatg

SEQ ID NO: 644639 - DNA, 911 bp, Homo sapiens
cattactttagtgcgactttacaattttattatgtcgtatttttatattcagttctaattttctttttttttcttttggagatggaacttcgctttggttgcccaggctagagtgcaagtggtcacgatctcagctcacggcaacctctggcctcctgggttcaagcgattctccgtgcctcagcctcctcagtagctgggattcacaggctccagccaccatacctggctaatttggtattttcagtagagatggggtttcacccacatgggccaggctggtctcgaactccttgacctcaggtgatccacccacttgggcctcccaaagttgcggggattacaggtgtgagccaccatgcccagcctctgattatttctaatttcctccctcagttcttcttgtgacccatggattatcagaagtgggtgtgtctgaatcagcaaacattggttttttttcctcttaatatcttctgtgtgctgattctacttaaattccattgaggtcagaaaatatcctctttatgattcaatcctcttagtcttatgggaagaatgcttttatgaccccaattatgttgtcttgtcatggtgagtgtaccatacacaggtctacaaggaatgggtatttaaggcaaggtgtgggggtcatggctggaatccagcaggagataatgcggggttcacaggtggaatctggaattggaaggggggaggggagggagacttagaaccaggctggaatgtttttgggacttgttttgaaacatttgttggtgtggggtaaatgttgatatagaaggaaggggagatggagaatttatgactggtaataaggcgcagaggaatataggatgttcactaccgggagaaaattctgatagaacgggggctgaacgtgaggtatt

SEQ ID NO: 644640 - DNA, 316 bp, Homo sapiens
  misc_feature (13)..(13): n is a, c, g, or t
  misc_feature (35)..(35): n is a, c, g, or t
agttttaaatttntgggtttaagagattttttaantttatttttataaagtgttgggagtataggtgttagttatggtgtttaatttgtgataattattttaaatttattttataaatgaggaaagtgatatttatatttgtaaagttattggggttgaatttttatttttgtatttatagaattaatatataaagtttatatgttattagaatgtaagttttttgtaagttatagattttttttattgtaatatttttagtgtttagggtagtgattagtatatagtaggtgtttaataaatatttgtagaatta

SEQ ID NO: 644641 - DNA, 106 bp, Homo sapiens
ggtcggactcccattctcctctttccgtgatttctgtgtagaactctggtatttgagctgtggtactatatttatcttttgtcttttaatttaaaccttggtggag

SEQ ID NO: 644642 - DNA, 149 bp, Homo sapiens
  misc_feature (28)..(28): n is a, c, g, or t
ggagatggacgaggaagataaggctttnaagcagaaacaaaaagaggagcagaagaaactcgaggagctaaaagcgaaggccgcggggaaggggcccttggccacaggtggaattaagaaatctggcaaaaagtaagctgttccttgtg

SEQ ID NO: 644643 - DNA, 569 bp, Homo sapiens
tggaactaggaagcacggaaccatgcagatttggtaacggagaggcgctgctctcggccgcgtgcacctggacgagctcgttgatcgtggctggcctactctccacgccttgctgcagattgattctggcccccgatttgccattatgtgtccgcatgtgattattaagaaaccaaggctccttaaatcttctaccgcacatgtcacacccgtcagtgaccgaatctttgtgtgttctcatgtggatctcaacatcaaaagcgactctaaatgtctgcccacatacctcacagctaaattcatttgccttgccattcttttccttgggaggttctgttcgcacttgacttttatcaagcggactgagatactctgcttcaacccgaagaactgctggttcacagaagggtaggccggtgtcgcatcaggacatgtggattcaggtcttctgaatgtgtgcaggtctggcatgcagaacatgccatccaagggcatatacccctcgagtgggatgacatcttattcttgtgtcgctcggaatggaacaacagcggtccctttcatggaca

SEQ ID NO: 644644 - DNA, 986 bp, Homo sapiens
ttttctagaagaggcacattgggtatcattcattacatttgttgagtttgttgggttttgtttttggttttggaagaaaggctggctgtattgcccaggatggaaggcgtgggggaagcattgcgaccgcccatggggtcctcaatggacccgggccgtaatggagacccttcccaaccgtgtgtggctggcgtatttgatgactcaatagcaacgactgtgggctaataatttatattttttggattggaccaaggggatccttcctatgtttgcccaggagcagggttcgtcaagggcttcatgggggcttaaaagagtggctcttgtcgtggccctgcagcttgtcccaagaagaccaagagagcaagagtgtgtgtactgttcgtcccttggctcatgtagtgcccaaaaagagaagggttcatattcccttttagtcgtagaaagtggatgttgacaatagaattggggtcattgtcgggcgggagcaaggtcttttgagggcgtggaaatgtggtaagttctcgcttccgtgaaaatggtttttctccaagtggcatgttcccccacttgacaccttaatgtcacttgacaattagcaggcgaggtgcgtcttgggggtggttacacttcttttgcatgagaaggaacacatatattacatggatcgattttgctaaagcaataagaaacataatgcaggggggcgcccccttgccattgaaaatgccccaaagggagaggcccagaatccaatcatgatcagcaggatggtaatgtaagacagggggccacatcatggagattgaaataaccaagacggctcacaaacgctgtaacaacgtgagatagagggggaccacaggttaaagggagacactgggggaagacctgtattgggggggcgacaaatgggccacccacccgggaaatacaccgcgaagaacaaccgggcaatgggcaccgaccatggcggcaaaggc

SEQ ID NO: 644645 - DNA, 212 bp, Homo sapiens
gggtggccggaggtggcagcctcgacagcgaccgctaccgggggaagcgagaaatcagaagcggaggggaccgtgcctcaggtcgcagggggcggtgcccggccactactcgtcaggtcccgcccgctgagagaccttgctggccagacggccgtcccgcagcctgtcccggctagtcccgcatcctcggcgcgcggccccgcgtgcggccg

SEQ ID NO: 644646 - DNA, 404 bp, Homo sapiens
ttccatgacatgaatgttaactataaagtggtggaactggacctgcttgaatatggaaaccagttccaagatgctctttacaaaatgactggtgaaagaactgttccaagaatatttgtcaatggtacttttattggaggtgcaactgacactcataggcttcacaaagaaggaaaattgctcccactagttcatcagtgttatttaaaaaaaagtaaccgcccccaatttcaggcgtgtttatcctaataagtttggtagttcagggtcagctatttaaagtggtaaggccccataatgtctttttaatgtttgagtttgtttttaagacaggcatggtctttgtggaccagatgtagaactcattgccgataagtttcggcgggaacctcacaaggatgaac

SEQ ID NO: 644647 - DNA, 1096 bp, Homo sapiens
gagctagatgcaactgatggaagatctgtatgaaattttccatagactgatatgggattctccaagatgggatgattaattggcccaaaaagaggcagtgagcgtgtttgttgatgcctcaagctactgtttaagatccctcaagactcgtgacggatttgcggacactacatgggccaactcgtatgataatatgttaagcaatctattcaagaatagccgaatggtcaatcatatgttgaaacacggatgaggtagtgaacgcaatccattcggctcataagcagactagcaagtgagcgctagcagccaaggcttatataacctccagttgataactggaactgttccatcagaacccttgaattcattgagaccacgggcagcaaacggacaagagacgtccaagcaagcaggattgcaaggcaagcattgtttcacgcttcttgtacacaaaatccaccctttcttagcccaccttggaaaccccaaattcttcaattccgtgaggccagtaggcaccaaggattatgtcttaaaacgaagcttgggaacccttttgctcaaaagcttcccatccgcctttcaccaatcaagtacaaacccccaagttttcaagacccctgttccaaaccctgtaaacttgacatgggaagctaatgccagcttgcatttgaaggactttcaggcacacaattgtccagcactttgacttgcaggccccttcattaaaaacgtgttccacagaaagacttggcaaatgaaattttcccctgtttttgccaaaagcaagttgggctgtgtgagtcccttggggccaaccaagcaagggttttccatgttatcgcaggagtttaccttcccaagtgtggttaccccttgattggtcaaagaaaattcccccagggattaaagaatccccttctttaatcccaaagggcataaagtacacacaccaaggttatacccttcataaaaccctttgctaagacctgtccgcggccaacttgtaaccgttgtagaaatctcaggaaaccttcaaaatttaatcaaatactccctgtaaacaattctttatacttttcataaaaaaaac

SEQ ID NO: 644648 - DNA, 856 bp, Homo sapiens
gagccggagcttctggtgtagtcttcactgctctgtgtcttctgctcctagaggcccagcttctgtggcctcgttacctgcaggtattgggagatccacagctaagacgccaggacccactggaagcctagaaatggtgagagtgccgggtccgacatcccgagagagggggcggggctggttggaactggtgggaagtggctgtggcgggactctggcctccccgcagctggctccaaaaatccgcggccccgagttctccttggcgcagctcggcctcagtccccttcagccataggatggcggcgggctgacagctcggaccccgggcatcctgtctcctccctgcgcagtgactgtgccttggtctggagtcctctgtgggcagctctgcccccactgcccgagctctccccgattgtgcaggaccactggacggtcgtcaggggagaataactgactcaggatgcagagttcatgaatgggaagagctttggtctgccggggtcccagtcccccttttttctatgaaaatttgtggaagtctcgcagaatatttacagaaattaattaaagagtaatccaacaattgagaggccccagctatgtgtcgaagttgggggtaatgaagcggctggaagaacacctgagttagggctgttaaagaaacaattcaaaaatggcaggaagtctgtactctaaattgcaaccggggcaatccctgcgtattacacagcagcgacacttgaaccaaactagccaggataagaaaaaagtacacgaaacacaggagcaactacaaaaacaaaagtaaaaaagaaaacacactaaaaataaccaacttcttatatacttt

SEQ ID NO: 644649 - DNA, 320 bp, Homo sapiens
  misc_feature (227)..(227): n is a, c, g, or t
ccctttttgggtcaggattggaattgggatggaatgggccagttgtctataaaactctagtgtaaatattagcccccccccccctcatctttttttttatttccccccccatttatttttttttaccccggttgtatttttaattttggacttcccccattgggcatggcagctcaaaggtggagtactaaagcctggccaagtgaggaaggaaaacaaaaaggtgncgattctcccccccctcttttgtttttaataaaatcggcccctgtttgtacaaacagcctgcgtgttgtaaataaaacaaagtgggctcttta

SEQ ID NO: 644650 - DNA, 433 bp, Homo sapiens
aaatgagcaggataatccatagataagcatggaaagggcccttgaagcaaacctcaattttgatggcacttcacagtacagcagttcccactgccagtacattttcagtgacagataaaatttcttaacacacttgtagtatagattattttgcctactaagtctgatgcccaaataacctggtatttcagaccctagagtccatgcatgagaagcctccactctctgtatagtctttgtcctaatctctccggtttccagccttaattaccatcctcctattggcatcttggaaattcctagactaatagctaccctgggattaatttcccttcaaccttacagtccctacctggtcaccacataaaagaaagtgaagagattcctctccaaatgctctatataaaagatacaagaagttttaaactatcag

SEQ ID NO: 644651 - DNA, 1038 bp, Homo sapiens
ggtgactggaaatggctctgtctccaaaaaaaaaaaaaaaaaaaaaaaaaaaaaatggctggtccctaaaattgtccttggggactgaaaggttggtggcaaatccgtctttaaaggggaaagggggttggaatgaaacctttccgggccgggggggccctaacggcttcaacaacttcgggaggtgaaacgccaacatagcttagggtgacaaagggagcatcacgccgcgtctcctccaatccgggccctttcctccccccagtggcgcgcttccaatcctctcccgccaggcaggcgtgatgagaaaaccccgggaacccccttaagaaaagattcctttaagcagcgttttgtcaagacactcacaggggagtgttgtagacacatataagcccttggtgctcctcctgggccttcttcttttcgctccttcaacctcctttccgtgaaccgagcggttgggtggcctttgggggaaaaacaccggaagaggccctccgtggcctcggggaccgtgttggaccgtggaacttttccttcaacagggggggttccctcgtggcactattcgcgagcgtgtgtttcgtggcccgcagatcccccccccgaggggggcccaagaagcccgcctaggtacacacggggcccccagaaatttggcaccgtgcccgtttcttcacggcggcgcccacgagacttggtcccctggcgcggctgtggtgggtacccccaggtgttgcctctgctttgtggcgccccttggggttccccgcccctgtgtttttgtgtaacccccgagaagcaaccacacggggggtgttgcaaccctgcctcgggctccctgggaagggtgggcctgcttgccctttgaagaccccgcggaggccccccagcgtgctgagacaccccgtttgcgcctctggagacgattcgcgggggctctcccaccaattccgccccttctctcgtttgttggggtcatccgcagaggtgccttgtccatgaatttctccttctccccaggaagggcacctt

SEQ ID NO: 644652 - DNA, 217 bp, Homo sapiens
ggggaaaaaggtttttcccctttttttttaaagggggaaaatttttcccttttccgaaaaacccctttggggtgggggggggtgggtttttggggaccgcaggattttacttgcccatttttttcttaggattttgggaaaaccctttataggggtttcccttttggggccccccgggggggttttctttttaattttaacccccccccttttaata

SEQ ID NO: 644653 - DNA, 532 bp, Homo sapiens
gcaccgagcttaaaagaatatctcatacatagacggttgatgttttaatgataagatgttcaagacgataggctactgttgggggctacccaaacaccaaaacattgccaaagagaataatgcacatgtgagtgtaataagatgtaaatcgatgacattgaaaatggcgactgatgttaaggagaaacaaaatgactcttctagaccatgtatggacagcacccaatatggatgaaccaaaggcaatgaagatggctgaaggcttagcgtgagaaacgaaaggggaaaagcttagcataagcagtgaaagtggcacatggtttggcctggtagactcttataaccttggataatgcctcatgggatagatgacggattagaatgtatacacatgtgtactgtgatttcaactgcctcacaaatgaaaccattttgtctcctattgtaacttggactttttttttaatttaaacccagcgtaactgcttaaggatgttttggaacttgaatacaatatttcttttctacaaaa

SEQ ID NO: 644654 - DNA, 638 bp, Homo sapiens
  misc_feature (35)..(35): n is a, c, g, or t
  misc_feature (173)..(173): n is a, c, g, or t
  misc_feature (199)..(199): n is a, c, g, or t
ttaagatccactaagagtattcagtaactcttaanttagaactttgtgagtatagtagataagtagactgtggtctttggagattctcctgccccagacagggacatagatatacggataatgttatatagttaagagcggagcccaggtgaaaatccccaccccaagctggnctcccaacccaaaaattaccattggnccctgagaacacccaaagaccaccctcccagatttcacacattatcaattgcaggaacagtcgtgcatggcaaagtatagttctatgcatttcacagcacagaaaacccttctttcagagggcatgcaagttgccggagattacacccccaagtctggtgctcttgtgatgagcaacttactggcaaacacatctcccagtgttgtaagcaggcaaatacattgagcacattttgctgtaattccatctatttgcaatgcctgcacagttgtctgtctctggctgttaacttactcattcttgacagaactctgctttattgattgcacttttttaaaaatgccaaaggcatttccacacttgttagcttgaccgccaccactagggtataagagcaagtggctctatgccttatggctaaaggctcctccttcttggg

SEQ ID NO: 644655 - DNA, 613 bp, Homo sapiens
cagtagctgccatcagtgtggattctgaaaactaactggcatcaacactgggtgtagaaacatgcttgccttatgtatcagaggacatgctcagcagatccaagagatatatttggcaactttttctagaaaaggcacatgggtatcattcattacatttttgagtttttttgggtttttttttttttttggagacagtctggctggtatggcccaggcgggagtgtggggtggggcacaatcacagctcatggcatcctcaatcacccaggcctaagcaatcctcccaccttgtagctggggactacagctcacagcacaccgggctaaaattttttttggggagagggatctctatgtggcccaggcgggtctcaggctccggggctcagagggtcctcctgcctcagtttccaagggcacaggccaagtggtagcttggtccctggcgataatgcccaaaagaggttctatacctttaaaggaatggacttccataaatgggttatgtgggggggcaagttcttaaagcgggaaatggtaaatccctccttgaaatgtttttccatgcagttaccatgaactaatactacaataagggatggtcgttggc

SEQ ID NO: 644656 - DNA, 115 bp, Homo sapiens
ctgttgggggccagtgccctcctagttggtggggtagtgggctatggctggcagtggtaaatcggctcacgaaaatatcctgtcgaagaagaaaatttctagaggtcgtaagata

SEQ ID NO: 644657 - DNA, 359 bp, Homo sapiens
tcgagaatagtacgtgtcgtggaagacaaaaaaagagggggacgaaggtagaggggtactgccactagataatggaaacatagtgacatgacagtcgtgagcctggatggatctcagattgagggggaaaagtagccttgaaggacattcttctgcaaactgaagacatgtgcatatggatggtgatggagtaatataatcgaggtcaatattacgtttctctttttttttttttttaaaaagaggggatctggcggtgtaccccaggcgggagtgcagtatggcaacctgaaactccggggctcaagtgatcatcccactttagcctcttaattaaaggggccgggaaccctcaaaag

SEQ ID NO: 644658 - DNA, 688 bp, Homo sapiens
agcactgcgaacatagtgctagctgtgctgcacgtggctgaccggaagatgctctgctgcatataggatggagcctgagggacaccattgaatacagggctgaagggttctatgactggatggaaggctcgatcacctatcataacaccctaatacgagtgagtggatgctcgagcagaagttgacatgaaggatctgcggacgcactttaagagactgtatggtagggctcatgactcgagcgtcaagggtgacacgtctgaggactacggtagagtactgctagaactgtgcctgggagatgattagaagattaccatccagaatgacacgaggattctagagactatgagtgtgaagaactgtacgtttgtacgctgttgtggtcattgtgtcaaagtgcttatttgcaatcacagcgtgtacagctgactactgaaatatagactgtcggtatgatagatacccatggtatgtcaagatgatgctgtaaagctggacttgcatgtgatagcttggaggatttaagtggacagtgtgcagtggagctgagtatggaatgcatgattttaccccgatgctcacgactgtgcgatttacacacgttgagtatagtgacttatggcatctaatcgtgtcagtgccttgttgtaatggcagacttgtctaagatgctttgttgccttcc

SEQ ID NO: 644659 - DNA, 117 bp, Homo sapiens
atctctagcaggatcccctgatcttccgtgcccctaggaacactcagctagacactacgtatgcagagggccacgagaagccagaccctgctatgaaaaaatagcctatttactttt

SEQ ID NO: 644660 - DNA, 2561 bp, Homo sapiens
  misc_feature (2409)..(2409): n is a, c, g, or t
  misc_feature (2561)..(2561): n is a, c, g, or t
gcgccatgaaccaggccaaagcggagcggagcgggggtgaggagagtcgagggaggtgacgcgcgctgccggggcgaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaatttatttttttcctgaataaattgtatttggtaaacttctgcctacattttggaaagtgatgctggtggggaaagttctagatcttacttggtttcttctagaatcagtcttcaggaatggattttgtcacaaatggggcatgggggctttctgaggaaataactacaagtcttggtggtgggctccttattatgtttctttttctttcattcttgatacttggaagtcgtctgaatcctttagcttcaaaccagcctgagtttgagtgcttgccgtagcagaaactatccttaccacaggtgggaaggaaaggaccagtttctagcagtgtcgggccactcctctttcgaacatccctaagggaggcattcacaaaagctgtcccaagcagctggaagaaaacagcttccgagatgaccaggaggactgggcggcgccgagcccagaacgctcctggcgcagcaccgttggcgttggccgattgctgctggtggggggcgggggtgcaggccccagtctctatgcaaatcagggatcagaagatcggaatttccaccaatcagcgggaagcctcggccctgtaactgctaatgggagacagcagcgccacgccacaggcttttcccctggtttcgggaggggtggggagccaggtggggctcccgcccagaccctttcccgaggtccgccctctccgccttttctctaaattcctcttttgagtgccctcccttccggttgagaggcgggggttggcccgtagttgtacactcagtcaccctgcactgtggaggcgggggcctcccttgtggactgatttgcgtgggatttggttgttttattaagagatttaaaaaattcagatgacttactagtatgactgttttgtcatatttgcttccaggttaataaatgacaaaaatgaaaaaaaaaaanggggcgtctaatatcccgagggccatttagctcccgtttgtcaagggccatgggcgataaaaagacggcggtaacgcggtggaaagtccggtttggacccctggggtggaccacgagcggaaatgttgtacatgtgtgtatttaaaaaagtn

SEQ ID NO: 644661 - DNA, 2418 bp, Homo sapiens
  misc_feature (2266)..(2266): n is a, c, g, or t
  misc_feature (2418)..(2418): n is a, c, g, or t
gcgccatgaaccaggccaaagcggagcggagcgggggtgaggagagtcgagggaggtgacgcgcgctgccggggcgaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaatttatttttttcctgaataaattgtatttggtaaacttctgcctacattttggaaagtgatgctggtggggaaagttctagatcttacttggtttcttctagaatcagtcttcaggaatggattttgtcacaaatggggcatgggggctttctgaggaaataactacaagtcttggtggtgggctccttattatgtttctttttctttcattcttgatacttggaagtcgtctgaatcctttagcttcaaaccagcctgagtttgagtgcttgccgtagcagaaactatccttaccacaggtgggaaggaaaggaccagtttctagcagtgtcgggccactcctctttcgaacatccctaagggaggcattcacaaaagctgtcccaagcagctggaagaaaacagcttccgagatgaccaggaggactgggcggcgccgagcccagaacgctcctggcgcagcaccgttggcgttggccgattgctgctggtggggggcgggggtgcaggccccagtctctatgcaaatcagggatcagaagatcggaatttccaccaatcagcgggaagcctcggccctgtaactgctaatgggagacagcagcgccacgccacaggcttttcccctggtttcgggaggggtggggagccaggtggggctcccgcccagaccctttcccgaggtccgccctctccgccttttctctaaattcctcttttgagtgccctcccttccggttgagaggcgggggttggcccgtagttgtacactcagtcaccctgcactgtggaggcgggggcctcccttgtggactgatttgcgtgggatttggttgttttattaagagatttaaaaaattcagatgacttactagtatgactgttttgtcatatttgcttccaggttaataaatgacaaaaatgaaaaaaaaaaanggggcgtctaatatcccgagggccatttagctcccgtttgtcaagggccatgggcgataaaaagacggcggtaacgcggtggaaagtccggtttggacccctggggtggaccacgagcggaaatgttgtacatgtgtgtatttaaaaaagtn

SEQ ID NO: 644662 - DNA, 2056 bp, Homo sapiens
  misc_feature (1904)..(1904): n is a, c, g, or t
  misc_feature (2056)..(2056): n is a, c, g, or t
gtgtcactggctgtaaggacgctcgcccacaggttcgtcctccttttcccgcttcagccattgctctaggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaatttatttttttcctgaataaattgtatttggtaaacttctgcctacattttggaaagtgatgctggtggggaaagttctagatcttacttggtttcttctagaatcagtcttcaggaatggattttgtcacaaatggggcatgggggctttctgaggaaataactacaagtcttggtggtgggctccttattatgtttctttttctttcattcttgatacttggaagtcgtctgaatcctttagcttcaaaccagcctgagtttgagtgcttgccgtagcagaaactatccttaccacaggtgggaaggaaaggaccagtttctagcagtgtcgggccactcctctttcgaacatccctaagggaggcattcacaaaagctgtcccaagcagctggaagaaaacagcttccgagatgaccaggaggactgggcggcgccgagcccagaacgctcctggcgcagcaccgttggcgttggccgattgctgctggtggggggcgggggtgcaggccccagtctctatgcaaatcagggatcagaagatcggaatttccaccaatcagcgggaagcctcggccctgtaactgctaatgggagacagcagcgccacgccacaggcttttcccctggtttcgggaggggtggggagccaggtggggctcccgcccagaccctttcccgaggtccgccctctccgccttttctctaaattcctcttttgagtgccctcccttccggttgagaggcgggggttggcccgtagttgtacactcagtcaccctgcactgtggaggcgggggcctcccttgtggactgatttgcgtgggatttggttgttttattaagagatttaaaaaattcagatgacttactagtatgactgttttgtcatatttgcttccaggttaataaatgacaaaaatgaaaaaaaaaaanggggcgtctaatatcccgagggccatttagctcccgtttgtcaagggccatgggcgataaaaagacggcggtaacgcggtggaaagtccggtttggacccctggggtggaccacgagcggaaatgttgtacatgtgtgtatttaaaaaagtn

SEQ ID NO: 644663 - DNA, 89 bp, Homo sapiens
actataacgctgctggaaatcattggataagcggatgagggaggcatcaccattgcaatcacttctggaggcgctgctggaaatgctga

SEQ ID NO: 644664 - DNA, 2241 bp, Homo sapiens
  misc_feature (2089)..(2089): n is a, c, g, or t
  misc_feature (2241)..(2241): n is a, c, g, or t
ttggggttgaatgaaaaggaagcagaaggggagtaggaccagtcaaggaagaggttgtacaagattgtctggcacaaaggagggaaccaagtttagcccttatcaccagtggctgttaaggaaattctttctgtatctctcccagtctcggttttccgacactcccccctgggtcatgcctgaattacattcttttgcctgagaatgcttcattctctgcacattttggaatgcctttcagctctcttctctggctggtcccacacaatcctctgtgaaaccttctctaagatctactttcctgccccttagagcacactcctctctttccactcttgactggtgggccccagctggcccttagtaacattttccaagcctgggtaagtacctaatgcctcttcccctgtttcttcccttggacttggccttttcccaaaagcttgagctgtatggtttgagctttttcctctttcttgtaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaatttatttttttcctgaataaattgtatttggtaaacttctgcctacattttggaaagtgatgctggtggggaaagttctagatcttacttggtttcttctagaatcagtcttcaggaatggattttgtcacaaatggggcatgggggctttctgaggaaataactacaagtcttggtggtgggctccttattatgtttctttttctttcattcttgatacttggaagtcgtctgaatcctttagcttcaaaccagcctgagtttgagtgcttgccgtagcagaaactatccttaccacaggtgggaaggaaaggaccagtttctagcagtgtcgggccactcctctttcgaacatccctaagggaggcattcacaaaagctgtcccaagcagctggaagaaaacagcttccgagatgaccaggaggactgggcggcgccgagcccagaacgctcctggcgcagcaccgttggcgttggccgattgctgctggtggggggcgggggtgcaggccccagtctctatgcaaatcagggatcagaagatcggaatttccaccaatcagcgggaagcctcggccctgtaactgctaatgggagacagcagcgccacgccacaggcttttcccctggtttcgggaggggtggggagccaggtggggctcccgcccagaccctttcccgaggtccgccctctccgccttttctctaaattcctcttttgagtgccctcccttccggttgagaggcgggggttggcccgtagttgtacactcagtcaccctgcactgtggaggcgggggcctcccttgtggactgatttgcgtgggatttggttgttttattaagagatttaaaaaattcagatgacttactagtatgactgttttgtcatatttgcttccaggttaataaatgacaaaaatgaaaaaaaaaaanggggcgtctaatatcccgagggccatttagctcccgtttgtcaagggccatgggcgataaaaagacggcggtaacgcggtggaaagtccggtttggacccctggggtggaccacgagcggaaatgttgtacatgtgtgtatttaaaaaagtn

SEQ ID NO: 644665 - DNA, 1071 bp, Homo sapiens
ccctgatggggagcacacccgccgcggtcacgtagctgtcgttggcgaacaggaagatcgtgtcgtcctgcatgctcgctccgacgatgagtacagggagcatcagcagcacgatgaccgtgaccatgacacgacgggatgcgacggcggcgaaccgagccagcaccacgacaccgacggcgaaggtgaggtacgccatccactctgcgctgaccgaccagtcgacgccgttccagtcgagcgtggaggggaaccagccgttgaggagcgtcaggtgcaggagaagtcgcccggggtcggcctgtccgaggaaagatggatcgccggacgagagagcctggaagatgaaatatgccccgaacagcatgagcacgaaagcggtgaggggccacaccctggccagccgcagccagatgaatccaacggcggtgcgccaggtgtatgcactcgtcatcgtcgacatgtgcgtgtaggtcaggatgaatccgctgaggatgaagaagagatcgacccgagatatcccgccgacgacaggtggatgacgaactgcgtgaaggggccaggaccgagggcatcgacgatctcggtgcggaagtgccggagaaagcaccagaacgcagcgagggcacggattgcccgtcagcgcaccgaatcagcgggcccgacgaacaggtggatcgatagcagagtcgactctcgacatcgaatacgggaagggccggcctaacggttgaccttggcgggcgagagcagcccagaatcgagccgagtacggcgggcaggaacacgaagatcaacaacacagtttgcgaagaaaacggggaatcggggtcacgacgatcgcgaatgaaccggggacagcaagattgacgacaacgacggagtgaaacgaaaggatgcaagcacaacgaaccccagaaaccccccggagtgtcagcgagcaagaggtgacaatcacgaaacaacaatatagtgcaggtacacacgaaggagaaccgagacgccccacaagatcaacacagcgtgggctgcacacagcagcacatcagagaaacaataagaagccagcaa

SEQ ID NO: 644666 - DNA, 1470 bp, Homo sapiens
  misc_feature (7)..(7): n is a, c, g, or t
  misc_feature (1318)..(1318): n is a, c, g, or t
  misc_feature (1470)..(1470): n is a, c, g, or t
acttctngctaggtacgaggctgggtgttagcggacgcgaggcgacgcggagagggcggcctgggccgaagtgaggcgacgcggggcggcggagtctgagggccggagcggagcggaggcgacgcggggaggggcgagggatcgcggccggtggctgggggccacctgctccccgagcaccggcccccgctccggggagcagagtccggagcgggatccgcggcccacaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggggcattcacaaaagctgtcccaagcagctggaagaaaacagcttccgagatgaccaggaggactgggcggcgccgagcccagaacgctcctggcgcagcaccgttggcgttggccgattgctgctggtggggggcgggggtgcaggccccagtctctatgcaaatcagggatcagaagatcggaatttccaccaatcagcgggaagcctcggccctgtaactgctaatgggagacagcagcgccacgccacaggcttttcccctggtttcgggaggggtggggagccaggtggggctcccgcccagaccctttcccgaggtccgccctctccgccttttctctaaattcctcttttgagtgccctcccttccggttgagaggcgggggttggcccgtagttgtacactcagtcaccctgcactgtggaggcgggggcctcccttgtggactgatttgcgtgggatttggttgttttattaagagatttaaaaaattcagatgacttactagtatgactgttttgtcatatttgcttccaggttaataaatgacaaaaatgaaaaaaaaaaanggggcgtctaatatcccgagggccatttagctcccgtttgtcaagggccatgggcgataaaaagacggcggtaacgcggtggaaagtccggtttggacccctggggtggaccacgagcggaaatgttgtacatgtgtgtatttaaaaaagtn

SEQ ID NO: 644667 - DNA, 968 bp, Homo sapiens
  misc_feature (815)..(815): n is a, c, g, or t
  misc_feature (837)..(837): n is a, c, g, or t
  misc_feature (843)..(843): n is a, c, g, or t
  misc_feature (890)..(890): n is a, c, g, or t
  misc_feature (895)..(895): n is a, c, g, or t
  misc_feature (952)..(952): n is a, c, g, or t
  misc_feature (954)..(954): n is a, c, g, or t
ctccctctatttcatggtctgtctttgcgttttttaggcgaccgtattcagtgccggtggtaccgtggttaggtactgggtacactggttcacctgtattctaagtgttcgatggctaactgcataagatgctcaggtctaagcaacatgtttgcggaatgtttccggtgagtccgctggtacccacggctcacacgcagtaatgctagcactgtgggtggccaaaaacaggttggatcactgttgtccaggtagtcttagatacaagcttaggccatcgttaagcaagatctctgtctcgtaacataaagttttaagtatattgagccagaccatggttgtgtgtatgcctgtagtccctagccactcagaaagtctgaggctaggaggatcgcctttgagaccaagagtttgagcctgcggtgtagctgtgtaatgcatccacggcactcaaagcctgggcaatgtagcaagatcctgtctctacaagaaattgttttcgaaaatgagccaagtgtggtggtgcatgcctgtagttccagtctactcaggacactgacgtaggaggcttgcttcgagactgagacgttggaggctgcgactgagccatgaatgccccagctgcactccacgcctggtgcgacagaacgagaccccatctcaaaaaaaataagttctggttgtcattgaattgggataaacagagagcttgatgctttctgccttttgtctcaggtgatgcattgcacatttgggatatttggaaaggaaatgaggaaagaaattagggcctcctttgatctctcgctatttgngggtcctgtccttttttcaagnccttcnccataacgggggttttcctgttttttttttagtatgatccctcaaancctcnctaactggaaggatgattttgtttcagtttgtactcctaaataaaaagtaaacatgncncctctgaccaaaaa

SEQ ID NO: 644668 - DNA, 117 bp, Homo sapiens
catgacttcgggtgtctcggcctcagagcctgggcacgcgatgcatcatcgccatcctgtctatcctcctggctgtcctcctcacggtacctcctgctgtgtgctcatatacacgct

SEQ ID NO: 644669 - DNA, 646 bp, Homo sapiens
aggaaggtcgtgtagtaaaaggctcttccatgagttcaagggattggattcacaaagggtatgctggtcaggacgttgtttgccaaatggccaactcagtgattaagaccagagacggatacacttgtgcgttcttctgaaggagtcatggatgtcaggcagtgtcctgtgactggtctggcgctcgacttgggtcgcgtaagatgggacagcgtctaaaatccatgtcacttattcacgaacatggtagaacgtatcttcagtaggtccaaagatcatgacaggcacgagtacatcactgctcaggtcactgacaagataggtagattgcagctccatataaggaatttgttcttgtcatcagtgcagtgccaaatggaataagctgtttgatcatggttgagcatagtctgagtgacaacctgttagatattctacgtaggagtgcaatgaggacaacattatattatatctatgggctgtttaagacgcaagattctgctctttcattcgaagcatattgagtaagccagctggaatagacgtcaccatagtaatgatagtcagtgtgaagtctaaagtaatgccacaatgattctaaagacgagagttttagggacaacaatacagtaaattgccaaggttc

SEQ ID NO: 644670 - DNA, 413 bp, Homo sapiens
gtgactctacaggatcccggtgtttccctttgtctctactaaaaatacaaaaattagtcaggcgtggtggtgcacacctgtaatcccagctacttgggagactgaggcaggaggatcgcttgaacccgggaggcagaggttgcagtgagccgagatcatgccattgcactccagcctgggcaacagagcaagactctgtgtcaaaaaaaaaaaaaaaaatatagatttttaaattggcttttactttatatattcgctaaactttctcaaacgggactcgtgcttgtacaggaaagagttctgggtggttttctctttggccctatccctgattaaccctttagagccacaccagggttttgtggaggtgactccagtttattggacagacaaaggaaaacaccgggttaccg

SEQ ID NO: 644671 - DNA, 1389 bp, Homo sapiens
tgttttgcgtgagggtggtggtcgagtgtgtgggggtgtgtttggtggcgtggggtcaggggttgtgtgtgttgtgggcgtagtgtgctacgggcttgtcggtttgtgtcgatgtgtggaggtgcagcgtgtggccttgggtggttgcgcgcgtggcgtgtagggttggtgtgtcgagtgtaggtttagcgcctgttgggtgggtggtgctgttgggtgtagggtgttggcgcgggtgggatttgtgtgtgtgttggcgtggatgtgcggtgtttgggtcgggggaccggttgtgggtgggtgcgggagctgtgttgggggtggtttaggttggggcccgggggttttcgggtgtgggtggtgtgttgtgggaggaggtttttggtgtgtggggtttggggtgggctgttgatttgtgaggtgcggatcgtggggggtttgtgtttgggtggtgagtgtgtcgcatgtgcctaggtgggtgccaacgtgcggggggggcgcttgtgttgcggcctgtatttgtgtaagtttaggttgtggagcagcgcggggggagcccggttgggttgtgtagcaccgtttcgccggtggtgtgttgggagaatagccaccgcgtgtgtgaagtggtgttggtggcccttatttattggtgtgtatgggtgggggcaccgcttaggaggcgttgttttgtatgggaggccagcggtgctgtggttgtggtggtgtgtgttgggttttgttgggattttgttgtgttgaagtgaattgtgagtgtagtgtgctcgagggtgtagggtgggcgcgctctctgtgtagggggcacggggagttctttcacctgtaggctgggcgtgtgcaagttgtgtgttggtagtagttaaagccacctgttgaagtgtgtatgaatattttgttgcccacatagatatgtgtgggcacgcgtgtcgtatacagagatagggcagtatcttaggccactgtgtgtgtacagatagtggtgtatgtagaatcgcagcagacagaggggggaaagcgttttctcttttagaagctgcccgtcggtgtgagcacacgtgttagtgggttaaagtataccacggggggggagagaatcgcactgtgtagtaagagtcactgtttcgtaagggcacaagagtgtgttgagatgctataatgagccacagcctcgttgtctagcctagtagggcacgtgctctttatgtttaggctagagaagtgggagatcactggccttgttgagaagagagaagaaaagtcacccacattcgtgcacttgtagctgtagattcaatatatgtgcactgttgcggtagtgtttttgtgttgtagttgtaaaaaattcacatatataaacgatgttgtgatgta

SEQ ID NO: 644672 - DNA, 949 bp, Homo sapiens
  misc_feature (7)..(7): n is a, c, g, or t
  misc_feature (294)..(294): n is a, c, g, or t
acttctngctaggtacgaggctgggtgttagcggacgcgaggcgacgcggagagggcggcctgggccgaagtgaggcgacgcggggcggcggagtctgagggccggagcggagcggaggcgacgcggggaggggcgagggatcgcggccggtggctgggggccacctgctccccgagcaccggcccccgctccggggagcagagtccggagcgggatccgcggcccacaggttgcgaggggcggtgttgaagaatgtgtgggcgaacatcctgtcacttacctagagatgttcntccacggagggagctttggcggccctacccagggatccgggcgcggggggcccaagcaaggcgggctcccgggggagtggggggggacccttgattaagttactggcccctcttacaacaaagagttccctcaaaattcccgaaacaagccccaagggtggctttccgttgctcttccggaaactgtgccacctttttttggacgaaacggggattttgcaaggaacctccaattccctaggaggcgggttaattcaattttggccttcccccaaattggcggcgtgtgggcgggccctttgggttccccttttcttgtgcgtttccaacacaggaaagagtggtagattccttttcacaaaagggcgttggcaaggtgtcaagattaactttaacgccaaagagcgttggttccgggataaggcttagagaattaaaccacgtggttgacagttttgggcacgcacacacgcggggggctccagtttttttaagagggggggttgggcccccttttccttgtgcgggcgaacaagacggggggggaaaacaggaaacccggagcctttaggagtggggatccggagagagtttttattataaaagagggccaagaggaaatttttgggggagatgttttcccctaaatttgaag

SEQ ID NO: 644673 - DNA, 516 bp, Homo sapiens
gggcggcagccggagcttctggtgtagtcttcactgctctgtgtcttctgctcctagaggcccagcttctgtggcctcgttacctgcaggtatgggagatccacaggctaagacgccaggacccactggaagcctagaaatgctggctccaaaatccgcggccccgagttctccttggcgcagctcggcctcagtccccttcagccataggatggcggcgggctgacagctcggaccccgggcatcctgtctcctccctgcgcagttgactgtgccttggtctggagtcctctgtgggcagctctgcccccactgccgcaggctctccccgattgtgcagggaccactggacggtcgtcaggggagaatactgactcaggatgcagagttcatgaatgggaagagctttggtctgcggggttcccagtccccctttgtatctattagaaatgtgtggaagtctccgcagaaatattaacagaattccattacaagagtaattcaagaattgtagag

SEQ ID NO: 644674 - DNA, 645 bp, Homo sapiens
  misc_feature (74)..(74): n is a, c, g, or t
  misc_feature (124)..(124): n is a, c, g, or t
  misc_feature (142)..(142): n is a, c, g, or t
  misc_feature (493)..(493): n is a, c, g, or t
  misc_feature (645)..(645): n is a, c, g, or t
gctccccacccctcccgaaaccaggggaaaagcctgtggcgtggcgctgctgtctcccattagcagttacaggnccgaggcttcccgctgattggtggaaattccgatcttctgatccctgatntgcatagagactggggcntgcacccccgccccccaccagcagcaatcggccaacgccaacggtgctgcgccaggagcgttctgggctcggcgccgcccagtcctcctggtcatctcggaagctgttttcttccagctgcttgggacagcttttgtgaatgcctcccttagggatgttcgaaagaggagtggcccgacactgctagaaactggtcctttccttcccacctgtggtaaggatagtttctgctacggcaagcactcaaactcaggctggtttgaagctaaaggattcagatgacttactagtatgactgttttgtcatatttgcttccaggttaataaatgacaaaaatgaaaaaaaaaaanggggcgtctaatatcccgagggccatttagctcccgtttgtcaagggccatgggcgataaaaagacggcggtaacgcggtggaaagtccggtttggacccctggggtggaccacgagcggaaatgttgtacatgtgtgtatttaaaaaagtn

SEQ ID NO: 644675 - DNA, 119 bp, Homo sapiens
  misc_feature (79)..(80): n is a, c, g, or t
gcactacggcttttggccaggccccctgggcgcgttccgggagctcaggcttgcggagctgggagaagcacaccgctcnncaagggggttggtgggcacgcggcccaggggtcagggtt

SEQ ID NO: 644676 - DNA, 433 bp, Homo sapiens
cagctttattcccaattacaaacacatggaagtcaccagtatttccttcagtaggtgaatgtataaacagcagtacatccagacaatggaagattattcagtgctaaaaagaaatgagctatcaaccaatgaaaaaacatggagacaacttaaatgcatataaatatgtgaaagaagctaatctgaaaagactgcatactgtatggttctaactatatgacattctagaaaaggcaaaaacagacagtaaaaagatcagtggttactaggagttaatgaggagggagggattaactggtgaagcacagaggatttttaagtcagtgaaactactctgtccatactccagtggtggatacatgccactatacatttgttcaaatctgcagaatgtacatcaaaaataaatcctaatctcaactaaaaaaaaaaa

SEQ ID NO: 644677 - DNA, 284 bp, Homo sapiens
  misc_feature (215)..(215): n is a, c, g, or t
  misc_feature (229)..(229): n is a, c, g, or t
  misc_feature (244)..(244): n is a, c, g, or t
  misc_feature (261)..(261): n is a, c, g, or t
tcatgtctgacgcttctgggtccggagacagtgttctgagaggcagcacacagaaatgaaaagcacaatgaaaaagtcttccatgttgtatacatacattagaatattattcagcaaagaagatgtatgaagtacaaataatgctacaacttgtaaaccttgaaaacctcatgttaaatgaaagatgccagtcacagaatatcacacattatatnatttcatttatatntgatttctggaatanggagatccgtatagacncgtaagacataaccgcggggagt

SEQ ID NO: 644678 - DNA, 219 bp, Homo sapiens
cgttcatcaagggatgcaagtatctacaatttggtcctctcacagaccgtttcgctgtcgatattccatgaccgttttgctccattccccctggtgtaacttgtatccctcaaacagaactgtgtaggtgaatttgctattcccttcagccttgaattcaccttcatttgtccccatcagcttcagggccttctttacatttccattggccttatcgag

SEQ ID NO: 644679 - DNA, 389 bp, Homo sapiens
  misc_feature (166)..(166): n is a, c, g, or t
  misc_feature (222)..(222): n is a, c, g, or t
  misc_feature (285)..(285): n is a, c, g, or t
acttcagtgccctgaacggttagagaaattaatgaaggagctccaccaggtgccttcacaactctgagtcatatcagaatctctccacagctctcctttcaaaaatgacaccgtgacatttcaggatgtgaaaaaacttactggaaagtgtgtaagaaaatataanatactatttgtacaatgtgataatgtatcatcagcttgttaatttcagtgtgcttnctttgagcgccggacttaccatttttgaattttgggatttggtatttttttttaaaggaatcnaccctttaaaagaaggaattgcttataccaattacctggatggaagcaaattttttggtgaaagctaaagatatgcatgcagttaaatttataaataataagga

SEQ ID NO: 644680 - DNA, 147 bp, Homo sapiens
tgtatgaccataactgttggaattcctatttccatgctttcctgtgtggtgaggatctcacaagcttttcgacataagtggacaggaatcatcccaacccggaccatccttgttcctgggcactcaaccacgggtgatcctcataga

SEQ ID NO: 644681 - DNA, 1336 bp, Homo sapiens
  misc_feature (249)..(249): n is a, c, g, or t
  misc_feature (298)..(298): n is a, c, g, or t
ccctagaacccaagagtcaggtacctcttctcctttctcctctagggcccaccagctctgagcagatcatgaagacagggtgcccgttttggcttcagaggtttcagtccagtgattcgagcagtggcgaatggtggggggaggcaccctgagctggccctgtgacccggtgcctcagtgatgcgtccaccaaagaagctgagctgagtgtctcaagacgcatcaggggacgaactgtgacagtaacantgtgagctgcagaggatgatttgccgccgtggacacagaactccccccngagaggtctttttcctgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccaggtggttgggtgagactcctcaagcctcctcaccccggaccaccgtgccctcaccacgcgccccgtgccccaccgtgcctgccccgcgtcagtgactcctgaggaccctgggccttgtggagcatggtgcacagtggtggccgctctgcatcttcaggatcatcagatgtggtctataatgcgtaggcccttacatgtctgatcaatcacccgagtcatgttatccctgctgatagctttgaaacagaagaaaccctggaactccacttgtgacgctttgacatttgaatgtaagtgttctttcttggcggctctcgctggaggcgtgccatgttgcctcctggcaatagctgcagagttgcataagactcgacgcgcgtctgaaactgtgcgggatcgcagttggggcagaggggttcagcatgcctctggactatctaggccgggaaggtcgacctgcccgtggaacaaggcggactatttacacacgctagaacgaggacggacccgtatgggcgctttgactgattcaaggcaaggcaggaagctaaccaaaacccacaggtaccgagactaccaaagcggcttgagaacttacgggacgcgggactcgggagagaggcaagctcgagcagtagaagctcaccacgtcaccgtcaaagggaacactaaacacacaggatccagggcgccacgacaggttaccagaaaaggggcgcccgtccaagccgcgggaagggctacaccgctggaccgcacaccgggccgcctagaaggcgctacaaagagagagagggagggcagggaacatgttacccggagaaaatgtgaggcgcca

SEQ ID NO: 644682 - DNA, 810 bp, Homo sapiens
  misc_feature (539)..(539): n is a, c, g, or t
ggggattcctgaatctgacagcatgcgggccgagatgtatcgctccgtggccttacctgtgctcgcgctactttctctttctggcctggaggctatccatcgaactccatagattcaggcatactcacgtaatccatcaaagaatggaaagtcagatttcctgactggctatgtgtctgggtggcatccatccaacattgaaggtgacttactgactaatggatagagagtggataaagtggagcattcatacttgcctgtcagcaaggactgaccgttctatctatcgcactacactgaatgcacccacactgaataagatgaatatgcctgccgggcgaaccatgcaactttgtcacagaccaagatagataagtgggatcgagacatgcatgcagcctcatggatgtttgaagatgcaccatttggattgaatgaatgacaaacactgcttgcttgcttgctaatatagataggcttacacactcacactctatgcacaaactgtagggttataataatgttagcatgcacaggancgaccttataaatctacttagagtgctggctgcatgcatgatggatctgagcaagctggttcacacgcaggtctatgaaggctggctcttacagatagggagcaaagaattatttattcaacccaacatcttggtcagacaggaactatccaatctattgccctcaaagcatgttaagatagataaggcggccttagttaacttacaatcaacatactttgtttagaataaagggggaagtaagtgacaggaggattggaagtaatttttt

SEQ ID NO: 644683 - DNA, 344 bp, Homo sapiens
acttgggctggacccactattgccatcttcaactgcctttgctatgatcattgacacactggacggaggacatagcagctctatgccccagtcgcactgctgccagtagacccccgggtcacctgcggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggaattccacaatccatcattgagtgtgtcaaacagatctgcgtggtcatgtaggagactctctcccagtcc

SEQ ID NO: 644684 - DNA, 102 bp, Homo sapiens
acacagtcactctagcactcaccagtattagaggcacctgccgtgtccttgtgacacatgtttaacggccgcggttacctaaacggtgcactggtagcataa

SEQ ID NO: 644685 - DNA, 356 bp, Homo sapiens
catgggtagaagttcacctgcatggccctggcatttctattttctgattagaacatcacaccagccatacatgatgtttcacttctgtaatccccgcactttgagaggccaaggcgagagaatcacttgaggccaggcgtttgagaccggcctgggcaacatagtaagacctcatctctatgaaaagttttttaaaaaattggctggatgttgtggtacacacctgtaatcccagttcttcaggggcctgaggtgggagcatcacttgagtccaggagtttgaggctgcagtgagcagtcatgccactgtactccagtctaggtgatagaatgagaccttttctctcctaaaaaac

SEQ ID NO: 644686 - DNA, 118 bp, Homo sapiens
tgctgtgtcattacaatttggcttcttatattaatgtttgaaaaggcttaaagctggtagtctcgaacctgcccttcactggttgtgtaaataaaactgtagaatgacaaaaaaaaaa

SEQ ID NO: 644687 - DNA, 373 bp, Homo sapiens
attgtaactcataaagaccatctttggatagaagtattttgctggagtaggtttgaaaaagcctgtatttgggccttggcttaggtacaatgtaaggtgaaaaaaaactctttccaaagactcatgtttcctttccctgaagttgcagctaaattacttgaatctatcgtatatgtaaaaacttggattttttatgttgttaataggctgtggttttaaattatttgttgtttagaaaattatttaaaattttggatattagttaaaatcatacagagattgtaataatcattctaattaaaatcttgttgatgaacttccttcttaggtattacatcaaataccaataacggatctatggtggtccacagta

SEQ ID NO: 644688 - DNA, 177 bp, Homo sapiens
gaagtgcatcgcgtatgagcatgcttgtagtctcagctactcccaggtgctgaagcaggaggatctcttgaacctgggaggtcgaggtgcagcgagctatgatcgtgccactgcactccagcctgtgtgacagagtaagaccctgtctcaaaaaatataaagtatttaaccaacaaa

SEQ ID NO: 644689 - DNA, 351 bp, Homo sapiens
tgccgctagaggcccctagacagatgtcacgtcagaggttaggactctgtttcatctataaggactcggacacctctaggcaccgagctaagacggcgccccaaagttaggtggcccgtcgcaggcagcccctacaagtctgtcctcctcgctcagcacaacccttcacccacaggccagcagcaatcccgacgcaggctcctgtcactaccctctacgcgctcaggcggacagctaaggtctggctgagtctccggcaggggcgcttggaatgtgaccggtcacccactctcggccctgcatttgcttgtgcatgcaagaaccacagtgtagaggcacccgaaccgtgtg

SEQ ID NO: 644690 - DNA, 349 bp, Homo sapiens
aggtgctgggattgcaggtatgagccacagtgcccggcgggataagttttaaaataatattctctgctggctgggcatggtggctcatgcctgtgaacccagcactttgggaggctgaggcaggagcatcactcgaggccgagagtttgagaccagtctgggcaacatgatgagacccccctctctacaaaaaataaaaaaaatttggctgagtgtggcatgttcctgtagctatcgggaggctgagatgggaggattgcttgagcccaggagtttgaggctgcagtgagctatgattgcaccactgcgctctagtctgggtgacagtgtgagaccctgtctcttaaaa

SEQ ID NO: 644691 - DNA, 288 bp, Homo sapiens
cgccacaggcttctccaccaatcacgcatttgggagcccacattggagcagtgggcctcctaaggcatcaggaacgggtcacgcagaatgagttgctgaaacatgtcacggtgaagatcttcgaggtagtgacttccagatggaccgcagtgctcgggaccgcctttgtgaggagacggcagagcatgtagaagctagtggagaagctgctcgtcctggttaacctgttcaatgcccagctgaaagcgttcagagatgaggagaaggccagagtagctgtggtggacg

SEQ ID NO: 644692 - DNA, 801 bp, Homo sapiens
  misc_feature (582)..(582): n is a, c, g, or t
  misc_feature (615)..(615): n is a, c, g, or t
  misc_feature (731)..(731): n is a, c, g, or t
  misc_feature (781)..(781): n is a, c, g, or t
tgcaagcaacggttcgtcaccgcaggttgagaaggaatgtctcctaccgcggatttatcagacttgaatgctataagctggtgaggcacttgttgggtatcgaaccttatcgcgccttgcgcgcttggtggtagcctctccttgaccatctttgcgcttttcgcaagcacggggaagcgagggagcgcgcgagaagatttgatcatcgtcaaccgctgagaagatgtacgtcattgtcgtctacgatgttgaacaagagcgagtgggtaaagtgtgccagttgctacggcgctacttgcgttgggtgcaaaattccgcattcgagggggagttaaccgaatcgcagctagaacgattgaaggaggatttgaaggcgatcatcgactcggagaaagattcggcctacttttatctgctaagagacgcaaagtggatgaggaaggagataatagggcaaaacaagggatccgttgactatctttgtgatcgcaccaagtaagacgctcgccagtagcggcatcaataagagatccgttggctatcttttgtgatcgcactgtctcgcgggctttcctgttcttngtctttttaacctaatccgttgatcatctttgnatctcaccgtgacttcatgtagagtcatccgtggatgtttcatccaagatcgcgcatcgtctgaaccttgcgaaggttacagtcgaagctcgtagtctcgccaaagatgctggccnaggccacgatcaggtctgggagcggtcactagtcttcatcggtggctccnagttgttggggacaagtcgc

SEQ ID NO: 644693 - DNA, 530 bp, Homo sapiens
gctcgtcgtccggcgcgtcgaaggcgatgggctgctgcaggcgcagcacgcggccagcgggttcttcagccccttgacgcggccatgcgggatcgcgacgccatggccgaggccggtcgagcccaggcgctcgcgcgcgaacaggttgtcggtgaccagcgcccgcgccatctggtggtggttctcgaacagcaggccggcatgttcgaagacgcgtttcttgctggacgcatccacattcaccaacacattgtcggcgggcaggatggcggcgagacggttcatgggcggaggccggtcatcgggggcgccgttggggcgcggccggaaccgggcgatgggtcatcacagagcagcagattatggaaccccggccgttttggggtgggcggcagaccctagggccgtggaaaacgcctctccaggcccccgaatgcgggtttttgcggcactgcagcaacaaccgacttgccatggattgcgcatcgcaaaaacaaagcggcccgcaggccgccgtggtgcttggccgg

SEQ ID NO: 644694 - DNA, 968 bp, Homo sapiens
ggtgcggtccacgttgagcctgtggccctccaggtggctgaagaggatctgggtgcgcgccatgttggatctccttccaggacgaccgctggcgctgacacgagcagcatctcactactgcatgccatgcgtcgattgtggaagttgtataccttcattctctctgagcggatactcatatatacacacgtcgaagaaacaaggccacagatgggtcgattggaggcccaccatccaaggaatgagacttgtaccatggtaggctccgcagctgagcggaacattccacacaattctcctcaacgcaacacgtaggaaagtcgttgtgtccttgtgatcacacacgatgtgcctatacaagagaggtgggccaacggctaatctaagaatcctggcaacgaggtggaacatgacagcaatcttatgagattgtatgactctctatgtagcactggtgaaaagctccatcctggcgagcgtaagcattggcaaaggctatcagtctcactatcgcgaggtggcgcgcgatgtctccgcgccccaccaccatggggactgggggaaggtgcacatatgaatgcgccatgtagggcataggtttaaggccctgagtagggagagcccgcagtgagacagaacccatgttcagagttgcgaactccacatgcacgagactgaatcctcaaggaagtaggcatcgacaatgatctatgtaaaacgagccaacacaacgagtttacgtgtgtccacttatagtgctattaccatgttaaagggtcgaccccatttgagacactttctcttccaagacgtggttggcctttgtgactggtacaggacaagcacggactttcgacggttggcggtttggacctggtatggaagcaacgggcccaccgggacctgtctagtctggttggacgccgaacggcatcccatcgctgggtaccgataacggccaccggatc

SEQ ID NO: 644695 - DNA, 403 bp, Homo sapiens
ccaaggtacattgtccaccaagtacagactggttggtgacaacgccagaaggctacacacaggaaggttactcttgtgcacctgacaaatagacaaggatcacaggatcaaaattgaaggcaggctatcagagtatcaagaaattcttaaaaaccaaaaagtgatttggaagcacaaaacttacagttaatgctacccaatgtcatgatgggcccagaggcattgtggcttcctaagttagaaaatgccatatgccaaaattttaaatggaacacactacatttttttctaatcaatccccctctctcccagaaaaaataggaactcatttttttcagggtggggaggaagagaggggatcatgggacatggaaacagtagttatattagtagtatttttgtt

SEQ ID NO: 644696 - DNA, 171 bp, Homo sapiens
  misc_feature (32)..(32): n is a, c, g, or t
  misc_feature (52)..(52): n is a, c, g, or t
cgggcatgtgctgtaggccagcggcccccggncgcgattccgggcagtcgcncatcccgaaccggagctcacggtgtacgacccgaacaatatctttgcccgaatcctgcgaggcgagctgccttgccacaaggtctacgaagacgccgacacgctggcctacagcacatg

SEQ ID NO: 644697 - DNA, 264 bp, Homo sapiens
gacgctctctctgtggggggtggccacgtagggtccagcacgtggggtggtaccccaggcctgggtcagcccgggacaaggcaggggccacaggaccgcggggtccccagctgccacctcacccaccgcaattcatttcgtagcaggcacaggggcagctccggcacggctttctcaggcctatgccggagcctcgagggctggcgagcgggaccgacaggcagtgctcggggacgttgcagcaggaccccacagagagagcgt

SEQ ID NO: 644698 - DNA, 344 bp, Homo sapiens
atggcagacacaaattctgtggctacagtagaaatagaaagaactgatgctgagttgttttcggcagatgtaaataactactgctgctgtctagatgctgaagctgaactggagacccttcaggagcctgataagtgttgcggaggtcagagtaccatctgtgggagggacagaaagagagcctggagacaagagcatttgcttctagtgagctatcaacgtgatgtgtgatatacacacctctaaccctggatgtagccagataagaacacatcatctgagagttatgagactcaaaccttcaatagtatgggagtggcagcgacaccagcacaaagagctgt

SEQ ID NO: 644699 - DNA, 198 bp, Homo sapiens
atagtgaaatgcccgccggactattttgttgaagactctctccctatataagcccatgtaaaaggtctcagcatctagcacaagactcaacaagtgaagcccacatctctctttcatacaggatttgctgcagttactatattcttccaaccagttgagtagtctcaacagtgtgactgggtgacttttaacatagtt

SEQ ID NO: 644700 - DNA, 402 bp, Homo sapiens
actaaagcatatacaatacaagcaatgcattccatattcttaaaatgaccaaacacttatggtattaatacaatgtataccctgtatactcatatatactataatatacatttccagtatatagttggtgtgtttacttgtgtgtttgtgtttttgttgtttctacacaggaatagttaggtctgattcatttgagggagcccaggtgaccttggatcgggtcacacgggcagtgtctcagtttctggtgcctcttcatatgctgggtcctggtggtcagagcgcgataagctgcggttgcacaccccgcactggaagggcttggcgcctgtgtgcttccggtagtggcgggtcagctcatccgatcgcgcgaacctccagtcgcagccttcagataaaatg

SEQ ID NO: 644701 - DNA, 210 bp, Homo sapiens
tcggaaacggtcccgttgccgaccgtctgagttaggtgagggtatacaccgaatccagacttgaccgccctcccaccagaacctctccccagtcggaggttgttcccgggagggatgagggaccccacgacacaacgacccgggaccgagccccttctacccgtgagacgacgcgaaaccctacgacaacttccgtcccggtaactaggt

SEQ ID NO: 644702 - DNA, 654 bp, Homo sapiens
  misc_feature (654)..(654): n is a, c, g, or t
aggtcccaccccaagggccgagctgtttttttgccccggggaaaaggccttttaattgcgggcaacccctgcgaaggggttttgccatttaccgggacacgggtttcatttaacccaaaaattacatttccttttaaagggggaagcccggtttccaaagggggcccccttttacaaaaatgtggcccccctcccatttgctatggggccggcttcctccgggggccggaaaggccggtgttacaattaaggcagtccctaactttatcaatttaggggacaaaaaataacgtgtagggcggtccatggtcaaggcccctaaaagcttgatgcctgggttaaaacccagatgtttgggaaaatattcaaaatttgagtggtcgaaccggcaaagttttattgagaaccggggacctaggttcattgtttgtaaattgtgcaatcctcccacatcttgctattcctgtcaaaccatgtgttcaaaagggagactggtatttccccgttgctcatggaacttgaaacaatggccatcctcttagtcaaatgctcacctttctttggaataactatcaatcttgtcgtcagtttcatctttccagatctgacttacccagtgctatacgctcacaaacttgtgtgttgagttgtggn

SEQ ID NO: 644703 - DNA, 520 bp, Homo sapiens
  misc_feature (5)..(5): n is a, c, g, or t
  misc_feature (237)..(237): n is a, c, g, or t
  misc_feature (243)..(243): n is a, c, g, or t
  misc_feature (267)..(267): n is a, c, g, or t
  misc_feature (443)..(443): n is a, c, g, or t
aaatnaacagggaacaacagcacaaaggcagtaataaattgttatttttgtttcttcctctaatgacacggaaaggcagggagaaagaccttttgaaggtggccccgaagcccatgggagtaaattttccggtggactgggggctctgctgagggaggccaggccacaaggggacaacgctggcaccaggcccagttacctctgtcccactggtaagtagtttggttggtggccgcnagaaanaggacaaacaacaggaagccaccnaggaggaagctcagaaccacgaaaaagcccagcatgaagaaaatccgtggaaaagtaaggaacaggtactgaataagaaagaacgtttccataaaagggaggtgttcaaggccatcgatgtaagtttcctggtataaatctgaaaacaccaccaagtggaccagaaaagtggtgcncacaatggcgagggtggcagcggaggccgtgaaggtcaagaggtagatgaggaagtccctaaggtcccaggccccga

SEQ ID NO: 644704 - DNA, 152 bp, Homo sapiens
acagattacatgcagtcctgacccagattagccgacgtcagacacatatggctacagatttctttaaatctgattataggctgaggctttccatgagtccacataaggaatggatgggcaaacattcaggctcactgtcgggctagtcgggg

SEQ ID NO: 644705 - DNA, 116 bp, Homo sapiens
acccatccttccttctctacgccctgtaaaatccgccgaaaatcctccatgcctcactggagcataggaacaaccacagataggtgagcggctgctcaatatttttttgataattt

SEQ ID NO: 644706 - DNA, 148 bp, Homo sapiens
agaatacccatcgcaggacatgcacagcagcagacacatgacccgcggacggggcatggggatgggacaggcagggagccacactgcaccccatcagtgatgtgcctgatggttctagtcctgagtcctgcccactatggagcccagt

SEQ ID NO: 644707 - DNA, 710 bp, Homo sapiens
  misc_feature (48)..(48): n is a, c, g, or t
  misc_feature (67)..(67): n is a, c, g, or t
  misc_feature (523)..(524): n is a, c, g, or t
  misc_feature (537)..(537): n is a, c, g, or t
  misc_feature (548)..(548): n is a, c, g, or t
  misc_feature (555)..(555): n is a, c, g, or t
  misc_feature (572)..(572): n is a, c, g, or t
gtagacctagtggatcctttgggctgcaggaattcggcacgagaaaanttgtatatatatatatacnctaaaagtggtatatatatatatacactaaaagtggtatatatatatatatacactaaaagtggtatatatatatatatatatacactaaaagtggtatatatatatacactaaaagtggtatatgtatatatatacactaaaagtggtatatgtatatatatacactaaaagtggtatatgtatatatatatacacactaaaagtggtatatgtatatatatatatatacacactaaaagtggtatatatatatacacactaaaagtggtatatatatatatacactaaaagtggtatatatatatatatatacacacactaaaagtggtatatatatatatatacacacactaaaagtggtatacatatatatatgcactaaaagtggtatatatatatacactaaaagtggtgtatatatatatatacacacacacatatatactaaaagtgnnatatatatatatnctaaaagtggnatatatntatatactaaaagtggnatatctttacctatacttccattcctgggggttatatctcacgctctctttcgacacccggtgtcccatatcaacgctcaccatcattaagcctagctcgatctcgcgttacctccgcttcgtgccgctcacgatcct

SEQ ID NO: 644708 - DNA, 367 bp, Homo sapiens
ccctgggcccggatttcctttcacagtgtttgctaggacgtcaattaaggctggagctgctgtagtcagaaaatgatagaggccggccgcggtggctcactcacacctgtaatccctgcactttgggaggccgaggcaggtagatcacctgaggtcaggagttcaagaccagcctagccaacatagtgaaactctgtctctactaaaaaatacaaaaattagctgggcgtggtggcgggcgcctgtaatcccagatactcgggaggctaaggcaggagaatcacttgaacccgggaggtgaaggttgcagagagccaagatcacaccactgcactccagcctgggtgaccgagcgagactccgtctc

SEQ ID NO: 644709 - DNA, 728 bp, Homo sapiens
  misc_feature (48)..(48): n is a, c, g, or t
  misc_feature (67)..(67): n is a, c, g, or t
  misc_feature (523)..(524): n is a, c, g, or t
  misc_feature (537)..(537): n is a, c, g, or t
  misc_feature (548)..(548): n is a, c, g, or t
  misc_feature (555)..(555): n is a, c, g, or t
  misc_feature (572)..(572): n is a, c, g, or t
gtagacctagtggatcctttgggctgcaggaattcggcacgagaaaanttgtatatatatatatacnctaaaagtggtatatatatatatacactaaaagtggtatatatatatatatacactaaaagtggtatatatatatatatatatacactaaaagtggtatatatatatacactaaaagtggtatatgtatatatatacactaaaagtggtatatgtatatatatacactaaaagtggtatatgtatatatatatacacactaaaagtggtatatgtatatatatatatatacacactaaaagtggtatatatatatacacactaaaagtggtatatatatatatacactaaaagtggtatatatatatatatatacacacactaaaagtggtatatatatatatatacacacactaaaagtggtatacatatatatatgcactaaaagtggtatatatatatacactaaaagtggtgtatatatatatatacacacacacatatatactaaaagtgnnatatatatatatnctaaaagtggnatatatntatatactaaaagtggnatatatatatatatatatatatactaaaaggggatatatatatatatatatatacaacagggggatatatatatatatgtatgtatgtgtgtgtatatatactagggtgtatttgtgggggtggaacatattatacacaccctcttgtgggggggt

SEQ ID NO: 644710 - DNA, 423 bp, Homo sapiens
agagagagagagagagagagagagagagagagagagagagagagagagagtgagagagagagagagagagagcgagagagagagagagacagcgagctacacacagagagcgaccctgactgctgcgccacgcaggaacctgccagagctgcctgcttctcgcgacacacatttcactgcccacacctcccccccttgctgcttccatccgttcatctgatgacctccgctcttcattaccctgaagctacttttctttgctaatacttctatcactgctccaacagacagccttacttctattccccgccgctccttccctttgctcgctttatagcctgcttttacacactcgccgcctccttctcctaacgccttcctgcctgttccccctctcgatcatcttccctattactcttcccg

SEQ ID NO: 644711 - DNA, 208 bp, Homo sapiens
cgcttggaggatgagagatatgtagaggacagacagccccaataataccacccaaagagccacgcaacgagccacgccaagagcctcaccaggagccacgcaaggagccactccacgggccacacaaagagccgtatggttgcaaagctgaaacttaaaggaattgacggaaggacaccacgggccacgcaacgagccacccaaagcg

SEQ ID NO: 644712 - DNA, 622 bp, Homo sapiens
  misc_feature (530)..(530): n is a, c, g, or t
cccacccagaagacaaaggatagcctggaccggtcgcagagtgagttgcacaatgactgtctgatctctaaggagagcgcctgcctcatgcaggacaggatctgtagctgtgagatcaatgtgagcgacgccattatgacctttggcttagagcccaaagacctcatgtctgtactgaacgacaactacggggataagactgaggtgatcagcagtctgcgaaatgccaactctgaagatcatgaaagtggaactgagactaacacctatgctgtcttaaacagcgtctatctcatgacgaacagccatacgcgactcctatacatgtaaacgatgggctggcaggaaatccgacatgccatcagccgtctgacagatggtgacaatatgggtggctctaccaagacagctgctgaccatatgagagagatgctgaacattaaccagcctagccatgactatctggacatctatgccatcgacgtgaacatgctggatgtggactgagcagaactgtatgcgctaggcancaagactgatgagtagagacttgcattgattgtgtagtacacaaggctttggaccaagtcttgtcacatatgctcgatgtcccgcttacagc

SEQ ID NO: 644713 - DNA, 527 bp, Homo sapiens
  misc_feature (54)..(54): n is a, c, g, or t
  misc_feature (56)..(56): n is a, c, g, or t
  misc_feature (275)..(275): n is a, c, g, or t
tcacccggggagatgcacagagaaaaaagcattccggtgggcgctttccctatnanactcaaacttagcccctcggggcctggttgggtggcatggccaacgaaggcaaaaacccaacggctcccagtttttcatccgccagtcaaaccaccctggctaaatggcaagcatgtggtgtttgccaaaattctaaagggcatggaggtggggcggaaggtggaaagccccaaaacaaccacccgggataaaccccttaaggatgtgttcctcccaanttggggcaaaattgaggtggaaaagccctttcccctccccaaggagtaggggacagggacatctttttttaagggcccgtttgggcaggccctgtagtcccccccagggtttttaattgccctggccccggggttggcatttgggggaggggaccccccccccccccattccccggggccaggggctcccttttggaacaaaccccccccccccctgcccaaaaaaaaaaaagggggggtttttttttttta

SEQ ID NO: 644714 - DNA, 744 bp, Homo sapiens
  misc_feature (693)..(693): n is a, c, g, or t
  misc_feature (695)..(695): n is a, c, g, or t
aattcggccgcgtcgagaagacgacagaagggggcagagcatggcggcgggcgagcttgagggtggcaaacccctgagcgggctgctgaatgcgctggcccaggacactttccacgggtaccccggcatcacagaggagctgctacggagccagctatatccagaggtgccacccgaggagttccgcccctttctggcaaagatgagggggattcttaagtctattgcgtctgcagacatggatttcaaccagctggaggcattcttgactgctcaaaccaaaaagcaaggtgggatcacatctgaccaagctgctgtcatttccaaattctggaagagccacaagacaaaaatccgtgagagcctcatgaaccagagccgctggaatagcgggcttcggggcctgagctggagagttgatggcaagtctcagtcaaggcactcagctcaaatacacacacctgttgccattatagagctggaattaggcaaatatggacaggaatctgaatttctgtgtttggaatttgatgaggtcaaagtcaaccaaattctgaagacgctgtcagaggtagaagaaagtatcagcacactgatcagccagcctaactgaagatgatttttgatggttttggtttttttcaccccggtttccctttcccccccccttccccttttacaaccttttttttntnccccgcattggtattaaatcctcgcattcagtcaaaaaaacaaaaaaaa

SEQ ID NO: 644715 - DNA, 855 bp, Homo sapiens
aattcggccgcgtcgagaagacgacagaagggggcagagcatggcggcgggcgagcttgagggtggcaaacccctgagcgggctgctgaatgcgctggcccaggacactttccacgggtaccccggcatcacagaggagctgctacggagccagctatatccagaggtgccacccgaggagttccgcccctttctggcaaagatgagggggattcttaagtctattgcgtctgcagacatggatttcaaccagctggaggcattcttgactgctcaaaccaaaaagcaaggtgggatcacatctgaccaagctgctgtcatttccaaattctggaagagccacaagacaaaaatccgtgagagcctcatgaaccagagccgctggaatagcgggcttcggggcctgagctggagagttgatggcaagtctcagtcaaggcactcagctcaaatacacacacctgttgccattatagagctggaattaggcaaatatggacaggaatctgaatttctgtgtttggaatttgatgaggtcaaagtcaaccaaattctgaagacgctgtcagaggtagaagaaagtatcagcacactgatcagccagcctaactgaagatgatgtatgaaggagtggagtgttgacaacaaggggtccatgatccctccccactgaccttttctaaaaaaattctggggcccgcattgggataaatcctcgaattaaggcttccctgctctacttgctcagattctttttttctagcttcatttaggcttacattgggtcaggcagagggtctcacccttcgggtgcatggtgatagggggccttgggcataacctttttgtggtatt

SEQ ID NO: 644716 - DNA, 220 bp, Homo sapiens
ggctcaacactgactgaaacatcaactcatctgaattttcagaccaccagcttgccctacagattttggactggctggcccccacaactgaataagccaattccctaaaatctcctctctctctcctctccctctcgactagtacacatgtgtatatgtaacatctggattcagagaaagtgactatagccaggaggaagtagaatcatggacgaggaga

SEQ ID NO: 644717 - DNA, 801 bp, Homo sapiens
aattcggccgcgtcgagaagacgacagaagggggcagagcatggcggcgggcgagcttgagggtggcaaacccctgagcgggctgctgaatgcgctggcccaggacactttccacgggtaccccggcatcacagaggagctgctacggagccagctatatccagaggtgccacccgaggagttccgcccctttctggcaaagatgagggggattcttaagtctattgcgtctgcagacatggatttcaaccagctggaggcattcttgactgctcaaaccaaaaagcaaggtgggatcacatctgaccaagctgctgtcatttccaaattctggaagagccacaagacactgagctggagagttgatggcaagtctcagtcaaggcactcagctcaaatacacacacctgttgccattatagagctggaattaggcaaatatggacaggaatctgaatttctgtgtttggaatttgatgaggtcaaagtcaaccaaattctgaagacgctgtcagaggtagaagaaagtatcagcacactgatcagccagcctaactgaagatgatgtatgaaggagtggagtgttgacaacaaggggtccatgatccctccccactgaccttttctaaaaaaattctggggcccgcattgggataaatcctcgaattaaggcttccctgctctacttgctcagattctttttttctagcttcatttaggcttacattgggtcaggcagagggtctcacccttcgggtgcatggtgatagggggccttgggcataacctttttgtggtatt

SEQ ID NO: 644718 - DNA, 309 bp, Homo sapiens
acactccttccgaatttccaaagtgctctgactatagctggagagtttgcatcgaggagaaatagtaataaaatagtatggggtggtttgcgggaagaagtacagatttacacatgggggtggtcagaaactgacatgagttaaatttaacattttggacgtctttcctactggatcagtagaaaaccactgcacaaacggtttaggatgagttatcctagaaaagggaaattctgactaaaagagaaaacacacggtagcagggtttttggcacttgtgagtaattcattaaagatcgaactttgaat

SEQ ID NO: 644719 - DNA, 884 bp, Homo sapiens
  misc_feature (833)..(833): n is a, c, g, or t
  misc_feature (835)..(835): n is a, c, g, or t
aattcggccgcgtcgagaagacgacagaagggggcagagcatggcggcgggcgagcttgagggtggcaaacccctgagcgggctgctgaatgcgctggcccaggacactttccacgggtaccccggcatcacagaggagctgctacggagccagctatatccagaggtgccacccgaggagttccgcccctttctggcaaagatgagggggattcttaagagacagaatctccccatatcgtccagggtggtctcaaattcctgggcttaagcaaccctctctctttagcctcccaattgctgggattacagcagctattctgggcctggaaacttgacttgggttaaaggagtggctggtctattgcgtctgcagacatggatttcaaccagctggaggcattcttgactgctcaaaccaaaaagcaaggtgggatcacatctgaccaagctgctgtcatttccaaattctggaagagccacaagacaaaaatccgtgagagcctcatgaaccagagccgctggaatagcgggcttcggggcctgagctggagagttgatggcaagtctcagtcaaggcactcagctcaaatacacacacctgttgccattatagagctggaattaggcaaatatggacaggaatctgaatttctgtgtttggaatttgatgaggtcaaagtcaaccaaattctgaagacgctgtcagaggtagaagaaagtatcagcacactgatcagccagcctaactgaagatgatttttgatggttttggtttttttcaccccggtttccctttcccccccccttccccttttacaaccttttttttntnccccgcattggtattaaatcctcgcattcagtcaaaaaaacaaaaaaaa

SEQ ID NO: 644720 - DNA, 123 bp, Homo sapiens
cgcacacagtgcttctgtatttcactctttctccctattagggagttatgcaaaatgtgtccccgattttacctttgtctttctgtgtactttacaaagagtcccaagaggtaaaactcccag

SEQ ID NO: 644721 - DNA, 335 bp, Homo sapiens
ctcctcaatggtctatcattatcatgtactataagttacttcctaaataagattacagtcctttattataaggcccctacgggtactatagtatacatttaaaaaacgctactagaaaaattttcttttctttgggtttgggcttatggtgtacttagctatagataattttggaatacaaagcctagggtacatataaatgcaatagttaactgatcctgttggctgatgtcctttgtatgtgccacaggtgacatcttttaatccagcatcttctcctgtttctagccttcctttttcttcttcttagattctgcttgaggatggtccgcaca

SEQ ID NO: 644722 - DNA, 204 bp, Homo sapiens
catcagtgaactttcgatgcctgaaagataaaggcagaagtcataagcatacttgagtttgttaccatagaaaaaagaaagaaaaaaacaaaagaaaataaaataaagtcacaagcaaaaagcctgcaaggtagtccatttatttttatttttattttttatttttgagatggggtttcactcttgttgcccaggctggagtgc

SEQ ID NO: 644723 - DNA, 110 bp, Homo sapiens
gagtctagtcgacttctgctctcatctggggtcatgtcaggttcgggggctgcagcagccaaagcgcatgagaggtgtttcctttggcttccaagaatgccactgtggag

SEQ ID NO: 644724 - DNA, 797 bp, Homo sapiens
  misc_feature (62)..(63): n is a, c, g, or t
  misc_feature (68)..(68): n is a, c, g, or t
  misc_feature (104)..(104): n is a, c, g, or t
  misc_feature (116)..(116): n is a, c, g, or t
  misc_feature (121)..(121): n is a, c, g, or t
  misc_feature (138)..(138): n is a, c, g, or t
  misc_feature (166)..(167): n is a, c, g, or t
  misc_feature (206)..(206): n is a, c, g, or t
  misc_feature (210)..(210): n is a, c, g, or t
  misc_feature (231)..(231): n is a, c, g, or t
  misc_feature (248)..(248): n is a, c, g, or t
  misc_feature (256)..(256): n is a, c, g, or t
  misc_feature (260)..(260): n is a, c, g, or t
  misc_feature (308)..(308): n is a, c, g, or t
  misc_feature (331)..(331): n is a, c, g, or t
  misc_feature (333)..(333): n is a, c, g, or t
  misc_feature (336)..(336): n is a, c, g, or t
  misc_feature (338)..(340): n is a, c, g, or t
  misc_feature (362)..(362): n is a, c, g, or t
  misc_feature (364)..(364): n is a, c, g, or t
  misc_feature (387)..(387): n is a, c, g, or t
  misc_feature (412)..(412): n is a, c, g, or t
  misc_feature (429)..(429): n is a, c, g, or t
  misc_feature (454)..(454): n is a, c, g, or t
  misc_feature (479)..(479): n is a, c, g, or t
  misc_feature (485)..(485): n is a, c, g, or t
  misc_feature (495)..(495): n is a, c, g, or t
  misc_feature (515)..(516): n is a, c, g, or t
  misc_feature (519)..(520): n is a, c, g, or t
  misc_feature (549)..(549): n is a, c, g, or t
  misc_feature (561)..(561): n is a, c, g, or t
  misc_feature (569)..(569): n is a, c, g, or t
  misc_feature (599)..(600): n is a, c, g, or t
  misc_feature (602)..(602): n is a, c, g, or t
  misc_feature (608)..(608): n is a, c, g, or t
  misc_feature (611)..(613): n is a, c, g, or t
  misc_feature (615)..(615): n is a, c, g, or t
  misc_feature (617)..(617): n is a, c, g, or t
  misc_feature (621)..(624): n is a, c, g, or t
  misc_feature (627)..(628): n is a, c, g, or t
  misc_feature (632)..(633): n is a, c, g, or t
  misc_feature (635)..(635): n is a, c, g, or t
  misc_feature (637)..(638): n is a, c, g, or t
  misc_feature (642)..(642): n is a, c, g, or t
  misc_feature (653)..(653): n is a, c, g, or t
  misc_feature (659)..(659): n is a, c, g, or t
  misc_feature (661)..(661): n is a, c, g, or t
  misc_feature (663)..(665): n is a, c, g, or t
  misc_feature (668)..(668): n is a, c, g, or t
  misc_feature (682)..(682): n is a, c, g, or t
  misc_feature (691)..(691): n is a, c, g, or t
  misc_feature (695)..(695): n is a, c, g, or t
  misc_feature (707)..(707): n is a, c, g, or t
  misc_feature (723)..(723): n is a, c, g, or t
  misc_feature (727)..(727): n is a, c, g, or t
  misc_feature (731)..(731): n is a, c, g, or t
  misc_feature (737)..(737): n is a, c, g, or t
  misc_feature (753)..(753): n is a, c, g, or t
gggagatgctttcatcgtctctccttccctcaagtgttctggaacctatcatttaaattaanngagtnaggcaggagggggcggggaatccttccgcccttctnaggaggggctgnattgnagggggaaagtaaactnaaaaaataaataaatgaaaagggaaaannagtaaaaaaaaaaaaaagtaaaaaaaaaaaaaaatttgnattnaaaaagaaaggagaagaaaanggaaataaagaagaaanaaaaaaanattnaaaaaaagaaaaaaattaaatgaaaaaaggaaaaaataaaggaaaatntaaaaaaaaaaaaaagtaaattnanttnannnaggataaaaataaaaaaaatgnanaagaaggaaaaggaaagaataanaatgaaaaaaaaaaaaaaaaaaaangaaaaaaaaaaaagtanaggaaaaaaaaaaggaaaaaaaaanaaaaaaaaaaaagaaaaaaaaaaanaagganatggaataantgaataaaaaaaattaaaannaannaaaaaaaaaattgaaaaaataaaaaaatnaaaaatgaaaangaaaaaangaaaaaaattaaataaaaaaaaaaaaaaanntnattgtnttnnntntnaagnnnnttnntttnnantnntttnccattttaatnttgttntntnnntantgtgttggtggtgntgatgaatntgcnagagttgagttntatgtatttatttatntatntgtntactcnatttctctcaaaagcnctcaagtcacaaagtaaatggttcaagcaatggagtatgggtca

SEQ ID NO: 644725 - DNA, 231 bp, Homo sapiens
  misc_feature (16)..(16): n is a, c, g, or t
  misc_feature (40)..(40): n is a, c, g, or t
  misc_feature (161)..(161): n is a, c, g, or t
  misc_feature (187)..(187): n is a, c, g, or t
gagtggccccacctgngcgtccgatgctgccgtcacctgntcctccgcctactgtccctctcagtgccttctctcagctcccaggccaacagtagccaaacccctagagacagtgatgcctgcccgcaccctggcctggtccctggtccttcactggcgcnttctcggagctggcccagggcgtganaagcatggacagtgtgggcgctctccctaacttgcctccttttt

SEQ ID NO: 644726 - DNA, 314 bp, Homo sapiens
  misc_feature (257)..(257): n is a, c, g, or t
  misc_feature (260)..(260): n is a, c, g, or t
  misc_feature (287)..(287): n is a, c, g, or t
gcagattccatatcacggctattttgaatgatgcttcaatatccctgggtgcagatgtctctttgacatactaatttcattttttttgattacgtacccagtagtgggattgctgggtaatataatagttctcttttttattttttgtggaaactccatactgcttttcataacagctatactattttaaattcccaccaacagtgtataacattcctctttctccacattatcgtttccatttgttatatttttgnctncttgataaatatccatcaatttaaacntggggtaagggaatagctcattgcggg

SEQ ID NO: 644727 - DNA, 377 bp, Homo sapiens
gtgatgttatcgccaacactacttctttattctgaagcactgtaaagtatatttagattaataatttccaaaccaagaaaatgaaagcctatattaattataagacccaaacagaaaaaatctgtaaaacgatcaagaccataaaattcacataccttctatttggtcaatgcagagacacagatctttgttccggagtatgaatttaaatgcaaagcttcagagcctgaaaatgtctaaaattagacccatgactgacaactgggctaggctcaatgtctttggaatgtgctctactaaatttggtaccatttggactgggttccctccaaaattcaggtgttgggggataacatcaggggaccgcgctcgaaatt

SEQ ID NO: 644728 - DNA, 298 bp, Homo sapiens
cctttttaatgcgctagaatatgtggctatttattgatgaattatttttaatctcagagttgtcgattgtacctttaagaaaaacatattttcctacaataaagcccctaattttatttgctaaaatcagagttctagttcagattttgttttgtgttcttactctggaggcccaaatggagtaaccccagtatgtttatgttggagaggagttttgtgttgcctttcaaacttgaatccaatagaactacagacttaaacaataaatatgaatgggagataaggaaaatcaaagcca

SEQ ID NO: 644729 - DNA, 1081 bp, Homo sapiens
  misc_feature (424)..(424): n is a, c, g, or t
  misc_feature (436)..(436): n is a, c, g, or t
  misc_feature (463)..(463): n is a, c, g, or t
ataacaacatcatcttatatcatgactactgactaaaatccttagtagctgggactacaggcacatgctacaatgtctggctaattttttaattcgtttgtagagatgggggtctccccatgttgccgaggctggtctcaaactccaggcctcaaaagatcctcccaccttggcctcccaaagggctgggattacagggatgagccactatgcccagcccataattttttttgttatgaaacataggatctcattacagcagattggaaagtagattaattcattcctaatcccagtgcttattcaataataacaaatatttattgcatgcttaactgtgctaggagctagagctgtggaggtggacaattactgtgagtagtctagttgatttcctccatttgtaaaacgaggcatcactttntgtccatgtttntgtgttttatagttacagtaaacaatntgatgtcctacttttttttttttttttttggagacgggagtctcgctctggtcgcccaggccgggactggcgggacggcgaggggccggcaatctcggctcatggcaagcctccggtttcccggggttcacggccattctccggcctcagcctcccgagtagctggggactacgggcgcccgccaccggcgcccgggctaattttttttgggtattttttaagtaagagacgggggtttcacctggttagccaggagggtctcgatctcctgacctcatgatccacccggcctccggcctcccaaaggtgcggggattacgggcgtgagccaccgggccggcgccgaggtcctacttttaaattaaatcattagctcttccccagtttggttaacttcacaaaggtttttcacggtcaattatatgctagagtaaccgttaaaataaactattattttttaatgttggcaaaaaaaaaaaaaaaaactccggcgctttattggcgggggggaaaaaaggggtttggaatgggcatgggtcataggcggtttctgaaccagtttttgtccaaggggaattgcggggccccaaggggggataatcaaacagttgagaacg

SEQ ID NO: 644730 - DNA, 889 bp, Homo sapiens
agcggaggtgcagcccaacatccggactccgtagaccagcggatctcgtgcaaagcctctttctcgaccacccaccctaccacttcttgctaaccatggcggtagttggctggtggtctcgagtctgaactgttcatcatcggcgtggtactattcgttccgcgtgctgctgcaggtgtcaaggtactccctgcagaatcctgtcatacacaggtgtcgcaggaacggggcaggcaggtgtatgaggggaagcagcatggcaacgactgatgtccactccaagcttgagtgcaccccatgcatccactagctccatggggtcgtgcccgttcattcatacacggtcgctccgtgtcgccgatcttcgtgcccacggaaaccaggcgaagcctaggtgtactggcagtcaggtaagtgctggtggtccccgtgttgtttccctcggccagtaggagtcacttgtgtcccggatcaatgaaggggccatgttaaacctccagggagaagcagtgacccgaccaaagtcaccgaaatgaattaccaagtagtcccatatcggtaagccgcgtatatgctaccaggggtccgctactatatagcggggacaagggatacggataagcagtgcaagcggttgagaattacgagggaagtcatgacacccgccattgcatcactcctgggggccattagagacagcgctgcaacattcttggaattctcgaggaacagataagttcggggcaaccaggattactctaatcctccacgtcccctcatgtaaagtccttgtggatcgctggccgttgattaggccccgaaccaagtgggaagaactctaatattcatccgaaactccagtgcgagtcacagaaactggaaccattcc

SEQ ID NO: 644731 - DNA, 158 bp, Homo sapiens
cccgtagtgagaggtgaggagtgtctctgcctggtcgcccatcgtctgggatgtgaggagccctctgcccggcgcccagtctggtaagtgaggagcgtctccgcccgggcgccatcccatctaggaagtgaggagcgcctcttcccagccgccatcta

SEQ ID NO: 644732 - DNA, 349 bp, Homo sapiens
actttgtagttcatttagacgactagagtaaatattaagggccttttcccagggattatgggctttttaaaggcagtcgctctttaaattcacagggcgggctgtgtgtgtgtgtgtgtgcgcatgcgcgcgtgtctgtgtctgtgcgtgcgtgtgtgtgtgtgcgcatgcgcgcgtgtctgtgtcagcgtgtgtgtgtgcgagcgtagtgtagtgtgtcagtctgagtgtgagagtcagagtgtgtgtagtgaccgagcgtgagtgagagactgagagagagagtacagagcgtgagcgtgtgtgtccgactgacataaagcccacgaacagcgagtgacaaagaaaa

SEQ ID NO: 644733 - DNA, 703 bp, Homo sapiens
accccgatccgaagacattgaggctgtgttttgaagcatgccattgataggttgaacataacatttttcttagaataaaagcacattccatacactctactatggcagaataaggaggttcacagataattgagagaagccaccgaaacgtgctgttttctgaaggtctccctacgcgtgttgtagtaaatgtgtgtctctctgtgactgacagtatgctggcggtcagggccccaagctcagccttgcgtttgagtgtatctttagatggaaaaggcgttggtgtggtgtggattgtagcttcccgaaactcatggcgcctcccctcggacgtcggtgtcgtggcgcctccccgcggatgtcggtcttgggtgttttgggggagaaaacaagccccatccttcccgcggggtttctgggcttcacgcctgccttgccctctcagacaaaggccaggacttgtgcggcccacactagtgtatcgccctgtattagagtaaaacatgtttatcaaagaacattggaaaatcagacacaaagaagaaaataaaaatcacctacaagctgccacaccaaaaaaaaaaacacacttccagaaatttcccctccgcatacttatagtcagattgcatgaattgtttgcataatcatatttacttaaaataagtatagccttcccttaagtataaattgtccctccaca

SEQ ID NO: 644734 - DNA, 6051 bp, Homo sapiens
  misc_feature (3052)..(3052): n is a, c, g, or t
  misc_feature (3054)..(3054): n is a, c, g, or t
  misc_feature (3282)..(3282): n is a, c, g, or t
  misc_feature (4304)..(4304): n is a, c, g, or t
  misc_feature (5274)..(5274): n is a, c, g, or t
  misc_feature (5277)..(5277): n is a, c, g, or t
  misc_feature (5902)..(5902): n is a, c, g, or t
  misc_feature (5962)..(5962): n is a, c, g, or t
ggcggcggcggcggcggttaacggcgcttcccgtgcggctgaggacgatccgccagtgagcgcggagactgcttccacttcgggcgggggagccccggaccgaatcggctctctaggccgtggagcttgccgtcccacctccgtccaaatcgacctttcctttctatccccaaccacccctcaacccctgttttcccctgccttccttgcagaggccatggaggacgaggagagacagaagaagctggaggccggcaaagccaagattgaagaactctctttagcttttcttgtcagacagcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaactggaaagtgaaatttcaaccacagcagatgactgcagttcagaggtaaatggttgcagttttgtgatgagaacaggaaagcctacaaatttattaagggaagaagaatttggtgttgatgattcttattctgaacaaggagcacaagacagtccgactcatctagagatgatggaaagtgagttggctgggaagcagcatgagattgaagagctaaacagagagctggaagaaatgagggttacctatgggactgaaggactgcagcagttacaagaatttgaagctgccattaaacaaagagatggcattataacccagctcactgctaatttacaacaagcaagaagagaaaaggatgagacaatgagagaatttttagagttgacagaacagagtcaaaaattacagattcaatttcagcaattacaggctagtgaaactctgagaaacagcactcatagtagcacagctgcagacttactacaagccaaacaacagatcctcactcatcaacagcagcttgaagaacaagaccacttattagaagattatcagaaaaagaaagaagacttcacaatgcaaattagtttcttgcaagagaaaattaaagtatatgaaatggaacaagataaaaaagtagaaaactcaaataaagaagaaatacaggaaaaggagacaatcattgaagaattaaacacaaaaataatagaagaagaaaagaaaactcttgagctaaaggataaattaacaactgctgataaattactaggagaattacaagaacagattgtgcaaaagaaccaagaaataaaaaacatgaaattagagctgactaattctaagcaaaaagaaagacagtcttctgaagaaataaaacagttaatggggacagtcgaagaacttcagaagagaaatcataaagacagccagttcgaaactgatatagtacaacgaatggaacaagaaacacaaagaaagttagaacaactccgggcagagctggatgagatgtatgggcagcagatagtgcaaatgaaacaagaattaataagacaacacatggcacagatggaggaaatgaaaacacggcataagggagaaatggagaatgctttaaggtcatattcaaatattacagttaatgaagatcagataaagttaatgaatgtggcaataaatgaactgaatataaaattgcaagatactaactctcaaaaggaaaaactcaaggaagaactaggactaattttagaagaaaagtgtgctctacagagacagcttgaagaccttgttgaagaattgagcttttcaagggaacagattcagagagctagacagacaatagctgaacaagaaagtaaacttaatgaagcacataagtcccttagtacagtggaagatttgaaagctgagattgtttctgcatctgaatccagaaaggaactagaattaaaacatgaagcagaagttacaaattacaagataaaacttgaaatgttagaaaaagaaaagaatgctgtgttagacagaatggctgaatcacaagaagctgaattagagaggctgagaacacagcttctatttagtcacgaagaagagctttccaaactgaaggaagatttagaaattgaacatcgaataaatattgaaaaacttaaagataatttaggcattcactataaacagcagatagatggtttacagaatgaaatgagtcaaaagatagaaaccatgcagtttgaaaaggacaatttgataactaagcagaatcaattaattttggaaatttcaaagctaaaagatttacagcagtctcttgtaaattcaaagtcagaagaaatgactcttcaaatcaatgaacttcaaaaagaaattgaaatactcagacaagaagaaaaagaaaagggtacacttgaacaagaagttcaagaattacaacttaaaacagaattgttagaaaaacagatgaaggaaaaagagaatgatcttcaagaaaaatttgcacaacttgaagcagagaatagcattcttaaagatgaaaagaaaacccttgaagacatgttgaaaatacatactcctgttagccaagaagaaagattgattttcttagactccattaagtccaaatccaaagactctgtgtgggaaaaagaaatagaaatacttatagaggaaaatgaggacctcaaacaacaatgtattcagctaaatgaagagattgaaaagcaaaggaacactttttcatttgctgaaaaaaactttgaagttaactatcaagagttacaagaggagtatgcttgccttctcaaagtaaaagatgatttagaagacagtaaaaataaacaggaattagagtataaaagtaaacttaaagcacttaatgaagagcttcatttgcaaagaataaatccaactacagtgaaaatgaaaagttctgtctttgatgaagacaaaacttttgtagcagaaacattggaaatgggtgaggtngntgaaaaggatacaacagaactcatggaaaaacttgaggtaaccaagcgagagaaattagagctgtcacagagactgtctgatctttctgaacaattgaaaccgaaacctggtgagattagttttctaaatgaagaagttaaatctttaaagccagagaaagaaccagtttcattgagatgtagagagctagaaatcattattaaccacaaccgggcagaaaatgtacngtcatgtgatactcaagtaagctctttattagatggagttgtgactatgaccagcaggggtgctgaaggatcagtttctaaagtaaataaaagttttggtgaagaatcaaaaataatggtggaagataaagtttcttttgaaaatatgactgttggagaagaaagtaagcaagaacagttgattttggatcacttaccatctgtaacaaaggaatcatcacttagagcaactcaaccaagtgaaaatgataaacttcagaaagaactcaatgtacttaaatcagaacagaatgatttaaggctacagatggaagcccaacgcatttgcctctctctggtttattcaactcatgtggatcaggttcgtgaatatatggaaaatgaaaaagataaagctctttgcagtcttaaagaagagcttatttttgctcaagaggaaaagatcaaggaacttcagaaaatacaccagttagaactacagactatgaaaacacaagaaacaggtgatgaaggaaagcctttacatctgctcattggaaaacttcaaaaggcagtgtctgaagaatgttcttattttttacagactttatgcagtgtccttggtgaatattatactcctgctttaaaatgtgaagtaaatgcagaagacaaagagaattctggtgattacatttctgaaaatgaagatccagaattacaagattatagatatgaagttcaagactttcaagaaaatatgcacactcttctcaacaaagtaacagaagaatacaacaaactcttggtacttcaaacacgactaagcaagatctggggacagcagacagatggtatgaaacttgaatttggagaagaaaaccttccaaaagaggaaacagagtttttatcaatccattctcagatgaccaatttggaagacattgatgtcaatcataaaagcaagttatcttctctgcaagatcttgaaaaaactaaacttgaagaacaagttcaagaattagaaagcctcatatcctctttgnagcaacagttgaaagaaactgaacaaaactatgaggcagagatccactgtttacagaagaggcttcaagctgttagtgagtccacggttccgccaagcttacctgttgattcggtggtaattacagaatctgatgcacagagaacaatgtaccctggaagttgtgtgaaaaagaatattgatggtacaatagagttttctggtgaatttggagtgaaagaggaaacaaatatcgttaagttgcttgaaaaacaataccaagaacaattagaagaagaagtagctaaggttattgtgtcaatgagtatagcatttgctcaacaaactgaactgtctagaatatctgggggaaaagaaaatactgcatcatcaaagcaagcacatgctgtgtgtcagcaagaacaacattattttaatgaaatgaaattatcacaggatcaaattggttttcagacttttgagacagtggatgtgaaatttaaagaagaatttaaaccacttagtaaagagttaggagaacatggaaaggaaattttattatcaaatagtgatccccatgatataccagaatcaaaggactgtgtgctgactatttcagaagaaatgttctccaaagataaaacatttatagttagacagtctattcatgatgagatttcagtgtcaagcatggatgcttctagacaactaatgttgaatgaagaacagttggaagatatgagacaggaacttgtacgacaataccaagaacatcaacaggcaacggaattgttaaggcaagcacatatgccgcaaatggagagacagcgagaagaccaggaactagctacaagaagagattaagagacttaatagacaattagcccaggtaagggtcttgtagtcccctttctctccccagttaatttttttttccaaacaccaacttgaaccagatccccaattaaaacaacagtattttttatgtagcnatnatttttttttttgccgaaatctgaataaactacatatatttagcatcaggaacacactctatactaagacagcagctttagatcttgttagggacacctatctcaaccttggagtgggcattgtctttctgtcattttatttaactcctttttcaagcactggaaaagtggctacacggttttgtttttttcttttaaatcattccattagccatatatagcaaactcactttgacattttggaaataacattgtgctgaggtgctccattatgcagttactatcattcagttttactatcttcatttatagttttgtgagtccaccaattagcatctcgaaggtttacctttatctgtctttaatccatctttttaatcatgaatggaaatcggaagtagtatgcttctgaaactctttccagggaaacatctcttcttgatttgagaaatgcaaatttatttaacattcttatccctttcttgactaaatttaaatacttcttggtatttgggagctggattcttgtcaactgctgtataaaatatactcacccaaccattgcagaaaagcaagaaatatttatgtagaagttcttatgaaaacttattgaatttaattttgnaaactgaagctaagagagataataaatatctagagataactattaacagtattctttcanacataaaataataagataattgggagctgagcataaaacattatttggaaaaattaactttgcttttcttcattgcattttgtgaattc

SEQ ID NO: 644735 - DNA, 1068 bp, Homo sapiens
tattgtgatggaaatatgtcattttgtgtatttataaaaagttgttcgcagctgggtgcagatggtgtgtgcctatagttccagctcctcggaagctggggcaggaggatcacttgagaccaggaatttgaggccacagtgccctagaatcatgcctctgaatagctgctacactccagacctgggcaacaaaccaagaccccatctttaaccaaaaaaaaaaaaaaaaaaccacaaaaaaactgtgtaagccgaccccgagaccatacaaaaaagaataaaacaaatacgtatagggaaaagaagacaaaaagaaagcaaagaacaacggacaaaaagaaggccacataaagacaaaccgggaccatacaaaattaggaacaagagaaattacaaacaaatcacaacaaagaccagaggggagaaaaaggaaatttcataaaaaaatataagagaagagaagaaaaaagcagcaaaaaaagggaaaaatatataacaccagagataccacaaaaaaataacaaataaaaacaaataaacaccccgaacacgatggagcaaaaaacgaaaaacaacaatacaaacaaaacagagaaaaagccgaagggagtgcacagaagaacgagagcacgagtgagaagagcaagatgagggaagaaagagataggatgaacgaagtagtaacaagagaataagagatgctacaacccaaaccacaccgcgagacaagaagcgcggagaggcgataacagaagcacaaggagagagaatcagacacactacataacctaatatgtcacatagtacgattaaaagaagccaaaggagaccaaaagtctcagccagacgaatagcgacggggaggatgggagaggaaggaggacatgcctagaaggactgaagaagcgggaggagctaggtgaggtcaagagagaagagcggcagacaagggacgaacaagggagtcagcaggagagcgaaggcgacagaaagagaagcagcaagacagaggggcgaaagaggcggggacagcagcggcagagccaggaggaagggggcagagaagaa

SEQ ID NO: 644736 - DNA, 758 bp, Homo sapiens
  misc_feature (37)..(37): n is a, c, g, or t
  misc_feature (73)..(73): n is a, c, g, or t
  misc_feature (81)..(82): n is a, c, g, or t
  misc_feature (95)..(95): n is a, c, g, or t
  misc_feature (98)..(98): n is a, c, g, or t
  misc_feature (150)..(150): n is a, c, g, or t
  misc_feature (167)..(167): n is a, c, g, or t
  misc_feature (180)..(180): n is a, c, g, or t
  misc_feature (188)..(188): n is a, c, g, or t
  misc_feature (244)..(244): n is a, c, g, or t
  misc_feature (255)..(255): n is a, c, g, or t
  misc_feature (257)..(257): n is a, c, g, or t
  misc_feature (267)..(267): n is a, c, g, or t
  misc_feature (269)..(269): n is a, c, g, or t
  misc_feature (284)..(284): n is a, c, g, or t
  misc_feature (301)..(301): n is a, c, g, or t
  misc_feature (308)..(308): n is a, c, g, or t
  misc_feature (319)..(319): n is a, c, g, or t
  misc_feature (328)..(328): n is a, c, g, or t
  misc_feature (332)..(332): n is a, c, g, or t
  misc_feature (355)..(355): n is a, c, g, or t
  misc_feature (377)..(377): n is a, c, g, or t
  misc_feature (386)..(386): n is a, c, g, or t
  misc_feature (394)..(394): n is a, c, g, or t
  misc_feature (455)..(455): n is a, c, g, or t
  misc_feature (479)..(479): n is a, c, g, or t
  misc_feature (490)..(490): n is a, c, g, or t
  misc_feature (601)..(601): n is a, c, g, or t
  misc_feature (756)..(756): n is a, c, g, or t
aaaaaacaaaaacaaatataaaaatatcaaaaaatanaaaatgctaacactgaggagagttgaaaagggttgnggtttttnnccaaagggacctnttnggacacaggatttaagacttgccaaaacctccaagggaacctaaggccttgngggccttttcaagatcntttgcttatggtngaatttgntttaacggggcccaaccctgggcccttaattattaaaccattttttttggcacttnttcaatcacgntnttttccaatncntcccgaagggcattnttgaaccggcggtaggntacaaanttcacaatttngcgggcatnatcntgcccaaaacttttattcagggntccaccatcatcttccagcttntccattgcntcaaattnagcaccacccacacccacaattattattgaaatgggcaggttcgaggcacgcaccaaagcntcacttttggtttccacatccttnacagcaccatnatttatcattaacagcattaattatttcaaagcatttcccttattttcatcctttgttgcaaacctttccactattgtttatgattggttcaaattttttagggtctatanattctaacttatttgtaatgcttggcggtaggcatccacaatgccctggatgcctgcacagtaggggttactggggttgaaattcaaggcaaattcatgcgagacctgccagtcagggggaacctgggccccaaatccaaatgcagggaacagcngg

SEQ ID NO: 644737 - DNA, 6015 bp, Homo sapiens
  misc_feature (3016)..(3016): n is a, c, g, or t
  misc_feature (3018)..(3018): n is a, c, g, or t
  misc_feature (3246)..(3246): n is a, c, g, or t
  misc_feature (4268)..(4268): n is a, c, g, or t
  misc_feature (5238)..(5238): n is a, c, g, or t
  misc_feature (5241)..(5241): n is a, c, g, or t
  misc_feature (5866)..(5866): n is a, c, g, or t
  misc_feature (5926)..(5926): n is a, c, g, or t
ggcggcggcggcggcggttaacggcgcttcccgtgcggctgaggacgatccgccagtgagcgcggagactgcttccacttcgggcgggggagccccggaccgaatcggctctctaggccgtggagcttgccgtcccacctccgtccaaatcgacctttcctttctatccccaaccacccctcaacccctgttttcccctgccttccttgcagaggccatggaggacgaggagagacagaagaagctggaggccggcaaagccaagcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaactggaaagtgaaatttcaaccacagcagatgactgcagttcagaggtaaatggttgcagttttgtgatgagaacaggaaagcctacaaatttattaagggaagaagaatttggtgttgatgattcttattctgaacaaggagcacaagacagtccgactcatctagagatgatggaaagtgagttggctgggaagcagcatgagattgaagagctaaacagagagctggaagaaatgagggttacctatgggactgaaggactgcagcagttacaagaatttgaagctgccattaaacaaagagatggcattataacccagctcactgctaatttacaacaagcaagaagagaaaaggatgagacaatgagagaatttttagagttgacagaacagagtcaaaaattacagattcaatttcagcaattacaggctagtgaaactctgagaaacagcactcatagtagcacagctgcagacttactacaagccaaacaacagatcctcactcatcaacagcagcttgaagaacaagaccacttattagaagattatcagaaaaagaaagaagacttcacaatgcaaattagtttcttgcaagagaaaattaaagtatatgaaatggaacaagataaaaaagtagaaaactcaaataaagaagaaatacaggaaaaggagacaatcattgaagaattaaacacaaaaataatagaagaagaaaagaaaactcttgagctaaaggataaattaacaactgctgataaattactaggagaattacaagaacagattgtgcaaaagaaccaagaaataaaaaacatgaaattagagctgactaattctaagcaaaaagaaagacagtcttctgaagaaataaaacagttaatggggacagtcgaagaacttcagaagagaaatcataaagacagccagttcgaaactgatatagtacaacgaatggaacaagaaacacaaagaaagttagaacaactccgggcagagctggatgagatgtatgggcagcagatagtgcaaatgaaacaagaattaataagacaacacatggcacagatggaggaaatgaaaacacggcataagggagaaatggagaatgctttaaggtcatattcaaatattacagttaatgaagatcagataaagttaatgaatgtggcaataaatgaactgaatataaaattgcaagatactaactctcaaaaggaaaaactcaaggaagaactaggactaattttagaagaaaagtgtgctctacagagacagcttgaagaccttgttgaagaattgagcttttcaagggaacagattcagagagctagacagacaatagctgaacaagaaagtaaacttaatgaagcacataagtcccttagtacagtggaagatttgaaagctgagattgtttctgcatctgaatccagaaaggaactagaattaaaacatgaagcagaagttacaaattacaagataaaacttgaaatgttagaaaaagaaaagaatgctgtgttagacagaatggctgaatcacaagaagctgaattagagaggctgagaacacagcttctatttagtcacgaagaagagctttccaaactgaaggaagatttagaaattgaacatcgaataaatattgaaaaacttaaagataatttaggcattcactataaacagcagatagatggtttacagaatgaaatgagtcaaaagatagaaaccatgcagtttgaaaaggacaatttgataactaagcagaatcaattaattttggaaatttcaaagctaaaagatttacagcagtctcttgtaaattcaaagtcagaagaaatgactcttcaaatcaatgaacttcaaaaagaaattgaaatactcagacaagaagaaaaagaaaagggtacacttgaacaagaagttcaagaattacaacttaaaacagaattgttagaaaaacagatgaaggaaaaagagaatgatcttcaagaaaaatttgcacaacttgaagcagagaatagcattcttaaagatgaaaagaaaacccttgaagacatgttgaaaatacatactcctgttagccaagaagaaagattgattttcttagactccattaagtccaaatccaaagactctgtgtgggaaaaagaaatagaaatacttatagaggaaaatgaggacctcaaacaacaatgtattcagctaaatgaagagattgaaaagcaaaggaacactttttcatttgctgaaaaaaactttgaagttaactatcaagagttacaagaggagtatgcttgccttctcaaagtaaaagatgatttagaagacagtaaaaataaacaggaattagagtataaaagtaaacttaaagcacttaatgaagagcttcatttgcaaagaataaatccaactacagtgaaaatgaaaagttctgtctttgatgaagacaaaacttttgtagcagaaacattggaaatgggtgaggtngntgaaaaggatacaacagaactcatggaaaaacttgaggtaaccaagcgagagaaattagagctgtcacagagactgtctgatctttctgaacaattgaaaccgaaacctggtgagattagttttctaaatgaagaagttaaatctttaaagccagagaaagaaccagtttcattgagatgtagagagctagaaatcattattaaccacaaccgggcagaaaatgtacngtcatgtgatactcaagtaagctctttattagatggagttgtgactatgaccagcaggggtgctgaaggatcagtttctaaagtaaataaaagttttggtgaagaatcaaaaataatggtggaagataaagtttcttttgaaaatatgactgttggagaagaaagtaagcaagaacagttgattttggatcacttaccatctgtaacaaaggaatcatcacttagagcaactcaaccaagtgaaaatgataaacttcagaaagaactcaatgtacttaaatcagaacagaatgatttaaggctacagatggaagcccaacgcatttgcctctctctggtttattcaactcatgtggatcaggttcgtgaatatatggaaaatgaaaaagataaagctctttgcagtcttaaagaagagcttatttttgctcaagaggaaaagatcaaggaacttcagaaaatacaccagttagaactacagactatgaaaacacaagaaacaggtgatgaaggaaagcctttacatctgctcattggaaaacttcaaaaggcagtgtctgaagaatgttcttattttttacagactttatgcagtgtccttggtgaatattatactcctgctttaaaatgtgaagtaaatgcagaagacaaagagaattctggtgattacatttctgaaaatgaagatccagaattacaagattatagatatgaagttcaagactttcaagaaaatatgcacactcttctcaacaaagtaacagaagaatacaacaaactcttggtacttcaaacacgactaagcaagatctggggacagcagacagatggtatgaaacttgaatttggagaagaaaaccttccaaaagaggaaacagagtttttatcaatccattctcagatgaccaatttggaagacattgatgtcaatcataaaagcaagttatcttctctgcaagatcttgaaaaaactaaacttgaagaacaagttcaagaattagaaagcctcatatcctctttgnagcaacagttgaaagaaactgaacaaaactatgaggcagagatccactgtttacagaagaggcttcaagctgttagtgagtccacggttccgccaagcttacctgttgattcggtggtaattacagaatctgatgcacagagaacaatgtaccctggaagttgtgtgaaaaagaatattgatggtacaatagagttttctggtgaatttggagtgaaagaggaaacaaatatcgttaagttgcttgaaaaacaataccaagaacaattagaagaagaagtagctaaggttattgtgtcaatgagtatagcatttgctcaacaaactgaactgtctagaatatctgggggaaaagaaaatactgcatcatcaaagcaagcacatgctgtgtgtcagcaagaacaacattattttaatgaaatgaaattatcacaggatcaaattggttttcagacttttgagacagtggatgtgaaatttaaagaagaatttaaaccacttagtaaagagttaggagaacatggaaaggaaattttattatcaaatagtgatccccatgatataccagaatcaaaggactgtgtgctgactatttcagaagaaatgttctccaaagataaaacatttatagttagacagtctattcatgatgagatttcagtgtcaagcatggatgcttctagacaactaatgttgaatgaagaacagttggaagatatgagacaggaacttgtacgacaataccaagaacatcaacaggcaacggaattgttaaggcaagcacatatgccgcaaatggagagacagcgagaagaccaggaactagctacaagaagagattaagagacttaatagacaattagcccaggtaagggtcttgtagtcccctttctctccccagttaatttttttttccaaacaccaacttgaaccagatccccaattaaaacaacagtattttttatgtagcnatnatttttttttttgccgaaatctgaataaactacatatatttagcatcaggaacacactctatactaagacagcagctttagatcttgttagggacacctatctcaaccttggagtgggcattgtctttctgtcattttatttaactcctttttcaagcactggaaaagtggctacacggttttgtttttttcttttaaatcattccattagccatatatagcaaactcactttgacattttggaaataacattgtgctgaggtgctccattatgcagttactatcattcagttttactatcttcatttatagttttgtgagtccaccaattagcatctcgaaggtttacctttatctgtctttaatccatctttttaatcatgaatggaaatcggaagtagtatgcttctgaaactctttccagggaaacatctcttcttgatttgagaaatgcaaatttatttaacattcttatccctttcttgactaaatttaaatacttcttggtatttgggagctggattcttgtcaactgctgtataaaatatactcacccaaccattgcagaaaagcaagaaatatttatgtagaagttcttatgaaaacttattgaatttaattttgnaaactgaagctaagagagataataaatatctagagataactattaacagtattctttcanacataaaataataagataattgggagctgagcataaaacattatttggaaaaattaactttgcttttcttcattgcattttgtgaattc

SEQ ID NO: 644738 - DNA, 397 bp, Homo sapiens
  misc_feature (286)..(287): n is a, c, g, or t
aatggtctgtagtttccttgtaatgtttttgccattgttttggaattagggtattgttagcctcacataatgaatttagggagtatttcctctgccttcctgaaagagattgcagagaattggtataatttcttccttaggctgggttcagtgtctcatgcctgtagtcccagcactttgggaggctgaggcaggtggatcacctgaggtcaggagtttgagatgagcctgaccaacatagcgaaaccctgtctcaattaaaaatacaaaaattagctgggcatgnntgcatgcgcctgtaatcccagctactcgggaggctgagacaggagaattgcttgaacccgggaggtggaggttgcagtgagccaagattggccacgcactgcagcctggg

SEQ ID NO: 644739 - DNA, 452 bp, Homo sapiens
tccagacgtggggaagagagtgagactcgtgtctaaaaaagtaataagaataatgaaaataattgaccaaaactcctttctccttgatatggaaagctaacatagggtaactgggaggaaaaaaaaaaatcccacgagcaaaaaagcccacatccatgccaagtcaagaggcacgttcatccactgcaagtaataagcccaaggaagacgacttgggcgtgttgacgaccagagagacaccagcccaaggcttttacaaactgtcctcactgtgcacttataccattttctcaaagaggagctggagagcggagacgtgccccggcaccctgtgccttgccccatcagagcatgtatcacgaggcattgtgctctacattaacttgtcttattcactggagacacggactgagccctccttgctcaccaggtaatgtctaggacctcactga

SEQ ID NO: 644740 - DNA, 535 bp, Homo sapiens
agcgaacagagaaataagtccaactatgtaagcacaaggcagtcatttcccagtgggtctatcagtgatcggtcatctgtgaggaaatgtgacgctcattgctttcatggccacaaatgctcttctttcctccacatgtcctaagtagatggcacataaaatcataatcataatcatcgctaatacttattgagttattcattggataccactcataatgcgcaggtagcgtgttacctgcatgaggttcatttatcattacatgtaatacattcatatcagttagggtttccatttggagatgcgaaattacaattcgagattatacttgtctaaaggagcacacttagtaaaccagaacagaagtgaacttagctgggggtgtgaacacaggtcaataaattcattcattcaataaaatatcacctgagaatctagttaggtaccaggcattttcttaactttgggaatcaaatacaaaataataaaactgtctgctctcatgaattttaatatcatagtgggcaacatgaaa

SEQ ID NO: 644741 - DNA, 285 bp, Homo sapiens
  misc_feature (67)..(67): n is a, c, g, or t
  misc_feature (109)..(109): n is a, c, g, or t
  misc_feature (116)..(116): n is a, c, g, or t
  misc_feature (184)..(184): n is a, c, g, or t
  misc_feature (200)..(200): n is a, c, g, or t
  misc_feature (230)..(230): n is a, c, g, or t
  misc_feature (266)..(266): n is a, c, g, or t
ccctgatcttctgttctccaaaaaactccctctgcctccatctcaacccttccactgtgccgtccanaaccacagttctactataaacataccttctactttatgtctnccccaanaacactcttccatctctgtgtctgggcaaaatgctaggtccttctctaaggacactgcttcctggcanccttggtgactggaanctgtacattgacccaggctccacacaccanaggacaagtaagccccacttcacaatctcctgaacnatacctgagatgatcctga

SEQ ID NO: 644742 - DNA, 115 bp, Homo sapiens
cttatctacctacaatctgaactagctcttgaattctgtttattttctccatcatctggccacaactcttcaaactaatatttccaattttctcccacccttctgtcgtcttctc

SEQ ID NO: 644743 - DNA, 307 bp, Homo sapiens
ggctgggtgtggtggctcatgcctataatcccagcactttgggaggctgaggcagtcagatcccctgaggtcaggagttcgagaccaattggccaacatggtgaaaccccgtttctatgaaaatacaaaaattagctgggcgtggtggtacacatctgtagtcccagctactgtgggagtctgaggcaggagaatttgcgtgaacccagaaggcggaggttgcagcaaacccagatcctgccagagtgagactctgtctcaaaaaacgtaactcaaattcaacaaaaaaaaaacctcatcaaacaaa

SEQ ID NO: 644744 - DNA, 162 bp, Homo sapiens
actatgtcgagtctgcagaaaacagttggtgattccttgaacaaggttaaacggaattagcatatgacccagcaattccagctcctaggtatgtacccagaaagaattgaaagcaggtattcaaagcaaatacttgtacagtgaatattgtgtgtcaaaatt

SEQ ID NO: 644745 - DNA, 1014 bp, Homo sapiens
  misc_feature (251)..(251): n is a, c, g, or t
  misc_feature (796)..(796): n is a, c, g, or t
  misc_feature (798)..(798): n is a, c, g, or t
cgtctgctcacctgtgaatggtcgtagcttcgtgggcgatggacggacgcggtgcgcgagattcgccgtttcagcttctgctgtggccccgagcctgaggtcggaagccgaggctgcggcgggtccgggaccctgcgagcggttgcttgagccgggtggcctgcctgttccccggcgctgcgtgccttggcggccttcctattggcgcacataccgcagatgacgtgacgtggtgacttggttcgcctttntccagttgacagaggacattgagcaagtggccatcgtccatacgctgaatggatagacgatcttaccgaactctacgattagatacgacgcacaagagacacgacgtgccggtctgggatgctactctgctccaaccgttgttgcgtcaggagtgcttgcccctggtagcattggttgcatccccaagtgttgatacatgcgagtggtctgacaagtgtggcctagtggctagggaaccacgactcacgagttgcatgcagtcttgccgcagtgactacgtacccttggtagtacgctgtcttgctacggggacaacgggtcgttgcacccgtggggccccacacaacgcctcgcgatttccccagtcccgcttcggggcaccgtgtcctgaggcgcttcgtcgccacagaccgcatgcgctccgcgaacggtgcaaaccacggaacacattcggggtggcccaggcactgggacaatggcgtccacgcagtgcaagctggaggccacacgatcactcctcagtgcacggggaaggcccgccctngngcccacacgggcagcaatcacgcttcgtggtcacatcgggacggatctcgagttgttgcaatttccttgaagaaacggtttgggcgacaagttgtggcaggtggcccttagccctcttgggccattggcagttcggatatcgatgtggagcacggcgcggccacagcgaagccgcctgaacgccggtttctccagaaagttccagaaagaggacaa

SEQ ID NO: 644746 - DNA, 235 bp, Homo sapiens
ggcagaggagcaaatgcctctgtgtccttggtcaggggtttgtctacctggggaccccgttgcacacagggatcaatagagccaagtgggaccctcctagatgtcagtatcagtggggggcagtggaattttgagcgaccttactttatacttttctgtgcttgcagattttcagccatgccatgttcactttataatcaacaaaaataaggtcccatttttacaaaagggaaaa

SEQ ID NO: 644747 - DNA, 1769 bp, Homo sapiens
gagctagctgacagagttagtagagtatggcaacgcactggcaccgacgcgcacggcacgacaaagaaagacaagcggcgagaccacaccaacacacacaaacacaacacacagaaagaagcacacgacgcacaaaacacaacactgacgcaaacaaccaccatcaccccaacaccacacaaccacacacaaaccacaaaacagcaccacactacccgcagagacaacacaaacatacagagaggaaagaagaagaaacaaggagaacacacgctaatagacatcagcgcgcgcgaagaggacaacggcacaaacacaggaatagaagacagagataaataacccggatcaaccgacggcgaaatctcacacactacccagccacgcattctcagcacacgccaggaacgacacaacagcgccagagcacagcaactaagagaacaacgactgacagccgagcgcactgaccctgaagacaatcaacatatgaagaaacaccactaccaccaaacacacaaagaacacaacaaccatcacaaggactaggcagcatgcacaacaccaggtaggagcgagacgaagacgacgacagacgaacaaaagtaccgaacgagagcgaactaagatgaagatgaacaagagcagcacgacaacgaaaacgagccgacacagagcaacaaagaaaaaggaaagaagaggtaagaccgcacgagaaacaaagaggcgaacagaaaagagcgagacagaccagcacgcgaacagaggggagaaaaagagaaaacgacaactcacgagtacgcaacaaaccgcacaaccaacaacgcacactcaacgcaccaaacagactcaagatcaagccgaagcccctcaccggagccactcacaaacgtggtagagaacacatcacaccgagcacacgacgagacgacgcaggcgccacaggagagcactcactaccacaaagactacagcacacgataaacacagatacgacgaacgacaccacgcaaaatggccagtcctgacgcatccgcacagagcgaccaggaagaaaaacaacgaacagaccacacaacaccaccggcacgagagaatacgacaaacatgaatcgcgagtagggtcaagctgaggtcatagcgtggcatatagaacgagagacagacgagagtatgcgtgcatacagagcagcaagacgcataagacgcgtagcaagactacagacaactacgtatggacaggaatgcgagatcgacggagacgaccgaacaaacacatacgcgtcctgcacgcacgcaatcagagccatacagagcacgccaccacgagacactgacaagcacaagagcaaacaacaataaacagtctgaaactaggcgacatccaagcacacaccagctcatcatctaacccacacaaaccaacacaaccaacataaacactaatcaacgatatacacgcacaaacaccaagtacaatataacagcaaaacactactaccatccaaactgataaccacatactcagaacatacaaaacagacacaccaaagcacaataacatacattagcacacattaaatacgaaacgacaacaaacacaacatagacaactcatcacacccatacactttactactcgactaccactctaaaacaatctcccaacaatacaacaatcgacactcgtaaacacaacaaacacgcagtaaaacacacaaatcactaactaaacaagctacataactacactaacatacatcaccacc

SEQ ID NO: 644748 - DNA, 191 bp, Homo sapiens
agcggggaacaatcacttcactagtgaagtgatgtcagattcctagttttttttctagtttttagttttaacatcagaacggaaataaaaaattatggatacgtgtttggaatggcaaactattcctcaggaattccaattaaatttattttactggaataggaatgatcataaaagtgatggttcccgcg

SEQ ID NO: 644749 - DNA, 136 bp, Homo sapiens
aacctgagctgcggaacagttagggggacacagcattgtgacctgactcccgagcgctctgacgtgtggtatgcgcttcaactcaacctgaagctctgacttgtggtgtgaaatctgggcatcctgcacatgagaa

SEQ ID NO: 644750 - DNA, 138 bp, Homo sapiens
atcccttgataaaataactatattataatactggctgttttgtgtattctaatctgaaaaatacagttgtttttggaacttacttaaccaaaaaatatgtagaattttctgccggtaaagcactcttataatcatttt

SEQ ID NO: 644751 - DNA, 786 bp, Homo sapiens
aaatattatactgagcatgtaccatctcacttctaggaatactagtatatcgctcacacctcatatcctccctactatgcctagaaggaatagtactatcgcgtgtgcattatagcttgactctcataaccctcaagcactccactccctcttagtcgaatatgtgcctatgccatactagtctttgccgccgtgcgaaacctcggtgggcctagcccttactagtctcaatctccagcagatatggcctagactacggtacataacctaaacctactccaatgctagaacttaatcggtcccaaacgaattatattactagcacgtgacatgactttccaagaaaactactataatttgaatcaagcgacaactcacccacagtctaattattagcatcatccccctactatttttaaagacaaatctgaaaacaagctatttagctgttccacgatcttttcctccgaccccctaaaacccgcctcctaatactaactaccgtgacgtcctagccctcacagtcatggcaagccagagccacttatccggtgaaccgacgtgatcacgaaaaaaactctacctcgtctatagtaatctcgcctactgaatctccttaattataacattcagagtcacagaactaactcatattttatatcttcgtgtcgaaaccagaagttatcccgcgaccttggtatcatcacccgatgaggcaaccgagcagaacgcctgaacgcagggccatacttcctattctagcaacctagtaaggtcccttaccct

SEQ ID NO: 644752 - DNA, 921 bp, Homo sapiens
  misc_feature (921)..(921): n is a, c, g, or t
tgtccgtctgccactctcgctcgaggtccccgcgcagagacgcagccggctcccaccacccaaccaccggccctcgttcgcctcttctccgggagccagtccggccacctgctgcggcccagcccaatcgcacaccctccgcagccatgtccaccaggtccgtgtcctcgtcctccttaccgcaagaatggttcggcggcccgggcaccagaggaagccggacgagtcaagccggagccaaacgttgacttacgttcaaacccggacttacagcctgggaagcgggctttgcgcccaaagaaaccaagccgggaagacttttaggcttcgccccgggacggggggtttctcccaagggggctcctttgacggtgcgccttgcgaagcaacaacggtgccccggggggggcgggcaccctgtgaaaggaccatcggggggaacttccctcgtgttgccgggccgcacaattcaaccacgggatgcttcaagaaacccccggaaccaagaaggaagtgtgagagctgaagaaactagaagtgaccggtctgcaaactaacttcgacgaggtcgggctccgggaacccgcagaataggatcatgcgggacgagccgagcagttaagggccaaggaagtcgggctggggaccactaagcacaggcacaggcggacactcgcacggcggagaaccacaaaccaagaaacagccggttaggtcgacccacaactggcgagaatatggcacggacatgacgggacttccaacggggacgaaacctgcaatcacggagtaacggttgagagtgacgaacaggactgcgagagtgttggaccagggaccggcgccatcgagaccgtgatccaaccccggggctaataatcaccgggcacaagtctggataggagcgaacgtgaaccgagn

SEQ ID NO: 644753 - DNA, 430 bp, Homo sapiens
  misc_feature (25)..(25): n is a, c, g, or t
  misc_feature (63)..(63): n is a, c, g, or t
acaaacccctgagctcacggcgcantcctcatatcgccccggattacacctcttacattcgcntgcaaactcaactacgacgcatcacagtcgcatcatatcctctctcaggacttcaaatctactcccatatagctgatgattctagcaagcctggtaactcgcttaccccccatattacctactgggagaactctctgtgctagtaaccacgttctcctgatcaatatcactctcctattacaggactcaacatactagtcacagccctatactcctctacataaccacaacacatggggctcactcacccaccacattaacaacataaaaccctcattcacacgagaaaacaccctcatgttcatacacctatcccccattctcctcctatccctcaaccccgacatcattaccgggttttcctcgc

SEQ ID NO: 644754 - DNA, 142 bp, Homo sapiens
acgatctgcacaggaccaaggtgacatatcttgaagcggctgcctgagtcggagagcctgtcgagtggcatcacacgccagtgggcacctcgcacctgtacgacgtcagccacccctgcgcctcggccccgccccagtacag

SEQ ID NO: 644755 - DNA, 1531 bp, Homo sapiens
  misc_feature (1)..(1): n is a, c, g, or t
  misc_feature (193)..(193): n is a, c, g, or t
  misc_feature (1076)..(1076): n is a, c, g, or t
  misc_feature (1198)..(1198): n is a, c, g, or t
ngggtgttccctccccaccctcgcaatgtgttttcctcccggggccctcagttttggctctggccactccagagggatattctccctagtatgatatgtgtggtgtgttttttttctccctctcctccccctgttggcgcgccgctctccttggtcgttcctctccgtttgttggtagctgattcttcatagngtattcttcattcctcgcgtgcactactcttcccctctaagaggtggctgctcccccgtcagatgtatacatctcctccgcggttttttgtgggtactatccccgtcgtttggggccgcacttcccccacaaatacaccaatgagggcggcacattcttcaacaagtgggtgctcaccagcaccgattgttccgcccacgcaccaagatagtattggtggtgaattttttaggcccccaccctccacgcgggagtgatttatctgcgccacgcaatgatttcggcggggtccccacccctcaccacgactattcgctgttccccccccgccgcccactatagggcgtctgttcttctgatacgcggcgggatacttctctacgccccacgagattatggcgttgaggaaccactatattgggcgtcgcccacttgtgggcggttttatatatgtgagagatatttttaggcaatattgtgggcccccccctctgcggcgcactattatggccacacaccaccccctctcacactgcttatagctctcctctccccggagatcttctgggagattataaaccgtccctcctctctcgagaaagaaagagatatatttgggtccctctcgagaagcgctctctgtgatgtgtctctgagatatttctccacagccaccctcgcgagatgtttgtgagagagacactctctgtgtgtgctgccgagtgtttgtgggagacgctctgcgtgagattatgagagagtgttatacactctgtgtggtcccacctctcgggtgaatttaaaccgtgtgtgacacagagcgtgttgtgagagtgtgtgtgtctctgggagtattttcttctcttagagagagagtctctgngacacacagagacacacacactgctgtgtgttgtgtgtgtctcttggcggggttgtcttctgtgcacacagagcgttgtgtgtgagatatagtttccacacagcgccgctagaggagacccnacagctgtttctctcttctctatatagactcagagaggtgtctctttggcacacagagacacacccgctgcggggctcgtgtatactctgcctcttagagagagtggagaacacggtgttgcacatcttatcgcccctggataaagtgagagtcacatttttataatttatatgtaaaggttttttttgtgaaccccacatttctcgagattttcttgaaagaagaatgaccacacccaaattttgggtttttaactgttaaggcgagcaaccctaggccccccccacacggccttgggtaagggaaaaaataaagggctgcccggaccccca

SEQ ID NO: 644756 - DNA, 717 bp, Homo sapiens
cgccgttcccccctccaaaaattggattcgccgagttgtttttaattccaggtataacttcccccctcgggcccaataaaaaaagcttttaaatattttttgacggtttaaaaaaactgccccgcaagtggtttatctttttaagccaggggagtccctattggccaatcacaccattaaaagggttttcagaaccccaggtattcccaatgtccccgttatgaagatggagcatccacttgtggggaaaatttccgtcccaggcccagctgtgagatacagtaagttcaaaatgtcaaaggccaggccgccccccctgctcgggcagcacacaacgcacatcctgaaggaggtccttaaatacgatgacagggccctcggggagctgctcagcgctggagtggtggacccacattaaactccctgacaaaggaaaagggctcttcctcataacctcgatccgaatacactggcaaaggcaaccctttgcttggacccttctccccagttttgatacccctaaaaagaaaatttagagtaactccagatttcttacatggcatctccagaaaggctctgggattaaagaatctagggccttttaaatgtatcccccgttttgttgcccaccctcttttttttcaaaatgttctgtcctcatggctctgtgggagtttttaaaataaaaaatacaatttttttcctggaaaagaaaaa

SEQ ID NO: 644757 - DNA, 304 bp, Homo sapiens
gtctctagaggctcccctgagacgaccttgtgcttagattattcttattatttatttatttatttatttttccgagacggagtcttgctctgttgcccaggctggagtacagtggcgtgatctcagctcactgcaacctctgcctcccgggttcaagcaattctcctgcctcagcctcccgagtagctgggactgcaggtgtacactgccaagcctggctaattttttgtatttttagtagagatgggatttcaccacgttgctgaggctggtcttgaactcctgagctcaggcaatctgcctg

SEQ ID NO: 644758 - DNA, 314 bp, Homo sapiens
gtaccctagaaatataggaatggggaaaaatatatgggatgctggtaatgtgtgtgtgtctgttggatgagggggggaggtcacctctagagtttagtaggcagtgtcacatgacttggcacttctaagcagacagtacgatgagaccagatgacctctctaatagtcctctctttccttacagaccagatgacctctctaatagtcctctccttcattacagaccagatgacctctctaatagtcctctctttcattacagaccagatgacctctctaatagtcctgtctttaatgacagaccagatgaccta

SEQ ID NO: 644759 - DNA, 822 bp, Homo sapiens
gctctcgcactactgtacttccgccgatccgacgtcgcgtttctctgccggtctgcaatgtgaagaagagatcgccgctgctggtcattgagcaatggctccgcgctatgtgcaaagcatggttttgctggggactgacgctccccgagccgtgatatccattccatcgtcgggcgccccagaacatcgatgggcgtcatgtgtgggcatgtggccagaaggactcctacgtgggcgaggaggcctcagagcatgcgtggcatcctgacctctgaagtaccccattgagcatggtcactcgtcacctaacatgggactgacatggaggaagatctggcactcactactcttctactacagcagacgctgtcgcagtgtgccactcggacgcgagctagcccaagtgctagcgtgacacgatggcccccgtaaaccccaagggccaacagagagaagatgactcagattactgttctgagaccattcaacaccccgtgcatgtacgtggccatccaggccgtgctgtccctctagcgcctctgggcagcgaccactggcatctgtcatggcactcgtggagacggggtcacccacactggtgcccatctacgagggactacgcccatcccccaagccatcctgcgtctggacctgtgctgggcggggacctgagccgactaccgtcatgcaagatcctcactgagacgaggctcacagcttcaccaccacggccgagacgggaaatcgtgcgcgacatcgaaggagaagctgtgctacgtcgacctggacttccgagcaggagatggccaacggcgcatcctc

SEQ ID NO: 644760 - DNA, 516 bp, Homo sapiens
ggtgtaatcgatgccacgtgcgctcgtgcccaggccggagtgcagtggcatcatcttggctcactgcagcactgaccttccgggctcaggcaatccacctgcctttgcctcccaaagtcttgggatgtaggcgtgagccactgtgcctggcccaaaggaatttctgtgatggaatgtatagtgtacttctgagcttgcctgctttttctaggtgcttggttcccggtcagttatagatccgggagtctttagaacttcttctgagccttttaatccctccattctccagtctgaagctagacctcagaatggtctggttagagtcctggatcagtcttacctcatggaattggtttcactttttccctaggcttagttactgtcttcttgtgtttgaacttgtcttttatactaaactagtatctagagtgagacagggattaggatgaatctctttgtccaagtggagtgggtgagacagtttgacctaggagtttgtggtggcatcgataaaca

SEQ ID NO: 644761 - DNA, 302 bp, Homo sapiens
caccaacattcagaccaaagcaaggaccttccaaaatcagtgcaccttggaaaatttttgtcttcagatattactgaggtaattttaaaagtctagggagtagggaccggctaagaggaactgtgtttaaccatgtaatactcttttagcaaaccaagtgcctgcgtaatttttcacacagttcaagaatggagaaataattctgtcctaaactctttccacttcattagctgaaatgttcacatttctcatatccaagcagaaaggggggcaggttcctcattggtccctaaagcaaactt

SEQ ID NO: 644762 - DNA, 346 bp, Homo sapiens
agaagagtatcggcgaatggcgcgcctgcacccagaactggatgatcaggacctggcacgcctgttggcccttgatgaagcccaggtcgcgcagttgcgtcagcacctgcacagcagcgaaaaggccgtcgagcaagccaaggttctgctgcacgagcgcgaacagcgcctggccgaacaccaggccctgcacaacggcaacctggaggccgagcagttggacgccacccttttttcgcttgagcagcaactgctcgagggcgagaaacactgcgccgaactgcgcgcaacgccaaggcgaagaccagcgccgccagaatgccaaacccaggcccctggcccgaac

SEQ ID NO: 644763 - DNA, 227 bp, Homo sapiens
gtaatacatcaaaaagctaagaagtcaccagagtgtccataaatacacctctgaaaaggtggcatccaatatcagcgactatattatacagcattaaaaagcttatgctttagggtgcttctctgcacaatggcattgagcagacagagctgagttccattatcccacccagtttcacatggccccatttgagagctttatacccaaaatgcagggacagttactgc

SEQ ID NO: 644764 - DNA, 569 bp, Homo sapiens
  misc_feature (219)..(219): n is a, c, g, or t
tgctggtgttatcggccgaggctcctttccgctcggctgttttcctgcgcatggatgcctgcagtggcctgtaggcagccatggcgcccagccggaatggcatggtcttgaagccccacttccacaaggactggcatgctggctgctgtggccacgtggttcaaccatgccggccctgtaatgatcctgcatgactgtaatgtgccctgtgcaatgccnaatggctgctgcctgcattctgcccctgcgccccgctgtctgtgtgtcccattcctggcccatctgtgctgctgccccactggttctggtaccacactgaatggtgcgctgccggcctgcggcttcagcctggaggagctcagtggtggcctggcattcacaagaaaggtggcccggaccatctggcatttctgtggatccgatggaggcggaacaagtccacaggagtccctgctaggccaactgtgcagctggctgaaggagtaccgctccaaactcatcctcttccccaggaagccctcggcccccaagaagggagacagttctgctgaagaactgaaactggccaa

SEQ ID NO: 644765 - DNA, 662 bp, Homo sapiens
cccaggaaccccgggccggggcgtccaagcccaccctctggccggcttttcacaagccgccggaagccccccaggtgccaagctccggccagacgcaggccagcggggacatcctcggtagtgatcgtcctgggcaggtgcacaaattcctgcgcggtcgcgccgcacaccgggaagtccccgcaacccgcaggctcgggccaaccccagcccccccggaagctccgccgcatggtcgcggtggtcccccactcacgcccgccgttgcccctcctcttctaaggaacccgcgttcgttggccgccgccatgaccacggtggcggaccgcctcatgtttcgatagccaccgcgcgtctctcggaagaaactatcctgcacaacgttttatgggttgtctaccgccccctttctatggggcgtgctaagatgaggctccctcgccgtcgcccacaaggagaagccacattgcttccttgctccgtcgtgcccttccccttttatcggacaggcacagcagcattctcctccgcagcagcctgtaagaagcaagcattcccaataggtggggatgagcaagaagcgctgagaatctctgaagcaatagccggtgcgcgcggaagggccgtcgcgcgtataacaccaaaaacccacaaaaataaca

SEQ ID NO: 644766 - DNA, 846 bp, Homo sapiens
ggccgtcgtgtggtgtgctcggtgcgctgagctccgggtccgcgagccggttccgtccccttcccgccgcgccatgaagtggatgtcaaggaggaccactcgctggaacacagatgcgtgagtccggaagattcgagcgaaatatcccgacagggtaccggtgattgtggacaaggtctcaggctctcagtattgttgacattgacaaacggaagtatttggttccatctgatatcactgtggctcagttcagtgtggcatcatcaggaagaaggatccagcttccttctgaaaggcgatcttcctgttgtggataagacagtcccaacagtccagcctaattatgggacagtttactgatgaaggacataaacgatgaagatgtgagttcttatatgtggctagagggagagaacacgtttggcttctgagggccaatgtgggcttaggtgcaaccgaactggtgtgtatctggtaagataggcagcaattttcaggtattataccagaacctcttcagatagagttataagtgaattgtaggtgattattctaaagtatatgggaggttttgttccttagactagtaattatcattacagagttcattggagtttcgtttgtgatgctgagcgttttgtcaagaattgtctctgaatattgaggatttattcgagggagaggtgggataaggaggaaggagctaatgggaagtgaagtgaaggaagtttaaaaccaataacttagagaatttataattacgaaatgggggattgtttgaaggaaaaaaatttagaaaaaaaaatagcgggaaaagggagaagtgtaatttaaaagtgaattttt

SEQ ID NO: 644767 - DNA, 323 bp, Homo sapiens
ttctttgcttcaggtcctgtttggtatatggcatgcctggagtccacacgcagaggtcagggagcgagagagagagagggcgagagagggcgagagagagagagagagagagagacacccaggcgccaatgcccttattggctcaagggtactattcaaactggttctctgtggagacttttaagtcgcgtgcttaaagcacgcaggcaagagttctctggggtcacactgtgactgggaggtggacactggctccatgaggggagcggggttccagaggcttgtcaagtagattgcatcacgctcgcccatgatcaagtggt

SEQ ID NO: 644768 - DNA, 266 bp, Homo sapiens
agtaatacagagagtcctacaagagaacgagagtagatctgtaactaagttataacgaacatagtacatttttgttaagtagtaaatacaaaggatcgagtatagaaggtgccaatatgtgcctaggcataacaattctttacatcttatactaaatgctatatatatattttgaaggtaaagttaatttggagactcccattgatgttattttaataaaagcatattttgcagaaaatacagtataattcacaggcgtagccagg

SEQ ID NO: 644769 - DNA, 282 bp, Homo sapiens
agaaaatcgccgaaagttaccaaaacattctagcggccatcgagggctccaggttctacacctcggaccccagccaggcgtgcctcttttgtcctgagtcttggatactttagacagaggccaggtggtcacctcagtatgttcacacatttgagatcaaagtcagaggcttcacttgttggacaattggtgggttaatttaatttttaattaatttcggcacttggcctacttcaccgaggacgttggggttacaactggcacgcgagttgtgccaaagcg

SEQ ID NO: 644770 - DNA, 176 bp, Homo sapiens
  misc_feature (156)..(156): n is a, c, g, or t
  misc_feature (166)..(166): n is a, c, g, or t
aatctgttgtctcttgaaacagtgacacaaaggtgtaattctctatggttgaaatggatcatacgaggcatgtaataccaagaatgttactttacaatgttcccttaagcaaaattgaattgctttgaacttttagttatgcacagactgataatnaaagcctctnaaaacctggc

SEQ ID NO: 644771 - DNA, 260 bp, Homo sapiens
tgtgctcttatgctagatttacggacagattttcttctgccctgtaaactaatagcataggagcattttttaatacgattcgatacaaaaaagaatttaagcaatctctcgccgagacgcacaatcaagaccattcatatactgatctatccgctgaatacgaaccttcaatcgactcaatccgtaactggatcaagttgtacgcgggtccacgaagtgacagacgaaaaatgaacgcaagctgatgtaaacgcatcaca

SEQ ID NO: 644772 - DNA, 345 bp, Homo sapiens
cgtgttccatgtcttcaagatgatgtttcaggttctgcggtaccaggatcaccaatctcagattgtggtagagctgcagctgccccgcattggctttcaaagtttggtcaatgaaattgaagttaaagggttccattatggtattcttgggatcaaatgttgtcttccacttggcactcaggtagatagcattgagcagctcaagacgggtatcggagggcagactgtctaacatccgcctgatcttgttgttggtgttcttggccactcaggtgttgatgagctccaagttggcgtcactggtgttgcttaggactctgggtctgcttctgtacaggatccgag

SEQ ID NO: 644773 - DNA, 315 bp, Homo sapiens
catatattgcatttggttgttaacacaaggctgttcttaattttgagacagggtcttgctctgtcacccaggctggagtgcagtggcgtgatcacagttcactgcaacctcccaggctcaagcaaccctcccacctcagctaggatagcttgggcttcaggcgtgtggcaccataatggctaattttttttttatagagaagggtctccctatgtttccaaagctggccttgaactcctgagctcaaacgatccacacacctctgcctcccaaagtactgggatttcaggtgtgagccaacctgcgaacctatga

SEQ ID NO: 644774 - DNA, 540 bp, Homo sapiens
atagcagcgggcaagagaattgtgccggggaaccctatattcaaaccatcagatcttgtgaaaattactcactaccacaagaacagcaagggccagattgtccccatgattcattacctcctaccaggtccctcccacgacatgtgggaattcaagatgcgattagggtggcgatacagccaaatgctatcagctgtcattttgtatcttttaacaaatctgtctttaactttacctcccctctacccttcccagcctctagttatcttctgttctactttatacttcagttgagatccacttttaaatggcttccacttataagtcaaagtatgtggtgtataactttctgttcctagctgctatcacttaacataatgtcctccaactccatccatgttacacaactaacaggatttcattcattttaataactgattagtatcctatttagtatatccaccaaattttctctatccattcatgtattattggacacctagataggttccatatcttggctaccaagtatgaatccga

SEQ ID NO: 644775 - DNA, 793 bp, Homo sapiens
  misc_feature (88)..(88): n is a, c, g, or t
  misc_feature (179)..(179): n is a, c, g, or t
  misc_feature (236)..(236): n is a, c, g, or t
  misc_feature (245)..(245): n is a, c, g, or t
  misc_feature (250)..(250): n is a, c, g, or t
  misc_feature (269)..(269): n is a, c, g, or t
  misc_feature (282)..(282): n is a, c, g, or t
atgtctttgacaggtgctgtcctgaaaaacaaagttctatttttatttttaatggtttagttcttaactgcggccaactcttacatcnccagcaaatcatcgggccatggattttttccattatgttcatcacccttatatcatgtacctcagatctctctctctctcctctctctcanttatatagtttctgtctggacttttttttttcttttcttttctttttttttggcttnaaaacaagngtgangccatatcaagtccaggtnattctctcacagngtactctataagaagggtggtgggtgtctgttgggcaggattggtcagaaagtgcggataagtagcatgatcagggtatgcgaaagggttttaggaagtatgggcaaacaatgtggtatggactatgagggtgacatgatatagtcagcgggccttttaagaggtcttatctgtccagggtcaagtgatttacaaaaataataaccggttttctgactagtttacagatggttggacactggtttcgaagtggcactgagggttcatgcttcatcgggcaataagactcagcctttgaagctaaacacaagcatacacaccacacacaacaactagtgtgcgccgcgcgcaccagaaaaaggtttccagaccctcttggggcgcgcgggcccaggtataggacacttggcaacgcggtcaagagaacctggcgagccggctggttccacccaaaaagccgggccacgggttgacaacaagggcggcgacggtacacaggcaggggcgtatc

SEQ ID NO: 644776 - DNA, 452 bp, Homo sapiens
tcattatgtccgcaatgccacattcttcccaaggagctctacaaaactctactgggcctatcatataacaccttatgaccttccataatcacgccctcataatcattctccttatcctcttcctaatcctctattcccttttcctaacacttcacaacctaacctaatactaacatctcataccctcaccaaatacaaaccccttcaactatcctccccgccatcatcctactcctcatccccctcccatccctatccatcctttacataacacactacctcaaccatccctcccttaccatcaaatctcgccaccaatcccacttactctactactacacctacttctactcactaatcttcaatcctacatacttcccccattattcctataaccaatccaccttcctactccttttcttctctactccattacctactctcccccttct

SEQ ID NO: 644777 - DNA, 203 bp, Homo sapiens
gcatgtctggtggctccgcggattataacagcagagaacatagcggcccagaaggaattggaccccgatggtgtcatcgagagcaactggatgagattgttgataacttgatgatatgatttaaaggagtctctcctcgtggcatctatgcttacggttttgagaggcctccgctattcagcagagagctattattccctgta

SEQ ID NO: 644778 - DNA, 107 bp, Homo sapiens
  misc_feature (77)..(77): n is a, c, g, or t
tttttttttttccgttggtaaagtatattggtatcccacagtctcgcacgcttacttatgatatagttataatagcnattattatgatactatagaggatgaaagag

SEQ ID NO: 644779 - DNA, 1216 bp, Homo sapiens
agcgggaaaaaaaaaaaaaaaaaaaaaaaaaaaaaaaaaagggttttttttgggggtatttttttttgggggcccacaccaatcttttttgtttaagcccccacaaattgtgggtaccccttaaagtgtgggttgtgtttgggggacacgttaatctacctataactattttcccgctattagcatggtttcttacaacctgtgcgtgtgttacaaattttaacggggggaaacaaaaaatatgggcctgggaccctggagagggttccccacaccttttgtgtgtgagagaacaacaagcgttgtgtacaccctattgagggggaaccctgtgaacagagtgtgtacacctcttattgtggggcgcgggaaaaaattcccgagagggaaacacatggagaacaacaaggtgtgttgtggccccgccattacagcgtgttgtttaccccacacagctgatgaacacccgggaagcgagaagatttcttcaccccaccttttttgtctgtgaacacaagtggaaacacaaacggggcgctttttcccacccaccaaagtgtgaaaacaaagagtgtgtgtgtttctcacacacaacctataagagttgtgtggggattcaaccccacaacaaagatcaccttggtgcccctattgcgccttgtggaggcttctaatatatgaggtctctcatataataacattggggggagggtgtagggacaccaacttctctcaactgtataacagttttttttcttctcgccaccacgtgttgtgttaacaccaacacttattttgttgttgtagtctttcctacaacagactatatcatcttcttagccctccaacaaaaaatatattacaccacctgttgtggtggcgtccaacacagcgtcgcctctattatgaaggacgaggcaccctcattgtaggagaggaggggacgaacaacattagtcgagtaatcttatatctactagtccgccccccgcaggagggtggtgcaacatacaagacgggtgggggcttgctggtagcggagcacaccgaacacaaaatctatacaaaacgcgtactatttgtggttcttccaccaacatattattttttccaccgcagtgtggttgtgtctcccccccccgcaatgaaactatttttggcgcaccgaatattaaggaatgtttccttctaacagatatttgtgatctcttctcga

SEQ ID NO: 644780 - DNA, 564 bp, Homo sapiens
  misc_feature (387)..(387): n is a, c, g, or t
  misc_feature (482)..(482): n is a, c, g, or t
tggagagggggtctcaccatgtgtagtagatgggtcttgatctcctgacctcgtgatctggcccagctcagcctcccaaagggctggggattacagggcgtgagccaccgtgcccggccggtccctaagagttttactctgggttcagcaactggcctaaagtggcactggtggttctgggaacgcagtcatctttgagacagaggtggtgggacactgggattgatacctaagaggaagctggggaaaatgtgagtggcacagacagtaagtgtggtagcgaatccagagcgggaaatacttttatccagatcaggaaagtcaaagaaggctattctcgaggagggtggtgatgacggtgcccctcttctatcgacctggtgtgtnggatccttatgcctattcctagatggaaaaagaaccggtggagggtcagtgaataccgggggggggtttcctaccagagttaaattatgctcggnacttatttaagcggtggaactggtgctaaagaagacttctagggtggagggctcgccactcagaattggttctgtgtgggaa

SEQ ID NO: 644781 - DNA, 296 bp, Homo sapiens
aggtgccagagtgtggcaggtatgagtgtatagtccgtagaaggggcgtaaatctctggcaaattaagttagatgaaagatcttctctaaatgtctagagtacttagggatcatacaataacgatatactgtgctctttccgtggtatttcatctaagcaggtctcactatattgcaacagtacctcccccttccacaagcctctaaatccaacctaaagatggtagtcagagtgattctttacaaaatataaatgtaataacattatcgtgctttagaccttctggtggcttcca

SEQ ID NO: 644782 - DNA, 416 bp, Homo sapiens
cagataattttaagctaagggcctgtgggttaggccggttctttcctttccagccggggacctttgccgaaaccatgctcggccggatcatgggccaggccaggaggcatccgacctggatcccctttttggaattaatgggaactggagctacgggagcaccactgaatctttggcgtctggcatggttaaatccaaaggttggtgggaccagaattaccccaaagccttggaccaaacggggtcccaaggatcattccaggttttactcagggaagggggataccagcaggctgaaggaaggttttccagaggccacatccgaccaattttccacttaaccaggaaatattcctcctttaaaggcatgaaatcatgttgaagacctttatgggaacctctatggaagattccaa

SEQ ID NO: 644783 - DNA, 167 bp, Homo sapiens
tcacggtgtattcctccgcgatcgtgaccctgaaagaaaatgaaagattctttggaagacggtgcagcaaagcatggagacttgagaatccaaaggctacgcatacgttacttccagacacctcctggggaacgcaggcagataaccccacatgtagctcgattacc

SEQ ID NO: 644784 - DNA, 893 bp, Homo sapiens
cctgcataaaaaactcatgttcaagacagaagggcctgactcagactagacattctccactatctatgtaccccactgacagacctcccacccccatctactaccctacccctgccatatttagggtattatgggtactattgaaccctatctaagccaaaaagtgtagtagcgtacagaagacataccaggcacttaccatattagctttgtacccgagggactcccaccctgcacacatatgctacagcgccctatggcaccttcggttcgaatcttgtcactgtggcgtacctgaagtgaatcgacaggcaccatacgccgcacacatacccccacagcccttacaacttcttcaaacagtgtaacaacaaacatcgatagcaacgcagactcgctatcctgacacacacaatatgctaccgtgaacacaataggatatccgtctgccacacgttataccaaggagcactaatccgctcctacaccacccattccaatcgccacacactatacataacgtgatacgcgcggcaccccatcactctcacaccccggatcaccttataatcccatgaggcaaaaaagacactgatcaccccctcacacaatggaatcggccagttatacttcctttccttccaccttattccacctctgccccaccaagtaccatacatcgatgccacaaccatatgtcatgcatacacctctacagtgcccctcccataacaacataccaccacaacaaccaatgtaaccatttacgcctagccctcgcgcctcatcaccttgacacaaccacaaacatctatatcacctccgctgctaccccactagacatgtcactccactccatcactcaactctctaacccttgcgcagcatcatag

SEQ ID NO: 644785 - DNA, 1022 bp, Homo sapiens
cgctcgcaagaggaccggcagagtgcccggcagctcggagctccgggaccttttggcgcatcagtgacgcggctgtccctctgccggtgacccagagcctgccgccgccgctctgcctcctgcgtgttagcctcctctgcgcgctccggtgcaggcggccgtgggagcctgctggtgtgcgaggactggctgctgatggctgctgctgctgcccccgtgcccgctgcggctggaaacggatgatggcctgagccaaagcggcgggcccctcttatgctgggaggatgctggatgagtagcggctgcaaaggcggctgaaggaagggctgtgcttggagaagcgcagcgacgggttgttgcaaggctctggaagaaaaaggtgttgcatcctcaccgaggaatgggcttgctatgcttatcccgcccaagcagcttgcaacaccaggcaggcagcagcaacagcagcaagcatgcagcaggaaacaacagcccgggtgcaggtggccggccgagccgtcccaacccagatggacccccgcatgtaatcacagtccttcgaagtccggacggatcaagcttcaaaggaacttgcaacttcttcccaagcatgagagacctgtaggactgatgtggaagcgcaaggggtcaaatgttaccatgtatcatatcaagaggagggatgactggagcagaagtgtcaaatggcatgatcggacttaacgcgtgcacggaaggaaacaagggagctggaaacgcgccataagattcacgacgtgtaagattggatggcagtaaaacagaaatcgggcaaggcccaatcccaggagagggggtacaaaatccaacggctagcaagaaaggcgagacaagagatcattgggatccaagagagcgattgcccacacttgagaaggcacacgaggcagcgttagactcgaaaggtagggaggagactaatagccgaaatgcctaatggcataaaagcggcaaagaccgcataacgccgattaagagaatctccg

SEQ ID NO: 644786 - DNA, 1277 bp, Homo sapiens
ggcgacaacatgcttgcggacctcgggttaatcggaaccataggtcgaggatgacgaggtggccggtggtaggcccgagtcgtgactctcggggactgaggaagaggagtgggctccattgtgcggtgggcgagcacgacagaaaagcttgggggaagaaccgctagtgctgatcgcatagcctgcatttcgtgtgtgtcactgagatagggaggggacgtacgtagtggcagcgtgggccctggctgatgtcatgagccaactcaatgaaggacgagggcagtccatgtacacttagattgagaacgattgaggaaatgttcgaatagacatttcggacaaatcgagaggataaacgaaggcgcacgatctgggaaggttcggagaagggagaaattaaggctaatggaaacggtcgtgaaaacctgtgggaagaagtgcatagaaggcgtttgatgagtacggaaatggagtgcagcgacagggagctcaggaaacgtattggaagggcctgcgaggaggaccactggtatctaacttcctaattcttgacttgaactggccgacacacgagtactgtttcgctcaccaagggccagacgagtaacaccctccagcacagggttaagaacgtgcggttccgccgacacggagaagaaacggaaccggcatattggacttcgtggcacccaagagggaaagtccgacagtgacggagaacccccaaggaaaatgcaaacccgcccccggagggatacctgtcacaggcaaggggcagcacacggaaaggccccccaagtccattcggaataccggcacaacggggtagcgaaatggcgagaggacccggttcgtgcacgggggcgacccacggtaactctgaggaagggccctgggtacatccgaggcccaaacggcgtgtgtccgacaaacagcgactcagatccccaaaccacaccgaggttccaccggacaaggacccgtagccagttaccacctaagatggggggagagcaaatatggaagagagaagggggagaatccttcggtgcccataggtcgccattgcagaattagacaacacacgggggaagatcggcggccaggcaagcacaggcccagggggccatggggctcgggaaacccgctcacgcacatagcaggccacagacgccgggctcagcgggggatcggagcagcaacacagcagccggctccatgaggggcgacacaaagaagctccaagagacgcgagagacagaaggggaagcacccag

SEQ ID NO: 644787 - DNA, 831 bp, Homo sapiens
  misc_feature (148)..(149): n is a, c, g, or t
tgtgttggcatgcgcctgtaatcccagctacttgggagactgaggcacaagaatcatttgaacccggaggcagaagttgcagtgagccaagattgtgccatggcactccagcctgggtgacagaacaagactgtctcaaaaaaaattnnaaataaaaataaaagatcctcgatttcactcagaataaaatagtcattaaaaccacactgaaatactgtggaactgttccatatcccacaagactctgaatgcccgctacacacttgtgtaggcaaaaaccactacttacaatgatatgagattagaagcaattctgttttataaatagccacaaaacagacaggcacagttgtaatgcacactgaattctctgggactacaatagtgtaagctgaggcaagggcacactcttctgcttggaactgggtggggagctgctgagcctctcaggaagccatgttgctgacggcaaggccagctgagaggcctggacccagccctgtgctcagcccttgcccacacaggccagtacggatcccgctgtgctgtcctcacgagtcagtccagaagcactgacacacctaaacgtatgactttattctgtttctttcctatcactttcccctgatgttacagttaggatactactctgccttccatttcagaattctgtgtgtcggcagcctacattaactatgttacccatgaattttatttctgcatagtaaaggggtatcacaaagtgttctaaaaacaggagttgagtctgataggcttggaaactaccagcctacactactgtacccagatatcagcctacatgtggcaggg

SEQ ID NO: 644788 - DNA, 867 bp, Homo sapiens
gatcttagtcaacaggtgtagcgtacttccagcccagtcaggactgcggagtatgatgaagacagcccaggagggtactttcactttttctccaacctcgtaaccaaatgggaagctgcagcccaggcttcctggagattcttacacgtccagcatgctggtgcgctcaggggttgtcctgggcccgtggggcatgatcaccatggggccaacatgctgctgccctgttcgcctgggcctggggggccccatcggctcaggccacctgattcttcccctggatacacatccggggacctggcaggaatcctgacccatgcccttgaagtcaaaccaccgtgcacggcgtcctgaatggagtggctcacatcctccgccacataatgactgagtttgcaccagaccttcggtgctgtcctgggccgccgagccgttcatccctctccccagcgtctgtggtgcaagctgtctttgggcgacagcgtgccatcatgctgctggagggccagaaggtgatcccacggcgaacactggccactggctaccagtattccttcccagagtctaggggctgccttaaaggaaattgtagcctaattaggtcattgcaagggcctgaggcctgttcctcacaggcttccaggttaggcaactgtgaataggctcagcgtcctgtagagagactgaagcatctggttcttagattcctctgcgcagtcctcgtatcccattgttctgttgatccaccttaatgtgtccaaggccgtaatctcatcacggcgggacattaatcatccaactcctgtaagattcacggtttggttctcaacagtgtccgcagataccccacggtccttacaggcgtgg

SEQ ID NO: 644789 - DNA, 361 bp, Homo sapiens
tgagtagcgattgtcggtggaaaaaggtctcattccagctagagagaatatcaaaaagcagtagtgctgctggaggcccagaagagactggagaagctcaggacattgtgctggctccaggatgacagcacccaggagctcccataccaggtcctcagcccttatgccacagtcccacggtctccatgttgaagcaaattgatgagttgcatttctttgagcccccaaagactctgcagtcaagcacatgtcccagctacacaggtacagccagtacttgtcactgggaagcactcggcttaagtttacaacctgtcttgcccaggctagtattcctgtttttcccccatgcctcatttcc

SEQ ID NO: 644790 - DNA, 161 bp, Homo sapiens
tgggcattagaagtacatatagtagtcgtgagctgtgtaaaaatgtgagcgtaatcgtgaatgtgagggatgagtattgaggtgtggaggtaaatagagaccagtaatgtatagcagtgttgatatttgttcgttgtttctattagatatggtagctcagg

SEQ ID NO: 644791 - DNA, 564 bp, Homo sapiens
ccccccctttttgggcagctgcccccgtttatgttgggcccggctggcaagctgccccccattactggggttttcccccctcttttcccggtggccccttacagcatcgccccccttcctgttgtcccaacccttttaaggtgctttctactagggggcgtcctcacagctttggatccccccctctttgggagtgtcccccctgtcgcaacagtaccccacgtgtgttataagtgatgaaatatttagtcctcggccttaaacccacttcgcgtgatataatatgcttaccccccccgattggcccccacgacaggcgagccccccgcgcgggctcccccacccttcttgagagggaatatcggggtgtatttcccccctctctgtaggaacagaatagtggtagggtgtaccactcttgagtgagaagagtctgggtggacactcagcgccacgacgccgattttgttgtgccgcccgcgtcattatgacgagccctcatgtttgtcaaaaaggtgaggcccaaaagtcaaggactgcctcatacggcgcaacataacaaag

SEQ ID NO: 644792 - DNA, 220 bp, Homo sapiens
agccttttcttatttagctctttagtaagatttacacatgcaagcatccccgtttccagtgagttcacctctaaatcaccacgatcaaaaggggccaagcatcaagcacgcagcaatgcagctcaaaacgctttagcctagccacacccccacgggagacagcagtgatttaacctttagcaaaggtgctaatccagtggaatcatgagatgtgtatgta

SEQ ID NO: 644793 - DNA, 112 bp, Homo sapiens
ctgcagctgatctaccggccttgagcatgccgacccggctgagcatcaggatgccaaagctggtggccacgctggacaggatatggctggcgataaacatgccgaacagcac

SEQ ID NO: 644794 - DNA, 199 bp, Homo sapiens
ctgaataggagcactcataaaaatatctgttatacaaaatctacaaataccatgtaagtccaatgaaaatactaacaggctattatcctggaacctgatggttgaataaacaatttatatggaagagtaacggaacacgaaccgttaaagtgcatttttgcatggataaccccccgccaggacgcacattgacaataca

SEQ ID NO: 644795 - DNA, 192 bp, Homo sapiens
  misc_feature (31)..(31): n is a, c, g, or t
  misc_feature (41)..(41): n is a, c, g, or t
  misc_feature (85)..(85): n is a, c, g, or t
  misc_feature (118)..(118): n is a, c, g, or t
ggaagtggggcctgataatagttcactgtancgtgctttangagtagtgtttttgtgcacttgccggggttttctctctgtgtgngaggggagtgatttaagcaatggtgtctggagnaagccttacaattttaatagactttttcttatatatccctcatttctttccctgaaataaaaatacacacaagc

SEQ ID NO: 644796 - DNA, 925 bp, Homo sapiens
gcgtggtggcgggcgcctgtagtcccagctactcaggaggctgaggcaggagaaaagtgtgaacccaggaggcggagcttgcagtgagccgagatcacaccactgcactccatccagcctgggtgacagggtgagactctgtctcaaaaaaaaaaaaaaaaaagggaaacccaaaatttacggcaaaaattttttcccagggatttaggaaaaaaaaattggccttggttatttctcaagtcaggtaactcaaagcaaaaaagttgattccaactgtgtagagttatgagtttggcactccaaaaatttggacatttacggctaaataaatctcagggaattttggctaaaattcagagaatacgggaagtttcacaatctacctattggtagactttgaaggttgcgaacacttacttacattatttaatgtgtaaactcaacctttagggaccgggaatgggtggcatttaaggctataatcgtgggatcgccacaattttcccaaaaatatattttaaaaaaattcacatacccttttttaagggaaaattatttaagggtttacaaaattcattattggcattattcaaggtaaaaggttactttgaagtgcttaattaaaatttccccaagttatttaacgtggtatgaggtttacttttactaaactaatgatgcctctgtgggtctcttagtgaagcataggctcggatttgggaccccgtaatttaaggctgtaagaatagaaatgggtattatagattcgaccgacaggggttaaattgagcgggttgggtaacttttgtgattttattaaatttggactaatttggcaggtttcttggcaagaaaagtgtgggaacaaggactcgttacggaaagggttcgaaaacgtttggtgtgaaagtgtatatcaaaaagt

SEQ ID NO: 644797 - DNA, 792 bp, Homo sapiens
  misc_feature (2)..(2): n is a, c, g, or t
  misc_feature (8)..(8): n is a, c, g, or t
  misc_feature (12)..(12): n is a, c, g, or t
  misc_feature (25)..(25): n is a, c, g, or t
  misc_feature (28)..(28): n is a, c, g, or t
  misc_feature (30)..(30): n is a, c, g, or t
  misc_feature (39)..(39): n is a, c, g, or t
  misc_feature (44)..(44): n is a, c, g, or t
  misc_feature (50)..(50): n is a, c, g, or t
  misc_feature (52)..(52): n is a, c, g, or t
  misc_feature (56)..(56): n is a, c, g, or t
  misc_feature (63)..(63): n is a, c, g, or t
  misc_feature (67)..(67): n is a, c, g, or t
  misc_feature (71)..(72): n is a, c, g, or t
  misc_feature (75)..(75): n is a, c, g, or t
  misc_feature (83)..(83): n is a, c, g, or t
  misc_feature (91)..(91): n is a, c, g, or t
  misc_feature (102)..(102): n is a, c, g, or t
  misc_feature (107)..(108): n is a, c, g, or t
  misc_feature (113)..(114): n is a, c, g, or t
  misc_feature (118)..(118): n is a, c, g, or t
  misc_feature (125)..(125): n is a, c, g, or t
  misc_feature (141)..(141): n is a, c, g, or t
  misc_feature (163)..(163): n is a, c, g, or t
  misc_feature (192)..(192): n is a, c, g, or t
  misc_feature (215)..(215): n is a, c, g, or t
  misc_feature (257)..(257): n is a, c, g, or t
  misc_feature (297)..(297): n is a, c, g, or t
  misc_feature (343)..(343): n is a, c, g, or t
  misc_feature (348)..(348): n is a, c, g, or t
  misc_feature (352)..(352): n is a, c, g, or t
  misc_feature (387)..(387): n is a, c, g, or t
  misc_feature (425)..(425): n is a, c, g, or t
  misc_feature (435)..(435): n is a, c, g, or t
  misc_feature (437)..(437): n is a, c, g, or t
  misc_feature (455)..(455): n is a, c, g, or t
  misc_feature (489)..(489): n is a, c, g, or t
  misc_feature (579)..(579): n is a, c, g, or t
  misc_feature (588)..(588): n is a, c, g, or t
  misc_feature (596)..(596): n is a, c, g, or t
  misc_feature (604)..(604): n is a, c, g, or t
  misc_feature (609)..(609): n is a, c, g, or t
  misc_feature (634)..(634): n is a, c, g, or t
  misc_feature (654)..(654): n is a, c, g, or t
  misc_feature (657)..(657): n is a, c, g, or t
  misc_feature (669)..(669): n is a, c, g, or t
  misc_feature (704)..(704): n is a, c, g, or t
  misc_feature (721)..(721): n is a, c, g, or t
  misc_feature (787)..(787): n is a, c, g, or t
anggcgcnccgnacccgccgccggnggngngggggggcnggggngcctgncngggnggggggngggnggcnnagngccgaggngggagggngacggggcggngggcnngggcnnggcnggggggnggggggggggcggggnggggggggggggggggggggancgggggggggggggggggggagggggggngagggggggggggggtggcggcngcgcgggcggaggggaggaggagggaggggggggcgggaggnggggggggggggggagacacaggatctcccaagcaccaancacaccagcactttaccggagtagaacctggcgcaaccgcgcttcncgctnactnacaaacccaggagcggagggccggggttctccacnatccatcccaggagggatgttatgggcttgcggacctnggggggccgngnacgggggcgccctccctnccggcgggggccattaaacccagtgttagccctnacggacgggccaaggggatttacattcggccccttggaaacggaggggaccttggagcctccctgggggacccgcgggcggggaccaccngcggggctnccaggatnccaccccnagctnccaagttgggggagggcggggcccngtggtggggcgggagcgagnctnggaggagccctnaccttggggaggggcggcagttgccgtggggagtngggctcccgccaggatnaccttgggtagaaacgggggaaagggaggacgcttgccagcgcggccgggaccccccccaaaagancacac

SEQ ID NO: 644798 - DNA, 185 bp, Homo sapiens
tatagtttgagtttattttaaccattgcaggaatttaaaactatcgtattctgggatataaatgtggtcatagaggcctgattttatacttaaacagggttttttgtggcttgaaaaacgtggcattttataaactaggcataagtgaatttaagccaacagtttaccgaatgtctccatatcta

SEQ ID NO: 644799 - DNA, 421 bp, Homo sapiens
gagtcggtaccttcctgcttctgctgctgaaataaactcaaactggccacaacaagtctgacatcttttctttatgcttttatttttttttttccctgtcaaggattctcactctgttgcccaggctagagtgcaggggggcaatctcggctcactgcaatctccaactcccgggttccagcgattctcctgctcagcctcccaattagctggctttacaggcccccaccaccacccccagattaattttctgctttttaagcggggacagggtttcaccattgtcggccaggctggtcttcaactcctgacctcaagtgatccgcccgcctcggcctcccaaagtgctgggcccacaggcttgagccactgcgcccagcctgctcttgctagatttttaaatttgtcagatcactaatgg

SEQ ID NO: 644800 - DNA, 644 bp, Homo sapiens
tgtgtgactagtaaatgctgcaggatgtgccatatcattgaacagaactaaagtctatgacagtggatatagctgctggaccattccatcttatatgtaaagaaatctggaattattattttaaaaccatataacatgtgattataatttttcttagcattttctttgtaaagaactacaatataaactagttggtgtataataaaaagtaatgaaatcctgagaagagttttatcttaggaaaatacatatatatgcagtgtgtgtgccaatgtggtattaacaagactaatagtgcagtttgatccttaccaatatcattacttaatttgaagtgttcattatcaccccaaaatataccttttctatgtactgttaaaagaaattggcttctgatgcatgaacatttacatgtacattgaaagtagtcccataatagaagttagtttaatacccaatgttagaccagtacatttacttcccttgaaaaaagaattaaagttgaaaggaattgtactttttcctttaaaaggcagtacttaacccaaacatctattttattaccctatatgtgaaaacctctattggtgtttaggtggaaaatacgccaaaattttaacttattccattaggttatggtgtat

SEQ ID NO: 644801 - DNA, 522 bp, Homo sapiens
  misc_feature (86)..(86): n is a, c, g, or t
  misc_feature (108)..(109): n is a, c, g, or t
  misc_feature (162)..(162): n is a, c, g, or t
  misc_feature (164)..(164): n is a, c, g, or t
  misc_feature (173)..(173): n is a, c, g, or t
  misc_feature (182)..(182): n is a, c, g, or t
  misc_feature (186)..(186): n is a, c, g, or t
  misc_feature (200)..(200): n is a, c, g, or t
  misc_feature (203)..(203): n is a, c, g, or t
  misc_feature (211)..(211): n is a, c, g, or t
  misc_feature (224)..(224): n is a, c, g, or t
  misc_feature (228)..(228): n is a, c, g, or t
  misc_feature (234)..(234): n is a, c, g, or t
  misc_feature (237)..(242): n is a, c, g, or t
  misc_feature (246)..(246): n is a, c, g, or t
  misc_feature (251)..(251): n is a, c, g, or t
  misc_feature (257)..(258): n is a, c, g, or t
  misc_feature (261)..(261): n is a, c, g, or t
  misc_feature (272)..(272): n is a, c, g, or t
  misc_feature (278)..(278): n is a, c, g, or t
  misc_feature (282)..(282): n is a, c, g, or t
  misc_feature (292)..(292): n is a, c, g, or t
  misc_feature (294)..(294): n is a, c, g, or t
  misc_feature (303)..(303): n is a, c, g, or t
  misc_feature (305)..(305): n is a, c, g, or t
  misc_feature (308)..(308): n is a, c, g, or t
  misc_feature (314)..(314): n is a, c, g, or t
  misc_feature (319)..(319): n is a, c, g, or t
  misc_feature (327)..(327): n is a, c, g, or t
  misc_feature (332)..(333): n is a, c, g, or t
  misc_feature (341)..(344): n is a, c, g, or t
  misc_feature (350)..(350): n is a, c, g, or t
  misc_feature (362)..(362): n is a, c, g, or t
  misc_feature (364)..(364): n is a, c, g, or t
  misc_feature (370)..(371): n is a, c, g, or t
  misc_feature (396)..(396): n is a, c, g, or t
  misc_feature (401)..(401): n is a, c, g, or t
  misc_feature (476)..(476): n is a, c, g, or t
aaatcaatgattggatatcagaaacaacctagcaaatatagctccttttggataaaagtagaagcctcacattcacctttaatgtnatatatacactttttccaaaannaatttcctggcaccacacaaacaagaacactggataaatgtatcacctgaacngnaggccacanatgctcacnagtntgtccctgccgtangangctttaanaaaaaatacatgnatcnccagcnctnnnnnngggncgggngcttcnntgngctcttcgccncctacncccntggggggtgngnggatctttncngcntggggncccantttttgcnccacnnggcccagnnnnaagggnctccagcacgcncnccaatnnccacactgtgagcggctcacttggnatggntgatgggccggagtggcgtcctcctgatgtggcttccttccagcctctaccacccctgggggcctcctccaaggngcgggtggtttgttgtcctcttgtgcccacacacacggcagggtgg

SEQ ID NO: 644802 - DNA, 252 bp, Homo sapiens
  misc_feature (11)..(11): n is a, c, g, or t
  misc_feature (36)..(36): n is a, c, g, or t
  misc_feature (145)..(145): n is a, c, g, or t
  misc_feature (204)..(204): n is a, c, g, or t
  misc_feature (215)..(215): n is a, c, g, or t
  misc_feature (232)..(232): n is a, c, g, or t
tgcagatggtngttctgggtaatcgggaatgatggnggagttcccatatcttggagagccttcatctggagcctccaatcagtgtccccacctccagtctctccccatccagagaccatgccagatgaagaaccacacaccaccnccccattggtcaggaaatgtaagcccagggtcctcaaggtgggcctcaggggtctccantggcttacctnatgattcccaggcaccntcctttccaggattctttag

SEQ ID NO: 644803 - DNA, 956 bp, Homo sapiens
gccggcataaaacttaaaagtgttacagtcagaggttcaattcctcttctgtaacaacatacccatggccaacctcctactcctcatgtacccattctaatcgcaagggcattcctaagtgcttaccgaacgactagaattctaggctatatacaactacgcaaaggccccaacgttgtaggcccctacgggctactacagagccttcgcttgacgccatagaagtcttcaccaaagaagcccctaaaaaccagccacatctaccatgcaccgtctacagtcaccgccccgaacttaagctgtcaccagttcgcgtcgttctactatgaagccccgccgtccccatacccagaccccctggtcagagcctgcaacctaggcgctccgtatttattctagccacctctaggcctaggcgtttactcaatcctctgatgcagggtgagcatcaaacgtcaaagctacgccctgatcggcggcactgcgagcaggagcccaaacaatctcatatgaagtcaccctaggccatcattctactatcaacattactaataagtggctcctttaacctctccacccttatcacaacacagagaacacctctgattactcctggccatcatgacccttggcataatatgattgtatctccacactagcagagacaagcgaaccccttcgacttgcgaaggggagtccgaactagtctcaggcttcaacatcgaatacgccgagggcccttcgcctattctcatagcgaatacacaacattattattataagaacctcacataaatcttctaggacaacattgaggcctctcctggagtttccaatatttgtccagactatttaactccgtttataattgaaggatacccgatcggttgacaattaactcttaaaatcttcctcccgtatttgaagtttcctaatcggtccccactaaaaaaagg

SEQ ID NO: 644804 - DNA, 115 bp, Homo sapiens
gtttccccccctttttttaaattattggccgttttatgggttggctttttccctttccttaattccttgggtttccccccttgggtccctttttttaaagccctaagggtttcca

SEQ ID NO: 644805 - DNA, 477 bp, Homo sapiens
  misc_feature (54)..(54): n is a, c, g, or t
  misc_feature (60)..(60): n is a, c, g, or t
  misc_feature (80)..(80): n is a, c, g, or t
  misc_feature (93)..(93): n is a, c, g, or t
  misc_feature (110)..(110): n is a, c, g, or t
  misc_feature (125)..(125): n is a, c, g, or t
  misc_feature (160)..(160): n is a, c, g, or t
ggcagcaatccctatcaaaagcacaaaaagtgaaagcaacccccagtacccatnaagggntgaaaggggtaaaacaacangtgtcctatgcanaacaatggaataatgancagcctttaaaaggnaggacgctgtgacatacgcctacacatagatgaanccttcaggacatcacgctaagtgaaacaaaccagtcacaaaagagaaataccatatgtttctgcttatatgagatcctcagtgtaagtttgtagagatggaaattagaatgctggttgcccaggagctggagagaaggggaaatagggagttattgtttaataaatagagattcagttttgcaagatgaaagcatctggagatggatggtgatgaaggttgtgcaacaatgtgaatatacttaatgtccctaactgtgcacctaaaaatagtctaagtggtaaatattactttacgtgtatgttaccacaatttatt

SEQ ID NO: 644806 - DNA, 299 bp, Homo sapiens
  misc_feature (21)..(21): n is a, c, g, or t
  misc_feature (120)..(120): n is a, c, g, or t
  misc_feature (130)..(130): n is a, c, g, or t
  misc_feature (132)..(133): n is a, c, g, or t
  misc_feature (165)..(165): n is a, c, g, or t
  misc_feature (168)..(168): n is a, c, g, or t
  misc_feature (187)..(187): n is a, c, g, or t
  misc_feature (191)..(191): n is a, c, g, or t
  misc_feature (199)..(199): n is a, c, g, or t
  misc_feature (222)..(222): n is a, c, g, or t
  misc_feature (234)..(234): n is a, c, g, or t
  misc_feature (247)..(247): n is a, c, g, or t
  misc_feature (256)..(256): n is a, c, g, or t
  misc_feature (293)..(293): n is a, c, g, or t
catagaagtggtgtttttttnccaaaaacaaagtgcaaagctgcttgaatcaggaggagattaacacactgaaccgctacaagagggcaaagctgattttttttttaacttgaaaagatngcaaagggananngaagtgtttaaaagagccatgtccaaacccanctncatggatagctcagaggtntccncttttggntcccccattttaactggccacancccagccacagnggggtttttttgncttcctatncagcaaaagttaatatccagatgttggccttggccanttgcca

SEQ ID NO: 644807 - DNA, 405 bp, Homo sapiens
tgattctagaggatctcccgtccataaggtgtgccagtggattgcatgttcattctagagcaattggaaaatacacccttgccaaagaaagtctaatgtcccctcatgtgtccggggttctggccaggtgtggtggctcacgtctgtagtcccggcactctgggaggccgaggtgggaggatcacctgagctcaggagttcgagaccggcctgaacaacatggcgaaaccccatctgtactaaaagtacaaaaattagcggggtgtggtggcaggcgcctgtaatcccagctacttgggaggccgaggcaggagaatcacttgaacctgggggccggaggtggcagtgagcccagatcgctccacttcactccagcctgggcggaagagggaaactccatcgcac

SEQ ID NO: 644808 - DNA, 328 bp, Homo sapiens
  misc_feature (7)..(7): n is a, c, g, or t
  misc_feature (155)..(155): n is a, c, g, or t
  misc_feature (283)..(283): n is a, c, g, or t
  misc_feature (285)..(285): n is a, c, g, or t
  misc_feature (288)..(288): n is a, c, g, or t
  misc_feature (310)..(310): n is a, c, g, or t
ccccccntcccccacttttctactcaacgccagggaacgcctccaaggtgatgggcggcaagtaacaattcattccctctcaccccacctggaaggctggactacttcctcctcccaactccggggtcccaaaaatcctccggtcccatttgctnacttacaatattcaattcactctgaccaaacttcctataaaaaaatccacggtgagccaaaatgaaaattacaaggcattaatacaagaacctggcaaccgcactggccgcccaaaaacttcaattgntnctnccccattccgcaaaaatttaanaaacaaaaaaaaaaaaaa

SEQ ID NO: 644809 - DNA, 259 bp, Homo sapiens
acatcccatatatatgtacaatgagaactcattttatctgtatcttctggacagttattgataactattccttctttatcgagctctctgttgtcttatctaagcctatctttggttcttatttgattttaaaaacactgattttctttctattaaacactgatttttattttcacgtttttatttgatgagtaatatcctgtgaataattccaaagtgaacactgggcataccctgggtgactacaatctccaaatgg

SEQ ID NO: 644810 - DNA, 402 bp, Homo sapiens
  misc_feature (42)..(42): n is a, c, g, or t
  misc_feature (98)..(98): n is a, c, g, or t
  misc_feature (394)..(394): n is a, c, g, or t
gcagaggcttaaagagtgcttattcactgaggcttgcccttncttactccttcctgggaacccatttggcaacaagtgaagaaacctaggccagcctncttgaagatgagggaccaacggagagagaggctctgctgtcctagccctcccacagaataagtaagcctagccaacaccacgtggagcagagatgaaccatctcagttgagcccagcccaaattgctgaccaaaagaattgggaacaaataaataattattgttttaagctactgtgtttctgggtggttttgtatataatagtagctacctgatacattgggatgaccccaattacttgaacttctcttaggcctgttttatcacgtgcaaataggggataattttagtaatttngggttgct

SEQ ID NO: 644811 - DNA, 184 bp, Homo sapiens
aaacccaaacgcctggccatcgacgtatctcgctgctggcgtacggcgcgcctgcggtgacggtttcgctcagcggcaggccgaggtcctccactgataaacggagcgatgaagcctgggctgcgatcgacagcggctgatattcctcagcgcgaatgcggttgtagcagcagggcggtcgacg

SEQ ID NO: 644812 - DNA, 790 bp, Homo sapiens
gagcgggcgggcggggtgcgcagggcccgggagccctctatggagattctgcctcccctgggacagatggcttcttgagcacactcccacgatgggtggctgctctgggtattcatccatggggttcttccgcggtgaagccagcttgtcgtgctgtcccccttgtcattgaagccatcatggttctggtcaattcattgttgaaagcctccttaaactcctggatggggaacgtggtcgaacatcacgaagaccatgtgtacttgtggccccttgtgctgtggtcgcttcttgcgtggtcttggcttttggtccacttggctgaacattgttgggcttcagggaaggaggtacctttggaagaggaaattgggaagagcgggagtgtacaacttccctaatgaatgaaggcagaatacgacgaagaacaaggaggaacaggacatggtcacgcccaaaggcacttggatccgtgtgggccgatcaacgatgtggcgaacagagacgggacgactgtacccacgtggtagaggctaacgaaggacgagggggcacagtccagaaccgcccgaaagagagaaggcagaacgctcgtggcaagagactaccagatgagacaaccgtatgagggacggggcggaaggtgcctaagaagccccggtcctcaccggagagggagcgagcgacgaacgaggtacacaagacctaaggagctggggcgcagaaagggccggggcgtgggggagggagcgacgaccgggagccagcgagaacccagggggacgccgag

SEQ ID NO: 644813 - DNA, 222 bp, Homo sapiens
tactactgcattcagcctgggcacagagcgagactctgtcccacagaaaaaaaaaaaaagaaatacaaaacttagctgggtgtggtagcacctgcaatcccagctactcaggaggatgaggcaggagaatcgcttgggcccgggaggcggaggctgccagtgaactgagatcacgccactgcacttcagcttgggccacagagcaagaccctgtcccccgac

SEQ ID NO: 644814 - DNA, 657 bp, Homo sapiens
  misc_feature (27)..(27): n is a, c, g, or t
  misc_feature (34)..(34): n is a, c, g, or t
  misc_feature (74)..(74): n is a, c, g, or t
  misc_feature (76)..(76): n is a, c, g, or t
  misc_feature (156)..(156): n is a, c, g, or t
ggttaacgcaacagcacaatggctggntgatggncgatgatgcccacggcacgggcgttatcggggagcagggncncggcagctgctggctgcaaaaggtaaaaccagaattgctggtagtgacttttggcaaaggatttggcgtcagcggggcancggtgctttgctccagtacggtggcggattatctgctgcaattcgcccgccaccttatctacagcaccagtatgccgcccgctcaggcgcaggcattacgtgcgtcgctggcggtcattcgcagtgatgagggtgatgcacggcgcgaaaaactggcggcactcattacgcgttttcgtgccggagtacaggatttgccgtttacgcttgctgattcatgcagcgccatccagccattgattgtcggtgataacagccgtgcgttacaactggcagactgcgtcacaaggctgctgggtcacggcgattcgcccgccaaccgtacccgctggtactgcgcgactgcgttaacgctaaccgctgcgcatgaaatgcaggatatcgaccgtctgctggaggtgctgcatggcaacggttaatcaagccattgcagcggcattggtcggcagccgcacactatgagccatgcagatctacagcgccagagtgctggacgccttt

SEQ ID NO: 644815 - DNA, 315 bp, Homo sapiens
  misc_feature (187)..(187): n is a, c, g, or t
ttagagtatcccttgtagaaacaggattcaccatgttgctcaggctggtctcgaactcctgtaccttgtgatccacctgcctcggactcccaaagtgctgggattacaggtgtgtcgccaccgtgcctggccaaaatatttttaactgtaatgattaatgaaaaaatgctgtatcaagaacttttanggcccacatctataagcaatatttaagcgcgaaacttacagctctagttatatattaggacagaagaaaggttctaaatttctttgtctagaagaaaaagcatagcacattaagcccaaagaaagtaa

SEQ ID NO: 644816 - DNA, 260 bp, Homo sapiens
tactactactactaattcgcggcggtcgacggctgaggcatgacaactgcttgaacctcggaggcagaggttgcaatgagccacctgagtagccaggactactggcgtgacgaccacgcccggccaatttttgtatttttagtagagacagtgttccgccatgttggccaggatggtatcgaactcctgacatcaggtgatccgcccgcctcagcctcccaaagtgctgggattacaggtatgaggtcgacgcggccgcg

SEQ ID NO: 644817 - DNA, 193 bp, Homo sapiens
ggcagtacgagaaagtgtagtgggaagaaagttagatttacgccgatgaatatgatatttgaaatggattttggcgtaggtaaggtctagggtgtatgcctgcgaatagagggagaatcagtgaatgaagcctcctatatatggtgaatacagctcctacttgataggacatagtgtgaagtgaggtacaacg

SEQ ID NO: 644818 - DNA, 139 bp, Homo sapiens
ggcagtcgagtagatactcggacgggccccgtcttgcttcccgccctgctgcgccccattgatcaagagaccatggaagtgtcagagattcagaatccaagagtgtctttaagttttcaactgtaaataaagttttttt

SEQ ID NO: 644819 - DNA, 368 bp, Homo sapiens
  misc_feature (76)..(76): n is a, c, g, or t
  misc_feature (105)..(105): n is a, c, g, or t
  misc_feature (123)..(123): n is a, c, g, or t
  misc_feature (167)..(167): n is a, c, g, or t
  misc_feature (171)..(171): n is a, c, g, or t
  misc_feature (265)..(265): n is a, c, g, or t
aatgtggccataaaataaaatgggatattgttcaagcagtgaaaggaataaagtactgatatggactacaacatgnatgaaccttgaaaacattatggcaaagtnaaagaagccagttacaangccgggcaccatggctcatgcttgtaatctcagcactttggganaccnaggtgggtgaatcacttgaggtcgggagttcgagaccagtctggacaacatggtgaaacccccgtctctactaaaaatacaaaaatcagttggncgtagtggtgtgtgcctgtgatcccagctactcaggatggtgaggcaggagaatggcttgaacccgggaggtggaggttgcagtgagccgagatctgccctcc

SEQ ID NO: 644820 - DNA, 1285 bp, Homo sapiens
  misc_feature (641)..(641): n is a, c, g, or t
  misc_feature (903)..(903): n is a, c, g, or t
tcaaaacacaaagatgtttggtttttaatggggagtttttttaaagtttccttttttttaaaaaaaaaaaaaaaaaattgttagggacaaacggcaaacctcacacttgccttgacgcaggggccgggtttctctctcctttgagggccttttacagatttgtcagtttacatgggcccctccattgcacaaccttcccattaccacccaattctgcctgccacagcaagagtgcagggcccctggggccccctgtgggaggatgcgggcgaaggggctcacggggctctccgaggaagtgtgtggctcgactctgtgggtgcaccagtcctcctgtggcggctttcccgtgagaatgagccttcctcaatctctccaagtgttcacggtgttcttctcttgtgagcctttgccaagcccaccgagggcgcttcagctactcacaccggcgcagaacttttcagtcaccccaggctctgctgttgaccctgtggtgcatctccagggcttctctgtgcaattttccggcctcacttctgtgttcggcaccaagatctcagagaggccccctctgtgttcttctcaggccctgtgggacttgacagcgcaggtgtgccaatctcctcactgtgggctcaaanggggccccgtgtgtgtggctcacagggctccctcccagggggctctctttctctgtgtcgccgacctgtgtgtgtgcagcggcggtgggacagagatgttgctcctcgggagaattttggctgttttgatacctccttatttgtagaacggggctcctttcggcctcataaagggtgcaccgggggataaacagggggctcataatttccttccttgtggcttgggacccccagggggttttcaagaaagacacccttttgnccctcgtgtgtgaagtgaccagagctgttgccccagtaacaacatccccgtgaggaactcatcggggcggagagagtgggaaactcccactgagggtggaactggcggaacgaaacaagaccccccaaggcccgcaaaacctattcatgcatattggaactaaccggcggctggaagacgacacacccgagtcattggtgtcttcaagacagagggaggcgcgcgggccaacccccaaccagcgagaagggaggtgctctccacatggcacagctgaagtcagcaccaccccatgttgtattgagaaccaggttgtattcggatggaaacaccacccaagaatgtgtctccgcgaaacgatgatcgtgcgtcttacacacag

SEQ ID NO: 644821 - DNA, 247 bp, Homo sapiens
aaggtctagcctctcgagagagatggaagcctccccatatctgtcaccagaatttgactcgatgccaggggaccatatttgtacaaagaaagctggagtctaatgatgatgatgatgatggaaggcacagctgctttccacaaggtgggatcttggactcgtgccggcacgaggacaagatccaaggagttacacgtgggagatccaagaataccaagccatctcggccagaagataggggaccagg

SEQ ID NO: 644822 - DNA, 369 bp, Homo sapiens
acccgcgtccatcacccctttgtaatcccatatggggcagacctctgtcctccagagcccctggccacctgcgagatgggtcttgccaaaatacacatttgtgcctcttgcctcttgcccacaaacctgaacagacacctgctgctcatgaaaccacatccctattacccaacctggtcctgaaaacccccaccatggcatgtcctcccacctcctttcccattgcgttccttcccccacagccaagtcaattcattctaaatttgatctgagattattggttctacccccttgcttaacctaatccctttttttaccacttggcaaaaacctaacctaaccactccacggaggagatgccaccaacgg

SEQ ID NO: 644823 - DNA, 207 bp, Homo sapiens
  misc_feature (33)..(33): n is a, c, g, or t
  misc_feature (35)..(35): n is a, c, g, or t
  misc_feature (65)..(65): n is a, c, g, or t
  misc_feature (93)..(93): n is a, c, g, or t
  misc_feature (98)..(98): n is a, c, g, or t
  misc_feature (132)..(132): n is a, c, g, or t
aaaagtctcgtattgaatgtaggataggtaagnanttatttgtgaaatactcgaatgcttcatgnaaatactttctgagtttgtatttttagnaaggnacattttggaggctgaggcaggagaatggcgtgnacgtgggaggcggggcttgcagtgagctgagattggccactgcactccagcctgcgcgacagagcaagattctgt

SEQ ID NO: 644824 - DNA, 259 bp, Homo sapiens
cgattatatgaaatagaagcaacttacccaaaacgtaagtacataaagtgtgtacagtcccacacagactagtacaggtttacaaattcaatacacagaactttaaccgtgctaaaggcgagaggaatctagacattctcgggtaaatctctactcaatctaaatcaacagcttggcttttcagcgacggaggaacggtgcgaagcgcagagcagtaggtgcgtgaactactcgctctatctgtattcacgttccactc

SEQ ID NO: 644825 - DNA, 116 bp, Homo sapiens
tgctgatacaccaaggtatggactttctttagtatgtatcacaaattggttcacttcattatggcaaatgccacctattagtggatagggtggtatggtggtatagggtggtatag

SEQ ID NO: 644826 - DNA, 399 bp, Homo sapiens
cgaacactgtatcgtacctatgctgatagccaaagccagtgatcaacatgagatatgatactaatagagacaagagaggatggtgccaaaaaagacctggaactcccagaggaagggcaagtgtgctgtgctcaaacacctctacacgacagacgtacttccttcctgtgatagaggttggtggatgctgaaaagctcacagccaggagacctggtgggtgtgaacaaatactcctatctgatcctggagacgctgcccacagagtatgactcgcgggtgaaggccatggaggtagacaagaggcccccggagcaatacagtgacattgggggttaggacacgcagattcaggagctggtgcaggccattgtcttgccaatgaaccacaaggagaagtc

SEQ ID NO: 644827 - DNA, 941 bp, Homo sapiens
ctcagtatagataatggataacgccgcgcgggctattaatgactgcagaaggacaaggggccaaaagcgggtgaacaccggggcacacacccgctgtggggcgcccccgctctcgcgccgggttgtggagaccgaagtgcgcacaaacccgagagggggccaaatgtgcccccatcaagaccaaagggggatgccccccggagattgcaaagtgttcctgaccgcggcgacgccccgtaattttggacgcaggtccccttccgagttgggggacacccaccaacctttgggcggtgggcgcttctgaaagagctcttctgcgtcgccccgatgccagccttcggccgacgaaaacaagtgctaaaagttggtgctttcttctaaaggagtttctaatctctggggcgagacaccccccccccccgaaggagggagtaaacctgctccctggcagtctgtccgccgcggagggaaaaaagttgcgtggcgagacaggaatcgccattctatcgaaaagcacaaggtaacaagaaagtcttctgtaggggaggtcgcccaaaagatgaaactgtttgtcatcggggagcgggccctctcccaagactacgatggaacaattggcccagacgacgagtcgttttccagtagaacccccagcataattgcggggaagaaggcacccacgggcctcacaatgggtgcgcccgttaccaagggcgattcacgaacacggtctggagacaagggtgaacgcatagagattgtaatggtatcacagaggagtccatgaaaaaaacagggatgaaaaagggtgcctcgcttgcgggagtaatatttgcggaagaaggtgcaccgcccgagacagagaaaaacacaggaaaattcccgctttgggcccgggaaatggtaaaagggggaaatttgaacagacccaacataac

SEQ ID NO: 644828 - DNA, 349 bp, Homo sapiens
  misc_feature (349)..(349): n is a, c, g, or t
aaccaatgtgatggtatttggggatgccaccttttagggctaattaggtcatgagggtgcagccctcatgaatgagattagtgcccttatcaaagtgacttgagagagctctcttgacccttttgccatgtgaggacatggtgagaaggacatagttgagaagaaagcagtctatgaaccagaaagtgggccctcaccagatgctcaatgtgctggcgaattgatctggacttcccagcctccagagctgcgaggaataaatgtttgctgtttgagccacccagtctatggtatcttgttacagcagccaaccaagacaggaccctcaggactgttctgagccccccan

SEQ ID NO: 644829 - DNA, 219 bp, Homo sapiens
ctagaggttcccaagcttacgagggagagccacagccagagcagaagaggaaaaaaaatcttccgaagacattatttcatattcataaaatgatagttatagaagtgggggaaatctatattcagtacattctacttactaaaaatgaagtataggtaaccactttaaaaagaataataacaaggttttgaagcttcatataactggacattcctcgtt

SEQ ID NO: 644830 - DNA, 140 bp, Homo sapiens
gacggggatctacaaccaccacgactaaaaacaaaccctgcacatagttcaccattcaatgcatctttttcaatttcaacagcacacacacagcaaacattcagccagtcatcttgcgacagcccattccagcattcaac

SEQ ID NO: 644831 - DNA, 164 bp, Homo sapiens
atcgggtcgagctcaccggcgcgcagtgtgggccagctcggggcgatcatcgagagcagcgcgtcgggcacgttctcgcgctggcccagctgttcgcgctggcgcttgctcagccagggcaggcccatcagcgccaggatgcgcccgcgcaggccccggccaag

SEQ ID NO: 644832 - DNA, 327 bp, Homo sapiens
gatccttaaaagcttatttctcagaacatatgtccggttatttatccggaataacattagaggtactcatagggagagttaaactcatgttcttacatatgtagtatttaaaataaagttcagataaaggaaaaaagcattactttgtaccttctacatctgaaagaacaatcaagagatcagtttttattttcacagtcagttgttcagtcaggctattattatctttaacactaataacctagaattgcagattaaaaagtcatatgtgagtgagctaagtagttcaaaaagaaattcatggaagaacacagtcaagctcatgca

SEQ ID NO: 644833 - DNA, 158 bp, Homo sapiens
agcttgtgggagagttgagcagcagcagagaactcattctcaaacatcttcttcttcaggcgctcgatggcctggtctggctttgttgcttactcctatctggatgacactcttgcatggcagagatcttcatcttcatgtcctccatgctcatggtc

SEQ ID NO: 644834 - DNA, 392 bp, Homo sapiens
gctgccattagccactcgcttctcgagtcgtgccccctagcggctttcgtcacgctggccctcgtagcgttcaacgaggaaaggaatcgtatcgtatgtccgctatccaaacctccatctttcgacccctttgctgatgcaaggtaagggtgatgacctgcttcctgctggcactgaggattatatcatatagaattcaacagagaaacggcaggaagaccttactactgtccaagggatcgctgaatgtatttacccgaacttcacaaacagaaactatgtgaaggcgtttaagaaaaagtttgcctgcaatggtactgtaattgagcatcggaatatgagaagtaattcagctacagggttgacccaaacgcccaaaggaaaccatatgc

SEQ ID NO: 644835 - DNA, 226 bp, Homo sapiens
cagataagaggcagaatacaagatagatttttagggcaatataaactattctgtatactgtaatggtggacacatgttattatattagtagttgtcaaaacccatagagtggtccggtgcagtggctcatgcctgtaatcccaaccctttgtgaggccaaggtgggagaattgcttgagaccaggagttcaagaccagcttaggcaacatagtaagaccccgatct

SEQ ID NO: 644836 - DNA, 229 bp, Homo sapiens
agagtataaaacatatgcatactaaatagaaaattaccttgatatttccctggaagatatacagttggtttatatgccgtctaatgatagtactactatttgtgcacgattgttagacgggatgtggaaaagcgcagacatctcggacgtgagcgtgatgactcgtgaataccgggctaccgaggcttcagcacgttccgtcgaatctatggtcatcagtcgtgtcatc

SEQ ID NO: 644837 - DNA, 754 bp, Homo sapiens
  misc_feature (5)..(5): n is a, c, g, or t
  misc_feature (8)..(8): n is a, c, g, or t
  misc_feature (568)..(568): n is a, c, g, or t
  misc_feature (618)..(618): n is a, c, g, or t
  misc_feature (631)..(631): n is a, c, g, or t
  misc_feature (637)..(637): n is a, c, g, or t
  misc_feature (674)..(674): n is a, c, g, or t
  misc_feature (684)..(684): n is a, c, g, or t
  misc_feature (699)..(699): n is a, c, g, or t
  misc_feature (723)..(723): n is a, c, g, or t
ttccntgnggatcctccgggctttaggaattcggctttagctgattctttcaaactggaaaccctgaagctgagagcccagcatggttcctggcaaacagcaggcactcaaatattgattggtttactgtatgactagtagagaccccaacgagcaaaactgtggcctaataaaattctggctcctctcccagacttcccctccctttgagaaatgccagaagcttcttagggaggctcttgccaacctagacatcacaggcactcatggggcagctccagcctcttcctcctgtcatcaccataatgcatccatatctacaatatggcaaatttcatatccttccaacctctttcctgcattattgatgggctgtgtgcactttttaaaaaatcaattagatcagggcgtggagctggagttcaaagaagcctttaaaagtctgctcttctgttttgctgttttgaataggcacagataaagctttccctctggtttgaataagccaagctcagtgctaagttggctctgattggccaggactaggtgcggttaagatgcaaacacnaagcaatataacccagtatctctgtggccattactaaagctaagcagcangacctggagcctnctgctntggagtggtcttcaatactgctgctgcttacgcgccnggcttggaanggctgtgaggagaangcaaggtagggtcttgattacggnggcattgcaagtaatcctctgaatgaggagt

SEQ ID NO: 644838 - DNA, 522 bp, Homo sapiens
tcggccctcttgatgcaagtgtcagtagctcgagactagccggtgtattagtcagtgttctctagcatagaaggattgcttgtggccagtagttcgagactagcctggtgctattagtcagtgttctctagagggacagaagtaacaggatacatgtatatataaaagggagtttattaaggaatattgactcacatgatcacaaagtgaggtttcacaataggccatctccacactgaggagcaaggaagccagtctgagtcccaaagctgaagaacttggagtctgatgtttgagggcaggaaccatccagcacaggagaaagatggaggccagaagactacatcagtctagtctttccatgttcttttgtctgcttttattctggctgtgctggcagctgattagattgtgcccaccccgattgagggtaggtctgcctttcccaatccattgactcaaatgttaatctcctttggcaacacccttcaatccaatcaagttgacactttgcatccagag

SEQ ID NO: 644839 - DNA, 449 bp, Homo sapiens
caaggtttccttgaccaggttgcccacaagttgccctttgcagcaaaggctgtgaaccgcgggactttaaagaagatgcggaaagatccagaggaaagagaacgtaaccaccagaacccctggacattttaaggaatagcccctgccaacatgctgggcatacggaaagtactgaggccatatgacttgacccccaaggggaaatactggggcaagttttacatgccccaacgtgtgtagtgagtgtaggaaataactgtatatagggtactgaaaaaaggattttgcatttttattccccccagcctaccccctgaagtttttggggaggttttaagccataactaaggagcagcctttgagtagatttttgaaaaacaatgttatttgttgatttaaaaaaaaaactggatttttattaaataaaatttaaacctcccttcagggca

SEQ ID NO: 644840 - DNA, 980 bp, Homo sapiens
tgggtggggggggaaaggggggaaagggggggggggtgggaaacttttttataaaaaaagggggggggggggggaaaaaaataaaaaaggggggtgtaggggggctggcaagcgcgagggaggggttattagcgtgtgacctaaattatcataaaaaaggagggtgagcgataaaaaacagaggtccctttggtaggaacaaagtatgtgtggtgtcgtcaagagttcagcggagaaaaggactgtgctcatatattgttgtgcgcccacgaaagaaagagtattagggggggagggagggggtggtataccacataatagatgtgtggggggtgtcagtcggctcctaaaaaaaaaaaatagggggaaaagggtgccggggggatttactccatgagtgtgtagacccccgaaaaaaaaagtggtggcggacccccctcgcgggaagaggaggcaacgagcggggggatccggggtgagcatccgccgactgggtggggagacaaaccaaccatctttggcggccgaggcggcacaaaggagggggggaaaaccaaccaagggggtgttctcggtcgtctcagcacaaaagcgggcggaagagggcataaagggcgcgccctcattattatgatggcgtggcggaccacaaccagagggcggcggggggaccccacaatcgaaaaggggtggggggacaaaatgcacagggcggcaaaagagggcggagttgggattaatgctgccccccgcgataagaagaatagttgaagactggctcgacaggggctgtccaaacaacagggcggcgaggtggggcgaacaaggaccggcacatgggcgggggctcccaccaaaacaagcagagcaacacagcggggggaatcagaactgatatctacgtcgcgactggactggtgcaaacttcacaggagaagcccagcgcagcggccgtataactaaccatgcgaaatcacgct

SEQ ID NO: 644841 - DNA, 608 bp, Homo sapiens
ctgtagttcaagaccagcctgggcaatatactatagcaagcccctgtctctacaaagaacagcttaattagctgagcatggaggcatgtgcctgtagtcccagctgctcggagggctgaggtgggaggatcactcaagcccaggagttcaaggctgcagtgagctatgatagcgtcactgtactccagaatggacaacagagcaagaccctgactctttaataatattcaaccaatgggacacttttcatttattcaccagggagcttttggccctggccacgagccaggcagaggtcggagtgcttgggatacgttagcgaacaaaccagacaatggctccctgccgttgcgcagctgacattgtaatgagtgtctgagtaggagtgaagatattgcccgttttgatcccagagcggcataaaccaaatgcgaaacataagtcgcgtagaatatacagaatgaagtctgatgtcagtctgattgagatactagcatttggcccaagacctgtaggtagagagagagcatgctaaacttctatggcgagcctggcagggacgtcctggggaccagacttcgaggccttcgctgatgatgcacacccgc

SEQ ID NO: 644842 - DNA, 1199 bp, Homo sapiens
gggagtatttaatcaggtgtggctatctgagaaatcaacttcgggggaaatgtaagattctgagctctctctctgtattgttctagccatgaatttgcctgcagaaacttgtaacctatgtgcctcaatatattccatagacacagtaggatccccctgccttctcccactcctcacacctcttcctaccagcggcataggccttctgcacaactactactcagcatacaatccacccgctcccatcgctccactcctacacgcgttatccaactctgcgaagcgtcgcccaccccgactgttcgccctcacccacgcgtccatgctacctacgctcgcccgtctacccctctccctcgtcactacagtaacaacttaacaccgcaccagacactggccgccaacacgccgcctcctcacctgtggctccacatccacctacatgctccagccagcctttctccctacaccactccctctctcaactgcgttcaccacaaccagctaccccacaaaacacaccactgaccctgcgaaacactaccttcggcgctcacctccactactaaccctaatgttggttgccccttactccatttaaactaagccacactgctcaacaattctacacactaacgccgccataaccatctctgtaacttcacctggagcacacgctcagacaaccacctaccatcctgcctgcaccacctgcaagctgcctcacacccgaactcgctctactacacccggcctggtaactctaccccacactacttcctacattcctgcacacgcatatccacataacctaaacaaacaagaacggtaatatttcacctcctacacctgacctaaacttcatctcccccctcacatctacctctcctacaccatcaccaccaactcacgccaccccaactcatctctatcacaccctatactctcttaacttcactccatacctgctctacctaccaccctcccccccaccccccctcctcgccccccaaccgcatccctcacccccacaccccacctccccccatcaccccacccctcccccctcatccaacacccccccacccccaccaccccccctctacccatccaccaccacacacaccccaaacccccactcccccccccccacaccccccacaaccataacacacatcacactcccccccccacaccta

SEQ ID NO: 644843 - DNA, 745 bp, Homo sapiens
cgttgcccttgctcttgagaacctcccccgcagttgggcgccggtttatttcacaaccgggacggaaattctgtttccccgcgcccccccccagtggttagaccagtgctatctcccggggacataataatatttcgccagctagcttcccgcgcacaaagttcttctacaacagtagtacgctgtaaccagcgggagaaaagcatatcgctgcactagaatgctgggtaaccaccaacgtcattagttgtgccacaacatcagaggccccaccttgtctattaatgggcggaccaaagagagcgggggtacaaatgctcctacctcggtccacatgccgcccgctccaaggactcctgacgacgccctttatagtcacttgtcacacaaatgctccgtgcgttgtttgtgccccccctggcaatattttatatagaaacagaaccaccttttagatccatgggtgtagatcgcgacagccaccgagagtgcttccacgcaactcgtgggagtatttccgccgaacatgttgtgtcgtcacctctgggacaccaactcgtagtagtcgacccgtcgggtcgcaagaaacgttactcaacaatgacagcgggcaaaatactagaatagacgacttccactagacaagcggcgctgattacacgcagtggtctcgccacactatttctcgccgataaagacctgtagcccgtgggagataataccctgttcccagttccacaaaaca

SEQ ID NO: 644844 - DNA, 167 bp, Homo sapiens
ctgatattctggcataaaaatgtgttacagttgggtgtggtgaatattttgtttggcatgaactcctgtcatacttttacacatacgaaaatgaaagcccagagaggggaaatgaggtcgctgagtcacacagtaattttctgttgctctggattccagtctggctc

SEQ ID NO: 644845 - DNA, 605 bp, Homo sapiens
tcgggcacaacctctcttctctaccagacaatacttttcaaatccatgaacgctctcctggcctacgattgcgacagactctgtcccaggatcagtggttctctcctccgtgagagtgaccttgctccacatccggaggggattccttgaggatatatcgcccagtctctcccccccagccctttgagggtcgacccctctcggagacttcctcgcaagcgccttgctgcctctctctgctggtgcggacctagggcccagctcttggcgggcacttctgcccagcgactgcgttatcagcagcagcccgccatgcgccacgcctgattgttccagctccaagagactaagcgacaaagaccccggctggggggagcgcggcttgggttgggctcttatcttccgtggagcttaggaaacgctcccacctcccccgggccctcgagggcccagcacggctgagcggctgaaaaccgtagccatagatcctgtccacctccactcccctctgaccctcaggctttcccagcttcctccccttgctacagcctctcccctggtttgggctatgtcagatcccaaaacatcctgaacctctgtctgta

SEQ ID NO: 644846 - DNA, 228 bp, Homo sapiens
catcatgaatctgcaaaaatcatttctgacattctgctacactttcggaatgtattaatctactagcccaggtttctttcctcccaccccctaatctcaatctgtagttatcctggtgtcctcagtgcaaacactttcagcatcattcagtccgcacatcattcagttctccattcaaccaccaacatatttattagcatcactcatttcataccagtcaaatatagg

SEQ ID NO: 644847 - DNA, 323 bp, Homo sapiens
atactctgcatatagctcagcatatgactgtacataaattatgctctaacagattaacttagccaaaaattttgtagagtagactaaagcttaactaagaacaattttcattctttgggaactacaataagtacgaacctgtgttgttcgtaccactggctatgtttctgagccaagattttttaaagcaattttcaactcacttttcagacctaaaaagaaaggctaaagcacacacacagtattttaaaaagtaaaaaacgaaagtaataaataaacaagaacttggctgggtgcggtgcctcatgcctgtaatcccagca

SEQ ID NO: 644848 - DNA, 112 bp, Homo sapiens
aagcagttatacagactcagaagttttgaaaactagcaaagaagactggatttggaaagcatggtctacaatgggtggtaaaattctgaagctatgaagaataacatgtttc

SEQ ID NO: 644849 - DNA, 368 bp, Homo sapiens
  misc_feature (349)..(349): n is a, c, g, or t
tgctgctccctcttcacctgcactgctgccccaagacactgtgttttgacctgatccagagtaagtgctctccaaggagaacgcttgcacggacctcctcacataagctggctaaggccaacggggggggatgtgaaatgtgacatggaggtgagctggccagatggctatacctgctggcgtctacagtcgggggcctggggctgctggccttttacccaggcttgtgtgctgtgaggaccacattcactggttgttccgcgggtttacgtgtgacacgcagaacggtacctgtgaacagggggcccaccaggtggcctggatggagaagggcccagctcatctcagnctgccagagccacaagcct

SEQ ID NO: 644850 - DNA, 707 bp, Homo sapiens
ccttgtgacagtgtgccaggacttcgaatcggaggtaggtaggagagtttacctagacgggcgttcgccaattggtgaagctgaagctgacctgaagtgtgatggtcgtggcgtgaccttatccactgcggcaagatatagtgcgcaggggcggtcaggtccctcagtgcgatgctgtgatctgtgagagctggtgccacctctgtccgttggcttggtgcctgagatcctcagcaaagctctggcccacgtggaggcctatatcgatttcggcgaggattgacaacctggaggatgggggtcctgtagcaagcctgacatctgaagtacgggcactgcaggtggccctgtggtgcacatctacgatgatgccaggcgctgggcagagtgctccgctcaggggcgcacgtagtggtcactggaccccccaattgctgggcaagagcagcctagtgaacctgctcagtcggaagcctgtgtccatctgtgtccccggatccaggaccacccgtgacgtgcttggagaccccagtcgacctggccgtgatttcctgtgctgctgagcgacacggctgggttgcgggaggggcgttggggccccgtggagcaggagggtcgtgcggcgcgcccgggagagttgcaacttcctggcaccgtcgtacctctgtgggagcccagagccccagttgacagcgtcagggcctcct

SEQ ID NO: 644851 - DNA, 333 bp, Homo sapiens
aaatttcaacttttcctttcaaaggtttttattacccaagttttttcccggccattccagtcaaattgggggtcattccccccaggggggttttaaatccctttccaacggcctaaggccctttgggtaaggggttttaaaacggtccttttttttttttaacagggttttgtagatttcaaatgactatgcaagggcctgggggccccctggttttgggccgggcctgggggtccgaaattccaaggcccaaacttggggggggggggggggtttccaaaattggttgtaaaaactttggatattgtttgttttaacccaaacagccctcca

SEQ ID NO: 644852 - DNA, 1256 bp, Homo sapiens
tgattcatggcaaccctgtggaagttccaccaagaggacatctgtcgccaaatgtgtaagcctctcgacaaatttgtccggcctattactttccgagagcctggggactttccctataataatggagactctgggcacccgaattgtctatcgtgttaccccgttcctgtgggggtcaggaaccttgtgtataggggaaaggggactccaattttcttccaaccccgtggggttccacaagtacaccccccagttggtgttcttgtggacgtgccccgtgtttttcgggacccaacgttaaatgtgcccccgttcaaaacagcttggtgtgacccaaggaattttgcccgagagatggtctaacgaatccacccgactgcgccataccttttttgcaccgggcactggtgtctgcccaagcccaagatattccctcgcgaatagtttccaacccggcaattctcggtagaaggtaccttttgaatgtcagcccctgttgcctgccccgtgcccattcaccacatcttgaggatcccttcccagttcacaatggttggctcgcctcttgatatctgggagaaaaccttatctcccccgaaggagagaactgggtttctcccccgaggccagggtgagcgacggacccttaccagaagcgatgcccgcccaccctttggggcttccatccctgggatgacacgtgtcccttgacacacacatcttgacaccttctgggaagagagattccaccagaaacccggtgtgaaaccccacaccagagtggctctcacccaggaacgccagaagatagggcccagaattttttggtgtgaaaagagctggagccacaccagaaataaaggcgcgcccatctcatttctttctgtgagaggcggacatcccacagaggtcagactggagactggattgtcccaacatccacatggcccactgcccgagggatgtgcctcggatcggaacttgcgcccaagactgggaagactcccagaagagaccattgcgttcccagactttcacagctttcgggaccatcacctacctgccaacggggccaatccgtgctcctcccagctgcccccagatgagggccccaccctgcctgcacactccgcgggctgactgggcccccagccccgatgatttttaacacagccttccttttgctcccacccccagaaatcactgtgaaatttcatgattggcttaaaatgaaggaaataaaggtaaaatcactt

SEQ ID NO: 644853 - DNA, 114 bp, Homo sapiens
  misc_feature (80)..(80): n is a, c, g, or t
aacctcttggtcagctatataccgccatcttcaggcaaaacccctgaatgaaaggctacaaagtaagcgcaagtaacccnacgggtaaaagaaaccgttatgggtcaaggtgta

SEQ ID NO: 644854 - DNA, 365 bp, Homo sapiens
atcccatccccccttgtggtctcagcccgcaaagccctcttcacctttgctccctgctttctccaggagtagctcttttctcatctagatcagtttcttaatttttaacatgcatacagatcacccaggggtcttgttaaaatgaggattttaattcagtaaaatctggagtgggatttgagattctgcatttgtaaaaagttcccagtgatgttgatgttgctggtctgtggaccacacatcctccagcaaggaactagtaagacagtggttgtgtttaatagtttgtgccaaaatgaaggaagactgtgaccacaaaaaggggccaggggagggagacaagctgtgttaagtggcctcaaact

SEQ ID NO: 644855 - DNA, 230 bp, Homo sapiens
tcgagaagcgccacaagtaacatgtctgtacacctgttccccctgcttcagagtagcttccagatccggtgagctactcgtcacagtggtgcgattgtcggcctctgagcaaggacagtgcgcttcaacgtgctcaaggtcaccaatgctgccggcactcgatagaaacagttccagaagttctgaggctggacatcggcccgttccctcacatagttcagcgtctgaca

SEQ ID NO: 644856 - DNA, 185 bp, Homo sapiens
gatcccccgttctgtccgaggttcgaaattattacgcacagtagactattgcactggtgatggaaagagcatctacggtgagcagcttccccgatgtagaacttcaaactgaagcactacgtggcctggctgggtgagcatggtcaacgcaggcaaagacaccaacggctcccggtacatgcaat

SEQ ID NO: 644857 - DNA, 175 bp, Homo sapiens
  misc_feature (77)..(77): n is a, c, g, or t
  misc_feature (98)..(98): n is a, c, g, or t
  misc_feature (107)..(107): n is a, c, g, or t
catagcgacgggttccagagtgttatggcacggattatcattctctaaattcttacaaaagaaagaacagtgggganaaagatgaggaaagcagaggngaaaggtangaaataaagtaacatgaatttaagtcattttcccccaaagtctcttaaagtatttaaatctctaactg

SEQ ID NO: 644858 - DNA, 364 bp, Homo sapiens
tgagacggagtctcgctctgtcacgcatgctagagtgcagtgatgctgtcttggctcactgcaacctccatctcccaggttcaagcgattctcctgcctcagcctcctgagtagctgggactacaggcgtgcgccaccaggctcagttaacttttgaaccttttttagaagagtgggggtttcaccattttggccaggctgtctcgatgacctcaagtcttctgcccgtctcagcctcccaaagtactgggattacaggcacgagacactgcacctggccaccttagacacttatactacaaaagaagaaagaccgaaaactaataaactaagagcaaaacttcaaacaaacacaaaaaaaaaa

SEQ ID NO: 644859 - DNA, 646 bp, Homo sapiens
atgaccccaatacgcaaaactaaccccctaataaaattaattaaccactcattcatcgacctccccaccccatccaacatctccgcatgatgaaacttcgggctcacctccctttggcgccgtgatcctccaaatcacaaggactatcctagccagcatatcaccagagcctcaaccgctttcatcaatcgccaatcactcgagagtaatatggtgaatcatccgtaccttcacgccaaggcgcctcatatcttatctgcctcttcctacacatcgggcgaggcctatataggatcatttctctactcagaaactgaaaatcggattatcctcctgcttgaactatagcacagcctcataggctatgtcctccgtgggcaaatatcattctgagggcacgtattacaaattatatccgcatcccatacatggggacagacctagtcaagatctgaggaggtatcagagaagccacctcaagatcttaccttcatcactggccttatattgagctagagatccactcctttttgccgaaaggacaaaaacccaggatactccatccggaaaacttcacttataaatcaagagcccggtattactttctaggatacattaccaactctggccgaatttccgcacttaa

SEQ ID NO: 644860 - DNA, 1635 bp, Homo sapiens
gcacgtggtagatgagctgaaaattgagatcaatcgcgccaagcgctctaggaactgtacccatggatcgtttggatagactaacaggcgaatgcgggatgcactcgaaagcgtgcagtctcactagaagtacagtttgggcgaaccagttggaccaagatacgttggttatcgtaaagatgcaattcatggcagggctccttcagggctggctgcagacactctcacatgacttgcgtggcaggtgtgtggctgttggacctgtttacttctgccttaccattgagtggccaaagcaaacgtgtggttgcatcgatcacccgagagtcagcaatcgtaatgagtgcaaacaaggtactgccttgtgtgaaggtcgtgtcctggcgtggaaggcttccgtatcccgtgatgccagtggctgaaggcaatggggtgcaagtcgccaggtaggctgaagaggaggataagccaaacaaggtggcaatcccatcacaattgctgcacaaggacgggcatcgaggaagcagaagctaccgtacggcacggaagaagggacgggcggtcacagcggacagccagtcgacccgtacaagccgcatgcctgcaatcggaaacaatacgcggcgcgtagatcccgcacgtcagcacacatcctcaaatctccgtgccgcacagcgaaaccggacgaatgaccaccgaagagaactaaagactggaatggacgcgccagcgaccaggagacgacgacagcaacgccaaagggcttggacacacacacgagaacaagggcacagaaattgaacctgcagcacgaggtccaccaccaagaaaccaccagcaacgcgagacctcccaaaactgctgggcgcttaccgcaagtggacggggaccgagcgggaaaaggcgtgacccacaccaaacaaccgacaaagcaatgcgtagcgcactgcaatgaaccacgacagagaagatagagaaaccaataggcacccgaaccaacacgcacggagaacaaaacaacacaggacaatcgcacaccacacaacacatacgcgcacaccaagaccacccaccagccaacaccgagacgacactaacatcaccccagagaccagcgcagtcacatgtgacacaccacaatcgctgaacaagaagcagtagccccaccagacaaagggaccacgagcgagactagcaagccacaggaagaccacggcagaccagagccaccaaacacacgtcgagcacaatccatggcacgaaacagtggaaacgatcaacagaaccgcgacgatcacccaaatgtcatgcgcacgcgggcaccccccaatccaacaaactcatggagacaagcaggaaagagaaagccggacgaacacaacagagaccacagcacacaacaggaggcaaacacacgagcaagaagaaagacgagacagccgaaacggacaagaatacaacgacaagaaaaatccgagagcgaagactccaacaacacaggacacgccacacacaaaaagaaaacagaacgagaaaaacaacgacacgacgaggaacagacgaacacaagcagaacaagaaaggctcaacagcaaacggcatgaagacaacagagaagcgagatacacacgcaat

SEQ ID NO: 644861 - DNA, 277 bp, Homo sapiens
tgtggcaggcgtggaggccatgcctgtctctcagcttttgggaggcggctgtgcctgggaggtccaaggtacagtgagctgtgtttgtgctgctgcactccagcctgggtgatggtgagaccccgtctcaaacaacacaatagacaaagagggagcaaacacaggagaaagtgcacgccttgggatcatcccctggccctccagggatcgccctgttgtgcacgcagaatggaccccggcctgggtgcattttcacatttctgtgacgtcagtcctg

SEQ ID NO: 644862 - DNA, 139 bp, Homo sapiens
tagcaggtgtaggcccacacatggaaaaaataataataaaacaaagcaaaacaggaaattatggattttagttgtatattggtttatgtattttttcttaagtatacagtgcacggtttgaaatgtaatgttagagata

SEQ ID NO: 644863 - DNA, 142 bp, Homo sapiens
ccataatttccatttaagaccatgtggatactttaggatacggacctgaccccacattgccacagaagaaggggtcagagtagaaccacacaagttagcggtattctccacacattgagtctcatctgaaatactactgagg

SEQ ID NO: 644864 - DNA, 894 bp, Homo sapiens
aatgtgtttagtctttcttgattactagggtttaagtcattatatagtggaatcagatggtgtcatttagtaaggattgatgagttcttgttttgaaaatccagacgtttcttttttctacatgtgagatagtcatccattattaacgtggctatgtcgatttgcacgacaaaaattaaagactagagctaaaataatgcaacgcgaggcggagaatagaaatgcattacgacaagaagattctcctcatagaacatggatctgtgtcacagggaaaaaacctttgcccttgaaatttgcactagtgagactgtacaattaattgtgcagtgaataatagctattttggtgtcctaagacattgcttcattcatgactattttcaatgttatttcattactgtacatcattttcttaagaagagatgataccagaagaaatggaaaatgaatgccggaattgggtgacacgtgtgttatctagctcaaaggtacctagagtatgtggcaagacatataccaccaatagtgcttcaaagagattgcactttcgtatgttagcagcgttatctgtgtagtaaacttattcttaattaaaactcactcactgtttactacatgttctggtagtgcattctgtatagtgagtgtgaatacctcacatcttattccatgttagacaaatcacgatgtttctgttttaattctaacccacttacttcgtttgcaaattttttgcactatccttttcccgtcgggccatggcgtgccactagagcgtcacaaaagcggaatccaaagggggcccgcctaaataataaggagctagacgggccggcgttaaaaagatgggggcggcaccacaaaaaaagacctaaagcgcgccaggtgttca

SEQ ID NO: 644865 - DNA, 101 bp, Homo sapiens
  misc_feature (96)..(96): n is a, c, g, or t
tgctgtgtactctaaggatccggatgcagtagattcacaaagaaattgaataggctgaatcacttttgatcctggtagtattcagcatactcctgntgcag

SEQ ID NO: 644866 - DNA, 989 bp, Homo sapiens
agcggacggatcgaccccgccatcccgccgtcccgctcggtgaccgtgagacacagccgggaacgcgactgatcagtgctacctgagcctggtgcctgcagtggcgaaatgcgtgtgctggtccgagtgcctcagaaattggacactgcatgcatgctgtgaatgtggcgctgactcatccctggctccctgcagtcccctgtgcagctgtgtatgcagccacatgtggtgcttggctggctggtgcatatgcctccccgcgcaccatccgaggacaccaaacccgagacgcgacccattaagcccagcgagcggaagatcacaggagacgcagtgcggtgccgggctggggtgcattgccgaggacgcggcggcaagttgagagagcagtgaggtgcagagcgaagggagagaaacacaggataggggagataacaagcgggggaaggcctaagaagtgtggatggttgaaaagtgttgtaggtaaaaggtgagtgttagcatcgattggtggtagatacattgatttggtacaccaagtaatggattacagagactgagaagtggttgatatcaatgaacaaagtaatacgtaagttgtttgattataggctgagtgagccagtgagaataatagctgagaagataagtcaggagctaagttcggcaggcgtaactagcgtggactatgaacgcgagtagagaggatgtggatatagattgaagcaactggaataagatggagttagtgagaagagggttaggatggagcgacgttagacacggaaccgagagataaatggtacgactatgaacaggcgggtaccaagtaggaatttaagagagcttaagaccaagtaaagactatcaccaggcgagtgcatagagagagggttgtccagtcagcagtgccatttgcgtgaagtggcggctaagaaaagatacgagatagagcacacagcttgcgatataataaggacatcgcttat

SEQ ID NO: 644867 - DNA, 437 bp, Homo sapiens
ggaagcatctaattccagtgtgcatcagcacttaagcaatgacgtttgcatagatgatgaaatgattgacagtaagtttattgtaaatggttcttacagagtatctttaaaatgtgccttagtgggaacccttgtcccatccgtaacaatgtgtatctctgattaataacgctgccatgtcccatgatcatcacatcatctatcgaatgtcttccccatgttataaatgaggtcacatatgtcgtgtgggtcgatgaattctgttgcctccagtgaccatggggcccacacctctgcccagggatgtccttgcgtcccattgaggtcttcccgcaaggcctctcagacccagatgtgacggggtgtgtggcccgaggaagctggacagcgtcagtgggcctgctgaggccttctcttgaggcctgtgctctgggggt

SEQ ID NO: 644868 - DNA, 665 bp, Homo sapiens
  misc_feature (348)..(348): n is a, c, g, or t
gcagtggtatcaacccagagtggccattaacggccgggggagaagggtattcctttattaaaatcttcctcatttggatttgctttcagttggttttcaatttgctcactggccagagacattgatggcagttcttatctgcatcactaatcagctcctggattttttttttttttttccaaacaatgggtttgaaacaactacgggaatttgtgtccacaaataagcttggaagtttggtgtgtagtatgcctcaaatataacgtgacgtgtatactatagcgggtaacttttcaaacagcccttagcacttttatactaatttaaccccatttgggtgcattggangttctctctttaacaaatgctggtggtgaaagacacagattacccagtagtgcttaccggctgaaaggaacacggtgtccgtgttggtaagggaacttccaagttttggtcggtaacatactgggacagaggtggtctgactcctttaaacaacacatctctaatctcatcatttataatggacctaaattttattacatcctggaagtattaccccattctctcgggtccttagatttttccacaaggaaccgcgacccccgggggtgcccaacgctggtttggcttcaagggacacaacaacgattcttttatcg

SEQ ID NO: 644869 - DNA, 479 bp, Homo sapiens
  misc_feature (48)..(48): n is a, c, g, or t
tgaatgcacacgtcacgaagacgttcctcagaatgcttctgtcttgtntacatgtgaagaagattcctatttcaccataggcaataaagggctcacaaatattttttgcagattctacaaaaagactgtatccaaactgctcaataaaaagaaagttttaactctgttacatcaatggacacatcaacaagtagtttctcagaaaacttctgtgtagtttttatgtgaagatacttcctttgtcaccattggcctcaaagcactcctaatatccatttacagatgtcacagaaagagtgtttccaaactgctcaatcaaaagaaagtgtttaactctgtgaggtgaaagcacacatctcaaagaagtttctccgaaagcttcggactagttttcatgtgatgatatttccagtctaaccataggcctcaaagggctaagaaatatccctttccaggttctaaaagaccaccatttccat

SEQ ID NO: 644870 - DNA, 510 bp, Homo sapiens
cagaataattttgttgatttatttttactataaggagataagagaaaaaatagctcacttggcagcacagaaaatgaataccatatggcaatattaaagcagaaaataattcatttctgatcagtagtgctttcagttttcatcagaattattattattattattattttgccactgtgaaaaagcagttaagcatgtaaaacttccctttagagagggttctttttggatagatcaatctggaactagcttctttttttttttttttaaaatgatacttcggtaaacccagcatttacaccaagattggtgggcctttggtgggcccattaactggggcttcacaccgattctccttacgaatctggtgagacttctaatatcttttatttcccttctcaccacagttgatcccctttggctttccttttctgctctccttttcaccctattgggagaatggggttcccccctggtacctccacgcgggacaacagagcgaactctggc

SEQ ID NO: 644871 - DNA, 387 bp, Homo sapiens
agcgtatgcaagaaggtcgtgggacactcagcaagctctatggagaccataaagcactctaagacgttcgaccggggcaatggtctggaacactggaccttgtggagaccctagagctgcagaacctgatgctgtgtgcgctgcaaaccatctacggagcagaggcacggaaggagtcacggggtgcgcatgccaggaaagactacaaggtgcgaatggatgagtacgattactccaagcccatccaggggcaacagaagaaagccctttaaggaagcactggaggaagcacaccctgtcctatgtggaccgtaggcacctgggaaggtcactctggaatatagacccgtgatcgacaaagactttgaacacggttaccgtgacctt

SEQ ID NO: 644872 - DNA, 638 bp, Homo sapiens
gctggacagccgtgaaagaaatgggactggtctttggacaggaggatggctgtgtcccctcctgaggtcagagggggacagtgcttccagacagggcctgcagctgagcttacagcctctcctgacatggccacgtgatgattggtcatgccttctgatgaatggctatctgcttatgtgcctagatccaccagagttgtcacagttacaggccagttactaggaggcctcttctgaatgtgacatgggaggagggtctccccttttctcttggggagatactgaggtgaaataggcctgcaccagccaatacagaggcagcaagtagggtcctgaagacactcacttggctgcaggagagaccaggggtttcctccagctgcctggttggtgctgctctgagaagataccaggctctgctctggtggcttcagggaggcaacctggacacagccagcagaagcaggtcatcgatggaggggtcagcctacaaggacacagcaagttcatgttcttggggaggtggagccaaggcacttggtgcactgcaaggaggtcagggaaacagagacagagaagctgttctccaaaattcagtgaccacactgtgttcctgcagtgaagtgtctctcagaatg

SEQ ID NO: 644873 - DNA, 367 bp, Homo sapiens
taggtcgcaacacactccataacctgaccttagaggcatggaggacactggggccatcctgtcctggcacagctggccaggccaccacacttgcttctctggtatacgccaggagcgctatgcccgatccatcatcatcggtggaaagcacataaatactctgatctttgccttataactaattatttacattgaatattttttacttatattagattgccttacgactaagttatgttacattgaatattttaaaagtatgtttcatcatttaagcattatatttgtttcttttagtaaacttttaagtggatgtcactatgcaagagacacacagtaaaaacataccgtcatacattcctttcct

SEQ ID NO: 644874 - DNA, 125 bp, Homo sapiens
ggttcgcgccgcaagtcgccgtgggccggttgaatcggttcttcgctgagcaaacggccgagacgctccgttgccgcgcgcacctcttcgtcgagtccgcgttcgcgagccgcttcgatcattcg

SEQ ID NO: 644875 - DNA, 415 bp, Homo sapiens
tcaccttgatgtaaatctccgtaccgtacattttgatcagatagacgtcctgccttatccggtggtctgcataggctgtcattgatttgtacaacattcgcgtttcaagggcgcagaccgccaaccgcatctggccgatgctcaattcaagttgacgagcgccctcccgcgcagttgccgtaaaggctctgaggcccagccggatgacttgcgccttgatcaaggccagatcgtaatgaggtgtgtacttttccataagacacctgagtccaataattaccctctgagggtaattttaccaatcgaaaatactgctcctttccctgcctaaaaaccctagtgcgttgcctttgtaggcgactcctaataggctgtaggaaaattcatcctatgattggacgaaagcgtaaagccc

SEQ ID NO: 644876 - DNA, 152 bp, Homo sapiens
atcccggtcatactggaccttctcggagcgagagagcaggttcaccatccgcttcttcacacttgcagcttcttcacccatttctcgtctctcatctacatcgccttcatcctggtccaggtgcaggtggccttatgccttaaatcccagca

SEQ ID NO: 644877 - DNA, 163 bp, Homo sapiens
cacacagcactcagggcgcaaggggcctgcggggtcattcgcatgtcgcacagcctgcagcactcagttccggcctccccgttcggcccaggtcgcacagggggttcgcgttggtctcatgctcagttgtggcagcatccaatccatcattcatggccccagg

SEQ ID NO: 644878 - DNA, 514 bp, Homo sapiens
cacgaggcgtcgtggcgctgagcgtcgaacatgcctgccgcacagccgttatacgcaaactcacgctcgacgacatcgacctgccgaaccggcggatcacccttgccggacacaaccaacggctcggtgagctcacccacatcgcgctgaacacatggctcgaccaccgccgggacagatggccccacactccgaaccggcacgttctactcacgacgaaaactgcattgcgcacaacgccggtcagtcaaaaatcggtgaaaccatcgttgagcgacaatggattcacgatcgaacgcatccgtgccgaccgaatccttcacgaagcgctgaccgcaggcccggacccactgcacctgtctctcgtcttcggcatctcccacaacaccgcacggcgctacaccaccgtggccgaacggctgctcagcgacgaactcgagcagccggtagaaccgtagtgccacccaacgccgccagactcagggcccgcgaacccgccgcagttatgaacctt

SEQ ID NO: 644879 - DNA, 155 bp, Homo sapiens
taggaaggaatggtaggtagtaatgataatatataaatagtaatataaagaaaggttaatgtaagggttggacggtagaactgctattattcatcctatgtgggtaattgaggagtatgctaagattttgcgtagctgggtttggtttaatccac

SEQ ID NO: 644880 - DNA, 328 bp, Homo sapiens
ggatgggggctctgctgtgtgtccgcctctatggggctgtcaggcggtagctactgcaccagccggtacgtgatgtacctgccacccgtctcactgcggccggatgatcttcaccacctgcccacgctttatccccaagtagcgcgccatagggtcccccgcctggatcctgggcaggtggttctctcgagagcttatatcgccgccagtcagctctgtcaactcctccttggtcataaccacgtgctcagggcactagctcgtgctccgtgatgttaatcatcagctcctgctgcagatactgctccaggatgtacttgggggccat

SEQ ID NO: 644881 - DNA, 590 bp, Homo sapiens
ttgagtgtcaattagcgcgatgagtagggctgtaactagatatgttgagtcactgctagagtacgatcagtgatatgtcgcatcaggagaaccgtggtcactagacacacgagagttctcccagcccggttaatcacgtgggcggagtacaggcgacgcgttagcgcaaggcttgcatagaccattcagtttggccgcgtcctgggccccagtcaggtacactgaactctggtcttcagctgggtcctatagtacgatcccggtcactgacgtagtgcttgcacttcctcaccctatatacaccacacaccgcccggtggccaacctgaatcgcttctgaaatcaaattccaggaactgcgcaagatcttcctgaaaggaagtccaattgtaagcctgggaagctcttaattcaacccccagtgcaagtgtaccaaatagccgggaagaccgccggaataacttcaaacactttaccggccttctgaaccacgggaagtgacgcttgacaacaagttgccaccacgactaacacagtactatcctcaaccacacacccatagcaaaacattgatgtatggccacgaagca

SEQ ID NO: 644882 - DNA, 187 bp, Homo sapiens
  misc_feature (1)..(1): n is a, c, g, or t
ncccccccccttttttccccagttttggtcctggccaggccatgtaaaaaataacccctgcccccaatttttctccccttttttccttccttcctacccccttttccctctcccttcccctgactgttcccccccgggggggggaacttcccctagccgtgccccccgtttttttttttaaaggaat

SEQ ID NO: 644883 - DNA, 595 bp, Homo sapiens
  misc_feature (595)..(595): n is a, c, g, or t
aacgaagatagagaacacgagacagaaggagtttcggcatgaaggagcaggatctgcaaagctgaaattgagaatgcttctgtgagaagggcagaagagaggtgtgggaaatggaactggatagactcaaggaatcatggatggcgaactaaataggaacaggttatggaagagactgaacgggcctggaaggcagagatcttatcactagagagcctggaccatgagttactggtactgaaactagaagacgccgaaaacgaggcagaactcgagccttagcttacctcaagtcaactccccgaacactggagacagttcgttccaaacaggagtgggagacgagactgacactggagttcggagtaatgaccaaagacatgttcgctagagcagacttgtaataaggtcatatccagcttagtgaggaaacggacgcgccagtcctgagcagccattcctcaaatccctacatcaacgaatattagcataccagacacatcagagtacagacttctatgccttcaggtgttacaaagagcagtccctctcgtggatcctcgggatgccctgtctcgattgaggaggtcacgan

SEQ ID NO: 644884 - DNA, 559 bp, Homo sapiens
ggttgactgagaatactgagtaagatataagacctaccaggaacctttaggaatatgctctgctcggtgtggtttgtctgctctgtttgccgacggagtctcgctgtgtcgcccgggctgcagtgcaattggcgtgatcgttggctcacagtaagctccacctcctgggttcgagcagttctcctgcctcagcctccctgagtagctgggattacaggtgcacaccgatcatgcatcggtctgatttgattctattgtttagtagagcatggggtttcaccgtgttggccaggactggtcatcgaactgcgtgaccgtgcatggatctgcccgccttggcctgccgcaaagtggctgggattacaggcgtcgagccaacattgcccaggtaaaactgtgtcttataacggagacgatggaggcagagtcgtgatcccagggctgaatcttccaggcctatggcatagactcaggaggcgtcactgagagacaggagcatctgcccatgacctgtatcccgacgtatctccaagttccattaccatcgcacatgatccaa

SEQ ID NO: 644885 - DNA, 339 bp, Homo sapiens
ttgtgagaatgaaattatacaatgcatttaaagtatttagcagccaggcatggtggttcatgcccataatcccagcactttgggaggctggggcaggcagagagcttgagcccaggagttcgagaccagcctgggcaatatggcaaaaccctatctcttcaaaaaatgcaaaaaattagcagggagtggtggcgcacacctgtagtcccacctacttaggcagctgagatgggataattgcttgaacccaggaagcagaggttgtagtgagcagagatagtccctctgcattccagcctgggggatagagtgagaccctaccacaaaaaaataaaaatt

SEQ ID NO: 644886 - DNA, 587 bp, Homo sapiens
acgattttcattggatataaattggtatcgaaaaaaacttcaacagttaaagtctataattttatcctatctcctcggtgcagcggaacatttcccttatctcatttctcctctgaatcaagaatggcaaagcagtaccttcggtagcgcggtcctcatcttcaagctcccagtctcttggaccagtccatctctacctcggggctcccagaccttttatgaagctacgggagagatctacttactccacagcaaccacagtcctttagaaccaaaccactttgggtgggctcataaaaacgacgggggtgaaggatgtgggagtggatacgcactctcaccttctgactgggttaagaggaggatgatgctggtaccacttctatgtcccagacaccaaactttagcatcgggacatgattaaacattactcctcagaggagtctcccctggccatcccatctgtagccgcctatcctttatcggagcacaccaattccttgactggacttatcacagcatgtgttgatttaatgtctggttccttccctaatctgtaagcacgatgagggccaggacttgatctg

SEQ ID NO: 644887 - DNA, 537 bp, Homo sapiens
gaggctgaaggtcatatcaagaatgcatcccatatacaatagctgcaaagaaaaaaataaaatacctaggaatgcacctaaccaaggaggtgaaatatctctacaggaagaactacaaaacaccacggaaagaaatcggggatgacacaaacaaagggaaaaacattccatcctcagggatgggaagaatcaatatcattaaaagggccatacgggccggagcaatctatagattcaaggctattcctagtcaaactaccaaggtcatttttggtagaactagaaaaaaactatggtaaaattcatatggagcaacaataacaaaaaagcccaagtagccaaagcaatcctaagtaaaaagaacaaagccaaaggcatcatactacccaacttccaactatactacaaggctacagtaatcaaaacagcagggtactgggtacaaaaacagacacatagaccacgggaacaaaatagagaacccagaaataaagtggcacaccggcagccatctgatcttggaccttcagcctcagg

SEQ ID NO: 644888 - DNA, 247 bp, Homo sapiens
caggatcccccccagcttttatgcattttgatactggataagtcacaacagcgcactggttcagaagcgctcattacctttttgatgtgcaacggaataacattgctatagctttggaagttacttaccgggaacgactgtatagagtatataaggaagtacagaatcgcctggactatcattatgtctcttcatgaacactatgcgtcgaatgggaactcgaatctacatattcttttgggtgggg

SEQ ID NO: 644889 - DNA, 1219 bp, Homo sapiens
aatttaaagtggtctctattcgaagtctctgctctttcacttaaacctttactctaagctgtccccctccactaatgccccccatctttgggagatgctcttttcctagttaatttaaacattgctgcgtttgcttagagagagagagagagagagagagaagagagagagagaaaggggaaaataataggaaaggaaagaggagggggggagagagaaaggaacaaaaaaatcttaaaaaggattcttagccaggttcctaatgttgctcctagcccttccacttctcggtgtgtgtgtgcgtgtgtgtgtgtgtgtgtgtggtgtgaaaataaaacatgcataaacttttggagcctctctccctcttctaggctcttctcccaacctctcttcctgctctcccttgccctgctcatcactttcccctgtttttttttttttttcctcccttcctcccctctgcctccctccacctccccctttttcttttttgctgaatcttattgatccagaaggtggctaattagcccttcccgtcgtgcctgggtaatgaagcacatgcggcactgaattaatcacagccattttttgcaggaaactaattagcagaataaagatccaaagacttttttttcttttcactccatcagctcccacttccagcgcgtcccctccgaccgctgcaggcgccaccgccgccgcctcctcctcctcctcctcccggcccgcagccgccgccgccgcctgctttgtatcccaattacagcctagagccgctgccgccgccgccgccgcttctcttccgttggcccctgcccgctccgggggctgtaaactccccgccaaccatgctgctcggcggcagcggcggcggcggctccggctcccccggctgcggccgcctcccgccccgggctccgccgagcgcgctccagctccgccgccgccgccgccgccgccgccgccgcccagcagcgcgtcctccgccgccgccgacccccgccagccgccgctgctgccttgatgggctccgcggcccgagcgcctctttttcgggattaaaagcgccgccagctcccgccgccgccgccgtcgccagcagcgccgctgcagccgccgccgccggagaaagcaaccgctgggcggtgagatccccctagacatgcggctcgggggcgggcagctggtgtcagaggagctgatgaacctggggcga

SEQ ID NO: 644890 - DNA, 669 bp, Homo sapiens
agaattcttgttgctaatgacactggcttcacagtgtcgcaacctggaaaggagaaggccctgatggaaagcagtcgccactgtggggcccatctcccttgctatggatcaaggccctatcgtccttcccagttctcaccaatcaaggccatttattttgaacccagactgcagccagccaaaacctggatcatggttttctggtggttggctacggctttgaaggacgccaattcgaatcaccagccagtattggctcgtccaaaaccagctggggtccccagaatggggctcgaatggctatgtaaaaatagcccaagaccagaaccaacccctgtggaatcgcccaccagcagccagctacccccatgtgtgagctgatggatggtgaggaggaaggacttaaggacagcatgtctggggaaattttatcttgaaactgacccaacgcttattgtgtaagataaacccgttgaatccttgaggatcccagttgagattttaattctgtgacatttttacccagggtaaaatgttacccctactttaattattgttatacccagctttatgatatccaagactccttgcttaattctaagacttttgaattttcattttttaaaaagatgtaccaaaccgtttgaaataaattttaattcgtatata

SEQ ID NO: 644891 - DNA, 181 bp, Homo sapiens
cgcatgatctttctcatggtgctgggtgctacgcgtgatctccttctgcatgcggtcggctatgccagggtacatagtggtgccccggataggacatgttagcatagaggtccttcctgatgtctatatcacacttcatgatgctgtggtaagtggtttcatggatgccagcagactccat

SEQ ID NO: 644892 - DNA, 220 bp, Homo sapiens
  misc_feature (70)..(70): n is a, c, g, or t
  misc_feature (93)..(93): n is a, c, g, or t
  misc_feature (145)..(145): n is a, c, g, or t
  misc_feature (187)..(187): n is a, c, g, or t
ggcggctatggtataaatacgcctcacactcagttctcaaccccctggacaaaacactatagcctacccncttccttgtactatccctatganggcataattataacaaggctccatctggcctacgaacaaacaagacctaaanatcgctccattgcatacctcttcaaatcagccacaatagccnctcgtaagtaacaagcccattcttcatccaaaa

SEQ ID NO: 644893 - DNA, 492 bp, Homo sapiens
  misc_feature (41)..(42): n is a, c, g, or t
  misc_feature (190)..(191): n is a, c, g, or t
  misc_feature (208)..(208): n is a, c, g, or t
gcagttctgatctattctaggtcagtggttcccaaaggagnntccctggaccagcagctgcacatcacctgggaacttcatggaagggcagattctcagccccaccccagacctactgaatctgaaatcctgggatggggcccagtaatctgtgtttgacaagccctccagtgtcaggggtgggcaaatnntctgggctcactgccantaacaaatggttttacatttgtaaatggttggaaacaaatcaaaacgaaaaacaatcttttgtcattcatgaaaatacgaaattcaaatttcagtgttcgtaaagaacacgttactggaacacagccatgcctattgacttctggattgtctgtagctgctttcagactacgatggcagagtggaagcattgtgacagttgtgtggcccaaagagcctagaatattcaccatctggccttctatggaaaacgcttgttaaccccggctctaggtgattctgaca

SEQ ID NO: 644894 - DNA, 178 bp, Homo sapiens
tcagacctggggtggggacggacgtggggggtccaaaacaatattgtaacgactcgataccttgccttccgtgggggatgtgaaacagacttggatcccatgcctgaaattcggtggcggatgcacaacaatcaaatgaccgtgggatccacaatagggtggggtcccacaccgttga

SEQ ID NO: 644895 - DNA, 204 bp, Homo sapiens
actctaaggatcccgtgatgttatccccaacacctgaaaacaggatgaaagcctgtttactgcaattccttttacccagtgtatcatgtctacctatcaacagaaaattacaaagcatacttaaaaggcagaaaatgcagtttgaagagactgaacaagcattagaaccagagtcagtcgtggcaggagtgttgggcgataaca

SEQ ID NO: 644896 - DNA, 167 bp, Homo sapiens
cccatcagatggtaagcgtgacagaatatagacatgcaaaggtcttgagatgcaggaagtagacgagacccacaaaaggcattcattgcgtcaagccttagcaagacatctctacattaacagagaaggactttaacacagctctggactgggcacacattatggag

SEQ ID NO: 644897 - DNA, 239 bp, Homo sapiens
aaaaatttttttttccccaaagcccccggccttttcaaaggggggcctccgggtccccttaaaaaccccccgggggcttccattttggaaaaattttttgccaaccgcttgggtgggtgggccaaaaaataggcctttttttttttctggaaatttggtttaaccttttactggcccaaaaagttgtccccttctggaaatgggttttggttttttttcccattaacccccctttccca

SEQ ID NO: 644898 - DNA, 1759 bp, Homo sapiens
ggcgtcggtatggtggtttctccgtggttcctgggtcgtgtgacggatgtagttgggtttgggtgggttggtgtggtgacctctctgtagtttgctggggtggtcagatcgacgtgtgtgacttggttgtgtcgtgtctgtgtgtggttgtgactccctgttagtggtgcccgacgggtgtgttctctccttgtatggtgtgtgccactggggtctggcggttgggtctgggtattatacgcgtcgtggcgtagtgtgttgtctttctgctgtggtggtgggtgtgggatgtaggatgggttgttgtgtggtgttgcttgccacacagccagcaccgaggtgtggtaggtggtgacgagaccgacggacggtgggtggatgagtaagtgatacggcgggccgccagcaacgagtagggagaatcagtaggtgagtgggggctacgcacccccttgggtgggtgagcgcctacgtgtgagtgcggcctttgttggttgtgtttgtgtgtcctctgcgtcggtgttgctcactacttggtctgttgatatgtgcgcgctcctcggtctgcttgtgcgaggttccgttcggtttgtgttgttgtgtttctcttctcgcttgtttgttgtgttggttgtgttgttgttgttgctcttctgtttggttgcgcgctgcaaggtgttgtgtgtgttgtttgttggtggagtgttgttcttctctgccactgttgtgtttgttgccgcttaggtggggttggtggaaggagggggggggggggggaggagtggggggatgggttcgccccgccggtgggtggaaaagcgcgtgcggccacacacggagggtagagagaacagcataaacccacccgctagtgtgtggtggtagagaggagaacacacatcatcagcacgcgcgtggtggaggtgtgcgtacaacacaccaccgcagtgagtagagagcgcgcgcagagagagagaggccccccaccacgtggtgtgagacacacccaaaaacacgcgcgcgcgtgggagagatacacacgccgcgcccgcgcgcgagagatatatatagacgcgcgcgcgcgcagagaggtggtggcgacgagagcgcgcgcgcgggtgtggggcagatagtagtgcgtgcgcgccgcagccgagagagatatcgacagcagcagagagagagaagagagagagagagaagagtgtggggcagcgagagagggcctccgcgcgagagcgcacacgcgcggcgcacagagcagagaggggacgacacacacaggtcactcagtgtgctgcgcgcgcgggtagagactacgctgtgtgcccacgcgcgcgtctctgtgtgtgagagatataaaggagagaggtcccccagcagcgagagaggctcccacacaccgcgcgcgggtgggggcagcacacacaaaacacccccccacacacaaagggagagggcgcccgcgcgtggcgccgcgcggggcggtgtggtgtctcccgatgagagaccccaccggtgtgtgggccgcgcggcccacacaaagggggagtgtggaaaagaggtgtgtagaacaccgcgccccacgcggtgccaccggcgcccacacaccccaccccccgggggcgcgcccacccaacacacccccaccccccccacccccgagatggcgtccccacccgcgccccccccccccccccgcgggggggagaggaacccccccgcgggggctccgtggccccccccggggacacccaca

SEQ ID NO: 644899 - DNA, 233 bp, Homo sapiens
gcgtttgtgtctcatctcacatttaaaaataactcctttagacaactaagatctagaccaggtgcggtggttcctgcctgcaatctcagtgctttgggaggccgaggtgggaggatcacttgagcccaggagtttgagaccagaccgggcaacatagtgagaccctgcctccaaagaaatgaacagacaaaagtcgacgcggccgcgaatttagttgtagtagtagtaggcgg

SEQ ID NO: 644900 - DNA, 216 bp, Homo sapiens
  misc_feature (14)..(14): n is a, c, g, or t
  misc_feature (30)..(30): n is a, c, g, or t
  misc_feature (47)..(47): n is a, c, g, or t
  misc_feature (54)..(55): n is a, c, g, or t
  misc_feature (58)..(58): n is a, c, g, or t
  misc_feature (61)..(61): n is a, c, g, or t
  misc_feature (187)..(187): n is a, c, g, or t
  misc_feature (203)..(203): n is a, c, g, or t
tcggcaatggcatnaagcggcgcggtgagngcgttagtggctaccgncaagtcnnaangtnccgtccggtctgcaccacgttcgtcagatggcgatcccacttcggcggtaaacatcaatatggggacgttagtcggttcttacgccagtgtcgcgcgcatgttagatgaagtcgcaagcgtgcctngtgccgaaggtaactnttaaccttcgacg

SEQ ID NO: 644901 - DNA, 136 bp, Homo sapiens
tgctgggattacaggcgtgagccaccgcgcccggcccctcctggtgattcttatgcaagagtttgctagctacactctttcccactgtgctggagggtctcactgtgggaaacggaagcccagagagggaaggtaa

SEQ ID NO: 644902 - DNA, 126 bp, Homo sapiens
gcgccagctggctgggcccagattagatgtcataggtcgacatgtgctaaaatccttacactgacaattccaaaatattctttttcctccaaattttcaagattttcattcttcactatcaaagtc

SEQ ID NO: 644903 - DNA, 198 bp, Homo sapiens
gacgtggtggcgggggctgctgttgcacctgctcagtcagaaatagttgtgtaatcgcctttgccaggcactgttctaggccatagggacgcacagtgacgacacagacaaggtcttgtcatttttgagtttgtggagggaggagacagacagcgaatcaatcaatatgaaaagtatcagctagagataagggctatg

SEQ ID NO: 644904 - DNA, 261 bp, Homo sapiens
aaaatgaaacattaaataaataatttagtcctaacatgaagcacactagcacagtagctcaaaaccatacaaggaaataaagaacattggcaaaaaaataaagaacacaggtaaatatacaagtcaataatatagtacttttggtttgaaactctttttttctatataatttaaaagtcaaatgcatattacaataattataaatattgttaatgggtgcacactgtataaagatgtaatcaatgacaacagcaatataaa

SEQ ID NO: 644905 - DNA, 1156 bp, Homo sapiens
  misc_feature (793)..(793): n is a, c, g, or t
ggtgaccagtaccatggtggtaggctgaacacaagcgccttacgaaaggcggtacaacgggatccaatgaagaaagatgtgttgatccatttatctagagaatagattggtctgatgtgagaatgcgcctgtctagtgttcagattatacataaaattatcggaaagagcgtctcgaacaccaagcgactccaaggaacctcaaacagttgtcagtctgattgcgtctcaaagggctcgttgtgtgtggtacgggtgtaggctcttgcctgattcgcaagagattgattgaagatcgcactactatgataacattccaaggcgtggaatccactgcgacgagcactgttgcaacgcgagtaaagagactgtgactaagacataatagtttcctccattcggcgttattgggatgcctgtgatccctgctagactacagacagggtttgtcttccagtaggtatccaacgacatatcgagggatgacgtactcgatgaggagaggtttgcccagcttttagactcggtgcatatggaacctaacacgcggtgtgcgtgtagcgtctggcatatgcaagtgcctgatttcatcgctagggtttgtgcttatttgagcttcaataaaaaaaccgcccacaagcgatttccccggtaccttgcagggcacaccgaatccactcccttttagttgacgtcaaggccaaccccacaacaaggcgctacaccgccacagaaaattccccgcagacaccggataagaacatggatctgcgtacctaccgtcagtgcatggnctccgcacgaacgtgggtgcccaaggacgcacagaactgagccttttcgagcaagcggacacccctcggtttcaaactaaacacaatgtggaccttctcccaagaactaccgacagtgtttgtcatcaccccccgacacttgtggcgaaccgataccggagctttaaggacctaagaatgcctgagatgctatactccctgtccgtccgctctatggacttggttccctctatcgggataaaggcaggacacaatgctatacccagagttgtcttcgtaagcaaaatagtcccacaacgtaacctgaaccctttggtggccaccgggcattgcccggaacgcatggccgagagttcccggacg

SEQ ID NO: 644906 - DNA, 305 bp, Homo sapiens
ttctcattaaaggtaaattaatgcaatgcaaattatatcctggtgatttttttttttaaaacaagatttttgattttggttaacagcaggcagggcgacttcattcttagtcttgggacccaaaaacggatggggtaaaaatatccctagattttgactatgagacttggactgactgtgtaggctttaaatatgaaaacctaagagcatttatcactgtctatcccaggaaacggaatatgctgggcgtttatacataaggaaagttcaaaggctaggccaaaataattagttacctagtagtt

SEQ ID NO: 644907 - DNA, 328 bp, Homo sapiens
acctctagagcacgcctggtatagttttaccagccaccttcatctgggagttagtttgggcgggggctcaaagtgattctctttggagtggggaggggatggaggttggactgagcccctggaggtaactggccagcatggcgtgttgctgggtctggatagtcccttttatacctgggcagagacaattgtgaaaaggtatcaaaggggtgggggaacaggcctggctgctgctgctgctgcttttatcttgaaaagacacaaggtgaaactaatgacacaagtgtgtccctctggggattcattttgatctttggtttgtctcggg

SEQ ID NO: 644908 - DNA, 843 bp, Homo sapiens
  misc_feature (207)..(207): n is a, c, g, or t
  misc_feature (215)..(215): n is a, c, g, or t
  misc_feature (222)..(223): n is a, c, g, or t
  misc_feature (242)..(242): n is a, c, g, or t
  misc_feature (244)..(244): n is a, c, g, or t
  misc_feature (258)..(258): n is a, c, g, or t
  misc_feature (266)..(267): n is a, c, g, or t
  misc_feature (270)..(270): n is a, c, g, or t
  misc_feature (272)..(272): n is a, c, g, or t
  misc_feature (275)..(275): n is a, c, g, or t
  misc_feature (277)..(277): n is a, c, g, or t
  misc_feature (282)..(282): n is a, c, g, or t
  misc_feature (285)..(285): n is a, c, g, or t
  misc_feature (289)..(289): n is a, c, g, or t
  misc_feature (292)..(292): n is a, c, g, or t
  misc_feature (298)..(298): n is a, c, g, or t
  misc_feature (302)..(303): n is a, c, g, or t
  misc_feature (310)..(311): n is a, c, g, or t
  misc_feature (314)..(315): n is a, c, g, or t
  misc_feature (319)..(320): n is a, c, g, or t
  misc_feature (334)..(334): n is a, c, g, or t
  misc_feature (336)..(336): n is a, c, g, or t
  misc_feature (510)..(510): n is a, c, g, or t
atccgcctaccttggcctccaaaagtgctgggattacaggcatgagctactgcacccggcctaaccaggctggagtgcagtggctcatgcctgtaatcccagcacttttggaggctggagtgcagtggtgggatctcggctcactgcaagctccgcctcccagattcacgccattctcctgcctcagcctccccagcagactgggantacaggcncccaccnncacacccggctaatttttntntttttagtagaganagggtttnnccntnttngncaggntgntctnganctcctnaccnngtgatcnnccnncctnngcctcccaaagtgntnggattacaggcgtgagccactgtgcccggcaagaatttttttatcgataacatagtgagctctctgcctcttcggaacgatgtccactttgcttatgatcaacccaagcaggactcttctctccctggacgcctctcccctggtctggaatcttccagttctgccagaattggnctttcccagatgctgcaaacttccagttgaacccctttttctgtgtggcccctggggctgcgagaccaaaatccatgagttctgtgtacccctcagacctttgcgaaggtgacgagcagggtcctgagaaccaggcagcagctcctctccctggctgaacccctgtccagcctactcctcacagaattgtcagctgactttcaccacaggtggtctttcttgctgagccctgcagctgtcccaatacacaccagaagtctgtcactatggcgcgctggcatgtcaccgacgagagcagttgacccgtctccactgggattctgcaacaagatc

SEQ ID NO: 644909 - DNA, 360 bp, Homo sapiens
acacacacacacacacacacacacacacacacaaaatcactgctgtgtgtttcttcccctgaaggattagggttaactcgggtttgtcttggcttccgagccttggcttggctcttctcagttgggttttgccttaaccacatgagccccccatgcctgccccccctgcggccttttgtgttccccgatgtctgggctgtgtcctgccgggattcccagccttcggggtcagccgtcgagccacttgctttgctcagttctgtgtttcagccacatttccacggtggaccctgtttgttttaaatattctgttcccatgtcaatcagtgacgataaatacagccttgatttggatgaaaa

SEQ ID NO: 644910 - DNA, 440 bp, Homo sapiens
caaacatcacatgttctcacttatttgtgggatctaaaaatcaaaacaattgaattcatggagatagagaatagaaggatggttaccacaggctgggaagggtagtggggaaggggggagttaggggaggttaggatggttaattagtaccaaaaaaatacttagaatgaataagagctagtatttgatagcacaacgggggactatagtcagtaataatttagctgtacattgtaaaataaccaaaagagtataattggattatttgtaacccaaaggataaatgcttgaggggatggatacccaattttccatgatgtgattattgcgcattgcatggctgtaccaaaatatctcatgtaccccataattatatacacctactatgtacccccaaaaaatttttaaaaaggaatgaaataaaaacatttgagtttaag

SEQ ID NO: 644911 - DNA, 173 bp, Homo sapiens
  misc_feature (13)..(14): n is a, c, g, or t
  misc_feature (118)..(118): n is a, c, g, or t
  misc_feature (128)..(128): n is a, c, g, or t
  misc_feature (155)..(155): n is a, c, g, or t
ctggaatttacgnnttatctttagagattgggaagaccctgatggaggacgtggagaacagcttcttcttgaatgtcaatttccaagtaacaacagtgtgtcaggcacttgctaaggntcctaaattncagcaaggctacaatgctatgggattntcccagggaggccaattt

SEQ ID NO: 644912 - DNA, 351 bp, Homo sapiens
  misc_feature (41)..(41): n is a, c, g, or t
attaataacaaatatatccccaaaagcagatatggactgtnccagtttattccctatgggttacggcaggtaacaatttttctcgactggtgcattcccaacctttgtaagtccaaaaatatgtaaccaaagtggtaggtaactttagacttagcactttccctaaatggcatacatcgaagggcatcaattcaagagcaaaaatggtttaactcccccaaacccacctatgtggtcattccagccttaaaaccgtccaggtttttgagctccctgtaggaaaggccaggccttaaaaccaaggcgttttggatatttttctgtgggccatgagtaaaagggggttttcca

SEQ ID NO: 644913 - DNA, 171 bp, Homo sapiens
ttttttcttctttggtagtgatgaagtttcgccatgttgcccagactggtctcaaactcctggactcaagtgatccacctccctcagcctgccaaagtgctgggattacaggcgtgagccaccacgcccggcctatctcttgtttttaaatcagtctggggcatctttgct

SEQ ID NO: 644914 - DNA, 297 bp, Homo sapiens
ccaatacagtttgtgataattggccagtttttacgaacaactagattcttcaaattagagaggtgacgaatacggatgattactatgcctcatatgctgtgtgctcttagacaggaatgaccgcagactacaaagcatataagatatactgagcctctacagattgcctgctcctcatagtctctcctatttgtgtattaccctgctttcgagttaataccaatttaattctatagtttactctgtatgctctgcctatcaactttgtagcttcattattgtaaaacatattccaga

SEQ ID NO: 644915 - DNA, 822 bp, Homo sapiens
  misc_feature (553)..(553): n is a, c, g, or t
  misc_feature (621)..(621): n is a, c, g, or t
  misc_feature (646)..(646): n is a, c, g, or t
acattctgccagcagcgcatccggggggcaggcagagaccttaggcacagctcagaccccgggccccgccgcctctggcttcgcagtgcccctgggcgatcacagactgtcaggacccgactgcagaggaagctacagggcttctgccccattggcccctctggtctccctgaggcccaaggaatctagtgctgtctgccccccctgcattctgttgggcaggagtggggagtctaatttggccttggggaggcctgtggagttctaagaagaggcagtgtctgctgtgcccagccttgaaggcgagttaggagttgcacagtgatgacaggcagaggcaggggcagaggatggaggcagaaccgggactgtttctcctgtgcgtgatggaaggttgcgagcagaccaaagccaggggcagaggatggagacagggccaggactgtttctcatgtgtgtgatggaagtttgcgagcagagcaaaggcaggggcagaggatggaggcacagctgcatgtgactgtttcttgtgtgcatgatggaaggttgcgancagagcaggaattccaccggtttgggtgcagacaggtatgcctctgcctggaggggaagggaaggtgntggtggtgactgacagcctggagcnctggcggtgggtgctggattctaggtggctcagagggcacgcccgccccggctctaagcttcctgagagcagctcgtcatttcttgggggcctcatgggaagatcatggttgtggccccaccaatgcccacctgggtatggctcaaggagcaacagtgcagagaggggcggagcag

SEQ ID NO: 644916 - DNA, 899 bp, Homo sapiens
caaagcagaaaaaagaattttaatctgaagactggacttttgaactaacccagtcacacaaaaattaaaaaaaaaaagaattaaaaagtctttgagaaataagggattatgtaaagtgaccaaacctattagttatgggcattactcagagagaaggagaaaaagcaaataattggtaaaacacatttgaggggataactcaagaaaattttcttaatcttgctagagagacagacatccagatacaagaaatcaagagaacacctgcaagaaactataaagcatgagcatcaccaaggaatatagtccctagactacccaggttcaatggctaaagaaaagggcacctgaagaaaaagttggcatcttaaagacagctggagaaaaaggtcagatcatttacaaagggaactctatcaggttaacagacttttcagcagaaaggttacaagccagcagaaattagaaacctattttttagcattcttaacagaagttccaattaagagtttaatatacaatcaaactatgcttcataagtaaagagaaataaaatcttttccaattcagacactaagataattcgtcattatctagaccagccttacaagaaatccttaaaaagtttaaaccataagcactactcataagaactgacacgactgatacctggtaccaaaaaaacacacctaaggtacataagccagagaccctataaagcaaccacacaaatagaaaactacaaaaagatcccagttatcaaatttcacaaaagaatcaaaacctcccatattcagtattaacccttgaatggaaacaggtctaagtaccccacttaaaggccacgagtgaagagggtaggtaaaatagaccttttgactacggttcagaagccatta

SEQ ID NO: 644917 - DNA, 499 bp, Homo sapiens
ccataaatcttcattccttgggaagccacttccattcccacccttaagcaaagttaggaaggaattctccttcccataaaaggacctctcctgagaggcaaaacctgttgcctcccccacggcttcccttttggctcattccaaacttggccaaattggggaaatgggatggaggttgccctgcatcccccctcctttgcctgagtgtgtttttttaatgtcagctggcatcatacaaaaaacaggaaaaacaaacccccaaaacttttttggtggtcaaaaattccctgagtgtctgtcctcaaccaaacctgctttgtgtttgtgtttttaaactttaaactttggaaaaaaatggggagggggggcaagggaaattttgccctaaaaatgcttttcattcctctgtttttattgggtcctgtttttcgggaaggtgggggttgggggaaactttaccttgtgtttttgtcaataaactcccattttcccaaaatta

SEQ ID NO: 644918 - DNA, 184 bp, Homo sapiens
tcgaaaagaggaggtgcggttcggactgcacaaaacaatttaacaaccccacttcctttccgaggaacactcttcacttcgtagctcccatcttcaccggcggcaaacctcagcagggaagaaatgctgcgctgcaacagcttgaccttcactctgcactgcggtcttgaccggcagtccagga

SEQ ID NO: 644919 - DNA, 294 bp, Homo sapiens
  misc_feature (111)..(111): n is a, c, g, or t
  misc_feature (124)..(124): n is a, c, g, or t
  misc_feature (208)..(208): n is a, c, g, or t
  misc_feature (265)..(265): n is a, c, g, or t
ccgtgagcaacaatatgagcaactacaatatgagcaacgacaccatgagcagctacaccgggagcagctacaccatgaacaactacaccgtgagcagcgacgttgtaagcngctacaccatgangaacaacaccatgagcaatatgagcagctacaatatgagcaacgacaccatgagcagctacaccgtgagcacctacaccatganctacaccgtgagcaatgacatcgtgagcggcgacactgtgagcagctacaccatgangaacaacaccacgagcaacggtatgagca

SEQ ID NO: 644920 - DNA, 330 bp, Homo sapiens
  misc_feature (198)..(198): n is a, c, g, or t
tttttttttgaaacggagtcttgctttgttgcccaggctgaagtgcagtggcataatctcagctcactgaaacctctgcctcccgggttcaaacgattctcctgcctcagcctcccaagtagctgggattacaagcatgtgccaccatgcccagctaatttctgtattttagtagagacaaggtttcaccatgttggncaggctggtctcgaactcctggcctcaagtgatccacctgccttggcctcccaaagtgctccgattacaggtgtgagccacccggcccagcccctcccttgtgtttcaaccaatcggaagtgaatttaacta

SEQ ID NO: 644921 - DNA, 647 bp, Homo sapiens
agcggggtggttgcattcgaggttgcgcgccggtgagtgtcactcccggcgctgagagcatattgctgctttctgccccgccgtctgtctgcgggcgctcgagcggaatgcttcctttcagtgacatggagtccagtcccaggctgtgggtgtgagactagaagacagagaagctgggccatgagaggccgggagtccccatggggcctgctccgagctttctgtgcagcggctcgatacctcgaaggcactcgggaccgaggaggtaccgagcgccgacgcgccgtaccatgtagtggcgttgcccgccgactggatgccatctacccatcagattgcgggagctgatccggagcatccggaggagcccgaaacctagctgaagaaggacataatgatctaattgaatgtgctgacaatgccggtcatctttgagcacgaatacgacggctacatatcgcgagagtcggaatgtgagcaaaattactgtatatgcacatgctgggctacccctggctcaccttttggaacaagttggcagtgcctcaagcttattgcctctcaagaatttacaagaccaacgcattgggctatctaggggcaatgctgctgttagatgagagacaagatgtccatctctcatgacc

SEQ ID NO: 644922 - DNA, 496 bp, Homo sapiens
  misc_feature (258)..(258): n is a, c, g, or t
tcgtgaccggtcccatgcacagttatttcaactgtacagttggctcattaaaagagaatgaaaagtacagagaaaatatttgttaaaaatctcatcaggctaggtgaggtggctcgtgtctgtaatcccagcactttgggaggccgaggcgggtggatcacaaggtcaggagttcaagatcagcctggccaacatagtgaaaccctgtctctactaaaaatacaaaaaattatccgggcacggtggcgggcgcctgtnatcccagctacttgggaggctgaggcaaggagaatcacttgaacctgggaggtggaggttgcagtgagctgagatcgtgccactgcattccagcctggtgtgacagtgcaagactccatctcagaaaaaaaaaagtaggagctaggctaggcacaggggctcgtgtctagaatcggagcacttgggaaggctgaggtgagaggattgccaggggccaggaattcgagaccaacctgtg

SEQ ID NO: 644923 - DNA, 958 bp, Homo sapiens
  misc_feature (1)..(1): n is a, c, g, or t
  misc_feature (4)..(4): n is a, c, g, or t
  misc_feature (7)..(7): n is a, c, g, or t
  misc_feature (24)..(24): n is a, c, g, or t
  misc_feature (27)..(27): n is a, c, g, or t
  misc_feature (34)..(34): n is a, c, g, or t
  misc_feature (39)..(39): n is a, c, g, or t
  misc_feature (43)..(43): n is a, c, g, or t
  misc_feature (49)..(49): n is a, c, g, or t
  misc_feature (51)..(51): n is a, c, g, or t
  misc_feature (58)..(58): n is a, c, g, or t
  misc_feature (60)..(60): n is a, c, g, or t
  misc_feature (66)..(66): n is a, c, g, or t
  misc_feature (72)..(73): n is a, c, g, or t
  misc_feature (88)..(88): n is a, c, g, or t
  misc_feature (92)..(92): n is a, c, g, or t
  misc_feature (102)..(103): n is a, c, g, or t
  misc_feature (106)..(106): n is a, c, g, or t
  misc_feature (131)..(131): n is a, c, g, or t
  misc_feature (133)..(133): n is a, c, g, or t
  misc_feature (143)..(144): n is a, c, g, or t
  misc_feature (160)..(160): n is a, c, g, or t
  misc_feature (163)..(163): n is a, c, g, or t
  misc_feature (165)..(166): n is a, c, g, or t
  misc_feature (174)..(174): n is a, c, g, or t
  misc_feature (180)..(181): n is a, c, g, or t
  misc_feature (186)..(186): n is a, c, g, or t
  misc_feature (190)..(190): n is a, c, g, or t
  misc_feature (194)..(194): n is a, c, g, or t
  misc_feature (201)..(202): n is a, c, g, or t
  misc_feature (211)..(211): n is a, c, g, or t
  misc_feature (213)..(213): n is a, c, g, or t
  misc_feature (218)..(219): n is a, c, g, or t
  misc_feature (223)..(224): n is a, c, g, or t
  misc_feature (226)..(226): n is a, c, g, or t
  misc_feature (229)..(229): n is a, c, g, or t
  misc_feature (233)..(234): n is a, c, g, or t
  misc_feature (238)..(238): n is a, c, g, or t
  misc_feature (241)..(241): n is a, c, g, or t
  misc_feature (247)..(247): n is a, c, g, or t
  misc_feature (250)..(250): n is a, c, g, or t
  misc_feature (257)..(257): n is a, c, g, or t
  misc_feature (259)..(260): n is a, c, g, or t
  misc_feature (264)..(264): n is a, c, g, or t
  misc_feature (267)..(267): n is a, c, g, or t
  misc_feature (277)..(277): n is a, c, g, or t
  misc_feature (286)..(287): n is a, c, g, or t
  misc_feature (298)..(298): n is a, c, g, or t
  misc_feature (302)..(304): n is a, c, g, or t
  misc_feature (308)..(308): n is a, c, g, or t
  misc_feature (311)..(311): n is a, c, g, or t
  misc_feature (314)..(314): n is a, c, g, or t
  misc_feature (332)..(332): n is a, c, g, or t
  misc_feature (335)..(335): n is a, c, g, or t
  misc_feature (337)..(337): n is a, c, g, or t
  misc_feature (339)..(339): n is a, c, g, or t
  misc_feature (341)..(341): n is a, c, g, or t
  misc_feature (344)..(344): n is a, c, g, or t
  misc_feature (353)..(353): n is a, c, g, or t
  misc_feature (366)..(366): n is a, c, g, or t
  misc_feature (370)..(370): n is a, c, g, or t
  misc_feature (377)..(378): n is a, c, g, or t
  misc_feature (385)..(386): n is a, c, g, or t
  misc_feature (395)..(395): n is a, c, g, or t
  misc_feature (418)..(418): n is a, c, g, or t
  misc_feature (422)..(422): n is a, c, g, or t
  misc_feature (432)..(432): n is a, c, g, or t
  misc_feature (444)..(445): n is a, c, g, or t
  misc_feature (551)..(551): n is a, c, g, or t
  misc_feature (956)..(956): n is a, c, g, or t
nagntgnggcttaaaagggcaacncgngcggganccttnctcnctagtngnggggggngngggggngggggnntgtgtggggaccatnaggnacctcccctnngcntgtggccatgtaccgctacctgggngnaggctgttgnngtcccggggggggggngcngnnctgggctnggggtnngccgngctnggcngggttgnnggggtgggncnggggnnaggnngnggngggnncggngcngggggnggnattgggngnncggngcnactacagggngggggtggnngagggggaggnggannncaanttnttnaagatggggggggggttnttngntngnggngccagcatngtggaggacaagntggnggagganntgagganncgggagagngaggaggagaaggggaaccgggngggngggatcctgnggatcatcaagnnctgcaaccatgtgctgagtctctccttccccatccggggcgacgacggctcctgggaggtcatcgaaggctaccgggcccagcacagccagcaccgcacgccctgnaaggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttcatgggattgaaantt

SEQ ID NO: 644924 - DNA, 96 bp, Homo sapiens
tgtgtcttttaaaaaaataaacagctttatggagacataatttatacacaattcacccatttaaagtgaacaatttaatgacttttagtatagtca

SEQ ID NO: 644925 - DNA, 530 bp, Homo sapiens
  misc_feature (251)..(251): n is a, c, g, or t
gtaattggaatttctagaaatattaggggaagcaactttatacgcaaagcataacagaaaaataaggtgtattttttctttgaaacctatgaaatatactggccaggcgcggtggctcatgcttgtaatcccagcactttgggaagctgaggcggtggatcacctgagctcaggagttcgagaccagcctggccaacatgttgaaaccatgtctctactaaaaatacaaaaattagccagtcatggtggcnggtgcctgtaaccccagttactccggaggctgaggtgggagaatcgcttgaacccaggaggtggaggttgcagtgagccaagatagcaccactgcactccagcctgggcgacaaagcaagactctttctaaaaaaacaaaaatgaataaacaaaaaaactatgagacagaaaagatgggtttttgttaaaataaaaaataatattgttttagtttgaaaattattcaaaggttgtttcaaaatgaatcaataaaaaacataaaactgaaaaaaaaaaaa

SEQ ID NO: 644926 - DNA, 247 bp, Homo sapiens
atttgtaaagcggggttcccatgggcaggggtgtactcctgcctcaagtatgctgctgcctcaaggtggattcaggtgtactcccgccagccagtcctttttggccagatctgtcccagtctgatgcctcctcctctgggcttctttttcaagatttctcttccttcctcctcttctttgggatcctgggtgctgtcccacctccttgtaggtgctttcccatagggcccttctagacaataatagg

SEQ ID NO: 644927 - DNA, 444 bp, Homo sapiens
tctcacacctcttcactggataattgcaagtaacctgactgataccccttatctccctgcagaaacgcacagcagacaaatacaacaatcatatgatttattaaaaatataaatcagatcatatcatccttctgatcaaaactctctgaaggtcccctatggcaccccagaatttgtggctcctgaagtgatccaatatgagcccatcggatacgccacagacatgtggagcatcggggtccaatgctacatcctaatcagtggcctatcccccttcatgggacccaacgataacgaaaccttggccaacggaacctcagccacctgagacttcgacgacgaggcattcgatgcgatctccgaagatgcccaggatttcatcagcaatctgctgaagacagatatgaaaacccgcctgcactgcacgcagtgacttcagcatcc

SEQ ID NO: 644928 - DNA, 266 bp, Homo sapiens
gtcgactaaattagttcaaagtcattattagaaggttatgagaaatgaggttggcccatgagctagaagtacttatagattaattagaaaaaaaatagttcagtcttgtttcacaagattaactcagataaaatatgataaaattttattagctgaatgggatttatatagcatctcagagcagaagctgggtgtccaaagaattctctacaggttattgttgaaatattccccagtactagaagtgtatgctcatacaaaagcta

SEQ ID NO: 644929 - DNA, 882 bp, Homo sapiens
accatcaggcgtggttcattggtggagctgcggcgatgaaatgctgcaccatattgggttgcggtgaaagaaacagctccagctgctgctgacggaactgtaatcactggcggcataggtaccagaaatatcccactcacccgctgaactcaggtgctgatagttaccgctcacctgggctccattgtccggacgatcggattgcagtccggcagacatgcccagctattacgttcatccagcgtatcgttccacgacatgcggtgtatggtgctgtggctactgttttgcatgtcatagccaacccgaccaccgttaccgaagggagcgaaatcgacagataaatctggttgtcgcgatctttatcttcgtagtgggtcgtattgaatgacgtcgaaatcgagatatctctccagtcaccaatatcaacattaaaacctgctgtgatgttggcggtcgtggaggcgtctgcattccaccaggtttgatgtagcaggttggcgtaaagattgaggtttagtggggtaatcggttggcccacggataagctgatcgtctgtttttcgtcctgcgcatcgctgtcgttgtatttgtgatccagatagttggcgtagctgtgaaaatgacgatctgagaagcgataagcggcgagcgaaatcgtgctgttggtggcatccacttgtttgctgtaattaaaacggtagcttaagccccgctcgtcctgctgagtatcaaaatggctactggcccaggtgacatcaaaggacagtgcgccaagccacagcatattttgcccgatacccattgcggcagaatggtagtcatcatcagaaatcagcaggccgccgtacagcgaggtgtttgagagcatcccgggggatc

SEQ ID NO: 644930 - DNA, 176 bp, Homo sapiens
actatatatagacagattagccttcaattgcaggtggagaatggaattaatatgttaacatttaaagatattttagaaatgatatttttaaaagagagtccaaataaaactgctttcattctgattattttgaccagaaattgggctgctataatataaatgaataatatgttagg

SEQ ID NO: 644931 - DNA, 1061 bp, Homo sapiens
gggagctttggtgtccagttaggccagcgggagcagtctcctgatttattgtgatctcattctggactctggacctctctgttcttcaagcatcgtgtcactgtgaaatcctaacgcccctgtgtcctacagaccgacggcacaacagacagctgcccatcccatgccatgctctaccctctgcctctcaccaggagacactctgggcctccaggacaattgctgcttgccggctcttatttttctaagcaatatgtgatggagaaaaataacatatttatagggattaggtaaccaagggttactaagaagatgatcaagggaacaaaaaatggttaaatgaggtctagctgaagtcgacttgaaaacacaattgacacctcaggcaggagggcactgacccacagcccacacaacctcaaagggtcagagcgtcaagtgacttaaacttctgaggcaggaaacaggtgccatctgggccacactacggcagggacagcccaccatgcctaaaaggaccccaaatggtggtcagtaagtaccctaacatgtgcaggccagcagggccccatctcgtagtaaaaccacgataggtatgaagtactggcaacaacatgctgcatggtaccagagctccagaatagatgccatcagtcaaaacacacgtgaataaccaaggactgctgagtagccttccatggggggtcaaactggactcaaaaacactgggacaactggccatccaaggacaccaaaagatttaaggagctagacactgacctgtataacaacctgactgtggccatggagggggctcagaggaacacaaatagaacacatagccccatgcaatagaaacacatcccaaatgaatgtctagggacacgacaatgggacgactcacggagaaagggagatgcccagtactagggaatacacaaagatcacacgcaggaactcaccccagaaacccagacagtggctgacgaacagaggacagcacccacgtgagcccccccttatacacagcacctcacgggggcaccaaaacccacaaaacg

SEQ ID NO: 644932 - DNA, 718 bp, Homo sapiens
  misc_feature (459)..(459): n is a, c, g, or t
  misc_feature (697)..(697): n is a, c, g, or t
atcaccgccgtacgcctgatttagccgctaatggagataattaaccactcactgatcgacctacggaccgcatgcacaatgtccggatgatgaagctactgctcactccttggcgcttgtctgagcctacaaatgaccacaggactattgctagccatgcactactcaccatacgcctcaaccgccttttgatcaatcgaccacatgactcgagacgtatcttatggctgaatcatacgctaccttcacgtcatagtcgcctcaatattgtttatctgcctcgtgctacacatgggacgaggcctatagtacgcatcatttctctactcagaaacctgggacatgggcattatcgtcctgctcgcaacgatagcaacagccttcataggctatgtcctcccgcgaggccatagatcattctgaggcgccacagtatatacgatcttacgtatcggcatnccatacattgagacagaactagttcaacgaatctgactaggctacttattagacagtccgatcctgacatgatggttaaccttgcacttcaagttacggttcatattgcagaacttgcacactccacttggcaatcctgcactgaaacggaatccaaccccctaggaatcaccaagcattgcggattttatcaactttcatcgcttacaaccactcgacaccgcccctctaggttganctcctttgcttcttcctcccc

SEQ ID NO: 644933 - DNA, 320 bp, Homo sapiens
gaattcggcacgggagacgtaaggctgtgttctcaggatgaccgagtgggagacagcagcacaagcgggggcagagccccagaacataaggctcttgggaaggtggcgcccatctaatgtaagataaatcacattccctacaggattacatacagtgtggagtgtttccaagcccctccatacaaacaggctgtctcccacactgctcaaatcgataatcccctttggggccccatacttctcatgatgacgccgcacacacagagttttatttttcattcaaagcttcttatacacccttaaggggcccctttagggct

SEQ ID NO: 644934 - DNA, 319 bp, Homo sapiens
gctcgacggggggaaggggactggagtataacgtttttaagggggataatgaaacttaggcaacgtccgggaagactgtaaccccatagtactcgaccagtgaggaactggggaagagacctgcgtgctaggagataaattacctgctgtacctgccccgggtgtgcctgcctaccagacacctgatcttgcaagactgccattgaaagtctcacttccgctgttcttcatgtctctgagtccattcatcgggtttggacgggtgaatgtgtttctcacacattgttctacatttctgcaaatccctttatggtcgacg

SEQ ID NO: 644935 - DNA, 373 bp, Homo sapiens
ttgatagacaatgactttatgtatatatgtttgtctattaccagacaacatatgactatctcataggctaccatattttgaacatgaagcacagataattctctgctagcttctaatcaactagaacaatccgttacaaaaaaattagtcccaagcactctgagagactgaggcacgaggatcactttagcccaggaattcacgaccaacctgggcaacatagtgagacctcctcgtctctacaaaaaaattaaaaaataagctaggtgtggtggcatgtaccccatagtcccagctactcaggaggctgaggcagaaggatcccttgaacccaagaggtcaaggctgcagtgagctgtgattgcaccactga

SEQ ID NO: 644936 - DNA, 106 bp, Homo sapiens
ccacggagagtaagacgatcatcaatggctgacggcagttgcagccaagcaacgccagaaagcctggcttcacgctcaggagaaaacgctacctctcttcctcgtg

SEQ ID NO: 644937 - DNA, 340 bp, Homo sapiens
tgacagcagacgcccttgccttgtttccttccttatggggaaagcatccaatcttttatcattaagtgtgatgttatctgtagggtttttgtgatgccttctgaaaagttaaggaagttgttttttattcatagtttgctaagagtttttatcacaaacggatgttgaattttgtcaaattcttttcctgcatctattgagatatcataagattcttttttttgtagtctgttgatacgatgaatgatactgatgtttgaaggttgaaccaaccttgcatttccaggataaacctcattttgtttgtcccagaataaatagattacttcagaaaaaaaaa

SEQ ID NO: 644938 - DNA, 184 bp, Homo sapiens
ctgccgccatcttggtccgcgttcctgcacaaatgccggcgacacaagaaaccgtccctgctacagagcaggagttgccgcagccccaggctgaggacagggtctggaccagattctgacagtgatgattcagtaccagagcttaaggaccagggttccacccagggacccacaaaaaaggccc

SEQ ID NO: 644939 - DNA, 267 bp, Homo sapiens
ggtacctgaaacaggctgatgcaggagaatggcgtgaacccgggaggtggaggttgcagtgagccgagattgcgccactgcactccagcctgggcgacagagcgagactgtctcaaaaaaaaaaaaaaaaaaaaaaaaaaaggaatgtgtgtgggaaaatgtgtatttgggatcaccaagggtttaagggtaatttttccccaagttttaggttcctatttgggcaaaccggaaaagtgtgtggttggggcttaaatatattaaaat

SEQ ID NO: 644940 - DNA, 145 bp, Homo sapiens
cttacatgtttcctgcacttcacaattactgtttagctcataactatactattctaaaaataacaaagactgccaaacttacctcaataaatgtccaatattcccatctgtttccctttcctaaataaactgatggaatattttg

SEQ ID NO: 644941 - DNA, 990 bp, Homo sapiens
attgagagaggaagacgagagcgacaagaggatagtggtgtgacctattgctatcactactctatcgatatgattgtgttagtttaacattttgggcggtcattaacttacgttcgccgtggctatatacgtttcgtcttatccgcagccttccaaacaccgtggtcccactcattatctccccgtccgcttttctgggattatactcttgtcagagatgccacactttatgctaaacaggtgtgcagtagcgctacccttttattggtaccccccctgaaatatagggttccgggaatgtggatcatatgccccagctgatcggaaggaagatatattgcgcgtcccctgtctccttaggaggagatctgatttatctttaaaaaggcagctgcttctgaggcccatgccaaggaccccttctgcgcacctgaccacagaggtacctttgttgttggatgtatttaagcgccagtactcccatgaggacacactctctggtggcactgccatatttctgggaggcactttgataaggacggctggtccctgtggtactcagagtatcgcttccctgaaggactcactcaagaccttcatgaggctgccatttcatcactggatgttccacgcgactggagccaactgaggagagaatgccttcgccagggtcatccgttttggaacccagccataatgcagctccactttctggaatctgggtcttccgaggccacggagcttgcctttccgctgagtccccgattggcacggtggactacgagtcatacacatggcggaactggatcctggcagcgaggagaccccgacgctggttcgagagtacttttcctgggagggggccttccagcatgtgggcaaaagccttccatcagggccagattttcaagtgacatctcttgccatcacctagctgcctgcacctgcccttcagggagatgggggtcattaaaggaaactggaccttga

SEQ ID NO: 644942 - DNA, 317 bp, Homo sapiens
acacctgactcagtgcagcagatccgttgagctgctcatctgtagctgcgtacgcgcctcacctccctcaggctgttctcagctggccttcaatttctcatggagtccaggtcgatctccagggatggactgtacgtctcagctctgtgagcgtcgtctcagcagctccaacctcagcagactgtgtggtgaccactgtggtgctctcctcaatctgctgagtacagtacttgtctagctcctctcggttcttccgagccagctcgtcatattgggcccggatgtctgccatgatcttggcgaggtcctgagatttg

SEQ ID NO: 644943 - DNA, 801 bp, Homo sapiens
gctttacttgtttcacgagggggcgacaatgtcctggggccacaccggggccgaaactccttgtcagggtggctgtgacccccgccctgttgccttgtttattggaaccggtgggcccccacaatgtgcctctaccgcttttggggtcaaccattcgtagcggttcatctgtcgcgcgatcacctgggggggaccccgcgacccagggggttcccccccgtaccacggggggtttgttggcccacggcgccggtggctcccccgtctagctggcatggtaagggcccctttctcttcgtttcggggcccagggggcgtggtggagagccgatggaggagaatccacgttctgggggggccagcctgctggagaaccaccaatctgggcgggtgttctacagctgtgttctttggggtaaaaaaggcgaggagaaaccgcgtatttcctcctgtctgcacgtgcaggatcatccgcgcagtcgtcctcccccgcgggccccctatattatggctatgccagaatcgcctcaatttctccaactgatttctaagaaacaagatttctcccccgactaatgcatttctaaagacaatcccccttccaacatagacgagggtatagataacccttcgtgcctcccagtccccccacagtttcacgcctccgtcgttaccatcccccactgttctgtcaggcacccaacgcgtcgccctgttttgtcttcagtgagacagcagtcgctcccccaatcaaataaacaagaaggctgcccaaaattaaattttcggccccacaaaaca

SEQ ID NO: 644944 - DNA, 293 bp, Homo sapiens
tgcctctgatagtactagactcttcttgtgcagtttctgctagtggtgtctactgcttgtcctagcctactagttgtactagcctactagatatagtcctagcctactgctcccaagtagctaggagataacaggtagcccatcaacacgcccggctaattattctactattcagtagagacggggtttcaacgtgtaggccaggctggtagtcgaacttcttacctcaggtgatccacctgcctcagccttctaaagtgctgggattacagacctgagccaccgaacccagc

SEQ ID NO: 644945 - DNA, 267 bp, Homo sapiens
cgtgttagaccagggattgggaggcatgaggggggtggatatgaggtcaggaggttcgagaccagggtgaccatataaggtaagaagcgccgtctctactaagagctacaaagaattagccgggtgtggtggcgtgtgcccgtagtcccagctactagggaggctgaggcaggagattcgcttgaacctggggaggcggaggctgcagtgagccgagactgcgtcactgcactctagcctgggtgacagagcgagactccatctcac

SEQ ID NO: 644946 - DNA, 250 bp, Homo sapiens
caagaggtatgtttactataaaagctattgggtaagctagttatattatattggtggctcaggagtttgatagtgggtgggcagtgagagtgaatactaaaatgtgcagggtgcctaaggtgctgtgagtgtaaatcactgcaatgagtaagggaaaggaccctactacggtgtagaatataaaatgtgtcctgagctctgttggaaccaaccctacccatttggggcttgaaattcaatgttagacctg

SEQ ID NO: 644947 - DNA, 482 bp, Homo sapiens
  misc_feature (13)..(13): n is a, c, g, or t
ctgtgttactaanagcgtaaggatgatgtagctttaggcataacttgattttggactcaaaaaagttctcagagtcagtcttttggctcagattcatctgggttggctctgtacttaagagccagttaatgacctcaatggcttcaagctcacgtcatcacaacatctagtccagcatttgaagagagagactagcaatcactgaaagctcaaacaaaagttgcatcattgagtctccttggtttagattggtctggtgtgggtcatggctcatggtgtttttgaataccagaaatcttaggttattataatgtaaagcaactttatgtttaaatgcttgtgccacagtgaagtttcattatgactgctgcaacagttggccaccgttggaaattttcgtcctataaattggagtaaaattttagatattgataaaatttctctttctgttgctttccacctctgcagtcagtaagattaca

SEQ ID NO: 644948 - DNA, 458 bp, Homo sapiens
tgcacggtgctagaatccgaagcgattctatacaaagcaacgtttagtgcctttaggtgaatatattccactatccggtttactgaaatgggtgttgactgccatgcagaatgatccgtcgataagtggtttttcacgtggtgaacaacagcaacaaccgctttctattcatcagcagcatttaggcgcgtccatttgctatgaagtagcttatccaaacttaacacgtcttaatgcccgccaaagtgatttcttggtgacagtttccaacgatgcatggtctccgggaactgcaggccctttagaagatttacagatggttcaaatgcgtgccaaagaaaatggacgctggtttatccgtgccaccaatacaggcgtaactgcgtttattgaccatcaagggcctatcgtagaacgtgccccacaagatgtggcaaccgtgcttcgctggagaactg

SEQ ID NO: 644949 - DNA, 386 bp, Homo sapiens
  misc_feature (16)..(16): n is a, c, g, or t
ttccttaaaaagcccntctgccaagaagtgccaaagtgcgaagggaaagtaacagcttgacccgtcaccccagccccaaactgctcagtgccccagacctctactgcgtgtggcccaggccctgcagagtctgccccaccccctcacagcctcctttcacacttcctcactgcatcagtttgcctttgtagcaataatgcttagaaacaaatcacccggaaactctggtttcaacccgagtatgtatttagctcacaagccgcaggtcaggggtcaggctgggctcagcaggtggctcttctgtcctcgcaggggtcactcgggactcactcactcgtctagggctgcttggctctccgatgccatcaggcagctctgtcccaacc

SEQ ID NO: 644950 - DNA, 353 bp, Homo sapiens
  misc_feature (244)..(244): n is a, c, g, or t
  misc_feature (323)..(323): n is a, c, g, or t
  misc_feature (348)..(348): n is a, c, g, or t
gcaaacagtttcagtctcaactgaagcctcctccttgaaaagaacacggcaagacggacagagaagctatatcattgatttgagggaggacaaagtcaagcagggatagtagcgtaattactgctgttgctgctttctttttcataatctaattcagtctctggaacggcccgcaacggccagacgatccagaatcaaccccactgtaacctcctcccgtggagaccctggcccgggtacacgnatgtggagacatggacaaaccattggaggatgtgatcccattttatcccgactccacaaagtggttctgaacctgacanagcaagaggggacgaagtgggaagncacag

SEQ ID NO: 644951 - DNA, 307 bp, Homo sapiens
tgtctgaggatgcactgtcttctttgtaacattagttagtgccatgcagaactgtcacctgtccttaaaacccatgactacaaacctgtcttaggaacttgacctttgcgacacagctactttgcctggctgcatactggtaccacccactgcgaggaggagagtcttgcagtccaacctaactttctcccagccagcaactctgtggtacagtgcgcgactcaatctttggggaaacaagaagaagcccacatgctagaggctggtgtgagcccttacctatggtggctgcatccatgccaatcaa

SEQ ID NO: 644952 - DNA, 507 bp, Homo sapiens
tttgcctaataaatgcaacagccacaggcaactgacacattcttaaacacacttggtactacccaggtcattcggttcgtttcacaattattagcatggcaaatcaggtcagcggagacagcatgctggaaacaatttcttccttcaaagaagcagtcatcgagcaagaaaccgcagctgcaagactgccatggaattcttacaagaattaaatagcgatgtactctggaagttttgtggacagagagtccagaaaacctatctagacaatgatccctcaatttatctgtaggtttacctgttgtacagtatgcaactcagcttcctgaaagcacttcactacgcttagacagatgtcctactggaattcccagatacctcttattgatctgtaggacatatggactagataggtaatatgaggatcattctaaaagaacatccagtaatagaatctcatccagatactgcattagaggatctacgactagataaagcaaattcctg

SEQ ID NO: 644953 - DNA, 297 bp, Homo sapiens
gacgccattatcaaagattcgcacagtgtggaaagtgacaggaccgtagttgccactgctgtatcgggcaggactgctttaatcactcttctctgcgtcctacctgtatcctgctgattggtccattttacatagagctgattggtccattttacagagagctgattggtccgtttttgacagggtgctgattggtgcttttacaattcctgagctagacacaacagatctccacgtccccaccagggtagctagatacagagtgtcgattggtgcattcacaaaccctgagctaga

SEQ ID NO: 644954 - DNA, 227 bp, Homo sapiens
gcaggtccggagcaagttgtcgctgaatattggtacggcatagcgaagctccgaagtctccgacgagcacagaagtggatgatataacagaataagcaagctcatttgggcacagccctcaaaggccaacccttttggcggtgcttctcatgcaaaaggaatcgtgctgcacaaagtcggagttgaagccaaccagccaaatactgccattaggacgtgtgtaagga

SEQ ID NO: 644955 - DNA, 544 bp, Homo sapiens
ggccgggcgcggtggctcacgcctgtaatcccagctctcagggaggctaagaggcgggaggatagcttgagcccaggagttcgagacctgcctgggcaatatagcgagaccccgttctccagaaaaacggaaacaaaacaaaaaaaacaaaggaccaaaacaaaaaaaaaacaaaaaaaacaaaaaacaaggtgtgtggcggcgcgcgcccgcgcggccccgcgagaaagaggcttctctagaaacacaacgcggtgtggggcgcgcgcgggggcccacaggagggaagagaggagaacagggggcccaagaggggttccccagagggagaaacgggggcccagaggaaaaggggggggggaatctccaccaaaaaaaaaaaagcccgcgggggagaaacccgagggggtttgaggaaaaatctccaaagaagggaggcgcttagggaggcgcaaatcagggggagcctataaacacaagggggagcccaacaggaggcgcctcgcagaatatcaaaattagacgcccacgggcggggggggac

SEQ ID NO: 644956 - DNA, 1200 bp, Homo sapiens
ctccacgtttacttcgcggagttaaatagtggtcgaaatagcgcccctgggaacctttgggacagaactttttttcccgggggcgacaaaatggggcctttcaaaaattccaaaagaagatatggtgtctgtcccaaaggaaagtttcgttcttctgtgcaaacaacttgtcgtcctggggtggacacagccgacaagcgaggggacccccccccccaatggagagaagcacgccttggggctttccaaactggcttacagggttggagtttattcccgtgggagcccactccaagggccccaatatatatggccctcccggtatatatttgccgccgcgcggtatattgggaatttgcgcacaacacccggggctctaaacacattggaaaatggcaaaagttttgtgcctgaaggccctgaaaaaggggaaaaggagtttgaatttcgccccctctttgggtgaaaaaaaagctctgggaaagaaggggccccctaagaatttcttgaaaagtttctcgggtagaatagcctgcgccactctgtgtagagaatatggggttctcctggggacaagcccccacatgggtgggtgttttgaaagagagccttctctcacagagactatatccaccccctttttgggctctcctcttttgtcgtgtttctggtgaatatatgaagaccacagacacacagttgtcggtgtgggtggttcactccacaagaccacaggcggaacacacgagaaggctcgcctcggagagctcggcacaaggtgtcacccacaagttctcgccccacagagaaagctctcacagagagagggtcaaataggaaaaattaattcccctcataaaacctcgccacaccccacacttcttaatccacagtcggtgggagaagaacaccggttctccaagagaactcgtgttgtgttcacaagtgggcccatttaaagtgttaagtgaagtaaaaagagactcggtgtaaatgagtaacacactgcactcgtaaaaccttcagaaggagaaaggagaaaatgttttgtggagaccacactttgggtttcttttttgcgtgtggcacagttttaaagttaattaagtttttaaaaatcacgtgaactttttaatgggaacaacttgacccaaaatttgtcacagaattttgagaccccattaaaaaagttaaatgaga

SEQ ID NO: 644957 - DNA, 251 bp, Homo sapiens
tgctggttacacaacaatctgactgtacttactgccactgaagtgtacatttaaaaatggttacaatggtacgtattatgttatgtgtcttttggcacaatgaaaacagctataaaaggcatccttgcaaccactggggctatctgctattctggcattattattacttttcttacgtgtactaaacctattgtggttctatacattatatacaaagaggatactgtccttattcttaggcgatgctttct

SEQ ID NO: 644958 - DNA, 425 bp, Homo sapiens
  misc_feature (344)..(344): n is a, c, g, or t
gcttgtggtgaaggggggcaaaaaaaagaaccaagttttgaagttcactcttgatggcccccaccctgtagaagatggaatcatggatgctgccaattttgaccagtttttgcaagaaaggatcaaagtgaccggaaaagctgggacccttggtggaggggtggtgcccatcgaaaggagcaagagcaagatccccgtgccatccgaggggcctttctccaaaaggtatttgaaatttctccccaaaaaatatttgaagaagaataatctccgtgcctggttgggggtagttgctaccaccaaaaagagttccgaattccgttccttccagattacccaggccnaaaaaaaggaggaagccgaggattaaatttcatttatctggaaaattttgtatgagttcttgaataaaacttgggacccca

SEQ ID NO: 644959 - DNA, 877 bp, Homo sapiens
gtcagcatacccattgtgcccaggaccgtggctatgaaggatgagttactctgccagcttacccagagcaatgaggagcaggctgctcaatggcaaaaggaagagatggcacttacagacacatgcaggtcagaactgcagctagacaagcaagctgtcctggccaaagaggtgcgggacctgaaagagaccttggagtttgcagaccaggagaatcaggttgctcacctggagctgggtcaggttgagtgtcaattgaaaatcacactggaagtgctcctgggagtcgcagcattgcaggtgtgagtaatcctctaaggcacacttgtagaggaaccgtaacggactaaacttggcccagcacctatagcagaataaccgaggagctaagatcttggagaaaagacggacagtactctcagaaagctaggtggctgcggtgactgagcagactacatgagcctgactctctttctactagacaaatactaaaggagcaagactgaactaagagacccttctgctgagtacggccgtgtcctcccagccaggaacaccctctgcctaaagtgacaggaccttcctgggaagcatcttgacagtagtggcagatgaggaatcaactcctgtgcccttgcttggaagtgacaagagtgcttacagccgagtagcatcaatggtttcccttcagcccgcagagacccaggcatggaggagagcctggccagaacatgaggtatgatgactacgtgagcttcagagtcttggttccctgctacaagagtctaaagaagaagccatcagggactctggcagcgaaaaatttgtgagctgcagctaaggctgcaggccaaggaagaacagcgtcagggagtca

SEQ ID NO: 644960 - DNA, 235 bp, Homo sapiens
  misc_feature (33)..(33): n is a, c, g, or t
  misc_feature (46)..(46): n is a, c, g, or t
tctttgtatgtgtgtccgtgtgtgtgtgtgtgnggtatatctgtgnttgtgtgtctctgtgtctgtgtgtgtctctgtctctgtgtgtgtctatgtgtatctgtgtgtcgtgtgtgtgtggtatgtgtgcttgtgtttctgtgtgtttgtgtgtgtctgtctctgtatgtgtgtctaggtgtctgtgtgtgtgttagtgtgtctgtgtgtattgtgtgtctatatgtctctaagt

SEQ ID NO: 644961 - DNA, 349 bp, Homo sapiens
  misc_feature (18)..(18): n is a, c, g, or t
  misc_feature (38)..(38): n is a, c, g, or t
  misc_feature (73)..(73): n is a, c, g, or t
gtgaactcaacctaaatnaaaaaccaaaaacccctganaaaactttctctttgccgtttcctcctttaaaaanaaaaaacaaaaaacaaaaactgaaagctgaatccttccatgtcttctatgcatctacatcttaaactgtgggcaaaagagaaggattggtcagagcagtgtgcaatatgatccaactaagtctcctcccttggcccctccccaaaatgtttgcagtgttatttttgtgggtttttttttaacaccctgacacctgttgtggacattgtcaacctttgtaagaaaacccaaataaaaattgaaaaataaaataaaaagaaacccatgaacattcaaa

SEQ ID NO: 644962 - DNA, 567 bp, Homo sapiens
ataataatgctgagtaaaagccacaccaataaaaaatttgttttttaagacggagtctcactctgtaacccaggctggaatgcagtggcgtaatctcagctcactcactgcaacctccacctcccaggttcaagcgactctcctgcctcagcttcctgagtagctgtgaccacaggcacacaacaccatgcttggctaattttggtattttaagtacagatggggtttcaacatgttggccaggctggtctcgaactcctgacctcaggtgaactgcctgccttggcctcccaaagtgctggaattacaggcgtgtgttaccatgctctgccaaaaaaaaaattttttttttttggagagggtgtctggtcctggtggcccagcgtggagtgcatgggttcaatctcagctcactggaacctccgccgagaaagctctcttatggtcttggcccctagctacagataaggcacccagggggcaagaaatttacggcgtttggaagagaattcccagattcctatccaggctacaggcagggcccatgttatggcctggagccccttt

SEQ ID NO: 644963 - DNA, 771 bp, Homo sapiens
atggcacatgcagcgcaagtaggtctacaagacgctacttcccctatcatagaagagcttgatcacctttcatgatcacgccctctataatcattttccttatctgcttcctagtcctgtatgcccttttcctatactactcacaacaagaagctaacataatactaacagtctcagacgctcaggacactagaaaccgtcgtgaactatcctgcccgccatcatcctagtcctcatcgtccctcccatccctagcgcatcctttacataacagacgaggtcaacgatccctcccttaccagtcaaatcaattggccaccaagtggtacctgtaaccctacgagtacaccgagctacggacggactattcttcaatctcgctacatagcttcccaccaattattccgtagtaaccaggtcgactctgcgactccttgacgttgactatcgagtagtactcccgatgtgaagcccccgagttcggtataataattacatcgacaagatcgtctgtgcactcatgtagctgtcgcccacatttaggcgtttgtagaaagcagcagtgtcaatctcccggatcgatcgtatgactcagaagcgcagcatgtatcagccagcatacacggacgcgtggggtactagctgacggatcaattgtctctgaaatactgtggagcaaaccaacagtttcattgcccaatcgatcctatgaatttaaattcccgctaaaaatctttctgacaaattaggggccccgtattttacccttat

SEQ ID NO: 644964 - DNA, 1289 bp, Homo sapiens
tcagtatgctcgatccacgcgcttcggatctttgcataaggaagcgagaacgcgcctaggacatgaacttactagagaatgcgactatgcaggataatgagcgatatggagaaagagtctgggccctggtgcaataaaagaccaaacaatgcaagaagaatcagagagtcctgttgaaagacccttgaacgagaacccaactaataaaatgacccaagaaagaacttcgacagagtcaagtaccattggccaggatcaaacgcttatggaacgtgatacagagggtggtgcagcagcaacattacattgcaatggagtgcattgcaagtcacttacatctatactcagaacagtaataatgaaaccattgagacatcaaacgaggactctacacatgctcaatgactgtcgatgtccacaaatctctgaatcaggaatctcagtttcctaagctcccaaaatggagcacagccagcacatctcaagaaacagactcttgtacacctataacatctgaggtgtcagaacaaccatggctgtgcccagtcttccctccaagtgtaggtcagatcattcagtgaacaacaacactaagccaacttcacagacagcattacgggcacgagatacccctgtgaacactgaacaacacagcaaagaaccataacgggaccactggacctaccacaggacaatccaacgggtgcacctttccttgtcactccccttgagccaaacaatgcacgaaaagctcaaggcggaaagatcgctgacccattggcataactggccatggatcgagatgacccataaccagttcacacggcaagaaatatacaaaacacatgccaagtatcgttaccatctgtaacgttgataatacgagcacatgcgctaaaataaaccccatgatgtatcatatgcgaacgaccggcactcaatagccctcgcactgggacaaacgctgaaaccactgggcagaaccaccaaacagtcacgggaaaagaaacgagcgacaatatgcacaaaacacactgacagagccgacgaaaactcgatgtaacagaggtcccacaaacaccaaacgcacgagctgaacaaacacaggaaatacaacacaaacaaagcagcgacatcgacaccacaccaaaacaagcagcagagcagtgacaacaaccacagaagcaagaactagtcacaaaaaaacaagtcgcagctataacaccacacacagcgtacagactcgcacgtcataacaaacaggatcaataaaacccagcaatatacat

SEQ ID NO: 644965 - DNA, 158 bp, Homo sapiens
tattagacaaagtaagtatcatagccatggtgtggtactataacaaaatacctgagacggggtaatttatagaaaacagaaatgtatttcttcacagttctggaaactgagaagtccaaaatcaagacaccagcatctgttacgctggaatggaatgg

SEQ ID NO: 644966 - DNA, 318 bp, Homo sapiens
gccaggctaagtgcagtggcgtgatctcggctcatgcaacctgcgcctcccgggttcaggcaattctcctgcctcagcttcctcagtagctggaactacaggtgcgtgccatcacacccggctaatttttgtatttttagtagatagtgggtttcaccttgttggccagtatggtctcaatctcctgacctcatgatccacccacctcggcctcccaaagttctgggattacagacgtgagccaccacacttggcctaaaaagtaaattttaataatatattttaactcatatctagaatgttactttattgtgtgat

SEQ ID NO: 644967 - DNA, 106 bp, Homo sapiens
caatgcactgttcattaattcaatcttaattactgcatattcattacttcttcctcctttttgcaaatgctatggtagactagtctgtggaaaatgagctccaagc

SEQ ID NO: 644968 - DNA, 131 bp, Homo sapiens
catggttatcggcaattcaagttgccgttatcagctgtatatctactctcaggcggtacacgtgctagctacatgtgggcccttatcgcccattatgagtgacgataatcttaactcatggccgacgaaaa

SEQ ID NO: 644969 - DNA, 739 bp, Homo sapiens
ccacgcgtccgaatacatctgtgtatccatgacttgttaattatgaaaactgttttccacagggggccagaggtgatgatgtttaattttcttctatacaggctagctgtatatggtcataaaaaacttggcatagttttttttttttttttctcctctctctcttttaagggagctatttctctgttgggtttggtggtgacattctggagccttctaatttaattggtttggctccgtgctattggattaaccagggtgacacttgccaaaccgggtcagttatcacccaaatacagcctgaaggctagaacggaagtgaatttccggggacatacatgtggtgaatgactcagagggtaaaaagagtttctaaattattaaccaatttatttaaaattgaaacagtgtttagcatttttaatcttctcttttaattattggtatacacagtaattatgagatgatacccaaggtgcaaaatttatgtgtatgtgtactaggtagtatttactggtagtttgacgggagtgtaaccggaagagagaagaaatggataccaggttatttcagtattcatatggggtcttctcccctccacacccaatttccttcaattgtctcctagattagaaataagtatggtttctctgagcggttccaaatcgggtggcaggatctccagacttttcctttcccatcattcatggttcccccttgggggtaacgggaataattg

SEQ ID NO: 644970 - DNA, 448 bp, Homo sapiens
  misc_feature (7)..(7): n is a, c, g, or t
  misc_feature (71)..(72): n is a, c, g, or t
  misc_feature (81)..(81): n is a, c, g, or t
  misc_feature (92)..(92): n is a, c, g, or t
  misc_feature (95)..(95): n is a, c, g, or t
  misc_feature (111)..(111): n is a, c, g, or t
  misc_feature (117)..(118): n is a, c, g, or t
  misc_feature (135)..(136): n is a, c, g, or t
  misc_feature (138)..(138): n is a, c, g, or t
  misc_feature (155)..(155): n is a, c, g, or t
  misc_feature (158)..(158): n is a, c, g, or t
  misc_feature (161)..(161): n is a, c, g, or t
  misc_feature (163)..(163): n is a, c, g, or t
  misc_feature (243)..(243): n is a, c, g, or t
  misc_feature (247)..(247): n is a, c, g, or t
  misc_feature (424)..(424): n is a, c, g, or t
taagtcntccagctatccccagaccagctagacacatcccaagcatggtcatgttagcatcaatgtccagnnatactcagntctcagaatcnttngttagtaccacttttnccactnnccccttatattccacanngnattcacagccagcgggntanctntnccctccctacccccaccaaagcctggggaatcacagacagcctttttacagctcctctttctcggcccccttcttctggnaggnagtgaggatgtttaagctcttctggagctcctccttcttcccgtcactcatcttgttcttctcaatcagcctggcgatccgtgtcatctctgatgctgggaagtcctccccttggtctaagatcttccccatgatcttcaggtattgctcggcccacttcttctgagtctccttcanacttgagaggttatcttgcccctg

SEQ ID NO: 644971 - DNA, 454 bp, Homo sapiens
  misc_feature (91)..(91): n is a, c, g, or t
  misc_feature (99)..(99): n is a, c, g, or t
  misc_feature (159)..(159): n is a, c, g, or t
  misc_feature (214)..(214): n is a, c, g, or t
  misc_feature (312)..(312): n is a, c, g, or t
  misc_feature (324)..(324): n is a, c, g, or t
  misc_feature (326)..(326): n is a, c, g, or t
  misc_feature (407)..(407): n is a, c, g, or t
cttgaagcctgctgatcctcccattgttgatacggttcctggcaacccgatgtgtgttgagacccttcctaaagactacctcaccaagggntcgctatnctgattcgtgatatgagacagacatttgcggtgggtgttcatcaaagcagtggacaagangcctcctggacctgccaagttcaccaagtctgccaagaaagctcagagggctacntgaatattatccctaatacctccccccccactcttaatcagtggtggaagaacggtctcagacctgtttgtttcaattgaccagataagattagtagnaaaagccgggtnantgataacaatgcctcgtaccaccctcagagggaaaggagaatgttttgtggccccctttggttttcttttcctccgtgtgncagttttaagttattagtttttaaacctcccacacccaaaaaaaaaa

SEQ ID NO: 644972 - DNA, 675 bp, Homo sapiens
  misc_feature (394)..(394): n is a, c, g, or t
  misc_feature (402)..(402): n is a, c, g, or t
ggggctcccgggggcagactcaggtgcttccagcaggcgcgggccgtggggctggcgggcacttccgccgccttcctgtcctcgcgcctgcaggacctgtccagcatcgtgcgccgtgccgaccggcaagccgtgcccatcgtcaacctcaaggacgagctgctgtttcccagctgggaggctctgttctcaggctctgagggtccgctcaagcatggggcacgcatcagctgctttgaaggcacggacgtcctgaggcaccccacctggccccacaagagcttttcgcatggctcggaccccaacgggcgcaggctgaccgagagctactgtgagacgtggcggacggaggctccctcggccacgggccaggcctcctcgctgctgggggggngggggggnccccaaaggggtcttctctgtgggcagagtgccgcgagctgccatcacgcctacatcgtgctctgcattgagaacagcttcatgactgcctccaagtagccaccgcctggatgcagatggccggagaggaccggcggctcggaggaagcccccaccgtgggcagggagcagccggccagcccctggccccaggacctggctgccatactttcctgtatagttcacgtttcatgtaatcctcaagaaataaaaggaagccaaagaaaaaaaaaa

SEQ ID NO: 644973 - DNA, 427 bp, Homo sapiens
  misc_feature (279)..(279): n is a, c, g, or t
  misc_feature (367)..(367): n is a, c, g, or t
  misc_feature (391)..(391): n is a, c, g, or t
  misc_feature (411)..(411): n is a, c, g, or t
  misc_feature (421)..(421): n is a, c, g, or t
ttgagatggagtttcactcttgtcacccatgctggagttcaatggcacaatcttggccctctgcaacctgcaaccttcgccttccaggttgaagcgattctcctgtctcagcctccccagtagctgggcttccaagtacctgccaccacacccggctaattttgtatttttagtagggacagggtttcactgtgttggccaggctggtctcaaactcctgacctcaggtgatccgcctgcctcggcctcccaaagtgctgggattacaggcgtgacacncacacccggccatgaatcaaccagtcttcttgatgtagtatcagaaatacttaggatgtagctttaaaggtctatatgaaaatagggntacttgtacttatctcggggaaanttttccaaatatttaaaacnaattttaaantaaaag

SEQ ID NO: 644974 - DNA, 891 bp, Homo sapiens
tggaaatggagtttggctcttcttgcccaggttggagtgcaagggcgcaatctgggctcactgcaacctctgcctcccgggttaaagtgattctcctgcctcagcctcccgagtattggggattacaggcgcctgccaccatgcccggctaatttggcatttttagtaaaaacggggttctctccagtgttgggctcaggtgggttctctaactccgtgaccttcgagggtgattccatccgcctcagccctcccaaagttccgggggatcacggggcggtgagccaccacaccgtggccatagctgtgtcttctcttatgggtggattaaactcgtgcattgtgctcccctaagaactcagatattacgtggtgggagtgcttcaaagggggtgtgtggtgttgctgtgtgtgtgtccagttaatccagaaatattcctcccaggaaaatagaagaccccaggagggaggtggggcaacaactctttatctgctaggggcagacagatcttcatgaaaacacattatgacctccagaactcgatgtgctccaccagccggccttagctggtcaaaagccacacctgggaattccctggtgaagcccccagtggaatagctcagtagcaggacgtggtagaactagaggatcctttactcacaggggcatctggatgtcctgagtgaagggaccagaacagaccctctgtgggagaccactcccggttgtgtaagtgaggtccttgcatggtaaacatcttgaagaagggaagaggtgtgtctggtgaagtcctcaacaaagcagaccccttgatttggagtcaggcgcacaggggtcatccgaaggggcctatacaacatgtcgcgttgccattggttgccaatgggcgg

SEQ ID NO: 644975 - DNA, 268 bp, Homo sapiens
aacgtagccggcctcctcgagaagcccggcgatgcgctcggagtcatggacattcatctgacacccgtaggtcacgactcgataggtcggggcctcggtgtgctgcaaggtgttattgggcatggcgcacacactctacgtcatgtactcgtcgcaacgtgtactcgctgacgaacgtgccgatcacaccaccgtctgaagcacgagcagtatcccgccatagacgaggacaaataccaccaacggccacacgaacttcagccagtgt

SEQ ID NO: 644976 - DNA, 455 bp, Homo sapiens
  misc_feature (283)..(283): n is a, c, g, or t
attgctgacattgtgtggatctcgtggtgatctcatcgtggctagacagtagtcgcaaggaaattctccattttcctaagggtgggggctatagtgtaccttattcgacgagggacttacctgtaccggtgaggcatacgccctagactcctaaggcggcagctgctaggtcttaggactagttagggatcattagcatcaagactctacagactaccatactgagaagatattccaccccgataggggcatgacaaattatcagtttcttactgctcccaangccaactatcccattcccttaagttcttgggttgttacgtggcacatcgcagaacagactcagaccaatgtcctgaattccagctagggtagttctagaaactttagcaagctccatcttttaatagtttttattatgttagtgtcccctatctcgcgcgatcgaagtagtg

SEQ ID NO: 644977 - DNA, 435 bp, Homo sapiens
  misc_feature (91)..(91): n is a, c, g, or t
  misc_feature (222)..(222): n is a, c, g, or t
aaagtcggcctgttccagaaggacctgtcccccccaccgcagggcccgaccctgccctcacggctaaggagtggttggggggtcgggatgntgggcccctcctcatctccctcaaggatggttacgtacccccaaaaaaccgggagtttagggtcaaccggggcctggacaccgggcgcagaagggcagcaccaaaggccagtggcactcccagctcggatnccgtgtttcggctggagaagaaaattcggaagctccaggccccggtgcaggagctccaaaagcgcttggacaggctggaggagacagtccaggccaagtaaagccccccagggcctccagcagggtcagccattcacacccatcccctcccctcccattcccagccccatggcaaaaaaaaaaatcataataaaatggctttattttttggta

SEQ ID NO: 644978 - DNA, 431 bp, Homo sapiens
ttaatgctcgacaccatagcaggttgctgcctcatgagaataagacatgtgtctgtaaactcttctacttctaagacccttattatatattttttttttggtagcaaaattccatggaaaagttgggtttcggtctcagagaagctaagggatttttcttttttttttcttttggactctgaggtcttcctcttggcggcgctggtttccagttcatctcggcaatacctacccgatcccggaagtcccggaaggaggcggggctgggcaccaccaaagaggagatcaccagggatgccgagggccgggatgagatggaccatgcggagagggagctggcgcggaggccagatcctcgggtccgggggcctgaacggtatacagccacgaaaaagaagatctggtcgagcttgtggggggctcctctagag

SEQ ID NO: 644979 - DNA, 689 bp, Homo sapiens
aggctgggtgttatttcgttaggtgctgaaggctgtggtgcgcggatgtgcccattcccacgtgaagcgctacgctagcatacgctcggctggcggctcccagctcgccgcaggagacagtcccggcagcagcgggggaccggaagtggctcgcggaggctcagaagctagtcccggagcccggcgtgtggcgcctcggagcgcggtgacgggccatgtccctaatctgctccatctctaacgaagtgccggagcaccccatgtgtatcccgtgtctctaaatcatgtttatgagcggcggctcatcgaggaagtacattgcggagaaatgggtaccgaccccatcaaaaccagctctctccgagggagcagcttcatcgaccatcaaagtttgctcacccaaaatccgggcccaaagcctccctcagccaccagcatcccgggccattctgaaagcttttgcagggattgaggtgggatgcagtcattgttgcacagtttcactctgcggccagcaggctgcaagacaacccggccaagagcttgtcacacgctcttgtaccaagcacggatggccggcctgccggtgtccatttgcccggtctcaccaagggaatgtcacttgctgcccgagaaagctctggctaaccctgaaaccacaggctgggcctcatttgtgccccaggctg

SEQ ID NO: 644980 - DNA, 784 bp, Homo sapiens
aactatgtaaatatatacccacccaatgtaggagtacccagatgcataaagcaagttctgaaacacctacaaaaagatgtagataaccacacaataatagtgggatactacaacatgacactgacagtattaggcagatcattgagacatacaactaacaaaaacattcaggacttgaactcaacacttgactaaatgggcctaatagatatctacagaactctgcatccaaaaataacagaatataaattattctcatctgcacatagcacatactctaaagtcaaccacatgattggccacaaaacaaccctcagcaaatcaaaaaaaaactgaaatcataccaaacatactctgtggactacagtgcaataaacaatcaacactaagaaaatgtgcttacaactatgcaattactttggaattaaacaacctgctcctgaatgactttgggtgaaccatgaaattaaggcaaacatcaagtaattctttgaaactaaactctagtatcccagagataccagaatctcgtgggacaaaggctaaagcagtggtaagagggaattttataggtgatgccccacatcaaaaagttaaaggatctctaattcataactaaggttcacccgggaaaattagaaaacagagcaaacaaggcaaaagtaggagagaagaaataccaaataagagtgatgaaggaatggaagggacggcaaagtaatcccatttattttaaggataaagagggaattgtaaataaaaacaggggggcagtgcttaaaag

SEQ ID NO: 644981 - DNA, 363 bp, Homo sapiens
tgagctactcggactctttattagaacaatcaatcattttcctttggacccacaatttttgcctctgctgcagccactttgtgagtgagcatgaatatgtctgtgtgaacacacaggcatgcgtgtgtatgcgcacgtacatgggccagaatgaatggatgtgtgtgtgtgaggcatacctcagatttttcttttcttattctgtgtcaaaatctcttttctacagattctccagggtttaagcactgcctgctgtataaaaaaccttcatccattctacatagttcgcatgaaatgttccttttaacaaccaaacaattgttaagtgttccataaaggttatgttgaattttaaaaaaaaaa

SEQ ID NO: 644982 - DNA, 114 bp, Homo sapiens
ttgatctgagaggatcccccccatgagcgagagctgtttcccggttaccacaccaaggcgcgggcggtgatgaactttgtggttcgctaccggccagacgagcagccgtctctg

SEQ ID NO: 644983 - DNA, 146 bp, Homo sapiens
acagaggaggaagcatcccaccagctggttaagaatactgaatcagggctgcagcccttgtgtgaccccgctctgggctgctattgaatacttctaaaactaggcattgctgactggagtatcttggtctaggtgctattgaaact

SEQ ID NO: 644984 - DNA, 305 bp, Homo sapiens
agctcgcgaccctccgacgaggattcagaagctgagatgggaggattgctcaagccctggagttcgagagcagcctgagcaacatggcaagacccccatctctaaaacatttataaaaattagcagggtgtggtagcttgtgtctgtagtcccatctactcaggaggctgaggcagaggatcgcttgagcccaggggtttgaggatgcagtgagctatgatcatgccactgcactccagcctggggcaacagagtgagatcctgtctttttttttttttttaaatgcttatttaaaaggccatta

SEQ ID NO: 644985 - DNA, 276 bp, Homo sapiens
cccctctcacagatccagcagcatcctgccacggggaactcacttgcgatagctcactcaaggcatggccagactcgtgaccgagtgcatgaccggaacgtgaagaatatgtaccctcctccttccttcccctactaacacaagctgcgcactggtgcaacattcttggcggcggtgcctaccccccagcctgaagcctgacagagctactaactcccttagccccagcactcccatcaccagcctcaactgcaaacccatcaccaatccccacta

SEQ ID NO: 644986 - DNA, 128 bp, Homo sapiens
tctagtcgtgacggggatactcaggaagtaagagtagaaagttgtacattagagccttttacttacagtttgcctaccttttctggggtggcacccgagggatgccttagggtctttataagtagatt

SEQ ID NO: 644987 - DNA, 128 bp, Homo sapiens
atcatctgtatagtcagtgcagagataatcatgataataattactcactggctttttaaaaaaggaaacaaaatacaaaacgggaaagcttattagttttcctcgaagaaaagttggtactcggatct

SEQ ID NO: 644988 - DNA, 423 bp, Homo sapiens
tcttttaagaaggatataataaattaaaaataattttcttgaggtcagactaaggaaaagtcaaagatatacaattgccatctctccaaatttattgattttatttatttattatttattattattattatttgagacagagtctcactttgttacccaggctggagtgcagtggcacgatcataattcactgcaacctcaatgtcctggagtcactgaagcctctcaagtaccttggactacagttgtgtgccacaatgcccagctaattttttttgtactttttttaaagacagtattttgccatgttgcccaggctggtgttgaactcccgggctcaaactatctgcttgccttggcctcccaaagtgctgggattataagtgttagccactgtacccagcccaatttactgacttaaaa

SEQ ID NO: 644989 - DNA, 237 bp, Homo sapiens
cgtcgttacctgtgggcagacagaaccgagtcatatttctcttctttcagaaagcgaacaggagaaatatcgctgaattcttttctcagcaaggaataaccctggaaaaaggaaggaatgcattcccaggaggaggtctctaaaatggccactctaggattgtctgtcttatgcagttgcaggataagggatgaaatactccctggtctcctgcagcacccccaggcttgttcagga

SEQ ID NO: 644990 - DNA, 296 bp, Homo sapiens
ccaagagaacatggtgcagaagctgacaaatcaaaagcacaagcttctaaagggcatcgaactaggcagtctgatggacaatgaggtggacctgccgatcgaggacattaatcagaatgtccttctgatgacccccccagactctgactcaggatcccaggatggctactctccctactccattgactctgagccaggaagccctctattgaatgatgcaaaggtcaaagatgagccagactctcctcctgtggcgctgggcatggtagaccgatcacggattcttctgtgtgtcc

SEQ ID NO: 644991 - DNA, 105 bp, Homo sapiens
  misc_feature (77)..(77): n is a, c, g, or t
gtgcgctgcagctccttcaagttattcttagagctggagccacaggtccgaggacatcatgtgcaaatgctacgggnccaaggtacggctcatgtctcaagacgg

SEQ ID NO: 644992 - DNA, 506 bp, Homo sapiens
ggaggcgggtgtgcagtgcgtgctggggccggctagtggcgccggagccgcacgcagccgcgtgggctccgagaggcgcgcactggggctgggactgcgcgtgcgccgccgctgcgagcgccactgagccggtcgcggcaacttcaggagtgcacagcgccgggagccatggctgatgctgctcagagacccggagccatgatgtgggctgctgccgtgagcctcagttcgatgagccggcgcctattgcaacccagctgtgctcacgagtgcccagtgcgtgcccatccgcggtatggctgttgcggctttccaggcttgcacccccacttgggaatggtgcacctggggcttagcaggcttgcctgagtgctgcccggggggaaggaacgggcggagcgacgatgatggcctagtgcgtgggagctgtgacaacaaggcgggcgtggagaacgaacttgggggaccaaggagagacaaggccccttgggagaaagaggtgcccg

SEQ ID NO: 644993 - DNA, 274 bp, Homo sapiens
aaatgcagtgcagtaatgctgtggctgagatggcacctccacgaacgtctatgtgctgggattagcgtttgtgtagtcaccaatggtgtcggtggtggcttaggcggaaggatgccaagtgtgtcctgggagcttggtttggatggtggtaatctgcaaagatccagggtctggtacaccccacaggccaagcgtcctgagctgaatgcaccattgattgcgtgtctttggcattgcctgtggggactgctcacctccaagtgccagggttgca

SEQ ID NO: 644994 - DNA, 463 bp, Homo sapiens
gtgtgtcatgcagagcgcagctttatgtcccgcccagccggccaggtgaaggaagaggcacgtgctcctcagtagcagccggaggcaggggggaggtcggaggtcgtgcaggtggtttgtgtatcttactggtctgaagggcgcaagtgtgtttgttgtctgttatgtatcttgtccttctgatcggagcatcacctactgacctgttgtaggcagctatcttacagacgcatgactgtaagagtaggaaggggtgggtgtcagcggatcacttggcatctttgaccaccttgaaaaattacaccctggcaagctgcgttaaagccttcccccatcggtgtacttgcagagttgagctggcaggggaggggctgagagggtgggggctggaacccctcccggggaggagtgccatctgggtcttccatctagaactgtttacatgacgataagatactcactg

SEQ ID NO: 644995 - DNA, 691 bp, Homo sapiens
  misc_feature (518)..(518): n is a, c, g, or t
gggggcgcctgagatctctatccgcaagggagggcgatcaatttggccaagcgactataacagggactatccggtataccttctgtataaggaattctctagaagacctttgcaaggagagcaagctggacccgggaaccggccgagctacctatgagcagctcatagaccacacgccggtggtgtatcaggatagaagggaagatccataggcagatgcgccaaccctaccgatcctagggatagctgtgcatccacgatcgaatattggtataacgctagatctgctcacgaaaccctataaatcccgtggctgatcgaactgttagtccaaagaggaacagctctatggacactagaaaaatgccttgtaaagggaggttaaagtattcacccccatactgggcaaaaactcagccacgatttctgaagccgtcaaatttggcccccacttccgtcattgaggccattaaacagataaaattgttattgcgccaatggcaaccacctaatacctnttgacggttcttcgaccgaacttatatttagcttaaggatcccagcggcatcgcacaataatgcatataattgccctgttggaggtctatgacactttgtattacatttccctaccgggtaaaccatgacgtacctggggtaatttccgccaccccagtttttttttcccgaa

SEQ ID NO: 644996 - DNA, 332 bp, Homo sapiens
  misc_feature (178)..(178): n is a, c, g, or t
gctgactctagaggattcattggatagcggatagcggccaagtacgtgatcgatgtggacacagcgttctcttgcacctccctggacgccgtggtcaactatttcgtgtcgcataccaaaaaggcgctggtgccattccttgttagaccgaggactgcgagaacggtgctaggctacngtggaacgccgataagggagaatggcgagacatgtgtgggtggcgccctccgctccgggcccaggtcctgcaccctgcacaggtggccccaagccgctgtcacctgctctagacaggacaagctgcccccactgcccctcatcgcttattcaat

SEQ ID NO: 644997 - DNA, 239 bp, Homo sapiens
cccacagttttggtgtgtgtacttcggtaaatttctttgtggccaaatattctctgaacaactcacaaacaccagcttgaatcctgaaaatagcttggttggtgacggttctcaagtcaatgacacggtagtctaatctggtgtccaagttgaccacgggcaaacctgcagcttcagcttcagcttcggaacgggaggcatcttccaaaaggattggcaatgcttctggagtctcggaa

SEQ ID NO: 644998 - DNA, 595 bp, Homo sapiens
  misc_feature (226)..(226): n is a, c, g, or t
  misc_feature (229)..(229): n is a, c, g, or t
  misc_feature (232)..(232): n is a, c, g, or t
  misc_feature (237)..(237): n is a, c, g, or t
  misc_feature (246)..(246): n is a, c, g, or t
  misc_feature (248)..(248): n is a, c, g, or t
  misc_feature (259)..(259): n is a, c, g, or t
  misc_feature (474)..(474): n is a, c, g, or t
  misc_feature (480)..(480): n is a, c, g, or t
tatgtgtgcccaggctggagtgctgtggcccaatctcaacccaccacaacctccaacctccccggttcaagcaattctcctgcctcagcctcccaagtagctgggattacaggtgcctgccactacgcccagctaattttttgtatttttagtagagatggggtttcaccatgttggtcaggctggtctcgaactcctgacctcaggtaatccacccgcctcgacntcncanagtgntgggattgnangtgtgagccantgcacccagcctgaatttgaacttctaaagaggtataatttggtgcaagataggtggaggttagaccaaagggagcattttctagtggtccgggtaggtaggtgccagaatagaaaaaaggaggccagaacattttagaggtttgagttcgaggctagaggcagctcagcttcctgaataagcctaggtagaggagcagttggcctgcgtgaggnggaggngaggaaggctgtgggcgggagaggagaacagtggcggagaagcaaggctgaggaaagggaaggcagagcgggaggagcctaggagggagaccctgagaagagaagggaggacata

SEQ ID NO: 644999 - DNA, 794 bp, Homo sapiens
ctgtttgaaggggcccacgagttgtagtgcgcgggataaacgctttcgatgcaaccaagcttgtaagaggcggactgtccctgtcttatgaagatctgggtagaaactcactctaatgaaagaattccggggatgtccagtgacagggaagccatatgcgttactgttgcagaagggataagctcgcttgcatgagagtgaacgtatggaaacgcctggacgacaatcaggagatagacagcgctctaatagaagggatacagacaacggctcgactgcacttgccctcgcgtcttcagaaaacagctagtagtagctccagaggaagtgtcgatggagatagagtgccataaccgcacaacaagagaagagaacaagtcatacaagacgcgccagcgaggttacctacagcgagaatagcgaaataggagacgaccctagtgcgatctgcgtgtctgccgaacccaagaaaaagaaatcctatgatccaaggaggagttggatgaagtagcgatccgttcgagagtagaacgcgcttggcagcagccaggatgcgccgatagacggaacgagagtcgacacccaaggaggagacagcgccaatgaccgctgacggaggcaggaccacagaagtggctgcaaggaaaagaggtgattctccgaagaaggagccggtcagacagtgggcctgaagaggccggatggcaagagcagctccaagaagaagaaaacagttccataaagcatcccaggaagagtagaatgcaaatgacagttctcgtgggatacgggcc

SEQ ID NO: 645000 - DNA, 486 bp, Homo sapiens
  misc_feature (319)..(319): n is a, c, g, or t
tggtattacagatctatatgtcagagaaaataagaatttcagaagaaaagaatcctatgtcagaatcagaaatatggaaaaatgagaaggcccaggaatggtgctccatgagattacatggagagtattgggttgcaggctgtttggaggtgtaaaacctttaggcaggaagagggtgaggtgtgggtgaaaagagctgaggagcatttcaagagaaacgttatcagaaaaggactctgcttcaacaggagagtgcaggtgacaccggaattccacatcagacctgtggacacttgaggtaatggcaggaccgtcctgngtaggaggcaggggacctggcagagaggggaagctggaggtatgaggcctggaaggaaagtacatagttacgtgcacagtgaagggaaggaagagggctgaggacagaatcctggcacaggcaaagaagtcagtgaagaaagatctaatgggaagggactgggtggc

SEQ ID NO: 645001 - DNA, 376 bp, Homo sapiens
ctaaacagcttataggggattgccctaatcctaataatcggggtgaattaaagggtctaagggctttcccaacatcaaactcctaatattactataacactaaaaaacacattcacacaaaatattatcttaaccactccgactcatacacaaataaacactaatatcaagtaacaacgcaaatctccccatttaatattaactcaaacatcatcactagtctaacattactctcatatttacaatcttccactcacccaaatacaacaaattatcaaatcacatcactaattcatacttccttaccccacttctcgcaataagcatcaaacactctcacacaattccctcctacatactctcacacctttacttc

SEQ ID NO: 645002 - DNA, 1302 bp, Homo sapiens
  misc_feature (541)..(541): n is a, c, g, or t
tctttagagggttgctcaaatcccgtgtgtgctacatcatatatgtccgatgtataagttgtgaaaatatattattattacctctaggaggagtttttccaccagggtttttagcgctaacccgtgaatgttttcctgtggaaggtccatgaagacgactatattccttatccgggagggccgttttcaccaggcctctgttcctggcacaaatttttgggtgggcacaaaattctgatagtcgttaggttgtcaccccaaggggccactatttgttaagttttgggccaaaccggaaattgccctttaaagttggggtaaaaaagggccattcttgggttttcccccctaatggatcttaaaatttgggtgacacattgttgaccacatgtcaatttcccggaagatttgggcgtttttacctgttgatgtaagaatggagagaaatttaaggtgtgttcccataattccgtattacccattaccctggtaataagaaagttccccaaaattttagagtttgttttaaaaaaattgctgnctccaccttaacataaaatttttgctgttttgtgtaaaatagccttttaaaaaagcccataaacatgttacaaaaattgttaagataacactggtttaatttctaaagctatccctggtggttttatgaaaaaatggttacaagagactgaggcacggagaaatgttttgtaattaagagaaaaggtaatttaacccggagaagatatgaggaaatatatgagtaatcttgccgaaatataagggccccttcacaaagctcttaataatatacggttaaaagacctcttggcccacactttttaaaaggaccactaatattttagatatttcctctttcacagtatttttcttaaaacacccctctttgtataaccacacaagtgttcttcgatagtgatcccccctcattatatttgggttttcttgtttatagccacttgattggatttctgtgataaatgcacaggcacattacgcacatagtgagccataattgtcgagttgtttccttgtgttgcttgtgtctcttttttggggcacttcacttgaaacacattcactttgagaatagcactatgtgtgtcttgaagtactttgtttttagcactaaatgttgggcacttttatcttaagtgtttggatggaaacactttgtgttgtttagctcttcactttgctttgtataatttaataaatgacccttattttccacggaagcctacattttgtattgccaccataaatttattttaagctgta

SEQ ID NO: 645003 - DNA, 647 bp, Homo sapiens
tccaaaccaaggctgtatcaggtcgttcgctggctgagggcatattctagggttgcagatgtgctagtgtgcccgcgcatggctttgctccgagcaagtgcagagaaggcgacgtgtgaggctatctaccatccctcctgtacaaagacactaatcctggagggtcaagggccgacttatgacttcattcagccttcattgttttctgctgaggacccatcatcccaaatccagccactaacagggttgagtgtcttgaacatgaaggtgcgaggcggggaggccacaagcatggagtcgcatgacagacgactgccaagaggacatggttgttcagagcaagccatctgagtcaagttgcaggcgcctcagttcagcctcgaggcatgcagtggagtgttgcaagtgttcgagacggggcctagctgctgggctgactgtcactgtgcgggagagcttcaactggaaaccctaatcactagctttcctgctagtagaaaccaccagtttacttaggaatctcagctgactgggtgcctcagtcagggctgtgcagagaaacagcaggagagacagagattgagatctcaaggacttgccttctgcagtgggtgagtccagcgggcaggtctggactccgtggacag

SEQ ID NO: 645004 - DNA, 122 bp, Homo sapiens
cggttattagaaacgttggtcttgagaaacaatcactgaagataaaggctacttgggagtgccagacgggtggatcacttgaggccaggctggtctcaaactcctgggctcaagcagtcctc

SEQ ID NO: 645005 - DNA, 140 bp, Homo sapiens
gtcggtaccatctccctctctcacgcgcatatctgctctttccctctctcacggtctctccttttcttctctgtttccagctgttgccgctccagctgcttctgatgcttctcctcccgggcctggctcttctgatgcag

SEQ ID NO: 645006 - DNA, 198 bp, Homo sapiens
ccacctcagcctcccgagtagctgggactacaggcatgcgccaccatgcccagctaacttttgtatttgtcatagagatggggtttcaccatattggccaggctagtcttgaactcctagtcttgaagaccttgtgatctgccctccttggccccctaacccggctaagtttttaaaagtttttgtagagataagggt

SEQ ID NO: 645007 - DNA, 153 bp, Homo sapiens
  misc_feature (11)..(11): n is a, c, g, or t
  misc_feature (22)..(22): n is a, c, g, or t
  misc_feature (75)..(76): n is a, c, g, or t
  misc_feature (87)..(87): n is a, c, g, or t
tgtgtgcatgntggctcgaagnctgcctcagtatcacccaccttggctcccgaagtgctgggattgcaggcatanncactgcacctngcctttcatccaccttagtcatcacttcctttcttctcttccagttcattgcaacacggtctctca

SEQ ID NO: 645008 - DNA, 115 bp, Homo sapiens
tttttttgaaaaaaaaacccccccctttggttggggggggggaaaaattttttttcggggggaaaaaattggcgggggggggttttttgcccttttaaaaggggggtcccgggta

SEQ ID NO: 645009 - DNA, 83 bp, Homo sapiens
ggtcacaatcctttgatatctccagctcaggtccgcgcaaggcactcggaggcggcccgggcccggccgggggagcgggcgcg

SEQ ID NO: 645010 - DNA, 368 bp, Homo sapiens
  misc_feature (127)..(127): n is a, c, g, or t
  misc_feature (289)..(289): n is a, c, g, or t
tgatatggagtctcaccctgtcacccaggctggagtacaatggcgtgatctcagcttactgaaacctgtctcccaggttcaagtgattctcctgcctcagcctcccaagtagctgggattacaggtntgtaccaccatgcctggctaattttttgtatctttagtagagatgaggttttgccatgttgcccaggctggtcttgaactcctgggctcaagagatccacccactcagcctcccaaagtgctaggattacaggcatgggccactacacccagccagtaattnctttttgtaagtattattctactttatgcgtactacttatggaccagaattttcagaagggcaagtacccctgcagcat

SEQ ID NO: 645011 - DNA, 748 bp, Homo sapiens
agcggtggaagtcagtgtggcgattcctcagggatctagaactagaaataccatttgacccagccatcccattactgggtatataccgaaaggattataaatcatgctgctgtaaagacacatgcacacgtatgttcattgcggcactattcacaaaagcaaagacttggaaccaagccaaatgtccaacaatgatagactggattaataaaatgtggcacatatacaccatggaatactatgcagccataaaaaatgatgagttcatgtcctttgtagggacatggatgaagctggaaaccatcattctcggtaaactatcgcaaggacaaaaaaacaaacaccacatgttctcactcataggtgggaattgaacaatgagaacacatggacacaggaaggggaacatcacacactggggcctgttgtggggtgaggggagaggggagggataacattagaagatataactaattgaatgaggagttaatgggtgccgcacaccaacatggcacatgtatatatatgtaacaaacctgcacgtagtgcacatgtaccctaaaacttaaaatataataccacaataaaatacacaatacataagtgaccatgctaaggagcaaacgaagatataaacagtttttaaaatctgagaatcgtaaagtatttgacaactggagaaatataaagcatatctaaacacagtcttttgcagagccatatgtgccaactgggagcctatgtacag

SEQ ID NO: 645012 - DNA, 139 bp, Homo sapiens
ctagagcatcccgtgctatcactattatctataacattatcctttttttttctccatcactttcacagattattcttagacatgcctcgagtattctgacttgccgctaacacctttttttttattgtgaaatggagtc

SEQ ID NO: 645013 - DNA, 111 bp, Homo sapiens
ccctagaggatcccggtcattttctacaccatcagaaagaattcctgaaaatttataatagaacgaactttattaatgcagaaaaataccccaggtgttaaaatatatgaa

SEQ ID NO: 645014 - DNA, 1190 bp, Homo sapiens
gccggagcccgctgcggccagcgcacggccctcaccccgtatcgcgacccgcgccccgccggccgagcatgggcgcgcgcgcctcaggcgggcccctggcccgggccgggctcctgctgctgctgctgctgctgctgctgctcgggctgctggccccgggcgcgcagggggcgcggggccgcggcggcgcggagaagaacagctaccgccgcacggtcaacaccttctcccagagcgtcagcagcctgttcggcgaggacaacgtgcgcgccgctcagaagttcttggccaggctgactgaagagacttcgtgctgggagctggactactgtcgtgcgagaccacctgatggacaacgtcatcggacccgcaacctccacggcattgtccctacgcgaacatcgaaccagtcctaccaaacactgaccccaagaataaacaacacacacagaaacatacagaggctccaaacaagcacaggaccaagagcacgacacacaggactggaacagggacgaaagaaacacacacctgaaaccataacacggcagacagaagacaccaagaacacacacgagaacaacaagaaaacaaaaacgacgacacgagaaaaagatggaaagaaccgaacacagccaaaacacacagagaatacaaaagacgataaaacaccagaacagcggacagagacacaaaaagaatacactagcagcatagaaaaactccaatgaaaaagagaagataacagcaagagggaaggaaacaacaggagcagaaacacaacagaggcaggatgcacagcacgccagagacaacacaggggaaggcgaacacgaaacaccaacaaccacaccgaacacacaaggaagaaacacaacaaagaggcaaacaacacacagggaccagacacgacaacagggacacacaagcacggaacacccagagcgaaaaaaaccacaagagaaaacacacacaagaggaagagacgcggaaaaaacggacagggcaaaaaaaccaatgagaaagaaaaggcagaacgaacagcacactgggaaacaagacgaactcgacggaagcagcagaagcaaaggcgaagagacatccaaagaacaagaaaggggaacgaccgaacacacaagagaaacaaacagcagaaaagagaacacaagaccgacacaacagacagagag

SEQ ID NO: 645015 - DNA, 100 bp, Homo sapiens
tacgggacccctgcccgctcgcggacagatttgttatccctgggatcatgagcgtcggtcttgcccacaggtcctgtgctgcgacgcacatacatacgtg

SEQ ID NO: 645016 - DNA, 232 bp, Homo sapiens
ttcgatgtgcagaggaataacattgccctggccttggaggtcacttaccgggaacgctacataaagcatataaggaggtaaagaatcgcctggactaccacatctctgtacagaacatgatgcgtcgcaaggaggaagaacacatgatagactgggtagaaaagcatgtggtgaagagcatttctgtacagcaggaaaaggagaccattgccaagtgcattgaagatctaaa

SEQ ID NO: 645017 - DNA, 291 bp, Homo sapiens
gggggggggggggtggggggggggggttttttaaaccaaggcttttttttttccccccctttttcggggggggcccccccccccgtttttttccccccttaaaaaccccgggggcgcttcccccccccggttttttcctggggcgggggggggggtattttttttccccggggacccctttgcccccttggccctttttgggggcccctttaaccccgttttttccaaaaaacggggggggggcgggccgggttttcccggggttttttgcccccccgggcccttttttta

SEQ ID NO: 645018 - DNA, 222 bp, Homo sapiens
  misc_feature (52)..(52): n is a, c, g, or t
gctatttaaagcaccagtctggggtcgcctgggcccctgctgaccccttccnccagagcagccagcccagcccgggaacaacccgaaattcctctcccttcggaataaaagcctttgcagagtcaagctccacttgaagctcactcagtaatatcctttcaatgtgttttaaattgttttgacggccttttttgtagaaataaaaattgcccttagaattta

SEQ ID NO: 645019 - DNA, 605 bp, Homo sapiens
  misc_feature (587)..(588): n is a, c, g, or t
ggctcggccctcatgcccatgtcacaggggctctgtggggccgctctggtgaagtccatcaaatcaggattcatcccgagttacaacacctctgaggcctgcaagagggctacgccccagcaattaccccacggatctatctgcatgagctcatgcatgaagcctctcactgatttgctatttgtaacaacggcacaaggctggagagaggctaaatgttctttcatatggcatgtcctcacacagatctcctgacacaggcatattttcactaaaacaacaaggcacacagcaatacaatgtgtagcatgactttgtgcaggaaaggggcaggagaggaggtgccacctagtgttctctgcaggatgtgcaggcgacgctgcagcagcagctgcgtgtttctctgggatcctttggattgttatgctccacaaactcagaaatacactacttatcccagaggcactggctggccatgtctctggttctggggagtaagggaccagcccagctgaggacgcggtggacagcccagggaggaggagcactcactgcaggaagagcttcttcatcatgttgtgacatgnngtgaggtccgagctcct

SEQ ID NO: 645020 - DNA, 165 bp, Homo sapiens
tctgtagtcttatttcactacagattgaactagggagataattttcttcttcacagacaaagatctttaagtttcttttctctgattatttgatcaaggaacaaagctatattacaagacatggcgacaaaatccaggctgttcatttactagccaacccctcaa

SEQ ID NO: 645021 - DNA, 223 bp, Homo sapiens
taatgtggtggtcgtgcaggtaaaggcttactaaaagtgtgaaaacttaggcttggattaaggcgacagggatttctaggatagtcagtaaaattaaatattggtggaaaatgataatgtgtgtaaagggaaggttaatgggttggatattggctaggtgtgggccgcttccaattagtgtgcatagagtagtgtggcctgggcgataatgtgtttagcgcgg

SEQ ID NO: 645022 - DNA, 1052 bp, Homo sapiens
gcagcctcgctccgtgccttctgcgcgcctgggatccctggagcctgcctagtgttctgtgctgctcccgcccaggccggtgcccgccgccgctgcgccccaggcaggtcccaggcctccggctgctcccggcctgaagccccgagtgcgagatcgagcgtccctgagctgcctgacctgcagccctggatcagcctgcggcagcgctggcctggaacagagtgtgtctgcggttgtacagccctgcgaggcctcggaagaggagctgggcctggtgcacagcccagagtatgtataccctggtacagggaggacccagtgttcctaggcaaggatggatgctgcagggcgctgtccggacagttcgacgccatctacttccacccgatgtaacctttcactgctgcgcggatgtccgcaggggctggactgcagcttggtggacgctgtgctcacctggagctgtgcaacacaatgggctttgccactgttgaggcctcccgggcaaccagtggccagagggtctgtgctgccaactgggtttctgcggtgtatcaacaagctttggccattcatgcagcttgacctatgccaagcgagacaacaattgggctacaacgagtggatcccctcggtcgttgaacttggtgctgttgccacccattgtctccagtgtggatcccaaggtattcactttgggaggaattgatccccaagcgtccctttcaacttttacattccctttgggaaccccgtggttaatttgatgccagttggacgcgcctatcctatggcgaccaaatttcctcgtttgccaacaggaacgttcaaaggaagttcgcacgcgaccgagcagagtatgggaggcgagggcgctacccacgtcgcgcacctaccgggaattaacagctatatgtacaaatccccccttagcccccttgtacacgccaagcgcgtctagcgccaatgctgttaaccacctgccattagaccattcacgtttggacctatcgctctattccacttgtcagccgtagacgtggatcccgaac

SEQ ID NO: 645023 - DNA, 107 bp, Homo sapiens
  misc_feature (28)..(28): n is a, c, g, or t
aatcattggctcacatggagcttttagncaagtgctcatcgccgtgcacagcccaacactatttcttattcatctctcttcaaaattgtccactgaaggcaattcca

SEQ ID NO: 645024 - DNA, 603 bp, Homo sapiens
actgtaccattatttggttcctggagttatacactaattttcagtatattactgttaaattaccaacacaaggcaatttatttgaaagattccgtttatcctgccatgtgctctgaaaagcagcaggaaacgaaatccttgtgactgtgtatcagcttcttgcagagcatctctgttttccttgtgtccttgtgtttcctacctttgtgaatcagattccgttttagtcaggaagacttctgtgggaccattcttagtaacctgaaatttcttttttaatggcatgaagtggattgatcatgagcaaatgatgtgcttatttctccctcactgttggaatatctttgaactgtgctgtttttcaactatggggcagcaacaaagtgttgagaggataccattatttaaatcagtaagttattggtattactcttataacattagatacctatatttaaatgaaaggccaattgtgtacactatacattcatattctctctgtgcccaagtttaggacatgttaggatataggagacttaatttcataataatgagagcattttttattttactaaaggcatttttataggtcaactatctttc

SEQ ID NO: 645025 - DNA, 184 bp, Homo sapiens
  misc_feature (153)..(153): n is a, c, g, or t
caattataaagatctgtagagcaaaagactccatatataaggtataaagatgacagactggaaaaaaatattatctatgtatataaagaatacacatccacagattccgtatcttctgggatgtaataaaaaagccacctcaaaacaatatgnaaaatgccaaaaacctcaaaaggaaagtggc

SEQ ID NO: 645026 - DNA, 1011 bp, Homo sapiens
gcctgttttaaacgagtttcttcaactccagtcagaccaggtcttgctggtgtatccaggacagggtatggaaagaggggctcacgcttaactccagcccccacccacacccccatcccaccaaccaaggccccattgctaggaaatgaacgaggccacttccttcggataatcctgctggaggagagattattagtgacatgtgcagttgggttgcttgctagaatttatttaaaaaaacaagcaatttaaaatcttatttaagttccaccagtgcctccctccctccttcctctactcccacccatcccatgtgcccaccattcctcaaatccatctaaagagaagccgacatgactttggaaagggaggcgctggggtagaacctcccagtgctaatctcccctgggaccgtcgccgaggaatcctctctgcccaattctgcgagggtcgtaggacaccatttaggaagccatcacggtcgtccttaagtacgccgacgagaaccgtgtctcacaccaccttgggccttagaaagccacagacaaaggtagatgccaacctctcctgtcaaagagaagtactcaccgcaacatagagagacggcggagcccaaagacacaggattaacctacaaagaagaggatgccacccaaacaactatcagttaagaagccagatagaataaaacgatccagccataacaattaagataggtggaatggcctgcctgcaaactgaccgaaatgcaataccccaagaatggccgtagacaaagcaaactgtgggatagatgccaggactaacaagaggacagggaccaaccagacgactaaacagcaagtgaactggctaaataccatgatcgttacaagcgacaacaggggaagggagacccacaatccgataacacatagaggacgacagcaacaaagtacaagtagcaagtaacaaacaggggaaaaaactaaaagacacccggtgcgttaatagctgcacaagttgcttggt

SEQ ID NO: 645027 - DNA, 97 bp, Homo sapiens
cttgttccaaaaagtagtaaccggatggaattttggtatttacaggcattggtgctaaatgggaccttttatgtgttaaaataaaccttgtttttga

SEQ ID NO: 645028 - DNA, 954 bp, Homo sapiens
  misc_feature (25)..(25): n is a, c, g, or t
  misc_feature (74)..(74): n is a, c, g, or t
  misc_feature (115)..(115): n is a, c, g, or t
  misc_feature (123)..(124): n is a, c, g, or t
  misc_feature (126)..(126): n is a, c, g, or t
  misc_feature (131)..(131): n is a, c, g, or t
  misc_feature (150)..(150): n is a, c, g, or t
  misc_feature (171)..(171): n is a, c, g, or t
  misc_feature (181)..(181): n is a, c, g, or t
  misc_feature (193)..(193): n is a, c, g, or t
  misc_feature (200)..(200): n is a, c, g, or t
  misc_feature (211)..(211): n is a, c, g, or t
  misc_feature (227)..(227): n is a, c, g, or t
  misc_feature (259)..(259): n is a, c, g, or t
  misc_feature (261)..(261): n is a, c, g, or t
  misc_feature (267)..(267): n is a, c, g, or t
  misc_feature (278)..(278): n is a, c, g, or t
  misc_feature (281)..(283): n is a, c, g, or t
  misc_feature (334)..(334): n is a, c, g, or t
  misc_feature (344)..(344): n is a, c, g, or t
  misc_feature (346)..(346): n is a, c, g, or t
  misc_feature (348)..(348): n is a, c, g, or t
  misc_feature (375)..(375): n is a, c, g, or t
  misc_feature (392)..(392): n is a, c, g, or t
  misc_feature (423)..(423): n is a, c, g, or t
  misc_feature (463)..(464): n is a, c, g, or t
  misc_feature (466)..(466): n is a, c, g, or t
  misc_feature (476)..(476): n is a, c, g, or t
  misc_feature (483)..(483): n is a, c, g, or t
  misc_feature (537)..(537): n is a, c, g, or t
  misc_feature (573)..(573): n is a, c, g, or t
  misc_feature (687)..(687): n is a, c, g, or t
  misc_feature (708)..(708): n is a, c, g, or t
  misc_feature (761)..(761): n is a, c, g, or t
  misc_feature (827)..(827): n is a, c, g, or t
  misc_feature (835)..(835): n is a, c, g, or t
  misc_feature (949)..(949): n is a, c, g, or t
gcaactaatcccaatactccgaatnggtcgcaggccgacagcaatcccctgaacgcctgcagggctcttatcangcgaaggcatccactgtagaaagaggcgacacaactctacncccaaaanncnccaanaggcccctcaaagcctacngaacaaaaacatccttcaacnggaaggaacnggcgctgttcanagaaagngaagacatgcnccgctttaaaaaaacnatcttctcaactcttgaaaataaacctctttncnctcgtncccctggaacngannngtccttggagaaatatcgcaaacagaacttccttcaatgcaaacagatctncaaatataantncntcaatatcgaagaatgtttcaaaaacnctctaaaagtccccgcnttgattcaatgcctagacatgtataaatctnctctagctgccaaatacctcctccatagcttggttttttnntnagcagtttanagttctngttctgaaagacatctcacatatattcaaaagatcttcaggatggagatttttngatgttttgctctgaccgaattaagccacggcagtnataccaaggccattcgcacaactgcccactacgatcctgccactgaggaattcatcatacattcccctgatttcgaagctgccaagttttgggttggcaacatgggcaagacanccactcacgcggtggtgtttnctaagctgtgtgtgccaggggaccagtgccatgggctgcatccctttatcgtncagatccgggacccgaagacccttcttcccatgcctggagtgatggttggcgacataggaaaaaantcgggcanaacggtctggataatggtttcgccatgttccacaaggtcagagttctcgccagagccttctgaaccggatgggagacgtcaccccgagggcactatgtcagcccctttaaagangtaag

SEQ ID NO: 645029 - DNA, 498 bp, Homo sapiens
  misc_feature (26)..(26): n is a, c, g, or t
  misc_feature (34)..(34): n is a, c, g, or t
  misc_feature (38)..(38): n is a, c, g, or t
  misc_feature (61)..(61): n is a, c, g, or t
  misc_feature (72)..(72): n is a, c, g, or t
  misc_feature (89)..(89): n is a, c, g, or t
  misc_feature (97)..(97): n is a, c, g, or t
  misc_feature (170)..(170): n is a, c, g, or t
  misc_feature (372)..(372): n is a, c, g, or t
  misc_feature (410)..(410): n is a, c, g, or t
  misc_feature (432)..(432): n is a, c, g, or t
ctccccccggacccctgtcccttccncccccccnaaancaccccccctaaaaccccctccnccactttccantccctccaccaaaaaantaattgancaccctccctctagccgctggggaagtccccacactgaaacaaaagaaacagaaaacccctgtccttccccancagttgagttcctagggccagggagaacagagtttaacaagataaggaaaaatatatatgtagtatgcctgccaagttaactgcctgtgtgggaaatcccagcagggggtgggatgtgtgatttgaattgagggccacactgccccaggtcgtgctccgtcaaggggtgacaggagcaacaggggtggctgagtaagggctngcagctggaggcaacagcacatgcaaaggccctgagcnaggatgtgctgcaataaggccntgagggggacagtgtagttgggggtgaggaatgtattaaaagatgagattgccttctaaaaaaaaa

SEQ ID NO: 645030 - DNA, 219 bp, Homo sapiens
gtctgccttctgccaggcttgtcagacatacttctggtgggcactgagccgaaactttatgatcaaaaacccctccctgggttcctttgaaccacttgacatcattttaatttccttctcctggcgtaagggggtaagggccaaaaaatgcctaggcaattttgaaaagaggttactttgccttaaaacctaattttttactaccagctcctaacgttt

SEQ ID NO: 645031 - DNA, 2012 bp, Homo sapiens
agcgggcttacgcagtcccagcctccgcggcgcccccaaatgccgcactgttgcgtcatctcagcacatccctccttatcgcacatgcccacacaccacacaaccacgctacacaccagccgagacaagcacgacaagcgaacacacccgcaccgccacacgcacacagcacagcgcccagaaagcaacggcaacgcaaacgcgagcgactatatacacacacacacacctccacaccaacctaaattcacacaagacaaaaaaaccacctcaaccaccaacacgacacaccctacacataaaaaccatcaacacacaccacaccaccacaccaacccacacacaaaaaaaaaaaacaccacaccctacaaaaccataaacacccacctacccaccaacacaaccaccatacaaacaaccacacaaaccatacacaacaccacacacatcaataaacaaaaccacacatcaacacaacccaaaaacgaaaagcagagccgacaaaaacaagccgagctacagacacgaggcaacgacacagagacgaggaacggacggcacacaagccgagacaagccacaacacacgcggaacgcccaacacaacaacgaggacacaccagagcaggagaccgcgacggcgggacgaggcgcagagccgaccgcaaacagaccccaagcccagcggctgccgacaccccacgacgcgacgaaccagcaccgccggcaagccaggggccaggtaaacggacacagacgccgcaggacgacacatgccacgacgcacaacaagcggccaggccgcgagcgacagccgagaccgacgcaacagaagaggcgcgcacaagcgaccaggcacacccccccgagagacgacggagaactaagaagaagaaagcacgcgaccaggcggactcgaggagcgacaggcaggggccacgccaggagcaccgcacatgcgcgacgagcggggcacaccagggccgctacggcccacaacaagggacgggctgatagcacacccgaaagccggagcgaggcgcgcaaacaagaacagccccatgcgatcacggagagccacgcgcgaggggagcgagatgaagcagacgcagcgcggcgggagggtgcagagcggcaacggcggaggcgaggcacggacagcgcggaggggcccaggagcagacaaatcggagagacgaggacgcgggcacagcgcagagacgagggcagataggcagatagcgaagacgcacagccagacgaccgggacccgcgcagagcccacccgccacgaccacagaacacagagagacatcagcccaggcgcacagacgacgaggtgaggagacagacgccagcacacaaaacgacagaccctgcgacgccaaaggcgccgcggatagagccccagcccaggtcaacgaggacggagcccgctacacgacacgagcgagcggcacgaggccacccagcgccgaggccggcacagaacccggccacgcaccgtgagaccgctgctcacacgacgcacccgacaagcgacaacgaagactccagagaacgaccgacagaacagacagcccgaaaggaacgcgagagcagacgcaccacccaacggacaacgacggaagacagcgaggagccactagaggcgcagagccagaaaccagcgagtgaggagagaagctccgaaagaacaccgatgcaccaactaccccagaccccacaccagacgacagccgccacagcacgacagaaccatgcgcaggccgcgcacggaaacaacgtacgcgggacaagctcgacgcgaacacgcagcgagaaggccggagcgacggccgagcgcgagagcgcagcaacagtgagagcggaacgacaccggggagcacgcgggctgcacggccggacgacagaagcgagcgagacacgcgacgaggagacggcccgatggcggccacgggagagggggaagacgaacctcgggacgcaatcgagcgccccgctcgccccaca

SEQ ID NO: 645032 - DNA, 404 bp, Homo sapiens
cacagtggttagtttttgtgcgggattcggtctcctgagatgccggcgaggggtcgcccttaggctgagcgagatggtgctgatgttctaagcgggtagctggaaatgtgaacggctgcggatctgtcgcaagatccacagtctcagagactcggcagcaacttccatgtcttatgatccagagaagctccaaaaagaaagcaggagggagaggggaaaaacaatactacattctcagcagagggctctgcgttaccaaaaccacccgcaacaaaggaatattcagtgggatagtttttaaagggacactcagttgccctctgccttttccccatcctcttcgttccacaggtctgaaagccctggtagctcttcctacaggccttctggcccatcagggcagt

SEQ ID NO: 645033 - DNA, 136 bp, Homo sapiens
atccgttacaccgctacggtggcaggcacgctctctgcccgtgagcattcaggtcaggccgtcacagccgtcttcaggtcacctccaggcacaggccgcgtgcggggggatgtatgggctcctgctgccttggggg

SEQ ID NO: 645034 - DNA, 508 bp, Homo sapiens
atatacaacaagtttcacattatgaagtttgttatataatgtgcctacattatccctagttatatatccgactctgtaggctttcttcacagttaaatacagtgagccagctgctttgatttctccatgtgatgtcctgttacagtctgactgtgctaaacacatatcatgggtacattgtaagcagaagggaatggggtgtagacttcctctgaagctagatccacctatctcctctggataattcaggccaagaacctgctcagccatctcagtccactaaacagtccttgcatcatttctttctgcagttatgaagttacaaaatgactagaatggacttcaacagtcctctaagaggacagtctgtcaggatcagatagcagctgctcaacataaaagatatcttccctgatgataaattctgatgtgtccttttcattacatttcaagttcaacatttcaaaataactaaatctaacagcaaatgtgtaaaagacaaaactac

SEQ ID NO: 645035 - DNA, 555 bp, Homo sapiens
ggaaactgagtatgagagagggtgcacgtctctgactcagaaaggaaaattggagccagccgaagaggatacaaaggtgtatactagagaaacactcagacagtcggtttaaatcggacagaagtcctaggcagctgtcatagctggtggagttgttggctttctcttggcaatttttcttatcctgctgttggtgtatcgcatgagaaagagggatgaaggaagctatgaccttggagaacgcaaagcatccagtgctgcttatcagaaggcacctactaaggagttttatgcgtaaaactccaacgtagggtctctatttatgagatcactgaacttgtcagaataaaggtgttgcatagaataatgaagatcttggtttgtggttttcattaaggagccattctggcagtttaagtgataaaatcccatcgtatttagaacatttgatgtattgcttgagagcaacataaagttaaaatttaacatctgcagtgttctgtgaatagcagtggcaaaatattatgttatgaaaaccctcgatgttcatggaat

SEQ ID NO: 645036 - DNA, 241 bp, Homo sapiens
gatgacaaagatgcacagtcccccgggacacaaggatcattcacacctacagccatatcaaccccagtgacttcaagtcaatatcctccgtctccctctcgaacatctacaccttccgtttcccactccatggaatccgtgtcaatggccgagatcgtgggagctgtgggccatcagctgtcggaaccgggactccttttccaactgggattccatctgttccttgagctccttcagctcg

SEQ ID NO: 645037 - DNA, 189 bp, Homo sapiens
gcctttaactagcttggatgaaggcactccccctccccagggatttctctgcttgcagcttccaggtcattctacaggtgccctagaatatttctctcaacggggaggagagcggtcagatcacgtcattcaccgcataaaaactaccagtgatgcccaaggtcacaagtccatacagccacatacggc

SEQ ID NO: 645038 - DNA, 1205 bp, Homo sapiens
gtcgctccagatgctcttgacgattccacagataccccgaagccatggcaagcaagggtttgcaggaccttgaagcaacaaggtggaggggaccgtccaaggaagccgtgtcagcggaccggagcggcaagctacaagaaacgtggctgaccaaggccaacagaaggcggggcacaagacaaggcctattgtgcacccaagcgtgggcccaaagaaccaacccagggaacaacccaattggaaccaaggcactgctaccccagggccttcaggaagaaccttaccaccaggcgaactgggcgagaccaaaaaatattttcggggccagtctctatagaaaaatatcgcaacaacacaagggggaaaaacaccattgggcaatatccggacaccaatccacttgaaaaacgtgtggacacaaggacagggcgaaaataaacctttgtgagttgtaccccccccacaattatccacaggtacggcaacaatagtaaagcgaccacaaattggcattgtggggcccccacaaaggaaatctcatccacgaggtgacccaaaggcgcatagccccaatgccctaccaagtcggggagtcacgtggcccccaccgtgtctcaatttaaaacacgagcttagcaaggggatacacaactaaaacgcacacaaaaaaacaaagacacaacggatagatataagaaatagaaagaaaacgcagaggggagtgcgaccgaggcaaacccgctgaggcggcgccacaagcggacgaaaggaagaggcgtcagcacaaagagaagacacggagaggaaggagaaggggggagcaagcagagagagagaaaaacagaagagggagagcaatgaaaggaaaaaaacagcacagtgagaacaagagagcgaacgagagcaaccaagaaagaggaaagaaaccaatctggagcaacacaaaaaaacaagaaggagagaaagaatagaatcacaatgtttatccccacaataaaaaaacaaacagtaggcggcccgcgagagggagacgaacaaacaaagccagggaagacaaaacaaaaacagaccgcccgaagagagaggagcgagaaacaggagaccccaagaaaacggcgggaagaataaaccgaaaagaaaggaaagaacacagagacagaccagcagcagaaataaaagaacgcgggcgacccagcgacacaaag

SEQ ID NO: 645039 - DNA, 436 bp, Homo sapiens
  misc_feature (302)..(302): n is a, c, g, or t
aagtactagatacatgctacaacatgcataaactctgaaaacatatatgctacataaggtcataccagacacagaagtccacattatgtataactctataggaaatgtccagaatagacaaattcacagagacagatagtccattactggttttcaggaggtggacgaggaaggaacggagagtgcctgctaatgggtagagggtttcttttttcagtgatgcaattcttatagaattagagtggtgatggttgcactattttgtacctatactataaccactaaaggtgcacttaaaaatnactttttaaaatctgtttaagaatacaatgaatagcatttttttaaaatgcaatgaatagcattttacatatctcatttcacacaatatattatttgaaaaggcctggccaggtcaaaggagatatgtaacttt

SEQ ID NO: 645040 - DNA, 133 bp, Homo sapiens
cagggaacagcggttcgctccatcatgaagtgtgacgtggacatccgcaaagacctgtacgccaacacggtgcttgtcgggcggcacaccattgttatcgggcattggcggacaggattgcagaaaggaagat

SEQ ID NO: 645041 - DNA, 336 bp, Homo sapiens
agtgtggcatcacctgttatcccagtctactcgggaggccgaagcaggagaatggcttgaacccaggaggcacaggttgcagtgagccgatatcgaagcaatgtattccagcctgggtgacggagcacaatcctatctcgaagaatgataaaatagaaaaggcatagaagctccctgggtgtcatgtatcacatgagaatggtaagtcaggtcttctctgactcctacgacattcctctctctgtctttgcgggtagacttccttgttagaagtctatcttgttagaggggcctcgcatctagcccttggcttctgcagcagccctcgttaatcct

SEQ ID NO: 645042 - DNA, 309 bp, Homo sapiens
ggattttaaaaggaaagggaagggaaaaccaagaacctagtggttttcccagtggttggcaactttcccaatgtttgcttacttttagggttggccctgggggccagggcctgccccagggctcctggaatttcccttgatccagctagggtggggccctccctaaatcaactgggtgttgttagcctcaggcagaatgaatggcagaaagtgattctgttttcataaagggggggggacttttccctaaggcatttcagtcaaatccccctccctgtcataaattcaaataaaatgtttgaacaagga

SEQ ID NO: 645043 - DNA, 534 bp, Homo sapiens
  misc_feature (290)..(290): n is a, c, g, or t
  misc_feature (329)..(329): n is a, c, g, or t
  misc_feature (341)..(341): n is a, c, g, or t
  misc_feature (348)..(348): n is a, c, g, or t
  misc_feature (381)..(381): n is a, c, g, or t
  misc_feature (383)..(383): n is a, c, g, or t
  misc_feature (398)..(398): n is a, c, g, or t
  misc_feature (425)..(425): n is a, c, g, or t
tatggaaggcctccggagcgcacgtctggcagacggctccctcgtatgagcgaatcagcgagctctctccccagctgtattccaaaatgtcgcttctaacaagctgacgctggacaatgctggacgttaaagggaagcgggtcgttcatgagagtcgacttcaatgttcctatgacagaacaaccagataacaaacaaccagaggattaaggctgctgtcccaagcatcaaattctgcttggacaatggagccaagtcggtagtccttatgagccacctaggccggcctnatggtgtgccatgcctacaagtactccttagagccagtnctgtagactcanatctctnctgggcaaggatgttctgttcttgaaggacttntnaggcccagagtgganaagctgtccaacccagctgctggtctntcatcctgctggagacctccgtttcatgtggaggaggagggagggaaaggtcttctggaacaggttaagccgccacaaaatggagcttccggctcacttccagctaggg

SEQ ID NO: 645044 - DNA, 1021 bp, Homo sapiens
tcaatacgcgaccgaactcccgtcccatgttgcgagggtacagatatgatctggcgtcctgatactcggacgctccggtacagacaaagcatccgggcacgtacctgtcagtgtccgtatgccctgacgcgtgcgctgcaggccggtcggactgtatcttgaggagctggagggaaccatagtgctaccccaggtctgctccggcggctggccacgagtgtcctttggctagcttgacttgttacgtctgccagtaaggttggtaggacgctgtccaatacagtcgggatggcgttggtgccccatgactggttccgcccatggtatttctgggtgcccccgagtgacttgcgtgtattgcgctgtccgataaaacgtgtttcaccgcgtgttgtggacgtcgtctcctgtctgcttgtgctctctcagcgtctcttccatcggtcatgtccttgcttaatagtcttgggggcgcgcctggccgctaggcgaaccacggctcttgtcccattggtcgtatcctcgtcaccgttaggctagagccatagcgtacgtttgcacccttggcgatgccttccggttaggagccatccactctattctgctccattagcaagccttaagccacgcgctagttcggcccgtctattgattttttggagcgcctacttatggtttgcgttctaacatagtagttctttccatagttcttttccccgcgtgacacataattcacattggttcgctacatgctgcctcacctctttgcggtctttgactcactgttccttcatcactaagcctgtctcattatcttctccgtattcttcgtctccaccggtccctaggcatggcttggccttcattttttacgtacttagatagactcgaaacctcattcctccatcttttttttgatcccttcccgcgacgggggtttgaacccgttctatacctgttccttgttcttgatttacggttccgcccttgggggttgctctcttattctaccagggttcgg

SEQ ID NO: 645045 - DNA, 848 bp, Homo sapiens
  misc_feature (368)..(368): n is a, c, g, or t
tgagcgaggaaccctctgcgccatgagagccaagtggaggaagaagcgaagtgcgcaggctgaagcgcaaaagaagaaagatgaggcagaggtccaagtaaaccgctagcttgtcgcaacggggaggcgcacaggagcagaaagcactggagatgccagacgctggggatgctggtagcaagttgtgggacgtgcagtggctactgtctagagtcttggtctcaaatgggatcgtagaaccgttcatcgacccgtctgattcgccgtatcaccatctgtagactcctaaactttgcgtacatagagatcaagaatgcccatatgttgggtccatctagcccgtggacctggtgactattactaggacntattgtctgtggttgattgtgtgagccgacgtgtaacgaacctagtataataaatcgaccgtattccggcctgtatgtctagactgaatgaattaagatcgaaaataaaaaacacaaaaaaagaatctaaacaaaacattacaagaaagaaatcatgactgaaaggaaaaacgaatgcccaagaaatcaagcaagatcatcatggaaggagcaaatatccgaggcgcagggcaaagcatacattggcgtgcgatcgcggttcaaagggccggggacagatgatggccgtagcagatgagcataatgctgcataaaagggcgaacagaggttgggagatacaaatctagaagggaagaatccaggacccacaaaagggcaaataaagaccaagggagaggacgtagaacccaatgtgacagagaaaaacgacacaaacaagaaagacagcacacgacaaaaaaggagacaagaaaacagca

SEQ ID NO: 645046 - DNA, 351 bp, Homo sapiens
acatcgctagacggaggtggcctgagtcctggccaggcacagaaacgtgaatctcaccatcttcaccgcccgcctctaatacttctgggatacagattaccaggatgggctccgctgtcctgagtcagtgacggggcctccgtggagatcatgtgctactaagattttaaatattgttggtgataactttgtgtactatgataataagccattcgagccttggaccggactcaaatacaacttcctatccctggactgcatgttgcaggagattctcgagtgaggggtctcccatggcctcatggtctgtctcctctagcctcctgctcatgctgtgcaggtctcccctag

SEQ ID NO: 645047 - DNA, 700 bp, Homo sapiens
gcatgcctgtactctctttcattaaggtcttgaagtcaggctgccccctccacagtaggatattcacgtgaatactctagaacagttgtgtccaatagacgttgtaagcggcagtgcctagatatatagactcagtatagtaatactttgcaagtggtgtctatggtgccgtcgatggcgacataactcgtagatgagtgcacgaccatattgttatacatgcttatgtatacggcatacctcacaaattttgtatatctaggacagccaatgtttgggaaacagttgtatgggcataacaatatgcttgcagagcaattgcaagctgctcccacctgcgtacgacttctccacaaacttgtctcggtcataatatcccatgtctgaagatacacctgtgcaccactgaccggcttgcatcgccaaacaggcccctacaacaaagacaaaagcatacgaataagatacccgtgcgacactcgccgcgtacaaaggtgaacactgagcacgacccagacacgacacaaagaagagccacgaggcgctgccacggaaagagggcgccaaacacaaacgagagaacgaaccgcaaccagccaaaacccgtcgcctcaccacaaggcgcgctgagaaagaaggcgaaccctccccacacgacctcggggccccgactacccacgacaggggccagagacgccaa

SEQ ID NO: 645048 - DNA, 581 bp, Homo sapiens
  misc_feature (130)..(130): n is a, c, g, or t
ggtgcaaagtgccaatagtagatctcgaaggttccggggctccatgcaggctttggagataaagtgcaagtcccagctcagcataaaagcatcctcgcagggcaactgagcggagacagataaccgtaantgcgtgcactagtcccagatacagaggatgattggcagcgtgaaggagcagatggcccagcttcgttgtgagatggagcagcagaaccaggaatacaaaatcctgctggatgtgaagacgcggctgaagcaggagattgccacctaccgccgcttgatggagggagagtatgcccacctgactcagtacaagaaagaaccggtgaccacccgtcaggtgcgtaccattgtggaaaaggtccaggatggcaaggtcatctcctcccgcgagcaggtccaccagaccacccgctaaggactcagctaccccggccggccacccaggaggcagggaggcagccgccccatatgccccacagtatccggcctgtccagcctcagccccgtgtttcagtcccttccccaagcttccttgccttagggcgatagagtttgttgaatcagctaacaaa

SEQ ID NO: 645049 - DNA, 607 bp, Homo sapiens
  misc_feature (12)..(12): n is a, c, g, or t
  misc_feature (78)..(78): n is a, c, g, or t
  misc_feature (121)..(122): n is a, c, g, or t
  misc_feature (129)..(129): n is a, c, g, or t
  misc_feature (143)..(143): n is a, c, g, or t
  misc_feature (195)..(195): n is a, c, g, or t
  misc_feature (374)..(374): n is a, c, g, or t
  misc_feature (376)..(378): n is a, c, g, or t
  misc_feature (388)..(388): n is a, c, g, or t
  misc_feature (398)..(398): n is a, c, g, or t
  misc_feature (453)..(453): n is a, c, g, or t
  misc_feature (474)..(474): n is a, c, g, or t
  misc_feature (488)..(488): n is a, c, g, or t
  misc_feature (505)..(505): n is a, c, g, or t
cggtttggccantggtggcaaagccttctggtagcttaggcagtatttactgggggtgggtttggaagaaggcgctgntgcattgatgtaatttttgtttaactttaggattttgaaaaanntttcaanttggcttcattacncttaattaggaagtagttttcaagcctgtacctacctggggaaaagggctcntgatcttaatgccagcattaagacagacagaagcagcatggtgctaaatgacagaaaatccagtatttacattaggatggtaacaggaacatttaagagcatttggtcttatttactggtgggccgaaagcccttagctagacaataggggaaaatgtaccatcatcatgttatttaanannntttaggtgcngaagtgaaanacccgggggctctgtgataaggtgacataaaacccccctgtgggggtcccttaancggcggttccctcgggggggnttggggcgctgggngtgtgaacatgtgggcngtacaaccccaaaacccacccaattcattcatggtacttatggttatgccgggtcggcctggcctttgatggcgcggtattgtttgtgacaatttagacaca

SEQ ID NO: 645050 - DNA, 421 bp, Homo sapiens
  misc_feature (1)..(1): n is a, c, g, or t
  misc_feature (267)..(267): n is a, c, g, or t
ntacctagagggtactggtacaatcaattctcctacgtcagcttcccgagtacctggctttacatgctcgtgccaccattaccaactaccttatgaatttctagtacaacgagggtttctccatgttgaacaggctggtcttgaactcctgacctcatgacttgccgtcctcggtctctcaaagtgctcggattacatgtgtgagcatcgtcgcccgtcgtgtacatgctcatttgtcagtagaattgctataggtcttgcagagantgtaagagtgactcgaatacaggtttctggtgatcaaccctggtgcccaactcttcaggtcaggatagcttattggcgcagggtggatctaggctccctcgtctggtcctggcatcatcgaacctgatgtatctgccacaggtcatcgcgcacc

SEQ ID NO: 645051 - DNA, 415 bp, Homo sapiens
agcactgagagaaaagctagccacagtcaactgggcccgggcaggactgggctccctctgatcgatgaggtgataagcccagagcccgagcccctcaattcctcagacttctctgattggtccagctttaatgccaccaccacctctgtgcaagaggagagagccagcactccatctgcgcctgctttctatagccaggctccccgccctcctccctccccaagccgtcccgagcagcacacagtcatacacatggggagtactgaagccctggcacacgccccaaggaaagtatatgacacacgggatgatgaccggacagcaggcattcatggagactgtgatgatgacaaataccgccgccggccttgctctgggctggctggcccagctgctcaggagccgggctgggtcc

SEQ ID NO: 645052 - DNA, 206 bp, Homo sapiens
tgaatggatcccccccttgagtgctgacagaagtttgtagaggaaggagagctgcgacgggaatcatccaggctgcggaaccggcgtccaagaatgtagataccgtaagctgaggggtctgcgatgtgttcctccatgaagcagccgaagccggagaattgggtggagatactggggattcccataaccgtgcactcagtttcacc

SEQ ID NO: 645053 - DNA, 116 bp, Homo sapiens
acctgatcgccgttattagccagattgtgtcctccatcactgcttcccgtgagattgtgatggcgccctgaaatgttgacctgacaggaattccagaccaacctggtgcccttacc

SEQ ID NO: 645054 - DNA, 88 bp, Homo sapiens
ggatttgctggtgcagtacaactaggcttaatagggacatgccactccactccagcctgggtgatagaacaagactgtttcgagaaaa

SEQ ID NO: 645055 - DNA, 153 bp, Homo sapiens
aacacgacgacgtcttgatgtccaggtagttcagcgtgttggccacgcgatggaacagcacccggttgtcggtgatgatcttctcggccttgtcgtactggcccgagccgcgctgcggatagccgcagcacaggtaccccggcggcagcacgg

SEQ ID NO: 645056 - DNA, 143 bp, Homo sapiens
atcaacctgagagtgatccataaagttgcttctaaactgcaacctcccattgcaagaaagcactcatgctaagctgccaagagcactgacgcatataacaggcattaagcctcttaataagttggtgtattaggacatatttg

SEQ ID NO: 645057 - DNA, 425 bp, Homo sapiens
  misc_feature (1)..(1): n is a, c, g, or t
  misc_feature (9)..(9): n is a, c, g, or t
nggccagangtttaatacccagcctgggcaacatagcaaaaccctgtctctacaaaatttttttttttaattagccgggcgtggcagtgtgcccctgcggtccttgctacttgggaggctgaggcagaaggatggcttgaaccaaggagttcagttgcaccactgcactcctgggttattttggagaccctgtctctaaaataaataaaaaagaagttagagaccagcctgggcaacatggtaagaccctgtctctacaaaaaataaaaagattagctgggcatgatggcacacgcctgtagtcccagctacttgggtggctgatgtgggaggactgcttgagcctggaaggtcgaggctgcagtgagctctgattgtgatcacaccaccatattccggactggaagacagagcaaaaccttatc

SEQ ID NO: 645058 - DNA, 193 bp, Homo sapiens
ggcatgcaagcttgggtattttataatcatctgtcataggctcctttactattttttgtggaacttgggctgttcccagaatactaatcctctctgttgattagttcagcctgtaaacaagaaatcattaaccagcatgctgttcctgaagaatgaccagggacaataattgtaaaaattcaagagcttttat

SEQ ID NO: 645059 - DNA, 112 bp, Homo sapiens
gcgtctgctacgggttggtgattcttaagtagtagttccacaggttacagtgactctaatgctcatcctgctcgctgtcctgcttctgcccgcagcagggtctcgtgtgagg

SEQ ID NO: 645060 - DNA, 862 bp, Homo sapiens
cgcgtttccgacagttgtcctgcctcgggacgtcctctcaggttccgcggctgtctggctggtcttcccgtgcccttgtaggctgccggtcccctggacgcctcggcgcggggacatcagcccttgcccgtggtctttcccctagcgctgccctgggttctccccagctgcttctttcgccccgccctcttcggccgccaagcgccatgtcaatcccctgtcccatgctttgcccagcgggtctgatgggctgcacctcgtgtcttgggctcctgtgcgtagccgctcgcagcactgcgtctggaagaggtggcggaagctggcgctgcaccacggcggggcacgtcgggaaccgtagcggctgagcgcgtctcatgctagggcccccaggtggggcgcgctagcgtctgcgcgctctgctccagcacctcggcctcggtctgcgggcggtgcagcccggaacacctgcgtggaacgggctcggccttggcagaggaggtcacggtcagcgccagggccacgacaggaacagtggctctcacagcagccgggacacggacacaggggacaatacacgggtgggcagaagcacaaacacacatgctgacagggccctcgatcccaacccgctgccgctgcgccccagcacccaccccggagttacccccggcctcacctacatccttaacattccagctttgctggggtccagctccatcgtacttctcctcaaacaccttgttgatgatggggcaccatgtatcgccgtgctggtatcgtatcccggtctacatggggaccacagcaggagaataacctcgtacttgttaatcacccggggggttcacgtccgaatgcacga

SEQ ID NO: 645061 - DNA, 247 bp, Homo sapiens
tcgtcttctagagttatccccgtggttatgtgactgtttccgctgccctgggcatcttcaacgggacccttcatgcagatctttgaggacaacccttctgaatgagagggtgtccgtgccgctgctgaacacgctggaccacgtgctcacccacggctgcttcgacctcttcatcacggaggaggactgaggctctgctttacatgacttcctttccgattcacgcctacagtgctcatgtattaca

SEQ ID NO: 645062 - DNA, 1935 bp, Homo sapiens
tgtcatcaagtaggtattttctccgtttgttgttcttctctatttatgttttctgtttgtttatttatatgttttatttttctagtctgtatattgtttataatcgacctcaacagtaactactactttcagaatatacacacagaacagagagacagacgaagcgcagtacgcacacgacgaagaacagaagagataagtgacagcacagatagacacaggaaaaacacagacaggagagacgggggggcagcgccggaagagagaataacacgacagcagccgcagcgcgatgcgagagaaacaagagaccagaggcaacacgacattacagacgacttacggtgtgcgacgcgatcaaactacctggcaaaacacaagaacaggaatacagagacaaaacaaacactccatgacgacgcgaccaagatagcaaagcacacacgcagagacgaagacagcaacacgcccaaacagctctgctgcaaccacacatcacacagcaacactgcacagcactctgaaccacgatacaacagcacataagcaacgcaaaaagaaacacatcgcccacgaagctcagaagcagaacagaccacacaccaaagagcagacgagacgagacgccaaacgagaccacacacacaaagaccaacgacaaagaacacagcaagaacacaacagacccaagcgaaacaccgacgcaaaacagccaaacacaacacacgcacccagaacacactcgccaccgcagcggatgccgaagcgaagaaggaaacaacaacgaaaaacacagctagagacacacgaccgactcacaaaagcaaccaccacaaaggaacctagaccaactcagcaagcaacacacacacagcacgcagacacctcacaactcagagcgccgcccaaacaagatatctgcacaccaagccattgaaacgccaacaacacacacgaaccaacccacacaaatgagagcaaacatacgcaccacgcaaccagaccgcgcgccgcacgaacgacgacacccaaagcccaaacacacacaaaaccgaacgagcacgaccacgaagccgccgcagaagcatctacgccctcaccatcaaaccaacacagaacccctacacaaaggagccacaacctcggcgaccacacgacggacaccacagaccatacacaaacaccacgactgacgaccacaactacaagccaggaacactccaacattcggcccatcacagaagcacagcacaggggcacaaaacaagaaaaagcgcatgagaacagagaaccaacagcacaagaaaacaacacacaacgcccagacacacggcgacgccgaccagaaagaaagagtagaaaaccaatacacaacaaaaggcaaccccacacacacataggcacccacgcaccacaacacatacacaaacacacatgcaagacaccacagacgcaaccgcacgtaaagacagacaaaacaatccagccgcacagacaagcacagaaacagaacacactgcagagtgaagaacaaaacaaacacaaaccaacagcaaaaccacacagcacccagcacgaccccagaagacacaacaacacaaaaacagaacagtcccagcacgcacacacaacaacaccagagtgagtacccacaacaccacgcaagaccaagacatagcaaacaaatcaagcaactcacgacagacgacaaattgaccaaaggaagacaatcaaccaacagcccgcacacagaacgaacgaacacgagagaccaaaccaaccaactcatgcacgcacgacgaccacgtacacacagaagacacgcaaagaagtcatcgaagacacgcaggctaacgacagcaagacagccctcccaataaaacgcacagatcacagcacaagcaatgacacagcacagccacacaccaccatacc

SEQ ID NO: 645063 - DNA, 266 bp, Homo sapiens
gaaattagcggggcaggggggcactcgccggtagttccagtgactcaggaggccgagggggagaaatcgacttgagcccaggaggcgaaggtgcaacgagccgagattatgccactgcactccaagcctgggagacagagaaaaattccctctaaaaaaaaaacgaaaaggaaaaagaaccacataattggtcattttacttctgtcctccttttttcttaaattaaaaaaactcaatatacatcacagtgagacaggggcttcgg

SEQ ID NO: 645064 - DNA, 130 bp, Homo sapiens
ctaaggatccgacgtctgtacatgtcactgtggctatgctgaatgcctcagggacttgatctttcaataaacaggtttagacagtatgagtcaatgtgcagtgtaagccacacttgagaggatgaatgta

SEQ ID NO: 645065 - DNA, 144 bp, Homo sapiens
tgattagagatcgctggtgatgagaggtagggagactgggtgtcggatgtagagagtacatgctctggccagagtaagttgagtgtaagatataagcgagtcgcgatctaggctgtcatttgagatacagtgtgttcttggatc

SEQ ID NO: 645066 - DNA, 908 bp, Homo sapiens
catgctaaaaactctcaataagttaggtattgatcggacgtatctcaaaataataagagctatctatgacagacccacagccaatatcatactgaatgggcaaaaaatggaagcattccctttgaaaactggcacaagacagggatgccctctctcaccactcctattgaacacagcgttggaaattctggccaggcaatcaggcaggagaaggaaataaagggtactcaattaggaaaagaggaagtcaaattgtccctgttttcagatgacatgattgtatatctagaaaaccccattgtctcaacccaaaatctccttaagctgataagcaacttcagcaaagtctcaggatacaaaatcaatgtgcaaaaatcacaagcattcttatacaccaataacagacaaatagagagccaaatcatgagtgaactcccattcacaattgcttcaaagagaataaaatacctaggaatccaacttacaagggatgtgaaggacctcttcaaggagaactgcaaaccactgctcaacgaaataaaagaggtttcaaccaaatggaagaacattccatgctcatggataggaagaatcatatcatgaaaatgggcatactgccagtaactgtggatcatgctatcccagcagctacatgccttctcccagatggaaaactctttaagtctttgtacgaaaagagcccattgcagagatctagcaaaacaatggggtccctctgttaacatctaagggttgtccacacgggtgtccgcaatttaaagggagaaagcccaattaacttaccgttttacccagagaaaggggggctacagggggggcgaaaggagccctaatgagaatggccaacagcatgcgctgacacataataatcaagggctcccatgccg

SEQ ID NO: 645067 - DNA, 805 bp, Homo sapiens
taaccagaaatgtttaaaaaactaagtgtgaggattcaagacaacattatacatggctctgaaatatctgacacaatgtaaacatggcaggcacctgaatttatgttttttccaacaaaggtgactaattggaaactttatgaacttcggagcggtccccttgtgcaattcaaccgcagttggaaattaaatcatatcaaatcagtttaaatttttaaaatggtacttcagagtctatatttcaaggggccacattttctcactacttatttaaataccataaaggataaataatcttcagagatgtgggaaacaaatcattggcttaatatgttcattagaataccattgaaacatacaattggaaaattagtaatagtattttggaagatccaatttcaaatgtgagatctcttaaatttcgatcactttatactgttgtagtactatataaggtgccttgagtggaattcaacatttgactaataaaatgagttcatcatgttgcaagggtgatgtggcaataatctctgggtgacaaaaggagtaaaatcaaatattgtggcgtgtacaaattatcaggggaagaccctgtactatgacataggatgacatactctggcttgatggtcataaaaaggagggattttttcaaatcaggggtgtagaggtctatggaatgaggactttgaacaactggggttttaaggtactttatgttcttaaaggccagaaaatttggtttgtaacaaaaagaaaaaacaaactgtggcgcggcgcaaaatttaaacatttggggcggcaa

SEQ ID NO: 645068 - DNA, 404 bp, Homo sapiens
aggggtttctcgagacaccaagcgtgctggccccgcttgtcacagctcgactgtgcacgaaacacacctacacgagagttcgggtctataataaggtgcactgatatctgacagaggcctgtacatttggtggtacaggctggtctcgacaattagggtaacgtggaacgttgatggaagggccaagaactttctcttcagatggaagccttgtgcaccaactttttgtgatcggactgtatgagctagtgtcttagcacaagagttacgtttaagaagactgccgagatcttaaagtccacttgggccattctttcagcaaccgattcagattttcaattcgcaagttttggcacaccgacaacagctttgtacaggcccacttatgtgagggcttatccttt

SEQ ID NO: 645069 - DNA, 408 bp, Homo sapiens
  misc_feature (109)..(109): n is a, c, g, or t
  misc_feature (141)..(141): n is a, c, g, or t
ttatcctcatagctgactctagaggatacaacaattcatgagggagcagtacctttcagatgatccatatatgaaggttttaaaaggaaaaaaaaaattattcctcgantgtaccataacttttaatttttacaagttggnacatcacaaaaaaagaagaaaaagaagggaaaagctaccacttactttcaccatcatttcacaaatgcaggaatattttaagtcctcagcctctccccgaaagaacataatctccaaatgaagggctctccttcacggggactgaaaaaaaaatcatgaaatcctaattttcattttccacaaacccttaaaaacctccctcatggactggtcttttcttttttgtaaaacagggtgtggtagccacttggttgggggtcatcaagt

SEQ ID NO: 645070 - DNA, 235 bp, Homo sapiens
tacgagggttgccatgtttttgttatactgtgcactggagaaagaacctgtgccattgtccctgcccccagtcttggggccagcatctattataaaaacgtgggttgtatctcctgcatactaagccaaatatgatgacttcttcctgaaaattgataccgatatggacggctttgtgtctggattggcggtccgtgaaatattcctgaaaacaggtttaccttctaccttacta

SEQ ID NO: 645071 - DNA, 124 bp, Homo sapiens
caagataaaagtaatacaaataaaaaatataacaactatttagatggagtttatgttgtattaggtattgtaagtaatctagagatgatttaaagtatatgagaaggtgtacatagtgttatat

SEQ ID NO: 645072 - DNA, 115 bp, Homo sapiens
cagtatgtgctaagcagaatcagccacaacatatgcatgatttttatggcctgaaagtttttcccaagtaaatggtctgttatagctttcatgtgtgattgggtccagcttctgg

SEQ ID NO: 645073 - DNA, 296 bp, Homo sapiens
cgcagagcaaatgttgcatagacatgatcatcgaaagcgaaaattactaaaccgatatgcaggagctgaactcaagtatttgaccaaatggacctaatagacatctacagaagtttctacccaaaacaacagaatatacatccgtctcattgccacagggcacatactctaaaattgacgggacaatcaaacataaaacaatgcaaagattattcaaaaaacaaaaacaaaaacaaaatcataccactgggtggtgcagggccgtggtgccctgtggccttggccaaatgaaaacc

SEQ ID NO: 645074 - DNA, 1225 bp, Homo sapiens
acatgaacgagagagaaaaaaatcgaatcaccccagtttaactgaaagcacagaatctacacacaaaagacaatgatgaattcatgatgttgctatccacagttgagaaattgtcagaagaaatcatggagataatgcaaaatataagtagtatacacggctttggagggcagtagagcagcttgaaaatctcattggaatctcctgtgcatcacaatttcttcaaaaagacgaaatgcagaaaaccaacagaacctacatgacaacaagtgacataaaccaaaaactgtttgaaaacgagtacaggacttcctcacaaaggccttaaggctgacttgcccattaccagattttcccaaaggacccgagttcctgcatagaggagactgtcatcactaaaccatgttgtaacttcctaatcatcctagatctacaactgaaaactcactttcacacacaatatctaactacatagtatctatataagtatgtactatcacttactgcgctgtacatcatttctattacttaccgtaagtcataggtccaatactggtcccaatggcaagagcttaccactctaggactccttcatattaaccctagacggctcatacaaacaacccttccacttaagctagttctaccactacatcttggggaacattccactaattggccctctacaaacaactacatacacagcgtcctactcaagaagacacatacgacattttgccgctatctatcgatgtcccccctgacatgacctaacctaacctctataactcatggataccctaaaaataaaataatacaaacatggccggatcaattgacatgaaagttactagatcacacatatagatcacaacacaatgcacccacacccaataccacactaaagacctacagtaaacaccatacatcaccattaatgtaccaccatcatcataaaaaaaaatagacataactagaaaccagctagaccactcgtagaaaaggacacacaaaacaaaaagcggagacaaacacaccagagcaacaagaccaaaacagcgaagcacagagaaaacaacaagacaagaggggagaagaagaacaagcaacgacaaaacaaacagagaagaagctacagacaataacaagacgcgacacgcgcgacatccaaccagtagaaaaggcaactcgacagaagagaagaatacacaagcaaaactagacc

SEQ ID NO: 645075 - DNA, 243 bp, Homo sapiens
cagttggtccgagagaaattagttgtggctatgaaaatgattaaggatactagtataagagatcaggttcgtccatttagatgttgtgtatggctatcatctgtctggaggttagtttgattagtcatggctgggtggtgactggcgggtcgttgatgagatatttggaggtggggatcaatagagggggaaatagaatgatcagtactgcggcgggtaggcctaatttctctcggaccaatg

SEQ ID NO: 645076 - DNA, 357 bp, Homo sapiens
atataagttctctttgcgtaggccactgggtttctcatgcagtaagctttataaaaactcatttgcactggactgtcatctcattcttgtacaacgtagaattacttgtttacatccaacaaatggttagctagggaaacagtgcaactgagtgttagtagtcattttggtcaactgcatgtcaacccttccatttcaatcccagttagaatgaaataattctttgaacttggctttaggcaattttcgtcgtcacatgttggtgaatatattataaaaatgtggcctcggtcacggcatatgtctaagtctatatacatattccttcaggggtgaggggcaatctggcttgtcata

SEQ ID NO: 645077 - DNA, 382 bp, Homo sapiens
cctgtgtaactcgcgatcaccgcgtggtcagcatgacgcacattgtgcaatgcttctctcctgtcaacagcggccagcctcccaactacgagatgctcaaggaggagcaggaagtggtatgctgggggtgccccagaaagccttgcttcccccggatgtccaccagtagatccgagatccggcagctgagacctccgtgcctgaccatgtggtctaggtccctgttcaacgaccctcttcatgaacacctgctgcctgggcttcatagcattcgcgtactccgtgaagtctagggacaggaagatggttggcgacgtgacggggccaggctatgctccacggcaagtgcctgaaacatctggggcccttgacttaaagggcg

SEQ ID NO: 645078 - DNA, 233 bp, Homo sapiens
attaagcgcagtaattggaggttacagtgagctatgagtggatgactgcatctctatcaggggcgacgcaaggaacttgtttctaaaagaaagaaacaacaaaaaaacagtgcctatacttgccttctaggaatcacagtccagtaaaaatgccctgcagcagagagactctagcgttaaaaccaagcttcgtggggttcgcagagacaacttgctcaataactttgtaaccg

SEQ ID NO: 645079 - DNA, 414 bp, Homo sapiens
cccaagctcatctgaaccactataactcctgtgtgtgcccctgctgagctggtgtggacagctctggcacactcagtgctctggacaactataggacgcgaaataccaacagatatgacgattgaacatctggcattggcattagagggccagtgtagcgctcaggcccttcatgatgcaatgcgctgcgcggcctcaataagccatgggaaggaatgtttgtccagccactggctgcaccaatagactgcccacgaacacctgcccaagactacctacacacgctctggagatgagctcatggtctacagcagcatatgcacacatcccatgatctctcacacatgcatttgtactgaccaatgtattgctgtgctgactgttgacgaatatcaatacgaccctccatcccgg

SEQ ID NO: 645080 - DNA, 327 bp, Homo sapiens
acccacttcactcccatccctactccctttttaacccttggcaaccataatctgttctccatttttatagttttttttttttcatttcaataaagctgtataactggaatcataataatatgtaaccttttgggattggctttttttcatttagcatgattttctggaggttaatccagcttattatgtgtatcaagtctattgacaggtactttttagtgtgaatagaatcccatagtatagatgtaccacagtttgtttaactgttcacctgctgagagacattgggccagtttttggctactataaataaagttgctataacca

SEQ ID NO: 645081 - DNA, 2083 bp, Homo sapiens
acactcgtgtcaatggcctacattctgtttgttaacccttctgttcttggcgcagctggcatggataagggcgcagttttcacagcgacagccgtttctgccgctattgctacattattcatgggtattgtcgccctttacccaattgctatcgctcctggtcttggggtgaatgccttcttctcttattctgttgtcattggtatgggcgttaagtggcaaacagccatggctggtgtcttagtagccgccttaattttcttggtcttgacattctttaaggtccgcgaaaagattatcaacttgattccacaaaacatgaaattagccattgccgcaggtattggtttgttcattgcctttattggccttcacgatgcaggcttgattgtggctagcaaggataccatggtatcccttggtcacctcacatcgccaacatcattgttagccatctttggcattattgtcacatttgtccttttgtcaatgcgaatgccagcggctattttcgtcggaatggtgttgacatcaattgttgggattatctttggtctcatcaagttgccttcttccttagtatcgcctgtaccatcattggccccaacttttggtcaaagtatcacacatcttggtgacatcaactcaattcaattgatcacagttgtgattacgttcttgttggtcacattctttgatacagctggtactatgattggcttggctacacaagctggtttcatgaaaaacaatgaaatgccacgtgcgggtcgtgccttgatggctgacgctgttggtatgactgtcggtgcggttgttggaacatcaccaacatcagcttatgttgaatcatcatctggtatcgcggttggtggtcgttcaggtttgacgagcgtctttactggcttggtcttcttgcttgctttgttcttctcaccattgttgacagtggtaacatcacaagtcacagcaccagctttgattgtggtcggtgtcttgatggccaatctcagatgggattgcgttgggcttcatcttgtacccaatacaatgcttgcaacaggtcgtggtaagcaagtacacgctttgatgtatggtctcgctattctattcgtcatcttcttagcgattgtcgcgcattaaacacaaaaaaaacaactgacatatgctgtcagttgttttttttgtgtttaatttttggtgcttgttggcgtaattctcgtgcattggctaatgcagtagttgtaatatcttcaccagacaacatcatggcaatggccccttcacgaccagcctcatctaaggcagttacttgcgtcaccgtacggtcattttcagttgtttttgcaatcagaaaatgatgggttgccgcagcggcaacttgtggtaaatgcgtaatggccaaaacttgtgaatcagcagcaatcgtgagcatcttacgcgcaatggcttgcgccacgcgaccagaaacccctgtatctgcctcatcaaacacaatggagacaatgtgttgttgcttggcaaaagttgtttttaacgcgagcatcaaacgtgccgcttcaccgcctgacgcaattttagctaatggtgctaggccttccccgacgttggtttggacataaaattcaactttgtctgcgcccgaagaaatgtaaccagtaattggttcaaagcgcactgcaaattcagcgcctgacatcaacaattcacttaattgttgattgacagcttgctctaagtgccgtgccacttcttgtcgtacctcacgcaatttaaccgcttgcttgcggaccacttgacgcaattcgttttgtttcacttgcaattgttcaatatcaaactcatcgtggtccaatgctgctaattcttgatcaattttagctttaaattgcaagacatcagcgactgttgggccgtattttcgctccaaagtgtgaatcagctgcaagcggtcttcaatgcgtaacaattccgattcgtcataagttaacgcgccgatttgttcatccacatcacggccaacttcttgcaccgtataataactatcggcaatcgttgtcggattcggcataaaagcacgtag

SEQ ID NO: 645082 - DNA, 103 bp, Homo sapiens
cagcgggggttgcagcgggtactggttagcagcggtactggttagcagcgatactggtctgcagcggtaggtttcagcggtactgttggcagcgtaactggtt

SEQ ID NO: 645083 - DNA, 704 bp, Homo sapiens
ttcgaagaaatgatacggctaggtgcgaggcctgggttgcgcatgaagacagtgcagccacctccgagtagcctggatgtgatggcgtcacagaagagaccctcccagaggcacggatccaagtacctggccacagcaagtaccatggaccatgccaggcatgtgcttcctcccaaggtcacatgatgacacgggcatccttgactccatcgggcgcttctttggcggtgacaggtgtgcgcccaagcggggctctggcatggtactcacaccatcccggtcaagaactgctcacatacggtctccctgccccagaacgtcacacggccggacccaagatgaagaccccgtagtccactttcttcaatgaacattgtgacgcctcgtcagtaccagcccccgtcgcagggaacaggggagaggactgtccctgacgcagactttagctggggggccgaaggccagagaccaggatttggctacggcgtgcggaagcgtccgatctagtactcggctcactcagtggattcagggggagtcgatgcccagggctcgcttgccaagatttcttgagctgtggaggaaggagatacgtcgctctggatcacccatggctagacgctgaagagcccacctggttcccggaatcctgtcctcagcttcttaatttaactgccttaaaacttttattccccgcttgccct

SEQ ID NO: 645084 - DNA, 305 bp, Homo sapiens
  misc_feature (156)..(156): n is a, c, g, or t
  misc_feature (175)..(177): n is a, c, g, or t
tgcacggtattctgcgaacctcctcccctgtgctgcctgcttgaattgagagaaagcaaacagcccagatttggctcaatcccatgaaatgcaaatgtctaacacaggctttctctatcatcttcacgtttacattatgcaccttaaagaagtganaactagctgggtgcagtgnnntgagcctggagccccagcctaccttgggaggcgtgaggcaggaggattactttagcccaggagtttgagtttagccagggcaacacagtcagaccgtatttctgagaaccaaaacgcagttgaaactc

SEQ ID NO: 645085 - DNA, 159 bp, Homo sapiens
ggtgaatctggactttcagtagagactggggtttcaccaagttggtcatggctggtctcaaactcctgacctcaggtgatccacccccctcagcctgccaaagtcctgggattacaggtgtgagtctgagtcaccaggcctggccctccttgtttcttt

SEQ ID NO: 645086 - DNA, 305 bp, Homo sapiens
gagaggaaacttagattttgtttatccagtaaacaaggctggttttgtatgtaggaaacttttgacccatcccagtctgaaattcttctccatttacagataagcctattttagttaccttgactaaggtattgctctagagacttcctttgaaaaacctcttaataaaaaaacagaccagtctacatgatcccactgaccaatacatttgtcaggaacaaaattgagctgggcatggtgatgcgtgcctatagttccagctactaaggagactgaggcaggaggactcctttagtctatctcta

SEQ ID NO: 645087 - DNA, 307 bp, Homo sapiens
tcctctcgtgacaatggataattatagattgtcatagcgcagggcgtggtgactcacatttgtagtcccagcatcttgggatggcccggcaggcagaacatcttcccggagttcatgaccatcgtggccaacgtggtgaaaccctgtctctatctataaatacaaaaatggtttagctctgtttttcataactagatactagaacaggtacaattgttttgcttctgaaaagaacaagtattgttcatcctagaagggtttttgtgactgaatcagcagtgcctgccctagtcttagctgtttcctg

SEQ ID NO: 645088 - DNA, 493 bp, Homo sapiens
  misc_feature (179)..(179): n is a, c, g, or t
  misc_feature (209)..(209): n is a, c, g, or t
  misc_feature (213)..(213): n is a, c, g, or t
  misc_feature (229)..(229): n is a, c, g, or t
  misc_feature (239)..(239): n is a, c, g, or t
  misc_feature (252)..(252): n is a, c, g, or t
  misc_feature (256)..(256): n is a, c, g, or t
  misc_feature (258)..(258): n is a, c, g, or t
  misc_feature (260)..(260): n is a, c, g, or t
  misc_feature (279)..(279): n is a, c, g, or t
  misc_feature (295)..(295): n is a, c, g, or t
gcggcgaaaaccatgagttatctgcctgcaggagagacagctcaggcctccaggagacttgaacatgcattctgtagcaggtaaacagtgactcttgaaaggtgcacataattggaaatggatgtgtttgtgagggggtggggagcgatggtgtacacctaacgatatactacaacacnaattggtttaaccttgggtagtttggttcnctgncttttaataatggggncacggcacantaattacacaggngatnantngttaccctaaccggggaantttatttggaaaaccncaaactggttacattgatctaaattcattgtaagcttcagcaaactttctttcccagatatcaaaatttgttgtcacatgagagttaaagggaaaaagctttcatagtttctcaagctatttaaaaaattccatagtttttgcttctggctctcctaacttttttaggttttgttttctgataacattttattcaaga

SEQ ID NO: 645089 - DNA, 572 bp, Homo sapiens
  misc_feature (2)..(2): n is a, c, g, or t
  misc_feature (76)..(76): n is a, c, g, or t
  misc_feature (97)..(97): n is a, c, g, or t
  misc_feature (197)..(197): n is a, c, g, or t
  misc_feature (270)..(270): n is a, c, g, or t
tnacggagcacagcttagtggctacaaacaatcaaattattacctcccagattctgcaggccacaagtcctagatnagtcccactgggtgaaaactnaggggttagcagggctgggctccttctggaggctccagggataattcactttcagcttctccttggtgcacggctgctcctccccctgcagagcttgcancgtggggctgagtccttctgagtgagtcctgagtccttctgattccttctgagtcaggccagctcccagctgntccctgtccccacagagggacccttgtgattacaccagaaaaacccagataacccaagataatctccccgtcttaaagtcagctgattagcagccttaataccatctgccttgtgagataaaattcctttgccaggtaagaacgtggtcacaggctccaagaatgagcacgtggacgtctttgcggcccatcgctctgactacaaatacatcctccgttttcttatgggagaacgaggttctccctgcaagtctttcatgctccttggtagttttatagttttcttcatttaggccccacag

SEQ ID NO: 645090 - DNA, 339 bp, Homo sapiens
  misc_feature (18)..(18): n is a, c, g, or t
  misc_feature (41)..(41): n is a, c, g, or t
  misc_feature (103)..(104): n is a, c, g, or t
  misc_feature (107)..(107): n is a, c, g, or t
  misc_feature (161)..(161): n is a, c, g, or t
  misc_feature (172)..(172): n is a, c, g, or t
  misc_feature (240)..(240): n is a, c, g, or t
  misc_feature (243)..(244): n is a, c, g, or t
  misc_feature (255)..(255): n is a, c, g, or t
  misc_feature (259)..(259): n is a, c, g, or t
  misc_feature (265)..(265): n is a, c, g, or t
  misc_feature (272)..(273): n is a, c, g, or t
  misc_feature (285)..(285): n is a, c, g, or t
  misc_feature (300)..(300): n is a, c, g, or t
  misc_feature (306)..(306): n is a, c, g, or t
  misc_feature (329)..(329): n is a, c, g, or t
agagagagagagagaganagagaggagagagaggagagagnagagagagagagagagagagagagagagagagagagagagaggagagagaggagagttcatnngtncccactgcctttgtgtacatagaaaacttaaaaatttcccccagtctattagangttaagatgtnccctaatttattaaatatgcctttattcacaatttgtttttttaggttattcttaatgcattataganttnngtatgtctttntttntttttnttacagnntgtagttattgnacatattgtggtttncagaantatcaattgtataaactaaaccnttaaattaaa

SEQ ID NO: 645091 - DNA, 136 bp, Homo sapiens
acgcacagatattatccctttcgcttagtggttgtatttctgtgcagccaagtactgcggctccctggggctgagacctccctttgtggaactccgagagccggcctgacagtcccagccgccacccaaggagccc

SEQ ID NO: 645092 - DNA, 264 bp, Homo sapiens
gaggcttggcacgggtggctcacaacctgttatctcagcactttgtgaggcagaaaatggcggggaacgaggtgaggagatcgagaccatcctggctaacacggtgaaaccttgtctctactaaaaatgcaaaaaattagccagctgaggtggcgggcgcctgtagtcccagctacttgggaggctgaggcaggagaatggcgtgaacctcggaggccgagcttgcagtgagccgagatagtgccactacactccagcctgggc

SEQ ID NO: 645093 - DNA, 309 bp, Homo sapiens
cccacgctgagcgccgcgccaaattgagattattagttttgttttgtcttaagaaccataccatgaaaatatcagtgaattgtaggatatgaattccctgtcagttgatttaaatcctttctgaataaagatcagatcaacatgtacctgaaggagcagtgtatagctctttccttcaacattcacctacgagcctttttaaaacagacatttgcctgcacgtcagataccctttccttttactgcgaattctcttaaataggagaaaacttacagaaactggtgttaaaggcctaaagttcaggagtg

SEQ ID NO: 645094 - DNA, 334 bp, Homo sapiens
caaagctggcatcctcctatgtcacctagagtgtgggtcaaagcaatacacctacatgtagaatgtgaagtcagaacaccaacggacaacaccaaacaaaaaaactatccccccgcatgaggatgcaagatgcaacagtttgtctttcacattggaagggacacccctggatgcccctaaccactagacctgtaaaacttcaccgcagtggccacttctgaatctccgtaaggtttatttatcttcaccctctggagagaagatgttctaccaaagcctctagtgtaccttcctcctcttactcatccaccccagtcaacatgatgttgtcaat

SEQ ID NO: 645095 - DNA, 557 bp, Homo sapiens
  misc_feature (197)..(197): n is a, c, g, or t
agtaactgccaggtgcagttacattgctcagtgacagagctcaagcttgacatggctgaaggtacacacggtatagtgaggcaggctaagcgggatggctgcagccaagagctgggggagggcgggctcagggctagccctctccgctctaactgatgatctgccgaggtcgtccgtagcctgtcatgccggcctgngaggcccctctgttgctgcccatctgaaggccaatgacatgctttccctcctgcagctggctctctgtgaattccctcttatgctcctgcgctttcttcataaaccagttgggatctccacggtagtgcccatcattcttggtcactgccaagctgcccaaagccatcagggtcctctgcactgctgccatgtctttgcctccaaagaggtcaacagtctggaacatgtcagtcttgatgaccccatagtcctcagccggcttcaggaactgagccacctgctccatctgcttgaagaccatggagggtgggttctagggcaccttcacgggcttggagcatcagggtacaggctgtcaa

SEQ ID NO: 645096 - DNA, 306 bp, Homo sapiens
aaaccccccccccccccggggaaattttggggggggggggttttttggggggtttttaaccccctttttttaaaacccccccggggtttttttcctttgggggggggggggggggggccccccctttttttccccccaaaaaggggccccccccccccccttttttttgggggggggccccctggccctttcccccaaattttttaggggggggggggcccttgggtttttccccccccctttttttaggggggtttttttttttttttttaacccccccccgggggggggggggggtttttttta

SEQ ID NO: 645097 - DNA, 524 bp, Homo sapiens
caacgactggtcctcagctcatgtcatgttccggaaatagggggggtatcatgcttgcgttcagagagaaagctgatacctattcctgaatacgatcatttcccacattacttccagatctgtgagttctgcattctcactgcacaaggatttccagtcactcatgtgttaggatttagcatgtaggtccttgatctagctgagagatcccagattcgggttcctggcccgtcagtaagggaagatacagcaaggagtttgtaaaagcatctagcccaagaaaagatctcaagccgttagatccatttcagggtctggtgcacgccgagtcgggttcatcttaatcgagttaggtagcactcaccgtgcagcttcggcgatagcccatcccaacctattcctgtgtagtcccaggtggggtccaggggtttggctgacagattttcgatcctgagtcccgattcagatttcactgacggtgagaaataggtcctggttccggacggggatcaactcccagctga

SEQ ID NO: 645098 - DNA, 317 bp, Homo sapiens
tgcggggagtgagggtcagaggactgaatgatgaaacccacagtaacaaaagcgagggtatggaaacagactgaacagagaagcaagaggccaggctcctcgtggtacgtatagttcgcctctgtgacagatgtcgacgacctgtgccttcctgaccttttcttttttggtgatggagtcttgctctgtcgcccacgctgagtgctgtggcacatgcttggctcacggcaacctgtgcctcccaggttcgagtgagtctcaagtgactaccagcgcccgccatccatgcccaactaatttctgcatttttaatagag

SEQ ID NO: 645099 - DNA, 182 bp, Homo sapiens
agattccaggagtagatgatttgggaacaacaggcagaggaaatgatatgcaagttggcacatacattgaaggatgttcatgtctaacctgtctgggatatcattgatatctgcccttaggtgcctacctctaagccctatgcctttactgcccgcctgggaaacagaagacagattccatt

SEQ ID NO: 645100 - DNA, 122 bp, Homo sapiens
ccccccccccgggggccctgggcccctgaaaggcccggggggaacccccccggggggggattctggggttttttttttttgggggggtttccctttttttcccatttaattcccccttggga

SEQ ID NO: 645101 - DNA, 418 bp, Homo sapiens
cgaagattgttaagttccagctcgatacagaagacattctaattcagaaccggggcaacggttagcttgggggtgcaaaaaactccagtatccgagttctcctttgctttgggcacacctcttacgcaacttcctttgtgggatctgttgttaagacaaacaaagaccaagaaacccagtcttatctcccaaagaaacacctaaattctctctatttaggttcgttgcagccaagaaatttattttaatccaggtataagagctcccagatataaacaagttttaaaccctcaacacgggcattttaaagacaaatgtggtttaacagaagtggtctcacacacgctcgataggtctctttctatctccctctcacccacaaagtctgttcaaatctctatcctcgcagcgaatccta

SEQ ID NO: 645102 - DNA, 95 bp, Homo sapiens
atgtttaattttttttttaacaaccttaacttgtggcctctttttacccctggaaatttactcttgaataaataaaaactcgtttgttttgtcca

SEQ ID NO: 645103 - DNA, 358 bp, Homo sapiens
cgtcgactaaggcagtcatcaatttataattatttcagaaaaatcagcagcagcaacagcaaaaacaaagacaatggcaacaaaaacaaataatgcttggcttctatgaaagatcacctgaattttattcttttaacaaaataacacacacacacacacacacagcagcgtgtgtatgcatgtgtgtgtttgtgttacataactgtatccctgcatcatgctatttcatgacaaagctagtgcacatatttgtaaaatctgagatactaaagaattggtagagaatatgtttggagtctactatagtttcctgtaggaactaaatggggctggggaaagaggggagaggggtcgacgc

SEQ ID NO: 645104 - DNA, 113 bp, Homo sapiens
ctcccttgaacatctccgccttactagaagtgtgaaaacgtaggcttggcttactgtgcgacagcagatttctaggatagtcagtagaattagacttgtgcaagatgataagt

SEQ ID NO: 645105 - DNA, 578 bp, Homo sapiens
tggaggggcccagtggttatattaaaaacccggatggtccaaaaactgggggggggcttcaccccttttccacggggagattgggcgcggagaggggtgaataggcgcgaggacattctctatacccatttctcctctcagggcaaccagaaggggggtgaaaggaggcctccctcaaactctcaagaaaggcacacaaaatgtggatagggggagcacagggggggcgcaggggaaaggggaaaagggaaatctcccaagggcaatctcaaataagaagagaggggtaaaccggaccccaaaacatcacataaggggcaggggggggcgcctgctggcccagtgggccggtctaagaggtgtcccgggccctcctcgtgaggctcttcttctaaccccacctcccatctccaaaagacatccctaacggggatatcccccccgagggtagaggcgagccgagggaaattatccctttccttatgagggggggccaataacgcggggaaaagccccacagaggggagagaggaaggaggtatgggagtgcaaaatgttccagggaagaggccaatttc

SEQ ID NO: 645106 - DNA, 358 bp, Homo sapiens
  misc_feature (105)..(105): n is a, c, g, or t
  misc_feature (128)..(128): n is a, c, g, or t
  misc_feature (340)..(340): n is a, c, g, or t
  misc_feature (352)..(352): n is a, c, g, or t
gccttttcacaagatggcgccgaaagcgaagaagggaagctcctgcccctccttaaagctgaagccaaagcgaaggctctaaagggccaagaagggcagtgttgnaaaggtgttccacagcccacagnaagaagatccgcacgttcacccacctttccggcgggccgaagacactgcgaacttccgggagacagcccaaatatcctcgggaagagcggcttcccaggagaaacaagcttgaccactatggctatcatcaagttttccgctggaccactggagttctggccatgaaagaagataggaagacaaccaacacacttgtgtttcattgtgggangttgccaaccgncaccag

SEQ ID NO: 645107 - DNA, 876 bp, Homo sapiens
atttaaaccgaatttaaggaattcacacacgacagtggacaggtcttcacgcaggctggttggtaacgtgctgccagcacagggctgggtgatacgtacaccctaagccgggggtgcctggggctgcgggggcgctccttgctattggcccctccagccacagggcacgtgaggtgctgctgtgtgagccgtcgggcgtggagcggccggctgtgtgggggcagcgcagtcgaggagcatctgtggggcctttccttctcggctggttctctgtgacggtggcgtcggctcggctctgctcctttcatctggtaccgaagccactgaccctgaattgcccacgtgtgttttaccactgagcagctgcactggtgctgtacacgttgtgaaaggccttgctgttccaggacttcaacaacttggtttcttttcagagttccgaaggatataatggacttcctcagcgcccttgctggtgggctgagggtgacagtcacgatccgaaacctgtctggtataagaaggctgcgggctgatcaatttagattggtcccactgctgagacctgtagggcagctcctagagcatgcttttctcaaggggagcaggcagtagtgacaacgtcgtggtggtcgggacttggcttctgacgaaccacgtctggaactggccccctggtttgtgccgaggggggcaggggcttccgggcgtgaaccgggcttcggcaccccctctttgttgttgggccgtgctctcttggcttgtcaatgtcaggacccctctttggggggtgggtgcgtggccgaccttggcggccccgccttgacgtcttgggcagattaccccactaggagtgcctccccagtccggtcttat

SEQ ID NO: 645108 - DNA, 447 bp, Homo sapiens
  misc_feature (307)..(307): n is a, c, g, or t
  misc_feature (314)..(314): n is a, c, g, or t
  misc_feature (323)..(323): n is a, c, g, or t
  misc_feature (369)..(369): n is a, c, g, or t
  misc_feature (373)..(373): n is a, c, g, or t
  misc_feature (383)..(387): n is a, c, g, or t
  misc_feature (391)..(391): n is a, c, g, or t
tactttcttaaattcccttcgggactctccggaacccaacattaaaaagtatctccttctttccaagggtaaaccccgggtggcccaaatcttttatttacaaacacccctggccggataccccaaccaaccaacagggtaatatcctccaaggccatgagctggttttgcccggtatccgccttccatcaatttaaaaattatatatatgtacatacacagttaagcgaaggcaggccagaaagagttcatctgtaggctcagcctcggtctcacaaacctccctcctgcggcccctccccaaccntcccccngctttgtgntcttaaggagtactacagaagcaatctacagtctctattgcagttngtanccccctcccnnnnncaantttaatactgaatgagatcgaatgttaggtccatgcagttcttggtcaatgttaac

SEQ ID NO: 645109 - DNA, 102 bp, Homo sapiens
gcctgtgcggagaccgctgctgctgagacaggcggctggggacagaacctacattctgcccaatgctgctgactttatcctgtgccctgcgttgattgccag

SEQ ID NO: 645110 - DNA, 302 bp, Homo sapiens
cctgagcttgctcaggtctggacatcacatcaaaatatggcagaagctaaagcacgaagacgtgagcaaggcaggtgataaatacacggtcctcactctgtttgcccacgactagagtgcagtttcataatttggtcactgtaacgttgaactcctgggctcacgcaattcttctacctcagcctcccaagtggctgaaactacaggcttgttacatcatggttgcaggatggctgctacagctcttgacattacatcaaaatatggcagaagctaaagcaggaagacctgagcaagccagg

SEQ ID NO: 645111 - DNA, 870 bp, Homo sapiens
cctctggttccttaatgggctggcccagtggctggagtctggcccccgatgtgggaaggtcctgcggaagtggtttgagccatctcagtttggcacttggtgggccatcctgtcagaccagtcaatgaacctggctggagggctgggccctatcctggcagagccgatccttgtcccagagctagcagctggcgcatgtgacgctggccctatctggggcactgtgtgtggttgtctccttcctctgtctcctgctcgaatccactaatgaacgctgctgagtgttggactccgcgaactggagcccgaatgccctctgagggcaagaagggctccttgaaggaggagagcaccctgcaggagctgtggtgtccccttagcctgtgggtgctctccactggttacctttggtggtgttcggcagtagaagacctgcgtgtactgacgtggggccagttcttccttatccaggagaaaggacagtcagccccttgtaggtagctcctacatgagtgccctgggaagttgggggccttgataggcagcatcgcagctggctagctgtcagaccgggcatggcaaacgcgcgggactgtgcaactagcgggaacccgtcgccagtggcctgttgctgttcaatgattggctggccattgacgagtgttcatgttacctcttcggggtaacagtgacagtgacttcccccaagctcttggatcctggtatgggagctgtattggcttcctccttggattgggcgcattggctgtttggagtatacccaagagagtgcccttccaattgtgtgggactccctcgcatgtagagccctggcagggggcgctcacagggggagccacgctgcgcaat

SEQ ID NO: 645112 - DNA, 443 bp, Homo sapiens
  misc_feature (193)..(194): n is a, c, g, or t
  misc_feature (200)..(200): n is a, c, g, or t
  misc_feature (278)..(278): n is a, c, g, or t
  misc_feature (351)..(351): n is a, c, g, or t
  misc_feature (357)..(358): n is a, c, g, or t
  misc_feature (387)..(387): n is a, c, g, or t
caacggcccggcacatccccacccccgccctcccaaacccctcccgaacccgcccgaaaccaacgaaccacccgcgcacccacggcgaccaccacccccacaccgccacccccaccccacccccagccacccacacaacacaccgcggcacaccaccgcctccacccgcccccgccaggtgccaccgccggcnnctcgtngatgcaaccaccagagcccagcaacgcaagccgccagcagacgcacacccacaggcacaccaccccccacacaaaacnacatccgacagggcccggcgacgcgcacccacactctgtgtcctaacggagcacaacagaagcaaaccacaanccccanngcagcgcggaacccgcggcgcgaccgaantttaatactgaatgagatcgaatgttaggtccatgcagttcttggtcaatgttaac

SEQ ID NO: 645113 - DNA, 175 bp, Homo sapiens
ccccatttgccgaagattggccctagggtgccccccccttccccccccccccccctttctttttttttgaattctttccatagccttttattccggtttgacaggttttggtccaattttacttttctcccttttttattgggaaaattttttcattaaattttttttttttcca

SEQ ID NO: 645114 - DNA, 548 bp, Homo sapiens
gactcgttaggatccccgcgcacgacaaggagcatgtcagtatccgccgagcgtgctgaggcgggggcgtccgcagactggccggcgcagagaaagaaacttggtctgtacctccagctgataacttccgggcccacgctgcccccacacagttggcgccaaagaccacaggcggagcttgcgctacccctcctacttggaattgacactggctgggagggggctgccgaagacagctccctatacaacatggaacagaaagacttgtatttagtcggacccatgtctactttgccagaccctcggccactgcgggagggcagggcccaggcgcatttaaggcttaaatgcacatcacatggaaactgactctgccattcatttgatgcaaccatgggcaagtcacttgtccctctctggcctcagtttccctaaaccgagtgagtggcaattttttcaaaacgtctgccaactccaggacttgccgtttaaacctccctctccaagagaggagatactcacctggaggtgtcaggacacggccgagt

SEQ ID NO: 645115 - DNA, 169 bp, Homo sapiens
tataaaaaataaatctgcagttagaaaaaaaaaataaagaccctatgacaatgaatatttggccggtctttaagtggaacatgatccttaaggtgctccacaggcagataaatagctaaatttcctaagtagaaggttcacataccacggttcttggctggttccgcgg

SEQ ID NO: 645116 - DNA, 137 bp, Homo sapiens
gctacccaatttcaagctggccaaaacgctacctacctccagcaataccacgcacgcacgccacgtaccacccggccaccggcaccacttacccattactactacggcattagggcgaccacccggacaacacctac

SEQ ID NO: 645117 - DNA, 187 bp, Homo sapiens
tagaggatcccggctccacttggttgccaggcagatggcttgaactcaggagtcaagaccagccttgggcaaggtggtgaaattccggtctctgctaaaatacaaaaaataagcccgggggtagtgtgcatgcctgtaatcccagctactcaagaggctgaggcagagaatggcttgaacccggaaa

SEQ ID NO: 645118 - DNA, 300 bp, Homo sapiens
atcgagcgcggtactctgaacattcgtgtccattgatgtatcgtgatcaagagaaatctgagtcacgcgtttcatcagatataccaggcatattaatatatctcagaggcagcgaagacacaatagcgcactatgactgcccagcacccactgcatagtgagccgcacactgatgtactggaaatttacattggttcttgtgaggagattccatgacactagactcctctgaggaaaacctctgggtcacttcatcttctacaatggcttccaatcccttcttggggacacgaatgttca

SEQ ID NO: 645119 - DNA, 185 bp, Homo sapiens
ccccggtgcaggctggagtgcagtgtcgtatttgcagctcaccacagcctcgacctctcgggctggagcgatcctcccgagtcagccttcctagtagctgggatcacaggcatgcaccaccatgcctggctaatttttaaagtacagttttctaatcttatgggaccgtggtcatatacgtggtc

SEQ ID NO: 645120 - DNA, 190 bp, Homo sapiens
tttttggggcttcccccggggggggggggcccccctttttttgctttcaaaaaaacccctcccccctttccccaaaggggttccccaaatggggtcccctggccccctgtcctgggaggggttcaaagggttcccttatggactaggtttggaacccctgggtttaataaacttaaaaaggggtgtttta

SEQ ID NO: 645121 - DNA, 659 bp, Homo sapiens
caaagctgctgagatgacaggtgtgggccccacgccagcctggcgtcgagtggagcccttcacccaaacatgaaccaggaggcgagcttggtaaggagcacgtgggctcaggaatgcgagggggaatgaatggaggcagctcctcagtgtgcaaaaacatgcagcgcgggcctcactggtcaccatcacagcagccttgcagtgggatcaggacagtcctgctgtccaggaaggagaggaccctgctctcttgtttctcactacctgctcctgtcgttctagtcccattgctgctctcaggacaagctgtgactgagagagcaggtcacgctggtgacattttatgaggctggatgcacagccccacagcaccttgtcactgaagctacaggaatccaagaaccagtgctctggccaagaagggagcactggggtgccctgaatggcacggacaaccccagccccccgccttcactgattatcatgacctgtggcttctgaaaggacagggcagtcttggaactttctgagaaacagatggtcaagtagatgtctgttagctcttttcttgaaattgtagtgacgaaaccatgactgccacttaggaaagtaacttgtgttgaaataacttttagaacaaagtaaatacattaagaaat

SEQ ID NO: 645122 - DNA, 288 bp, Homo sapiens
catgtgcatagctgactcttgagggtaaacggacggccaggcgaagacgacattgagtcatgacactacgttgctagaatcacatcaagccttacgaaaagcaaaaggccagcctgccaggggtggtgaaagctctgggcagatatggtcctgccgatgtggaagacactacaggaagtggagctacagatagtaaagatgatgatgacattgacctctttggatctgaggatgaggagaaaagtgaagaagcaaagaggctaagggaagaacgtcttgcgggggctg

SEQ ID NO: 645123 - DNA, 920 bp, Homo sapiens
gtgcgctgggtggcttcacctaaaggggtgttgctcccccggatgggtggattgatgatatgattctaaatacataactggcagtgataatagagagttagaataacttatatctagggttaaagtgttcaataaggtgaatatatggagtactctggtaagtagtctagataagctatatgaaactggaaaattggaactcactgactcaaaataatacaattaatagagaactactttaacagaaaggtagtcatgatggaacttgaggtgtatgtggaggtctgctaagaaccttggttgacaggtgggtcgcagaggacctgtacggaactgggtgagaaaggactttcctctctgtcgggccttattttgtgcacaatcttgtagattaatgccgccaccggtgtgacataatcccgaagcaagcgggcaggtcgtttcagacgagtgagcaactgacggcgtctagctcccctcagcatttacttctatgtactaatgtagtggtatggataatcattatagctgcacaaggaaggcgtctgatggcgacgttgacaggcggacgggagaggtgagagagcaacgcgttagagtagtctcatagaactgtcgatgcgtttaaagagttggggtcaggttagcacgcttacgatgtgtgcgccttgagctaatgtgagcatcaggaatggggtcggaacaggaccgggtcgctttaggtgggcatggacccgagaacctatccgtgaaaaatgggtttgaagacggaaagttgcaatgcccggatggagggggtcagcaaccggggactgcggtgaacccccgtcacggtactgccaaggctcaacgaacttgtgagcccccggagcgggacctgagagggaggtgacccggggaaagcagctggccccgaccag

SEQ ID NO: 645124 - DNA, 461 bp, Homo sapiens
  misc_feature (18)..(18): n is a, c, g, or t
  misc_feature (66)..(66): n is a, c, g, or t
  misc_feature (69)..(69): n is a, c, g, or t
  misc_feature (76)..(76): n is a, c, g, or t
  misc_feature (90)..(90): n is a, c, g, or t
  misc_feature (108)..(108): n is a, c, g, or t
  misc_feature (115)..(115): n is a, c, g, or t
  misc_feature (122)..(122): n is a, c, g, or t
  misc_feature (160)..(160): n is a, c, g, or t
  misc_feature (254)..(254): n is a, c, g, or t
  misc_feature (258)..(258): n is a, c, g, or t
  misc_feature (325)..(325): n is a, c, g, or t
  misc_feature (370)..(370): n is a, c, g, or t
  misc_feature (440)..(440): n is a, c, g, or t
tatcaagcaaagatttgngaataactacaatgtaaactttattttaaagatttgggggggcgtgcnggnggaaaanaggagaagagagcngggcttagaacataacanataaatnaaacgangccaaatggagagcctttctttaaactatatatatatntgccacttattttatttgttgaaggtattttgagcggcttcctctgtcagcggccacccggctcttcttaacctgttttgttttctgcgcagcncggntaaaagaccaacgggggtggatcaaatataaaggccacacctttcagaccgaacctactcaaagatnctttactttgcaataatttgaactggagaaccaaagacgggagangaatgaaagcaaagatgcgcaaagaaccaaaggaaagacctgaaggaatccacctgcataggccacgcgntccactctgggtcaaatgctt

SEQ ID NO: 645125 - DNA, 379 bp, Homo sapiens
  misc_feature (18)..(18): n is a, c, g, or t
  misc_feature (23)..(23): n is a, c, g, or t
  misc_feature (83)..(83): n is a, c, g, or t
  misc_feature (155)..(155): n is a, c, g, or t
  misc_feature (222)..(222): n is a, c, g, or t
  misc_feature (312)..(312): n is a, c, g, or t
  misc_feature (320)..(320): n is a, c, g, or t
  misc_feature (329)..(329): n is a, c, g, or t
ccttttcctttgctgttncttgnaaactgctttaagacccgtttgccccgttggccctcgaaaaccccaaacaacctgcctgnagtcaaggccggctccttcttaaacttgctctcgaaaggccccgaagtggccgtgctggtgcagcgcccagncagcgtgtcgcgcacggtcttgggcctgttgacccagtcctgctctccagaacccgcggctcttgcnccgcaccttccgcgctcagctcggcggccccggcagcggtggacaggctgtcggcgggccccggtgcgcaggcggcggcggttgtttctnccttgtgncgccttcanctgctcgtgctccacggcagcgctgctcgacacggatgccggccgcttgt

SEQ ID NO: 645126 - DNA, 148 bp, Homo sapiens
tggtgtcgtctagacgatcccctatacgagcgcagctccaactttgcatactgtaaacacttaacgtttctgcaggtccattttatacaacttgagagacgtaaaacttttctggttggcaccaggcatatcctttctttttctggtt

SEQ ID NO: 645127 - DNA, 612 bp, Homo sapiens
tttttttttttcggaggaacacaattttatgaagactcacagttataagacaaagctaaaacatttatatgtggtgatgattaaaacaagcaacaacgagcacttctaaggggaatggcgcttctgaaggttattggtacatcacaaaaagtcatggcaaggtcccacttggtatcaaaaactgtgcatgtcaaaatttctgggtatagtttcaaaagagaacaaagaacacgacaaagggcgcccaagaggaaaaaaaaccaatatatttttcgcagcgagcaggcctttaatattatatctcgtctatcatccatacatatctgcgagaagaagtgagaaccatcaagaccctcaccagcaagcgacagagaaggccggagacgcaacgcgagcagaaagcacagaggacgacacacagccacacaagagaaagaaggagacaacaaacaatagaaggagagacggcgcagggaaaacaaaaaagacagggaaatcaaacaaagcaaggacacgcgcagagcagaaaaacaaaagacaaagataacaacccagcacgcggacaggaaagtacgagcccaaaacaacgtgtgcgcccaaaacagactgcag

SEQ ID NO: 645128 - DNA, 301 bp, Homo sapiens
acaaactatatcagcaattcttactttctaagtacttacactggttaacataaaataactgaggctgggcgcaggggctcgcacctataatcccagcacttggggaggccgaggtgggtggatcacctgaggtcaggagttcgggaccagccgggccaacatggtgaaaccctgtctctactaaaaatacaaaaattagcggggcgtggtggtgcatgcctgtaatcccagctactcaggaggctgaggcaggagaatggcttgagcctgggaggcagaagttgtagtgagctaagatcgt

SEQ ID NO: 645129 - DNA, 110 bp, Homo sapiens
atttgatgccttccttttagtgtttttgaatcacctatcctcagtgctgaaattgatttttgtataactgaggggtctgttgggtcaaacttatgttaggttttacaggt

SEQ ID NO: 645130 - DNA, 844 bp, Homo sapiens
gtccaggcggctccagagtccaggttttttgggggtcacagggtctcgggccagatttttcgtcgggcgttgtggccacacccggtgttcgaagctccccccccggggtgacccgagttggccccccctttgggcgggcgcctttctgtgctcaaagagggtggggtaagacgtggcgtaagaattcccggtcttcttttcgggcgccacttttttcgctcttttctccccggatccaagggtttatgggcccacaacacacccttttaggggggcgcccgacccaggtgaacacttatagggagggtcccccgtgtgctggtgtgtggtctcgatgtttcccggggaccccgggttccttgcaaccacggtgctgggcctccggagagccccagggtccctgcacgcgcgctcctgagccccctcccttcgccgggggtatcgtttgcacgccccgcacacactagccgtgcctctatggctgttcacccttctcttttgttttaaatgacttcattagggtccccgcaccatctttaggtgtgattattttctgcgaaccgcggccggtcaccctcctgattttagataaaagttagcctcaggtgttgtccccacgggacgcgctcgggggggccccattttgtgggcttcctcgctcgggacttgtagtaaggctcccccgagggcctcccccccaatgttggtttccactgaggaagccccccgggtttttcccccccgtattttttcatttcccaacccccaccggttttaaaaaagatttttttgtaaccaccccgttaatttggaaccattttattaaggggatccgcccctttta

SEQ ID NO: 645131 - DNA, 233 bp, Homo sapiens
  misc_feature (3)..(4): n is a, c, g, or t
  misc_feature (8)..(8): n is a, c, g, or t
  misc_feature (10)..(10): n is a, c, g, or t
  misc_feature (58)..(58): n is a, c, g, or t
  misc_feature (60)..(60): n is a, c, g, or t
  misc_feature (92)..(92): n is a, c, g, or t
  misc_feature (102)..(102): n is a, c, g, or t
  misc_feature (109)..(109): n is a, c, g, or t
  misc_feature (112)..(113): n is a, c, g, or t
  misc_feature (120)..(120): n is a, c, g, or t
  misc_feature (132)..(132): n is a, c, g, or t
  misc_feature (148)..(148): n is a, c, g, or t
  misc_feature (155)..(155): n is a, c, g, or t
  misc_feature (161)..(161): n is a, c, g, or t
  misc_feature (164)..(165): n is a, c, g, or t
  misc_feature (186)..(186): n is a, c, g, or t
  misc_feature (189)..(189): n is a, c, g, or t
  misc_feature (192)..(192): n is a, c, g, or t
  misc_feature (221)..(221): n is a, c, g, or t
  misc_feature (227)..(227): n is a, c, g, or t
  misc_feature (232)..(232): n is a, c, g, or t
ctnntgcncntttttaaaaatcttcaaaaggttttaccagcataggtgtgaataagantnttttttttaattaaagaaaaaatattcacctnggcacagtgnatctcancanntgcgcanttcccaggtacnttgtggccagcgcccnagcgccnagcgcngcnnattccacgtgtgcaaacccgnagngcngcgtgccaaagcacccagccccgtgcgcnacaaancgtcnc

SEQ ID NO: 645132 - DNA, 326 bp, Homo sapiens
attcgagctcgagatccgagcactgtctgcgggtggacaggaactgtctagactcccgctggtgagcattttacctccatcactgatgtctgcccatgccctgtctgcctgccaggctagacccactcctaaggaagtgctctgtggcccgagttcctccgcaggcccagggtccggagggagctctggggagattagaaatggggctggctgggcatagtggctcctgcctagaatcccagcactctgagaggccaaagcaggaggaaccacttgagccctggagttcaagaccagcctgggcagcaaagcgtacccgtctctac

SEQ ID NO: 645133 - DNA, 307 bp, Homo sapiens
caacggatgtgcccgctccggtcgagtcgaaaaagagtcgcttgcgcgagctgcgatcgacgagatacttgtcgggaacgccaaggatctccatgatacaggcgagctgctcctgctcgttctcgcccggaaagatcgggtagccagtgtacatctcggccatgatgcacccgagcgaccacatctgcgagggtgagaagagtatcagctttccgcaaggtcactcccgcgcacatggatcggcttacatcgatcgacatgtggtagttttgacccaagatgacctcgggggagcggcaatgcgttg

SEQ ID NO: 645134 - DNA, 293 bp, Homo sapiens
tgggacacctgcacaccagtggccttcttgatcacggtgtctcttagacaggtccacgccatgtgagggcatgcacagaggcaggcagctcggcagcagtcggttcacttctgctgtgaccttactgttgtctccactgaggcccacaatctcatcgaccttggtacgtggggcagcgatttgggcagcaatctggggcagggcctctagcaccaaggccatctatgggtgcatccccggtatttctgggtaggcttctgcctttgagcttcaatccggtcagccttctgact

SEQ ID NO: 645135 - DNA, 205 bp, Homo sapiens
ggctgcttgctgtgagtggtctctgagggtgatacgtggggtagagagaggtgctgggtccagcgccagagcccagcgcgccctcgtcgacatgcctcggaaaattgaggaaatcaaggacttctgctcacagcccgacgaaggatgccaaatctgtcaagatcaagaaaattaaggcacatgggatgtaaattcgttgacgcag

SEQ ID NO: 645136 - DNA, 359 bp, Homo sapiens
gcggccgcctactactactactgctcgaattcaagcttctaacgatgtacggggacatgcttctggctgagtgatgtgattcacgcctgtaatcccagcgcttgggaggccaaagcaggaggattgcttgaggccaggagtttgcgatcagcctgggcaatatagcaagacccccatctctacaaaaaataatttttaaaaattagctgggtgtaatgacacacacttatgatcctagctacttgaaaggcctggggtgggaggatcgcttcaggccaagagttcaaggtcacagtgagctatgattgtgccactgcactcagcctgagcaatggagcaagaccctctctcttaaaaaa

SEQ ID NO: 645137 - DNA, 100 bp, Homo sapiens
gttgctgaaggttatcatcctgggagattctggagtcgggaagacatcatttatgaaccagctatgtttaatcagaattcagcaatcagttgcaaagccc

SEQ ID NO: 645138 - DNA, 637 bp, Homo sapiens
  misc_feature (96)..(96): n is a, c, g, or t
ggagccggagcgcgcgagctcgcaggcgcgaggaacgagcggtggctggctacgcacccgagaccgggcactgctgcgctcctgctcaggacccgngacccgagcgcctgatcccggccctatccccctccggccccgtggtccaccccggtctggcctagcggagcactccgcgtccgcccgccgcagacagccgcgtccatcccgcagccccggacccgctatcacaggctcgtcaggatggacgtgtctatgacagggcctgtccatggccaaggcagggcgtcgcggcagcccgcggagaaaacacaagcagggtggtcaaccagaggcggcggagaagaccaaggagggcgtcctctacgtcggaagcaaagacccgacgaagagtgtggtaccaaggtgtggctttcaagttggctgaaaaaaccaacgggaacaggcctcacattctgggaggcagctgtgattctcatgggcgcagggaacatcgacagcagcacacaaggactggtgaagagggaggaattccctactgatctgaagccacgaggacgtggcccaggaagctgctgaagaacactgattgagcaccatgatggagccacgaagggcgagagtaatgaggaccacccca

SEQ ID NO: 645139 - DNA, 937 bp, Homo sapiens
ggacgagagagaactagtctcgagttttgtgggttttttttaaaaaacaattctctacgtccactgtccccaagggtctatcctaaacgagtggtggccacaaccctttaaaagcaacaagaaaaagaaaaagggcaatataattgcaaaaggcagccagaagctctccaagaatgcccttgtcctcaggacctcttccccgaagtttaggcagtggccactcagggtcttggccacaggacaggggatgtggtctcagtaatacctgtcagggggcaagagcacaagtctgtctggaaggggtcggggagatcgcaggagaaggggatttgttgtggggatctcaccaatgggccataggatggaattcggcgggtcgacaggctagatttatgccaagacaaaaagagaacgcccctagagagcctaaatcttacaatgaggggatcctaatcctgggaaaatggggtagaaatagtaaaatctcccccaggacacatcgctcataacacaaggcaaaataaaagagaacgcaatggctaccttagaaagcgggtgaacgcgcgcacaaaggattgttgccattaaaagccataaaacgtgaaatgagaaatctcaacaggaacaaacgagccaagtggaaacaaattgcgcaaattggggccaatccgaggacccccaaataggacaagggccaaaccaagaggcctgccgacaagaataaccacctagaagaggaccgcgagaaatgaaaaggacacatagagagggatcaaaaagggaaaaagtcaacgagaggaagagacacggaaggaccaggggaaaaagccgatacagagggacaaaggggcaaccaggaaaagcccccagggcccacagagaagacgccccggcaggccgctgaaaaaatgttaggagagcacaaagagacaacgaa

SEQ ID NO: 645140 - DNA, 152 bp, Homo sapiens
  misc_feature (35)..(35): n is a, c, g, or t
cacgaggctgaaagctgataacaagcttggctgancaggaggaattcagagtctccagaaccgatgatgtcttgcaaatattggagcatcatttcctaaagttccttgcaacatgaacccatttatgtcacaccaatcttgacttccatatg

SEQ ID NO: 645141 - DNA, 671 bp, Homo sapiens
  misc_feature (146)..(146): n is a, c, g, or t
aaagaggcccgcccgctggggaggattctggagccgaggggcagaacatctctcggcgtggaagggcacgttccgaggttttataagagtggttctccctgttccagacttcgcacatgctaatctccacccccgcgccagcggcnggacgttgcgccctgtagggggaagtggtgctgcggcgggggtcctgtcttcttctgtaattcctgtatttgcatacggggaccccccccccgactgattttttttcctccatctaaattgcgagggtactgtgaactttacgtattttacctactgaaacccgtttaaactcaaaaggtccgcacttggagttcgttgtctcattaggcagtgcactgaagtttagtggacactatatcctgagatttcacacagatgccaagaaaggcggaaatggagcacacatttagtgcattaaaggacctaggataacttcgtttccttcatttgaatagtacctgctatgcatcagataatgtccatacttaatctatgacgtatttattattcctaactttatagatgaagtattcggggttcagagaagttacttcaacatacagtacttcagaatgctgataaaaggcacagtttaaagccagggttgtctgactccaaagctccatgcccttgcccctgtgaaa

SEQ ID NO: 645142 - DNA, 323 bp, Homo sapiens
ttccgggttgtgcatcccgagtacaccgactacggggactaatcttcaactcctacatacttcaccagctctacagccacattccttgagaccaccacactgactcctacaactgacatatccacagaatcttttatgacaccaatgatttctactacccccatcacttcttcaatgactctcagaaatacaatgacttctatgacaactgctgcctcccggcccacaacgactaatacattatcatcactcaccagtagcattttatcatccacacctgtcccaagcacagaagtgatcaccagtcaaaccacaaacccgga

SEQ ID NO: 645143 - DNA, 633 bp, Homo sapiens
ctgagaagacggtcgaacttgtactatctagagtatagcagcactaaaagcactctgagtcaagatgagtgggaaaccatctcaataaacacattttggataaaaaaaaaaaaaaaaaaaaaaaaaaaaaaaaaaaaaaaataaataaaaaaaaaaaaaaaaaaaaaaaaaaaaaaaaaaaaaaaaaaaaaaaaaaaaggaaaaaaaaaaaaaaaaaaaaaaaatgggcccaaatttgatcccaattggccaaatggcccttaaagggggcctataaaaaatcaacggcccgcgtttaaaaaaccttgaaatgggaaaaaccttgggttacccaaattaaagcctcttgaagaaaatcccttttcctccagttgggtaaatccaaaaagtgcccaaacgatatcctttcccaaaaattgtctatccttaatggcaaatggaaattggcaaccttaaatttctggaaaaatatcgcctaaaatttttggaaaatcattttatttttaacccataggccaaatacggaaaaatccctttaaaacaaaaagataatcctcaataggttaaaggtttattcattcctgaaaaagagtcctttttaaaaactggcttataacttgggtctttttgggc

SEQ ID NO: 645144 - DNA, 230 bp, Homo sapiens
ttagccggtccgtgggagctggggttctgtgtacacgctgcccacgaaggggagctggggttcctgtgtgcacgctgccttcacgaaggtgggagctggggttcctgtgtgcacgctgccttcagtgaagtgggagctgtggttcctgtgtgcacgctgccttcacaaagtgggtgctggggttcctgtgtacacattgccttcacttcgtgggagcacttcgtgggcag

SEQ ID NO: 645145 - DNA, 587 bp, Homo sapiens
  misc_feature (226)..(226): n is a, c, g, or t
tgctgggcctctctccgcagccgcgagacctggcgcttggcgcatatgccggttctaatttacaagaacacctgcggcctgagtgccgtgagagtcccttcaacccgtggagtgcctggccgggctgcagtggagccgagactggcgccattgccctccagcctggtgcaaaaatgagcgaaactcctgtctcacaaaaaaaaaacaagcatggcctgaaacctangtgaatgcttgctcggatggctgccatggcccctcttctcccgggctctgtgtccggaaggtgtaccgctcctgaggcagcccctgggttcccagcacgctgcgcgagaagcagggcggacgattgtataggccagtggagcccgagagattgcctacagtaaattgccccttgtgtgggaccctgattcaggagggctttctaccccagcacaattcctggcacggtgggatcgggcggccataggactcttgaaaggcacttcccacctgaaaaatggtcccaccgaagggtcgtaacttgtcttgctattcaggtacttgtagataaactccgtgaagacggacaacgactgtgagcc

SEQ ID NO: 645146 - DNA, 462 bp, Homo sapiens
ggcacgaggcagccacccagaccatgctccgccgactgggcgcccaagctgcagtcgccctctgtgtgcaggcagcagctgcctggcaacccccgagctcgctcgcgctgtcagcatcgcagaactagggccaggtgtcccagtggctgcggccaagccaggcattctgaccggcggcggcggctgcacaggagcgagaactgagaagccgccgctcaaccccacacggggtgactgctgagggcccataccaacggccccgatctccctcaggtggaggactgggcgggaggcacagcctgggggccctcaggctgggcgcgctggcgatcccgaggccgaccaggccatgcacctccagcccgcctgggcacccaagctgcagccgccttctgtgtgcaggcagcaacctccaggcaactcccgaatccgcccctcacttcccacatcttggaacgaggg

SEQ ID NO: 645147 - DNA, 949 bp, Homo sapiens
  misc_feature (7)..(7): n is a, c, g, or t
  misc_feature (36)..(36): n is a, c, g, or t
  misc_feature (108)..(108): n is a, c, g, or t
  misc_feature (126)..(126): n is a, c, g, or t
  misc_feature (134)..(134): n is a, c, g, or t
  misc_feature (136)..(136): n is a, c, g, or t
  misc_feature (139)..(139): n is a, c, g, or t
  misc_feature (172)..(172): n is a, c, g, or t
  misc_feature (181)..(181): n is a, c, g, or t
  misc_feature (205)..(205): n is a, c, g, or t
  misc_feature (215)..(215): n is a, c, g, or t
  misc_feature (232)..(232): n is a, c, g, or t
  misc_feature (248)..(248): n is a, c, g, or t
  misc_feature (252)..(252): n is a, c, g, or t
  misc_feature (275)..(275): n is a, c, g, or t
  misc_feature (281)..(281): n is a, c, g, or t
  misc_feature (302)..(302): n is a, c, g, or t
  misc_feature (321)..(321): n is a, c, g, or t
  misc_feature (326)..(326): n is a, c, g, or t
  misc_feature (366)..(366): n is a, c, g, or t
  misc_feature (373)..(373): n is a, c, g, or t
  misc_feature (377)..(377): n is a, c, g, or t
  misc_feature (380)..(380): n is a, c, g, or t
  misc_feature (397)..(398): n is a, c, g, or t
  misc_feature (402)..(402): n is a, c, g, or t
  misc_feature (425)..(425): n is a, c, g, or t
  misc_feature (496)..(496): n is a, c, g, or t
  misc_feature (502)..(502): n is a, c, g, or t
  misc_feature (552)..(552): n is a, c, g, or t
  misc_feature (596)..(596): n is a, c, g, or t
  misc_feature (602)..(602): n is a, c, g, or t
  misc_feature (606)..(606): n is a, c, g, or t
  misc_feature (630)..(630): n is a, c, g, or t
  misc_feature (633)..(633): n is a, c, g, or t
  misc_feature (683)..(683): n is a, c, g, or t
  misc_feature (692)..(692): n is a, c, g, or t
  misc_feature (698)..(698): n is a, c, g, or t
  misc_feature (701)..(701): n is a, c, g, or t
  misc_feature (703)..(703): n is a, c, g, or t
  misc_feature (705)..(705): n is a, c, g, or t
  misc_feature (710)..(710): n is a, c, g, or t
  misc_feature (713)..(713): n is a, c, g, or t
  misc_feature (715)..(715): n is a, c, g, or t
  misc_feature (730)..(730): n is a, c, g, or t
  misc_feature (734)..(734): n is a, c, g, or t
  misc_feature (736)..(737): n is a, c, g, or t
  misc_feature (739)..(739): n is a, c, g, or t
  misc_feature (818)..(818): n is a, c, g, or t
  misc_feature (824)..(824): n is a, c, g, or t
  misc_feature (840)..(840): n is a, c, g, or t
  misc_feature (844)..(844): n is a, c, g, or t
  misc_feature (858)..(858): n is a, c, g, or t
  misc_feature (937)..(937): n is a, c, g, or t
ggcagangcggccgggtctgcttcttccctgtcacngccgcagcagcttggggtgcaaggcggcctggggcggcggaatgggcgccccccgagttccgtctgaggaancggcggctgccgaggaantccacgananccnggtcccgcacgcccctggggtccgggtgctgangcgccgccnggccgcctccccgggccgcggcancgctccgaancaaccgccctctccaanggggccgcggcaaacnaatnggggcccttccctctaaaaaacncaaaantgcaaaaagccccaaaaaaanagaattgtaatcgtcaacncaacnggaaaaaaaaaaagcttcaatgcccgggaactcaaaaaanaagcgcnaaangtnaatgggtggcggtcacnnaaantttgccaatttccacaaaaaaangtccttcaaaaggtggagagatgtcgaataaggaaactgcagttacttgctcaccagtatatgatttcaantaaaantgagttctacattagtgaaagcttgcctgaatattttgcaccctatcaancagagcggtttcgaagacttggctacgtgtctctctgtgataangaaaanacangttgcaaagcccgggaactaaaancantttatgtggatgcagtaggacaatttcttaaactgatttttcaccaaaancaagtcaanaaaaanaanananaaaancangntgctttggttgccanaaanannantggagaccctgcagatttcagtgatgaaagcaatactgcctctcgagagaagttgattgaccactaccttgggcacaanagcgangaccctgctctagaangaangtacgccaggaaanctgactatatctctccgctagatgacttagcttttgatatgtaccaagatccagaagttgcacagatcatacgaaaaanagatgaaaaaaa

SEQ ID NO: 645148 - DNA, 114 bp, Homo sapiens
cctgctgcgtgcccgtgaccaaggttacggcgtgccggccgaagcgctgaagaaggccagcgagcgcctgctgcgctacctgcaggaacgcaacctgatcgaagtcgactacag

SEQ ID NO: 645149 - DNA, 121 bp, Homo sapiens
gaacatggtcagtttagttgcgagacatgtaatagcaatttcaaaatatcatgaaaatgggccccttcagtcagatcttggggatgatccctggtttgggacaaatttatgagcaaggaat

SEQ ID NO: 645150 - DNA, 110 bp, Homo sapiens
cttatctcccatgcaagcatggccaatcctattcttcccggcgtaggtcttcacctccgtcctcatcctcattcgagccgtcagacccggcccatcctcaatggatgcag

SEQ ID NO: 645151 - DNA, 531 bp, Homo sapiens
agaacgggtcacgtgagcgcctcgcctggatgtgagtttcagccagacctgtggatatctgggctttgggctgtatgatcattgagatggccactggaaatccctatcttcctagtagttctgatttggatttactccataaaattgttttgaaagtgggcaatttgtcacctcacttgcagaatatcttttccaagagccccatttttgctggggtagttcttcctcaagttcaacaccccaaaaatgcaagaaaaaaatatccaaaagcttaatggattgtcggcagatatagttcatagacggggtttcaccctgttggctgtggttggccaggctgctcttgaacttctgagcttaagtgatccggccaacttggccctccaaagtgctgggattaccggcatgtagtaccggacccagggcggtcatgcttgtgtacaaaatgagcctggtgaccgatatcatctagagaacctttgcgttatggagttttactgaagaggggttctttgaaaaaaattgaaaagg

SEQ ID NO: 645152 - DNA, 153 bp, Homo sapiens
ggacttacagagtagtactgcattactccctccgtctcagatcgtattctgctctatgtgtagctgccgcgaaagagactcgcagtccggcccttgcgacacgtgaaaaaatcacccagcgcgcaggcgcgctacgccccatgccgtacgccg

SEQ ID NO: 645153 - DNA, 362 bp, Homo sapiens
tctacaggatctacagggctgtgggtaggatggagtctagctgtgactgtgccaggaggggtgatcgagtgaagccaggtccagagagcaagctgtagcagaggtaccagcttcgcctggggcttcaagaacctcccatctatccccattcctgagacaggagttacagtcccgttttggccctcacatccaactagagagactgataccactgtgagtggctggcttttaattcccctgggccagacctgcagccttgccttcatcccttaactccaggactccaggggcagagtccctggccttcagccaagaggccttgccagcttggggtgccaccaacaagcgcctgggggtaccga

SEQ ID NO: 645154 - DNA, 1036 bp, Homo sapiens
  misc_feature (1036)..(1036): n is a, c, g, or t
ttttggttatgatgtctgtgtggaatgcggcctggtgcagcacattcaaattgttattattatgtcttacaagcataaataaaaaataaaacacttattgaatcaatcaaatcatctactaattaaaataaactgtaataaattcttaaaagctggtgcgctgcgattgagttttcttccccgggtcctttatgttcccttttttttttcaaaagcggcccccgggtcgccactctttatgtctactaaggcccgacacagcgatacaaaaactccagccccccccccgaatgccacagttgctccccgacttttcttggaggatcccccgcttccctctggtgcgcggccatagtccgcgcaagcatcccgctggtgtactcccggccacgaaggacatttccaccgagctttgtgccgtacctggctctgaccagccctgcggataccctgagtccgggaaagtccgtccgccggcgtgctcttggccttaagccttttttccccctccttctgttttgtatttttaaaatccttagccttgcttcaggtgcaagtgccccacggtctgcggctgcagaagaatccgagtgtttggcaggcttacggagaggaccacactgagaaatgaatgctgagacccccggacacgggtctgagccacagcgtgctcgccaccaaactgattctcacggttgtcacccaacagttgcagccttcacttttacttggaactttcaaaacctaagagtacacctccatccgtgttgtccttccgccgctcctacccatctttacgctgtgccggccgcatttctcgtactctcctctatacatctgcccatattggataaggtcttaacacacttatgccccccctttttgcctctattccccgcttcacttcccccgactatctttcgctctaccccacactccccgtccactacactgctctctctagtctcccacaccctctacggccacaccacgttccctctttccctcacctacgtctctccccgtcacctctctn

SEQ ID NO: 645155 - DNA, 147 bp, Homo sapiens
cagcaagggacagacagcagacgaaaagaggtgcaggccagtcccaggaagtcgagagaggccattcttggacccagtcctgttgacacctattaccacctacccccacagaccctgtcacactcactgaaaattgactggaccaga

SEQ ID NO: 645156 - DNA, 256 bp, Homo sapiens
tcgagatcttctccagtaaaatataacactgatcttgggttatacgctcacgaaaaagtgaccagacctgaagaagtattttgacagttgtaatggtgacctcgatcctgagattgtaaagtcattcctcttccagctactaaaaggctggattctgtcatagccgcaatgtgctaacacagggacctgaagccccagaaccgctaataaacaggaatggggagctgaaattggctgattttggccaagatctcga

SEQ ID NO: 645157 - DNA, 177 bp, Homo sapiens
  misc_feature (28)..(28): n is a, c, g, or t
aatgcagttaatacatgactcatgtatnaaaaatgtacatcatggtttcatggaaacaatgccccaccaggttggctgcctggatgatggatccctttccaaaaaccgaaaagcagaatggaagagacgggggtaaactggacggtgtgtacggggtgaggtgtcacttacagagag

SEQ ID NO: 645158 - DNA, 463 bp, Homo sapiens
gtcccattaatgatatggactcaaacatgaaccttactactaattactttcgcaccaattaatctagaaggacagattctttactctctcaacataaatttctctcttgaacaattctcctaggagagggtatcaaaatcaacttgtgaacctcttgtgggatcttagttattaaagtatttactctcattttagaaattctgattattttgggcgagcttacaggaccatagtttgagatagtcgactagaacatattcgtgcattacagccttgaatacagaatagcattggaactgatttcctcgataaattgttctgacccattcagggcattttggggacagactctacagtttactagtgggcccaggacatactgcaaaagaagtgaaatcagtattggagaagtggtctcatgaatatgggatctcgactactacaattgcctgttggcttctca

SEQ ID NO: 645159 - DNA, 1082 bp, Homo sapiens
gggaatgcagtagctccttgctaacgatgtttcaggaggtttggggcactatggtcttaatgagctctctgtcattcagggcttctctgggccatggtccccttcctctctggaacctgtgatgctatctcaccatcctagcagacctttaggtgctggttcactagctgtcagataactcagttcttgtgactcgatactgccgatgagcgaaggaggtggcctcgcgagagcatggctctggagctgcttggatgtctttagcgtgcggagtggtgagactggtctcccttcagacatgttagtcggggaaaccctcgcgtctactaggggtgatacacgatggtgacttttaaacgagcaaaagctagagtttctatgtgagaagatgctggaagacatgagtgttaggacatgtgtgaaggtccacatggagagacctgtgatgtctgctattgcattagtgctgtccgttatgacggtaaggcccatttgttgaacgtgttacacctgttgcatttcttcattttggatgttgtccatgtcatgttacctgtcatgacatcgcgttcaattcaaagtcgaaaacttggtacctggttttttacattcacaaagaccacaaaacacaagaacttcgagggccaccaaaggcaggaatgcggacgaaaaaacaggtaaatagaaatgggccctgtggcactacgaaatgagaccgtgaacccgcgtatcctgggagccaaacagaagaagaccggccgggaccccctaaaggagaagcacataaaatacgcaaacacccagggtgaaccgccataacggacgcggaaagtgagaaggaacgcgcaagcacggacagacagcccgcaccgggggacacccacgtgaccacaaaggggcttcgacaagccatatatagagaataagtcaatacaggaaatgctacaacaaaagggtcatactgacgaatcataaacaagtactaacagaaacaaaacaaaaagaaaacaacagttcattcatcatcgaaacaagagaagacaaataaccagcgcacaataaattcaacattttccctccct

SEQ ID NO: 645160 - DNA, 86 bp, Homo sapiens
gactgggatctgtgtctaggagtaatttgcagttatctaacataaacttgatttgcagtgatctgtaagtaattctgtataatacg

SEQ ID NO: 645161 - DNA, 600 bp, Homo sapiens
  misc_feature (600)..(600): n is a, c, g, or t
gtgttttgccaggctggtcttgaactcttgggctcaagcaatcctcctgccttagcctcccaaagtgataggattataggtataagccaccacagctgacctgtttttttttattttttattttttgtttttgagacgatgtcttgctctgcactccagcctgggcgacagagagagagactcatctcaaaacaaaacaaaacaaaaaagttggccaggcgtggtggctcactcctgtagtcccagcactttgggaggccgaggtgggcggatcatgaggtcaggagatcgagaccatcctggctaacacgatgaaacgccgtctctactaaaaatacaaaaaattggccaggcgtggtggtgggcacctatagtctcagctacttgggaggctgaggcgggagaatggcatgaacccgggaggcagaagttgcagtgagccgagattgcgccactgcactccagcctgggcgacagagtgagactctgtctcaaaaaaaaaacaaggttttgtggagatgaggtcttgtggcttgtggcgttgcccgggctggtcttgaactcctgggcttaagccatcctcccacctcagcctcccan

SEQ ID NO: 645162 - DNA, 992 bp, Homo sapiens
ggggcggataagtgcctcaggagtcctgacgcaatgtcttggggcgctaacggcggcggcggccttgtgtttacagctccagaagctcccgcatttggccgcgttctcgccgctcgcaggctcccggtgacgatggtggccccgcctgctgtctgcgcgcctggccccaggggcgctccgcggattggtccggcgagcccccagatcgcggcctgtcacgcagccggctccagaggccccggacagatatccttgcaggcgtcgaggcactcgtgcccacgcattgcagctactcacggacaggtctgtccaggctggcgtattcccaaatttgaaagacgccattcggatataccctctatgtgcacaaaaggcctctcttgagtgatcgggcatttcaggaaatgaagaacaattttgcaacagtgtttgacagactgggatgtgcaaaagagctgcgtgagcatgctgggttgcgtctgggacgaggcgataactaaacatatcgagctatcattttgtggaccctggtttgatactgtagcctatctgctcgagactccgtatgtctctgaacttttactcctgtttatgtgcttttcaatcctgacccagattctgagtgtaatgaccagttcacccgggctgtcacacatggactgttgctgccatccggttcctgaagacagctccgtgactgggcttctggaggcttgagtgttccacttgatgccctgcgaaggagtgaaactatgacttcaaggagactcgtcgcttggtgccttcctctctgtcctgttatggggcctactggcaaggggtatccgggatttgtcccgatttcggctttcagcacctggttaccaaccatcggatgatctttccggtaagccgacccctggtcctgggaggaatttacttttgccggccaaggactgtggccgtcgacgctttatagtaaagcccggttcggcttaaaggcttctcctttg

SEQ ID NO: 645163 - DNA, 134 bp, Homo sapiens
gcttgatgcgtgtggtcagatctagaggatcccggcctccctgtggttgcagagtactaagtcaggctctctcataagtcaatggtcgtatgactaggactgttaaagctgggtaagccatgtgggaggccggt

SEQ ID NO: 645164 - DNA, 347 bp, Homo sapiens
ccccccccccccccggtatcccaaaaaaaaaggggggggttccacaacttggccttcccccttaaagggccttttttggggggttctcccttgggggaattttccccggggtttcccagggggggttttaaggtaaaagggttttaccgggggtttccgccttcaaaaagcaggggggggaaattttgggggttccccggggttttttgccaaaaccccgggttgggattggggaaggggggaaaaccaggtcccttaaaccccaaaacccggggtttaacaaaagggggggggggcctcttttaacaaaaggggtatttatttttttaatttgggggggcccttta

SEQ ID NO: 645165 - DNA, 923 bp, Homo sapiens
caggtgaacagtggtatatgcagccactccagcctctgctgcaggcataccaccctggatgtggctgttcggagaggcctgtcccactggagcccagaggctgctgtgcgtggcctgggacagctggacctggcctccagacctcgcccatgacgggaggagtctgtggctgaacatcaggggcacggaggcggctgccctatccatgttccatgtctccactgccactgccagtgatgaccggtggtttcctgatgctgcatcttgggcttggtgcttgccccttgtgcctatgggctttcccagcctgaccttggttgctggttggctgctggaggccatggccattggcccttgcaagggcccaccacagcttgcactccttggcttgcaattgcttcagggtcgggcttgcgcatgtggggccgacgtccttgggccctacctgtgaagagagaaactcacagatacccaggtctatgcaagtggatcctaggcccgggttgcctgacatgggagtagggcacccgttcctaagccatatggcgcactttcccttcgtgttgggcgcttccaccacatgaggcacggtccatgtgccctgcattttacccttgcacgaatgggccagcttgaatgcctcacgttggcacggactggtgcaaggtgcccatacgctccaccatgggttggcgcattggcaacatgtccgggaccaatgggtggtggaagccgcttcgtacaacgccgccgaggaataatttggaccactcgtgcgaacggcccatgtaagcaccccaggcagggtctgccaccttaagaaggtaatcaccttcgaaacgggggtccccaatgagccattacggcggtaccgcaaagcctttcttttgataccaaagcgttgtgtcccgctagtatggtga

SEQ ID NO: 645166 - DNA, 485 bp, Homo sapiens
gaagcgcacgaaggcgcgtccgtgtgaagagaccaccaaacaggccttgtgtgagcaataaggctgtttatttcacctgggtacaggtgggctgagtccaaaaagagtcagcgaagggagataggggtggggccgttttataggatttgggtaggtaaaggaaaaagcggggttgttctctggcgggcaggagtgggggtcataaggtgctcagtaggggagcttctgagccaggatgagccaggagaaggaatttcacaagacaatgtcatcagtttaggcaggaacaggccattttcacttgttttgtggtggaatgtcatcagttaaggcaggaagcggccatctggatgtgtacatgcagggtcacaggggatatgatggcttagcttgggctcagaggcctgacattcctgtcttcttatattaataagaaaaataaaatgaaatagtggtaaagtgttgggacgcgccatcgtgcgctt

SEQ ID NO: 645167 - DNA, 162 bp, Homo sapiens
ggcaaggcgcagtcctaaggcatctttgcattctcatgccttggaagctgctaggtgctcagtaaaggctcagctcttcagatgaggccacacttgcccccatggccatgcaacccaaatcctcccaatgacccacaacccgttcccagcatggttcagcac

SEQ ID NO: 645168 - DNA, 537 bp, Homo sapiens
agcggggatccagccggcgagctgcctctctggagcccaggtcttgggccccctgtactcacctgctcttcctgggctggctgtctcctgctcatccagccatgcggtggctgtggcccctggctgtctctcttgctgtgattttggctgtggggctaagcagggtctctgggggtgccccccggcatcctgggcaggcacagagccggagacccaggagcagcagagccgatccaagaggggcaccgaggatgaggaggccaagggcgtggcacccaggtatgtgcctgaggagtgcgcggagatacccccggctcatatcaccctgctgggcctgatagccaatcaagcgcctaggtggtctaccagactcttaaacccgactaaggatggggggcaccccaagacagtgggcaggaactcgaggggcaagctgacagggtgcaccagggccagaggctacagatccagaaccccctgtatccgggaccgagagctcctgacaggcctatgccatctatgcttctggcgctggtg

SEQ ID NO: 645169 - DNA, 2054 bp, Homo sapiens
  misc_feature (1571)..(1571): n is a, c, g, or t
gacgcggaggcaggaggagcagtcatcattgttccgggagccgtcaccacagtaggtccctcgtgatcagatcgtgccagacacatctcaggcctccccaagccccgacaaacgccgcgcggactcgtgagacagcaggaccacgagcggacggcgtgcaggcaagcatgacaaggacatgcagtcatccagcacatcaagggcatgagaaggaccatggaaccaagtactaccatagcgtggatacatcgttccactcgggacaaggaacacagcaccccgggacagacaggaacacacgcggataccaaaggatacccaagatatcgaatgaggaggaagacacacagacgggaaccggaaggaaagcgaaacgcacacagcagggcacggacaggaacagcacacgacgggcacacccgacagggtgacacagcacatgaaaacacatggagaacagcagacagccacctcgggagacaggcagatggacctgggcgaacaagaacagagcgaaaatgacaacacagacacggacacccgcgagagcaatagaagaccacacgagcagaaaggaacaaccaccaagaaagtggcccagcgaacacacagcgaacagcacagattgcaccgtgccaaacgagaacccgcacacgagcaccaccacgatctagaccacgatagggcgaaagaaacaaccaagcacaacaaacgatgtggacacatcatgtccggcacgaaccgctgacaacgactagagagagaagacacacaaccgagaagagaggaaaacaccaccccaccaagtggcgcacgcaggagcaaacacagcggcatacatacacgacacaccacgcaagcgacacacgagcacacaccaagcgagaggaaagaaataacgacggagaggacaacaaaacgtacaccgcgagcatgacacatacgacgggcgacgaaaacatcgaccaggagacgaaagaacacggaaaggagagtgaatacacacgagacagaacaacatagtagagatcaacgccacgacagggaaagagacacacgaagtagcacagcagcagcaccatcgataccaacataaacagtaggaccagtaaggaaacgacacaaatgcagacccagaatcacaaaaagaagaacaacagccacataagacaggagacagcaaacagaacaagcgaacttgtcacagaagcagacgaggggagcgaagaaaagcaacagacaacggagcaaaagaaaaagaggagaacaccagaacgaggaataccgacgaaaggcaacagtacgagatagatgaggcacaacagaccacgaggacagcgaaagacaaacagcacactagcatcgagagtaagcgaagtagctgacagcagaacgcccgcgatcagcgagacctcgcggaccatcaagaacacatcacaccacgacgccgagcaagatgcagggatgcacgagccgcgagatgagctaacggagacgcagacaagcgacacacaaagaccagaagctgaaagtacgaggtaagcattgataatggatagccgacacacacngcagagacagcagcacgacgcggaggcaacacaccgcacactaatagacgaggcaaatcgcagaggacaggcgagagcgcgccggaagacgagcggaacggtaggaccacagatcagcagagaatcagtcacatgacgcacatggccactgctgacagcccactgacacaacgcagcggagccacagacgaggagcgcgacgcaacgagagcggagcagagcgcacgacgcagagcagcacacgaaagaggaaaagcacaggacagaagcggagagacgaacgacacacgcgcaacaaagcagcagcgagagacagacagactcaggaacagagcacgcgagacagggcacgcgccacctgcagccaagagggacagcgagcgagagagcacacgacggctaagagcggacacacgcgaagagccaaggcgacactaagcaagcacagagatagacaaacacagcagaatcaaagaaaacaga

SEQ ID NO: 645170 - DNA, 602 bp, Homo sapiens
  misc_feature (568)..(568): n is a, c, g, or t
ttacaacagctccagttacaacagcttccaagctttccatgggtctgcactgttacgatgagaaaaaaatcctccagtcctgtgtcaaaatctccctacaactggtgagcaatgaataaacttctcagcaggtaatattattcagataagcaatagtaagggtgaaccttatggaaaaatgctttaaaacaaaaaagagagccctgtagctcatgttttagtagaaagccacacgcagataaagataacacctaccttcttgtcaacaaagacctcaagacccataggattagctacaaccaaccaacattcaccatgtttcccagatgggaaaaacaatagggctagtgctttgcaagtccactgaaggtgaaaaagaaggcaggaaaacgccttcagtgcctgcaaaccgtgagtctgtacagtcttcccttcagctccaaatgcccctggcagacacttactctatctggcaatggggttgagtggaccttccgaagcgcctcacttaccctcatggtgtttcagggatgagtgtcaggtcgagggacagttttggttgcttcanatgggacatgtcagtgatggccaaagtcactatg

SEQ ID NO: 645171 - DNA, 107 bp, Homo sapiens
cttattatgttttttcccttttaagtaagggggtcttgttatggataacttcccaaaagcatcggtaaacttcgggtacaaaaatattccattaaactctttccggg

SEQ ID NO: 645172 - DNA, 783 bp, Homo sapiens
  misc_feature (90)..(90): n is a, c, g, or t
  misc_feature (134)..(135): n is a, c, g, or t
  misc_feature (147)..(147): n is a, c, g, or t
  misc_feature (207)..(207): n is a, c, g, or t
  misc_feature (213)..(213): n is a, c, g, or t
  misc_feature (222)..(222): n is a, c, g, or t
  misc_feature (229)..(229): n is a, c, g, or t
  misc_feature (232)..(232): n is a, c, g, or t
  misc_feature (254)..(254): n is a, c, g, or t
  misc_feature (256)..(256): n is a, c, g, or t
  misc_feature (260)..(260): n is a, c, g, or t
  misc_feature (280)..(280): n is a, c, g, or t
  misc_feature (325)..(325): n is a, c, g, or t
  misc_feature (327)..(328): n is a, c, g, or t
  misc_feature (339)..(339): n is a, c, g, or t
  misc_feature (342)..(342): n is a, c, g, or t
  misc_feature (514)..(514): n is a, c, g, or t
  misc_feature (531)..(531): n is a, c, g, or t
  misc_feature (572)..(572): n is a, c, g, or t
agcgggagggagtgcgtggcgaggccaccatcatcaccaccaccctccagcaggctcctgcggtggcggccgccgcggctccccaggacnccgcgacaagagccgggtgggcagcggtgcaccccaagccgcgnncccggcgcccgncggcctcgtcgcaggaaacccgggtggggacggggcccccgcagccacgggcaccgcggncgccgnctctttagnccaccgncgncgacagcgaagacgcggagaananagtnctcgccaccaaagtccttgngcactgtcaaactgggtcaacgtcagaaatggatatggatttatnanntcgaaatgacnccnaagaagatctatttatacatcagactgccagtcaagaaagaataagcccacagaaatatctgcgcagtgtaggagatggagaaactgtagagtttgatgtggtttaaggagagaagggtgcatgaagcagccagtgtgactggccggggtggagttcctgtggagggcagtngttacgcgctgattggncgccgttacagacgtggctactatggaaagcgccatggccntccccgggattacgctgggaggaggaggaagaagggagcggcagcaagtgaaggatttgaccccctaccactgataggcagttctctggggcccggaatcggctgcgccgccaccagtatcgcccccagtacaggcagcagcggttccgccttaccacgtgggacagacgtttgaccgtcgctcacgggtcttacccatcccaacagaata

SEQ ID NO: 645173 - DNA, 172 bp, Homo sapiens
gctcaaatccactatctaaaaaacccccaaccttataacttacctcctcacaccctattcggcaccaatctatcaccctatagaagaactaatgtccgtataggataacatgaaaacattactcctccgcatagtcctgcgtctgattaaaacactgaactgaccaatgctt

SEQ ID NO: 645174 - DNA, 1159 bp, Homo sapiens
  misc_feature (352)..(352): n is a, c, g, or t
tctctcagtaagtaaaggttatgctaatttttgtttgttcttttttttttggcaatccatattacatgtgtaactcccacgtgcatccccacactctgaggggtgggacgtgttattctcccgtggtttatacagatggggaaactgaggcttgtgagcaagtgcggcagttgtgcccccagaacttaccagaagcctagtgggctatacatctcaggagtgtttacaacactgtggtggttcctcctaatacgtgggcgggtgggcaagtgggtgaaacaaccatgtgttgggggggcagcgccattgcattattaaaattctcagtgggaaccctttcataacttcttcncataggaaggttagtttacttctgtgggtctgcgtttggggttctttaacacaagagcaaaaacagagtctgtggcctcgggtccaccccgaaggccataaaaagtgtgcacagggtgtggccagtctcctcggatctcaacgcgacaaacccggtcgtggcctctccccgagggggtctcgaggggggccagaattcctcatcgctgtgtgcttgtccaggcccctctcccccgagggggtataaccccggtgggggcacatctcacccgaggggcgtgtgtgtgccccaacgccaatgtgtgccccccaagtgtatacagatgtcttgatggggcataaatataggggggcgataaaccaggacgtcgacgaaattgtgacccaccccatagtgtttgtggggaccaggaggaagggggctccctgcgaaagattcctcgcggtgggaaaccccgtgtggtgaggaattcccgggcgtcgcggacctttccgggggctcttcccacaaagaagtgtggccgtgggggagaattttataaaccaggggggggctatttggaaaggcccccaaagttggggtgcggccctcgttggtgttccccccgttgggggtagcattaataaaggctcttccccaaatttttgtgacagcaggtgaaatttggttgtgcgcccaaaacaaaattcgtggaatggggcaccccctgaggaaagagaagggggacaacaccatgttgtcccgtgcttgtggggggcgtgaaaaaacacagagaatgggggagggtgccccttgacggaaaacacc

SEQ ID NO: 645175 - DNA, 118 bp, Homo sapiens
gatgtcgggacgacgggacgacggactgtcgtgacgacgggacgggactgtctggacgacggggacgacggactgtcgagagacgggacgacggactgtcgagacgagggacgacgga

SEQ ID NO: 645176 - DNA, 384 bp, Homo sapiens
gagtttttcaacaactcgatgcattccattctgtccataaaaggaggcagtgttgaattgcagctgttgaaagatacattccttctctattggcaagaaatattatctgtgactgaatcttcatcttactttgtcaaccttgttcacaccattaattacaagccccataaacacattaacaatacaatagtggttttaggttatgaacctaatgtcacgccctgaccttagagatcctttttattctctattttggttaggtcagggtgtgactagggtgggtagtctagttttttcatttctatagttggcctggtatggatcctaatcagaggcagctgtctattgttgtctctgattggggtcgacgcggccgcgaattta

SEQ ID NO: 645177 - DNA, 704 bp, Homo sapiens
gcggggaaggaggatggcggatatcatcgtgaagactccgggaggactgggatccaaagaacgtgatgatacatggaaggcctgatggagagctcccggtactttcaatgattggaccaatggccacgtttccactacctgtgacgctgcacatgtgactgactgaggtgcacctgtgcatggactgactagtcgggcgtcgtggcaatgccacatggatgctctatcagttgtgcacagaatgttcatatgcatgcgcttgtgttgtggatgaccgagtctgtgttgcagcgcattgcgactgaagtgggatgaattgcgccagtttccctctgatgacgatcagagcaatgtgcgtcgctgtaccctgcctggtgtgccatagagtctcacggcaatcatctgctggtgtggcaatggacccccatggaggggccatgctggcacatgctgcgtgtgtttgcacatgagtgcgtgaacacatgctcccttgtggccatgctgacctggactgccctgcatgcataaccgccaggccctcagtcttccacatggagattgctgaaggtggagagcccttggcacgtaccagcatggactccatgtggccatgacagactgaatgagaaggcaaatgtgcatgtgccacttatccaccaggagggcaaccgtgtttgtaccgcgaggggcatgtgaagggaggc

SEQ ID NO: 645178 - DNA, 489 bp, Homo sapiens
  misc_feature (12)..(12): n is a, c, g, or t
  misc_feature (46)..(46): n is a, c, g, or t
  misc_feature (95)..(95): n is a, c, g, or t
  misc_feature (103)..(103): n is a, c, g, or t
  misc_feature (226)..(226): n is a, c, g, or t
gcgagaagccgncgaggggagcagataaagcttgggcctggtggcntagtcggttctctccccgtcggagcctttgccgcaaacatgtccgcccngatctcgntcagcccagaagcatccgagcttgatccccttcttggtatttattggaactggagctactggagcaccactgtatctctgcgtctggcattgttcatcccagatgtttgttgggacagaatancccgagcctggaacaactgggtcccatgatcatacagttctactcagtgatgtggattacagcagctgaagaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactc

SEQ ID NO: 645179 - DNA, 850 bp, Homo sapiens
atcagaatttaaatgacaaaagagaaggaagaggctgattgctggagtgttatagaaatcttggccgggcgtggtggctcacgcttgtaatcccagcactttgggaggccgaggcgggtggatcacgaggtcaggagatcgagaccatcctggctaacacggtgaaaccccgtctctactaaaaatacaaaaaaaaaattagccgggcgtgatgtgcgggcgcctgtagtcccagctactcgggaggctgaggcaagagaatggcgtgaacccgggaggcggagcttgcagtgagccgagattgcgccactgcactcccgcctgggccacagagcgagactccgtctcaaaaaaaaaaaaaaaaaaaaaaaagaaagaaaattttataaaagccaagggttaaaaaaacaagtagcacataacgacctagggaacgcttcctaggccataaaagagcctttgaagttactactgaactgggttttagacacaattgacgtcatggagtgggaccaacgtgatgaccatcaaaaaagcttttctaccccaagattattggactcagcagacggaatatagggaacgattggtccaatactcacctgcagaaaacaaagggcgccagggcaaggatataggattctttctaaccaggcaaaacgtgggtatttcccaaaggggagataaattaatacactgataaaccctggaatgatgaaatcgtacagggaacgctattggtaaacgtgacgcatatcagacgcctatctgtggaccacataaccccaccggcactaggtgcagagaacatatgcgcgttcaaacgataacacgacgttatgtaagaacg

SEQ ID NO: 645180 - DNA, 298 bp, Homo sapiens
gctttttaattttggggtaaaaaaaaggcaaatgggtaaccttgccccccttttactcaatagcgcacacccccacgagcccacccacccagagataccctgtctttttctttctttctctccctttctctctctggcaagttcccaagtttttatggtcattttttaggtggggcagcaaaaattcagggcaaataagcccccccaacagcaattttttttttttttttttgggaacagaaaaccccccaaacccccttttttaaccccccctcaacagaaacaaaggattcctcca

SEQ ID NO: 645181 - DNA, 797 bp, Homo sapiens
  misc_feature (1)..(1): n is a, c, g, or t
ncaattgcgggggcggaataaatgttccgttccccctaggagaggggccttccgtttcccacgccaatttttaagagagttgtttctactcggaccatcaagttgggtgccccgggaattgtacccccctttcctaggaatagcccaggtttcctcagccaaaaaaaactggtttcaggagctgttcttccagaaatgtcagcggtaattgcagtcacagcttgtctagagaacgtggtactggttaggttgaacccatggcctcagcaccctccaaagtggtgccagagcctgaacatgagtcccgggaggaccgccccttcaggaagcgtatgatcttcttaatcatggcgtcctggtatacatggaaacacctgttggcacagcagtcaatgtggttcagtcagatggacggagcgtgcttttagccagctgtttgcccatgctatgccggtcatggtgattagtaccgtacccccctggtcccagggccctagggctcacttgaaaacgtcgaaagtaagcacagcgtgcatgtcctcaggcaggacctgaggctcaggcctctcccatccatcgatcatgggctcaatgttcttcaagcagcttatatgcaatccaagtctcctggatatagaaaggaaaggagtttgcatgccgctgtacccgtctaggtccccttgtaggcaggcaggtgttagcaggccctctgtcccgaggttgggcccaggtcaggtcgcctgtccttatgtcctcgtaaatgtatgccttctccgccgaagtgtaataaataatcc

SEQ ID NO: 645182 - DNA, 401 bp, Homo sapiens
  misc_feature (9)..(9): n is a, c, g, or t
  misc_feature (353)..(353): n is a, c, g, or t
  misc_feature (382)..(382): n is a, c, g, or t
  misc_feature (386)..(386): n is a, c, g, or t
  misc_feature (401)..(401): n is a, c, g, or t
aaacccccnatctcctattacaaatacaaaaattagcccaggtgtggtgatggtgcatgtcatttcatttcacacacaaaattgttgtggatgccttcaaccttaaaaatccctggcccaggcgccgtggctcatgccctgtaatcttagcacttcgggaacccgaggtggctggatcacccgaggtcaggacttcgagaccggcctggccaacatggtgaaaccccatctctactaaaaatacaaaaaaattagccgggtatggtggtgcatgcctgtaatccagctacttgggaggtgtagacaggagaatcacttgaacccgggaggcagaggatgcagtgagccaagantcgtgccattgcacttcagcctgagtganaaangaaaaacttcatctn

SEQ ID NO: 645183 - DNA, 238 bp, Homo sapiens
cccccaaaataaaaaaaagttttttcccaggaatttgggggggggtggctgggggctgcgttttgccccccccaggatttaaaggattaccgggttttcccatgaccaaaattttaagattggtttctactattcggtccccaaaactgaggctttttgaaaaaaaaatgtaaaatgttatttgttttattatagcaattattcctaattaaagcagtatttaatgcaatttccagtt

SEQ ID NO: 645184 - DNA, 984 bp, Homo sapiens
  misc_feature (641)..(641): n is a, c, g, or t
  misc_feature (984)..(984): n is a, c, g, or t
agcggagcgggcgagcaagggagcgagcaggacaggagcctgatcccacagcagctgctccagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggttatgacaatcgcctgagaccaggattgggagagcgtgtaaccgaagtgaagactgatatcttcgtcaccagtttcggacccgtttcagaccatgatatggaatatacaatagatgtatttttccgtcaaagctggaaggatgaaaggttaaaatttaaaggacctatgacagtcctccggttaaataacctaatggcaagtaaaatctggactccggacacatttttccacaatggaaagaagtcagtggcccacaacatgaccatgcccaacaaactcctgcggatcacagaggatggcaccttgctgtacaccatgaggctgacagtgagagctgaatgtccgatgcatttggaggacttccctatggatgcccatgcttgcccactaaaatttgggaagttatgcttatacangagcagaagttgtttatgaatggaccagagagccagcacgcctcagtggttggtacgcagaagatgggatcacgtctaaaccagtatgaccttcttgggacaaccggtagaactctgggagttgtccagttcaagttccgggacgactttgttggttgacccctcctttccccttggaggacaaccggatgggtaccttggtttttcaaagctacccttcgctggtaaggccgggattccttcaaaggtctcctttggtccacagagagttcgtgcccccacaggacacggggttgggggtagcacgtgccacgagtgacactgtgactcggcgaaatcccgn

SEQ ID NO: 645185 - DNA, 1274 bp, Homo sapiens
  misc_feature (261)..(261): n is a, c, g, or t
  misc_feature (310)..(310): n is a, c, g, or t
  misc_feature (328)..(328): n is a, c, g, or t
  misc_feature (931)..(931): n is a, c, g, or t
  misc_feature (1274)..(1274): n is a, c, g, or t
agcgcggggagagaggcgagacgagtgctctccccacacgtgtaaccctgcatctcccagtttcagagcttgcgttcattcatatgcaggcagtggtttaatatttgatcaaagctgcagatggatatgggaagcaaattgggtgtgaaatcttcagcaaaggagcacgcagagtccatgatggctcagaccaagtgagtgagaggcagagcgaggacgcccctctgctctggcgcgcccggactcggactcgcagactcncgctggctccagtctctccacgattctctctcccagacttttccccggncttaagagatcctgtgtncagagggggccttcagctgctccagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggttatgacaatcgcctgagaccaggattgggagagcgtgtaaccgaagtgaagactgatatcttcgtcaccagtttcggacccgtttcagaccatgatatggaatatacaatagatgtatttttccgtcaaagctggaaggatgaaaggttaaaatttaaaggacctatgacagtcctccggttaaataacctaatggcaagtaaaatctggactccggacacatttttccacaatggaaagaagtcagtggcccacaacatgaccatgcccaacaaactcctgcggatcacagaggatggcaccttgctgtacaccatgaggctgacagtgagagctgaatgtccgatgcatttggaggacttccctatggatgcccatgcttgcccactaaaatttgggaagttatgcttatacangagcagaagttgtttatgaatggaccagagagccagcacgcctcagtggttggtacgcagaagatgggatcacgtctaaaccagtatgaccttcttgggacaaccggtagaactctgggagttgtccagttcaagttccgggacgactttgttggttgacccctcctttccccttggaggacaaccggatgggtaccttggtttttcaaagctacccttcgctggtaaggccgggattccttcaaaggtctcctttggtccacagagagttcgtgcccccacaggacacggggttgggggtagcacgtgccacgagtgacactgtgactcggcgaaatcccgn

SEQ ID NO: 645186 - DNA, 992 bp, Homo sapiens
  misc_feature (649)..(649): n is a, c, g, or t
  misc_feature (992)..(992): n is a, c, g, or t
agcggggttgtaacctgatgtttcttgctagagacattgatctctacttatctacttttcagctgctccagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggttatgacaatcgcctgagaccaggattgggagagcgtgtaaccgaagtgaagactgatatcttcgtcaccagtttcggacccgtttcagaccatgatatggaatatacaatagatgtatttttccgtcaaagctggaaggatgaaaggttaaaatttaaaggacctatgacagtcctccggttaaataacctaatggcaagtaaaatctggactccggacacatttttccacaatggaaagaagtcagtggcccacaacatgaccatgcccaacaaactcctgcggatcacagaggatggcaccttgctgtacaccatgaggctgacagtgagagctgaatgtccgatgcatttggaggacttccctatggatgcccatgcttgcccactaaaatttgggaagttatgcttatacangagcagaagttgtttatgaatggaccagagagccagcacgcctcagtggttggtacgcagaagatgggatcacgtctaaaccagtatgaccttcttgggacaaccggtagaactctgggagttgtccagttcaagttccgggacgactttgttggttgacccctcctttccccttggaggacaaccggatgggtaccttggtttttcaaagctacccttcgctggtaaggccgggattccttcaaaggtctcctttggtccacagagagttcgtgcccccacaggacacggggttgggggtagcacgtgccacgagtgacactgtgactcggcgaaatcccgn

SEQ ID NO: 645187 - DNA, 269 bp, Homo sapiens
cccgactagcccgacagtggacgtgttgtgtgtggcgatccagtgctgctgtggactgggcgtgatgcttcaaggaggcctgaggctgtggtgttgtcaggtaagagtgttgtttcatgtggagcctgggctgctgtcgggctagtcggggctgtcgggctagtcggggctgtcgggctagtcggggctgtcgggctagtcggggctgtcgggctagtcggggctgtcgggctagtcggggctgtcgggctagtcgggggggtaccgag

SEQ ID NO: 645188 - DNA, 1073 bp, Homo sapiens
  misc_feature (730)..(730): n is a, c, g, or t
  misc_feature (1073)..(1073): n is a, c, g, or t
ggaaggcacgctcttgtcctggctgcaaaattgcctgtttttccctttccagtggacgctggtgaaatgccctcttgtgtaggggtctctcccattctgaacacgaaaactcaacttagtctttgatatggatggcatggcagctgctccagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggttatgacaatcgcctgagaccaggattgggagagcgtgtaaccgaagtgaagactgatatcttcgtcaccagtttcggacccgtttcagaccatgatatggaatatacaatagatgtatttttccgtcaaagctggaaggatgaaaggttaaaatttaaaggacctatgacagtcctccggttaaataacctaatggcaagtaaaatctggactccggacacatttttccacaatggaaagaagtcagtggcccacaacatgaccatgcccaacaaactcctgcggatcacagaggatggcaccttgctgtacaccatgaggctgacagtgagagctgaatgtccgatgcatttggaggacttccctatggatgcccatgcttgcccactaaaatttgggaagttatgcttatacangagcagaagttgtttatgaatggaccagagagccagcacgcctcagtggttggtacgcagaagatgggatcacgtctaaaccagtatgaccttcttgggacaaccggtagaactctgggagttgtccagttcaagttccgggacgactttgttggttgacccctcctttccccttggaggacaaccggatgggtaccttggtttttcaaagctacccttcgctggtaaggccgggattccttcaaaggtctcctttggtccacagagagttcgtgcccccacaggacacggggttgggggtagcacgtgccacgagtgacactgtgactcggcgaaatcccgn

SEQ ID NO: 645189 - DNA, 404 bp, Homo sapiens
caccagattttattgtagtaaatgatcaaatagactagtatctacatatattttatgcaatcgtgacatctaaagtttcctcaattttctcaacatttctgggctacacagttcatctgagtttttcaaattattgcacatgttcaaaagtttttccagtgtatttattgaaatctgcatataagtgaacacacatagttctactgttcgagtcaacagtatgtatgtatatactattgtttctgtatatatgtatatatgtgtgtgtgtgtgtatatatatgtgtgtgtgtatatatatatatatatatatatatatatatatgtatatatgcttatgtataatatgagatttattgatttattgattggtgttgtatttgattgtatgtagatgtgatgtgt

SEQ ID NO: 645190 - DNA, 650 bp, Homo sapiens
ttgtagaaataaactcttatgtgtgttgtggtatatgatatcgtggattcctagagaatatggaaatcaccgttcaagtcgggggagacatacccaagtcatctgtagagatttggacccccccacagtaatacatctttatcatagtcgtggcgcgttgcctaactctccgagaaatctacttctctcgctgtatatatgcgcggcagcacatctcgtgcaccacgcgctaaagtacacaacgctagttttggcgcgacaaatctatctcccacaccgctccacacacattctatgtggtgagcatcatcacctacatggtatcgcggaggatatctcctctctgtacaacaaactgtttgtgtctgttacaatgcaattcggtatatgagtgcggcaggcggcacattgggctcccacccacagcagatcacctcatctcctgtattggaacaaggcacgaccccttgcggtttctctgtgaacacatcttttcagtgtcgtgtctgttacaagataggtgatgataccccttcgcacgcccgctcgtctattcgttatgtagtgatgacatgacatgggccgccttgtacacgtcaggacagaaattcaaccatgtacccacccaggacactacaaatggaagacaa

SEQ ID NO: 645191 - DNA, 1323 bp, Homo sapiens
  misc_feature (16)..(16): n is a, c, g, or t
  misc_feature (84)..(84): n is a, c, g, or t
  misc_feature (134)..(134): n is a, c, g, or t
  misc_feature (310)..(310): n is a, c, g, or t
  misc_feature (359)..(359): n is a, c, g, or t
  misc_feature (377)..(377): n is a, c, g, or t
  misc_feature (980)..(980): n is a, c, g, or t
  misc_feature (1323)..(1323): n is a, c, g, or t
gcatataaaaaatggncggattggtctccagatccagaggctggtaccaccttcctttctaaaataaaatctctctggcatgangtcaccgcctatttcacatccggtttgccctgggacgtattactactgtnttggtaaagagaaatcttttgttgtatagctgcagatggatatgggaagcaaattgggtgtgaaatcttcagcaaaggagcacgcagagtccatgatggctcagaccaagtgagtgagaggcagagcgaggacgcccctctgctctggcgcgcccggactcggactcgcagactcncgctggctccagtctctccacgattctctctcccagacttttccccggncttaagagatcctgtgtncagagggggccttcagctgctccagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggttatgacaatcgcctgagaccaggattgggagagcgtgtaaccgaagtgaagactgatatcttcgtcaccagtttcggacccgtttcagaccatgatatggaatatacaatagatgtatttttccgtcaaagctggaaggatgaaaggttaaaatttaaaggacctatgacagtcctccggttaaataacctaatggcaagtaaaatctggactccggacacatttttccacaatggaaagaagtcagtggcccacaacatgaccatgcccaacaaactcctgcggatcacagaggatggcaccttgctgtacaccatgaggctgacagtgagagctgaatgtccgatgcatttggaggacttccctatggatgcccatgcttgcccactaaaatttgggaagttatgcttatacangagcagaagttgtttatgaatggaccagagagccagcacgcctcagtggttggtacgcagaagatgggatcacgtctaaaccagtatgaccttcttgggacaaccggtagaactctgggagttgtccagttcaagttccgggacgactttgttggttgacccctcctttccccttggaggacaaccggatgggtaccttggtttttcaaagctacccttcgctggtaaggccgggattccttcaaaggtctcctttggtccacagagagttcgtgcccccacaggacacggggttgggggtagcacgtgccacgagtgacactgtgactcggcgaaatcccgn

SEQ ID NO: 645192 - DNA, 266 bp, Homo sapiens
  misc_feature (17)..(17): n is a, c, g, or t
ccccccggaactgtttnggatgaagcagatagtgaggaaagccctgccaaaattgactccgagaatccttggatacctgtggttccaaaaaatgttgagccgtagatgccgtcggaaatggtgaagggagactcgaagtactctggggcttgttggagggtaaaatagagacccactccaattgtgataagcaaggcttgaaatatccggattcagccgatttctattagaccctgcggccctcggaaccttgatactcttgatgc

SEQ ID NO: 645193 - DNA, 894 bp, Homo sapiens
  misc_feature (1)..(1): n is a, c, g, or t
  misc_feature (176)..(176): n is a, c, g, or t
  misc_feature (208)..(208): n is a, c, g, or t
  misc_feature (220)..(220): n is a, c, g, or t
  misc_feature (235)..(235): n is a, c, g, or t
  misc_feature (238)..(238): n is a, c, g, or t
  misc_feature (242)..(242): n is a, c, g, or t
  misc_feature (292)..(292): n is a, c, g, or t
  misc_feature (295)..(295): n is a, c, g, or t
  misc_feature (302)..(303): n is a, c, g, or t
  misc_feature (320)..(320): n is a, c, g, or t
  misc_feature (325)..(325): n is a, c, g, or t
  misc_feature (334)..(334): n is a, c, g, or t
  misc_feature (339)..(339): n is a, c, g, or t
  misc_feature (360)..(360): n is a, c, g, or t
  misc_feature (364)..(366): n is a, c, g, or t
  misc_feature (385)..(385): n is a, c, g, or t
  misc_feature (388)..(388): n is a, c, g, or t
  misc_feature (399)..(399): n is a, c, g, or t
  misc_feature (407)..(407): n is a, c, g, or t
  misc_feature (409)..(409): n is a, c, g, or t
  misc_feature (413)..(413): n is a, c, g, or t
  misc_feature (422)..(422): n is a, c, g, or t
  misc_feature (431)..(431): n is a, c, g, or t
  misc_feature (446)..(446): n is a, c, g, or t
  misc_feature (456)..(456): n is a, c, g, or t
  misc_feature (467)..(467): n is a, c, g, or t
  misc_feature (479)..(479): n is a, c, g, or t
  misc_feature (489)..(489): n is a, c, g, or t
  misc_feature (491)..(491): n is a, c, g, or t
  misc_feature (522)..(522): n is a, c, g, or t
  misc_feature (530)..(530): n is a, c, g, or t
  misc_feature (640)..(640): n is a, c, g, or t
  misc_feature (676)..(676): n is a, c, g, or t
  misc_feature (692)..(692): n is a, c, g, or t
  misc_feature (699)..(699): n is a, c, g, or t
  misc_feature (834)..(834): n is a, c, g, or t
  misc_feature (864)..(864): n is a, c, g, or t
nttaatttgtttaaatttcttataacacttcattataattgttttatacaaacaacagtttaaatttacttatgtttatctatttatttgcttactagtttttcaatttcagataatccttttagaatcatttcccttcttgaagatcatccttttgtagtctctttactgaagtngtgctgaggataacatctgtttttcatctgancatctgtttgtntcagtttcgcttgtngcnaatnctaagctaatagttttcctcagaattctaccctctttcgggtacattgtngcngttaggnngcctactaagtatttgnctgtnttgctttcnctganctttttctccccatggttgcntttnnnatcttgtatttgggatctngtnatttacaatancttgggtntngggntgggttttntttaaatanaggggtgggatatantgggcttccngaatttatganttcatgtttttncaacaaattngngaaattgtgttatctttcaagtactgcctcncctttatnctctaaattttctctttctaggactcctagtctttataattcttgccctcgaactctcttaactttccaatgttttctagcaccttgtttctcctcactgctcactgggnaatttcttttagatccagcttatagtttagttcacnttgtctcttcagctgngtctaantaaaatattcaacatgtctgagggcttttttcttatttcaataaatatttctcatttttaggagctctatttggttctttttcagatctgcctgttggttccaacttcattccttatgttggtgatgaacccttnaagacctgagttcaatgtttattttttccnatagctttcttgtcatgttagtctgtttca

SEQ ID NO: 645194 - DNA, 166 bp, Homo sapiens
ttagcggctatactttgctccaaggtagttatatcctgtctgcttttgaaagcttaaattagtattcgctaatttgtctattggcatctctctgcatttcgatgaactgcagttctgagccattctgcagtcctgccaggtcacccactgtgcccccgctagggga

SEQ ID NO: 645195 - DNA, 104 bp, Homo sapiens
ggaagaggagaactccagcattggtcataaccgttctgcctccctaatgagacacctctttgctgtttacttcctcctctataacagtgcgggctgtgtcctta

SEQ ID NO: 645196 - DNA, 292 bp, Homo sapiens
tggaatgcaggcggactacagaagatgaacaggcagagaagcaaatagccaccagaagtgcagcaagtcttgcgatcctggggaagactgtgcaagttgtcagcaagatgagatagatgtggtgccagagagtccattgtcagatgttggctctgaggatgttggtactgggccaaaaaaatgacaacaaattgactagacaagaaagttgcctaggaaacttctcctccagtttgagaaggaaagtgaacccgagatcacctgatggatgtggactacattctaacaacat

SEQ ID NO: 645197 - DNA, 235 bp, Homo sapiens
  misc_feature (117)..(117): n is a, c, g, or t
  misc_feature (146)..(146): n is a, c, g, or t
cagaggatacaggtgatgactgtccgtcctgagtcactgctactcagctgaggtgagactggctgaaggtgtacaggtgcctctgtgctatacagcagttccctactgaagactggnagcgctcagcctggcgacggaagactggntctgcagctcccaactgctcaggccactgaattgggtaggagcaaacacatggatggtcttaaacgcggtctttgcataggctcttaag

SEQ ID NO: 645198 - DNA, 567 bp, Homo sapiens
caggcatcacctgaggtcttgtaatgtttcccctgtagataaggggaaaatactgcatgtaacttacttgtttactttgtctgtgtctcctgatagaatgtaagctctatcttttgcttactactgtgtccttcatacatagaacagtgtctggcacaaagtaggcactcaatatacgttgatgaattaatgtcactaacttcagtgatttcactactggaattgtagtagaaaaactatgctcacacatgctcaaagcctgttcctgtaatccagctgtaacctgggctctgttttcactttctgtttatgatgtcctgaactgagagattatttttttaaggtcttgtttaaaagtttatgtctaggatacactaaaaaataacaacatatcagaaataaaagagataagactgctaaaaaaaaaaacaaaacaaaaaaaaaacaaaaaaaacaacaacacaaaaacacacaaacacacaaaacaagaacaaaacacaaaaaaaacacacaaaaaaccaacacaaccaccaccccacaacccacccccacacaaacacaaacacc

SEQ ID NO: 645199 - DNA, 155 bp, Homo sapiens
cgggctaaggacgcggtacagatgggagacgcgggaccgagggagtaaagtgaaacgagggcgataacgtagctgtcaccattaaagagaatgctcttcggatccctcgactactgctcggcatactcagcaactaataaacgacgccggactgc

SEQ ID NO: 645200 - DNA, 417 bp, Homo sapiens
  misc_feature (409)..(409): n is a, c, g, or t
gatgtcccatgttgggatcgtatgaaggagagcagcaagcatggtccgtcagctcgtagatagcccttataccgcagtaccttctaatcgccaataggcatcatggttcccacagtaatcagctgggactccagggtgcacttggtgcctgaccgatgtcctcgtaaaagcatgcctgggcgtggcaggaagctcaaggttgatcgcagaggcaacgacggggtccaggcagcagtagcagcagtgcgagcagccctgcacccccaacggcccgcgacggccgcgcagcgctgcccgacccccgcccgcggcatcccgaaaagacgcgatcggcctcaaccgagctgcgagacgcagggtcaggtctgcgcggactcaccgcgcgcggcaggcctcagcgaaggccacnccgcaaag

SEQ ID NO: 645201 - DNA, 101 bp, Homo sapiens
tggtgctctagaggtcccgtgtgtgccacacagtaattgcagataaaaacaaaatcttgaaactttttaagtcttcaaaagtgttggtgttggggataata

SEQ ID NO: 645202 - DNA, 819 bp, Homo sapiens
  misc_feature (459)..(459): n is a, c, g, or t
  misc_feature (538)..(538): n is a, c, g, or t
tggggctcctaaagggggtaaagggggtgctatagggtaaatacgggccctatttacaaaaattttcaggggaattaattctaggacgatgtgggcattgaaacgtggtggttgtgcctccacagaatttctcagaaggcatttgcaccgttagttattaccccgcggtctcgtgttacgcggtgaacaggtggtttcgggttataaacgtctccgggaaatgtgtgcctctctgtgtttttataaaccgcctctaatgtgtgtgggcgaacaccgcctcatgtgagtgtcgcaaaaccgttcttgtgtgtgacgtgataactatattatattaccagaatgtgggggcgctctcacacgtcgggagagttacataccctcgattgtgctcacaccgttcagaggggagtctcgccgagagtctcgcaccgtggggtctcatagagaaatatacagtgngcggggacagtctatttgttacgcgaagtttttgcaagaattatagtctccgcacgcgaataagctcggagtgtatacnctcgcgataggggctctcagtctacccctctgtgtgtgtgggcccccaaattgagactctctggactgggcgctaaccgggggacgggcgaatacttgtatgagaacactctctgctcttgtggtgtctctgtgtacaccggggagacatcgcgcgttacgggagcatttgcggagcaagtgggccagaattcagaggagaccctaagcgaattagatgtcggcgcgccccagggcaattacgtcccaacaaaccggggtctaccataaaatacacccttg

SEQ ID NO: 645203 - DNA, 465 bp, Homo sapiens
agcccaaaattgaaacagccctaatttctatcaactaacaagtgaataaacaaaacgtggcatatccatacaaggaatattattcagcaataaaaaaagagatgaagtactgatatgcaccacaacatggaaaaaccttgaaaacatatcaagtgaagaatgccagacatgaaaggccacatattatatgatttcatttatatgaaatgtccagaacaggcgaatatatatagagagaaggcagattagtggttgcttaggctgaagggttggggaggacaaaggggtgactgctaattagtatggggtttcttttttggggtaatgtaaacgttgtaaagttgattgtggtaatggtggcacaactctgaatatactaaaaaccactgaattgtatactttgaatgtttgaactgtgtggtatgtagattttatctcaagttgttataaaaaattaaattacaa

SEQ ID NO: 645204 - DNA, 552 bp, Homo sapiens
  misc_feature (23)..(23): n is a, c, g, or t
ctccccggagtccgtgtaaatangttaataacccttacacactacttaacaccctcaatactccgccctcccccaacccccaccaaaaaacacactgccgttttcttacaaacaaaaactgaccccctccccccaaaccccccacgccttaatctactaccccccatccccttactccacctcactcaaccacactcccacacacacctcaccccacaccccaaacccccctcaccccctcccaccacaccccccccacccctccaaccacactcccacattaaccacaaacactctccgcaccccccaccccccacaccacatacacacaccccaacctaacaacccaccctacttccactacccccaccacctctcaccctccccccccacatatctcacccgcccactcctacccacacccccctcaccccccacctcctcccccccccacctacaaacacccccctacaccccctccctccccaacactcacaccccactccaccaccaccctccccaccccacccacatttcactcccacaacacac

SEQ ID NO: 645205 - DNA, 386 bp, Homo sapiens
  misc_feature (338)..(338): n is a, c, g, or t
tgagacagtcttgctctgtcgcccaggctggagtgcagtggcgcaatctgggctcactgcaacctccacctcccgggtttgagcgattcccctccctcaacctccagagtagctgggataacaggtgcatgccaccacacccggctaattttttatttttagtagagacagggtttcaccatgttggtcaggccagtcttgaactcctgacctcgtgatccgcccgcctcggcctcccaaagtgctgggattacaggcgtgacagctggcatggccacattttatttttcaaaggagtcaaaggtttcttgggccgggcatggtagcttcagggactnttaatcctaggcaattttggggacccccaaggttaggagggttccctc

SEQ ID NO: 645206 - DNA, 966 bp, Homo sapiens
agcgggtgtgggaagcgcccgcgctttcggcgggttccgttaaaatgtgcgccctggtggcctggcggcgcccgcgccttagcctgtcaggagcagggagcttgcggggcgcagggaagggcgcgggccgcgggtccctgcgcgtgcggaggcagtggcggctctgcccggaccaccgtgcacggctccgggccgaggatggcgaccccggaccagaaagtcgcccgaacgtcctgcttgcagaaccttgttgctgcaggatcctgggcaggagcgaacgcttgatgttagccccagcaagtccaagtatgctgtgcgggtgatgggccagcaactttcgccccaacgtgttgaagagagatgaattttagatagctgaaaaaatcagagaaagagcttattcgaccaaggaaagagcacgcaggatgctgcacttattttcagaactccacagaacaacttcattcaccagcgcagttttgaaacactacaatggtcaaatacttctaacttcttgctgagcctcagtgagggaccccacgcaaggcagcagagagaagggttactagctatgctagggtaatttgctcaaggcctttaccaaagagatgccccagtcaaagcccctttacctactatgccagggctcagaacccttcccctgaaggctaccaagatcgcgagttgcccaggtcaggccctagatggttccgtgaagcggtgggagcagcaggtggtatcagcagcattggccctgtgttgccccttaagtgggccccatgatgaccttgcgaccagcagtcatcttcctccctcagtgacaagttaaattagaggcgtccaccggagtacgaaaatcgggcttcgaacgactgaatgggggtcaagagccatccggcttgagccattaaaagttggggattcgacgtttattagaggagcggcgaccactaagaggggtgtcca

SEQ ID NO: 645207 - DNA, 1063 bp, Homo sapiens
gagtttctggaggggtgaacacgtggaggcaaacaggaacggtgaagaacgaacttatcctatcaggacggaaggtcctgtgcgcgggatcgttccagacgtcgcgactctaaattgccccactctgaggtcaaggaatcacgaagatggttttggaacatgctgaacccgagtacattataagatcaccagccatcgtgcctgaagccatgccgtgctgccatccattgccgagttcctgtcgtcctctacgtgggcctttcgttctgccatatggatgatggaattactgaggggcagcgatccatcgaaatacgcaggatgcactggcattacgtgtcactggaggacactggacccacactacaatctgcactcacggaacgaattcacttgttggactcgcggcgagtcaggacgaaggttgtcgcatgaccagatgttaacttatcaaccaggggggttgtactaggtaggagagtatccattggacgaaggatacatggggaattcctacgtagggaaaggaagaggcataatcaggttccgagtgaaatgcaaggtcgaacgattcgcattcacgaaaggtgattggtcttacgtccaaggagattataaaatagaggaaacagggcggtccaaaatttcagagtagtaaacaaatggagtgtcctgacgagaaatgtgtacgtgagggcaatggcgagagagaacaatttgggcgaggtctgtgacaaaggagggtcaaatgacaggtggataattaggacaaatttggagcgaaacaaacgggtgaccaagttcgacagtaaggtactgcaaaaaggcgacgagccaaagaagtacccaagagaagagcgctaccttgggggaaatagagagcctaaaggattacggaaaacaccgctgtattactagttatagtacgaataggagggcttcctatgggtgcaagggggacccactggggccccttgtggcgttgccggaataagttaggggtactcagcagaaggttcgcttggattggccgatgaagaacttcgccctgttcccagaaggg

SEQ ID NO: 645208 - DNA, 287 bp, Homo sapiens
cacgaggagtcatcccatgtagtttactgaaaatctatttgcatagccaacatgcatggagtgctcagtaccctccaggcgctgttcaatgcacagggttgaacagcagccatcaagagatgacacccctgcctacaggaagtacggggggtagtatggaagacagatgctaagtgaatacaataaatacacaagatactgtttcttactcggcctaagtgctacgacggaaataagcatatacgtacgacctgctcgagacaagtcctcatgtctgagtaatgggg

SEQ ID NO: 645209 - DNA, 1067 bp, Homo sapiens
gggtggcttacagcgtgttacagaaatgggcgtccgttgcagcctatatatgagtccctgcggatttccgagacctgcggaagctcacagaccgaggctatcagtggagacgcgtagtacgagcgttcgtcgtgatagagcatgacggctgatacgaatgcctggtgatacggaggaccagcgctatcatggctataactacagagctcgcgtcatagatatcaacgagcggtatagtcgcagagtctgaaagtgccggcgagtctcatggctagaggcacgtacaaggaatgtagagttggccctgctagagagcaacttagtctcatactagccttccataatctgccgtgagccttggccagtatctacggggcctttcggcttgttcacgcagtgcgcgcgtccgtaccttcgtacaacacgggggaatcgcacatgaggaccgtgcagcaagaggaagctaaactggactcggaagttcggccaagaaagaggacaggaatgacactgtatgccccgggaagcgacggcttctccgtacctttgatcaaccagtcggtggccagctttacaagtcacgtccgtaacgctaccgggacaggtgaggccctcatacatagaaagtctggggccctagtccacctacggcggatcgaaagcgcgttgcggctacaaggcgacttgacgtgcacaatggggtggcaaaggaaagtgcccacgccgctgggcaagaataccgggaacggtgttgaacccacttgccaacttgcatggtgcacccgatagcttgcttcgcaagttacgattcccccgcttgcttcgggtcagggaacgcgacaaccatgggagagtgtaaacgcacgtgacattacgggcctacaatggcctccccaagcaaacctgatacgccgcactgccccacgggtttgcacaaagaagtcccagggagtcgaaagcttcgatgttggccctgtgcatacggcgcgatcaaaatcgcccttgtgcccctgccaaatgtcgcgggcaacattcaggcgcctttcgggatcctttccggaccacgc

SEQ ID NO: 645210 - DNA, 560 bp, Homo sapiens
gagcggagtggttaggacgaaggggaaggaggagaaggcgcttaaatgcggcgtgagctggtgcgtggagaggggttggacccagggctgaggcatgtgccctcccctccatcctgcctcagtggatcatgcccagtggcggcatgcggcgtgtaggttgctgtgtgagtggaagtgactggtgttgtgtgcctggcgaccaggagcacgcatgcctgatttcacagaataataattacatagcattcaatacaaaactactatttctgcacacatctaaccatcgtactgtgccacttgtactcatcatcacattacatcaagacgatacgccagaccagacacaacgggacagaatctgccgctcggccgttacattgtctactccaatagatcacctcaaacgtcctcacaccatcacgaacacacccgcttcaagaagagctcgtacctgaaacgcagcgaaaaacaatgaaaccagcaagaaggcctggacattgcacacatcctatccagcacacacactgaacatataacccctggccacaaatacgtaatac

SEQ ID NO: 645211 - DNA, 411 bp, Homo sapiens
aaagctcagtggttgcaaacatttatgactgtgcctacaaagtcatagtaaaggtcaggagttcaagacaagaccagcctggccaacatggtgaaaccccgtctctactaaaaatacaaaaattagcggccgggtgcggtggctcacgcctgtaatcccagcactttgggaggccgaggcgggcggatcacctgagttcaggagttaagaccagcctgggcaacatggcaagaccctgtctctactaaaaatacaaaaaaattagctgggcgtggtgacaggtgcctgtaatcccagctactcggtaggctgaggcaggagaatcacttgaaccagggaggcggaggttgtggtgagccgagatcgtgccattgcactccagcctaggcaagaagagcgaaactccgtctc

SEQ ID NO: 645212 - DNA, 496 bp, Homo sapiens
  misc_feature (78)..(78): n is a, c, g, or t
aatccttggatgctcaagtccttatgtaaaatgccatagctagcttttgcatataccctatacacctcttcctgtacnctttaatcatcttgagattacttataatacagtcatgcaccacataacgacattttggttattgatggtggtcccataagattataatgctgtgtttttactgtaccttttctacatttggtatgtttagaaacagataccactgtgtcacaattgcttacggtattcagtacagtaacatgctgcacaggtttgtagcctaggagcaataggctgtaccacgtagcctaggtgtgtagtaggctctgtcgtgtaggtttgtgtaggtacactctatgatgtttgcatgaagatgaattgcctaatgatgcatttctcaacatatccccttttaagcaaggtatggctttatctaataaaatataaatgctttgtaaatagttgttacagtgtattgttattacatttatattattct

SEQ ID NO: 645213 - DNA, 163 bp, Homo sapiens
gataagttctttgaaaagtgatgaagatatctacaattaggtatggtgatggtgcacaactcgtattaaatatagctaaaaaagcactaaatggtagcattgaaagtattatttaaaagctggttttaaaaaaagttttcattagatctaaaggattgctccc

SEQ ID NO: 645214 - DNA, 137 bp, Homo sapiens
gaggatccccgcttctctttcctcttctccatgaagtcatcgagcatttctgcctgcctcacagtccgatggaatccatccagaagaaaaccattatttgcacaagggggtctccaaattcttctcaatgagctcca

SEQ ID NO: 645215 - DNA, 930 bp, Homo sapiens
ctcgatttttatggtacacgttcgcgccacgacgtcgtatgatgtggcgccgctcttccggcaagccggctgtaatggaccccccttttgaggcccttatttctccccaggcccgcggggcaaccgggggatcccaatggaaactgtcaaatcaggaaccaatttgtggggagggccacataactcaaggaggtgtcccatgttcgccgccaagtgcgccctgccacaatggcgaacatttcggggcgaaaggtctagtagccctgttggttggaacactattcccgtaaaggggttcctcccgcctggccccaaaatacgcgccccttttcgttgtggcgttccttcccccacgggtgtctgcccccagttatcaacggtcattggtccccaaaccccttttttaaggaaactgctccaggaacattcttccacacgggcataactcctggcaaataatataacccccctgttcgcaccaatatgcaaactacgactgggagttcggtctcccaattagggggaaccatcatctggtttaacccctctcctttaaaatatgagcttttctttaggcgagccgctcccacacaggttgccttgtgaagacgtggaccatcaacaatctgcttcgaataatgaccacctctccaccacaaattgactcttaaaaattgcccgtaccgccgagaccggcgggtacatatccccgggatactctcgtcccaccaattatttttgtaatctcctggtctcctgtccaccacgaaaacacaattttcttttatattgtaacacatccgttcttgaacacttctgtgtcagcccacactctaaaaacttccgtctatggcgcaccacaatgtcccccaaaacccatcccaatctaaattttttttcccaaaaaaaaaatcccattacccccaaaaa

SEQ ID NO: 645216 - DNA, 166 bp, Homo sapiens
taaaaaatactttatttttactcaaatttgccaagtcttattctgccctttaacaagtagagtaaaaataaaaggtattataaggtcaatgtgtgccatgagtttgcgttaaattaatacttttaagtaatggaacttttttcaaaggccaatttaaactatttaa

SEQ ID NO: 645217 - DNA, 330 bp, Homo sapiens
gcgtcgaccactctgtcaggccatcttgaactcctgggctcaagtcatcctcccacctcagcctcttaagtagctgagactacgggcgcacaccattgcgcccagctaattttgtatttttataaggacggtgtgtcactgtgttgcccagcctggtcttgaactcctgcactcagaacgattcacccacttccggcctcccgaagtgttgggattataggtgagccactgcacctgggccaggacatctctaatatgagataggacacggcacggtggcttacatctgtaatcccggcactttgggaggctgaggtgggtggatcacct

SEQ ID NO: 645218 - DNA, 124 bp, Homo sapiens
  misc_feature (9)..(9): n is a, c, g, or t
  misc_feature (31)..(31): n is a, c, g, or t
  misc_feature (76)..(76): n is a, c, g, or t
  misc_feature (86)..(86): n is a, c, g, or t
  misc_feature (120)..(120): n is a, c, g, or t
  misc_feature (122)..(122): n is a, c, g, or t
ccgctcccnacaggcatccaggagtctcttnacaaccctacccctggggacctagaggaaattgtcaaaatagaancctgagacancccagactgacaaagaggtagcaatttggggacnanga

SEQ ID NO: 645219 - DNA, 1435 bp, Homo sapiens
  misc_feature (353)..(353): n is a, c, g, or t
aggtgctttcctggcgcgtgctcgacaagcgaggccagccatgtcttatcccgctgatgatatatgagtctgacgcggcttatgaccccgtacgccttactccctagccgacctactgcactactgcaacagcagcgacgactccaaaagtcacgggacccgttgccctctaatgcacacgattcacgtattgcaaccagccaaacgctatcaggctgactccactgccgcgctgcactcacagaccacattacactaccaagcatactcactcccaccaaacagaacctgcgtcgctccaggcaactccctcggcaccatcggcacccccatcgccacagcagacttgcatnagtagcaacgaccgtcaaccaagagtcccccaagattccgagatgcctcgctcccacaaggcattgcaagtaggatccccaatgatggaagccgcaagcgccaaccggggctaggctaccattggaacgtacacataccccataggtgaacaccaattcgctaacctggaaccgcaacacgccaaccgaccattgatagacactacctaacactgcacgtttcgacacaacgtcgaaagcacatcagcacaacagacccctagtgcgcgagagggccaaacacttcacccgagcgcccatgatggcccaccacgcccaggcaaagcgcgacaccaataggaacaaaaggcacacccaaccatcatggaccaactacgcgacaacgcacactcgcgagccactcactggccgaccatgacaaaaccgcagatgcaacaacgcggaccccacatggcaacaaccaccatgcgcagccccagttcggggcgaccacgactcacagtagtgacaagaagacgataaacacgcacatagcgaaactgaccaagtgacgtaaccaacaacttctcgctacgacgttcagctcccagtaatacaccgacaagagcgccgggccccccccagctcacacggttacaaccctaaccagtttggcagccgccacaacaaagaaaacgcagattccgacaccggcagatagggagaagaacgctcggaccagaccaacacgacgcaggcactgactcgcgacacactagtggagtgacgacaaagagcggcaacaccaaagtagcacaaagaaccaagcgagacaccactcaggcaggaagagcgccgtgttccacacaccgtacaagatataacgaaagcacgaaccacaagaacgacgttacaaccgcgaccttagggccacgaacaaaaaggcagagcgcatagaccagtagtagccacagtacaaaaggagacctacaaagacacaagaagtcatgcccatgcacataacagaacagccattggtcacacgacggaaagtatgacgcgagagctgaaccaatgttggacgaatatcacgcagcagcacg

SEQ ID NO: 645220 - DNA, 268 bp, Homo sapiens
gaggtcgcgcaccgggtacgtgtccttccactgccatggacacttttcaccgaatagcacaaagaactggaatataagtacagatagtaacgctaaggaaagacctaaaaataatgtcactaacatagagctaaaggaagaatggaaacgggaagggttcatgctggtacgaggtagtaaaggcctagtatgtctttgaagactaccacttaataaaagctcactggttatatgataagcctccataaaggacaccacaaacctagaa

SEQ ID NO: 645221 - DNA, 184 bp, Homo sapiens
tgctgtttctctcctcgctctgggcgtcacgatagggatgtcagggatgatggggatggacatgggctcttgggctgggtggccaggttgatgatggctcccgctcaggccccagccgtgcccgttgcgcgcttcaccgtgtagcggtagggctgggactcccgaaggttctcaagaagcagca

SEQ ID NO: 645222 - DNA, 320 bp, Homo sapiens
  misc_feature (130)..(130): n is a, c, g, or t
gtcaaaaaccctttgccaaattcaatggcaaaatggaggaaattttttcccctaaatttttggggaggagttttacaactttcacccctacatttggatttttttaacaaaggattccagaacaatgctncgagggtttgaatgcctgtcccccccataggattttaaaaccccccaactgttgtttgaatgattgccccccccatatgattccagaaccctgctggtgcggtttgaatgattggacctcccccaggattccagaacactcctcctctagtttgaatgtttgtcccccaaataaaattccgggaccctga

SEQ ID NO: 645223 - DNA, 236 bp, Homo sapiens
  misc_feature (4)..(4): n is a, c, g, or t
  misc_feature (12)..(12): n is a, c, g, or t
  misc_feature (211)..(211): n is a, c, g, or t
  misc_feature (213)..(213): n is a, c, g, or t
  misc_feature (232)..(232): n is a, c, g, or t
  misc_feature (234)..(234): n is a, c, g, or t
ttgntaaaaatngtaaggtccaaatctctgaaaaacgatttttttttaattttttacaaatttgttgagcatggtggtttgtgcctatagtcccaggtactcaggaggctgaagtgggaagattgcttgagtctaggagttcaaggacatagtaagccataactgcaccactgcacacaagcctgggtgacagaatgagacctggtctccngnaacaaaacaaaacaaaacnanac

SEQ ID NO: 645224 - DNA, 596 bp, Homo sapiens
  misc_feature (101)..(101): n is a, c, g, or t
gcattatccttgtatgtacaatcaatccaattatatgtttgtacttatttaaaaatgtacagttcaattatcattgactgtagtcatcctgtctgtgctgntgaaatactaggtcttattttttcgactttttgtacccattagccatcctcccttaccccccacctcccactaccttttccagcctctggtcactgtcattctacactctatctccaagatttcaattgtgttaatttttagctcccacaaataagtgagaacatgccaagtttgtctttctgtgcctggcttattttatttaacacagtgacctccagttccatccatgttgttgcaaatgacagggtctcattctttttaatggctgaatagtactacattgtgtatgtttaccatattttctttgtttattcatctggacacttgggttgctttcaagtcttggctattgtgaacagtgctgcagtaaacatgggagttcaggtatctctttgatatactgatttcctttcttttgagcatatacccagcagtgggattgctggaccatatggtagctcaatttttagtttttttgaggtaatccgtgaggg

SEQ ID NO: 645225 - DNA, 106 bp, Homo sapiens
tgcaccgatccatagagagagtgaatgcatggatggacgagtgcatggatccgtagacagagcgaatgcacggatggacagatgcatggatccatagagtgatggt

SEQ ID NO: 645226 - DNA, 311 bp, Homo sapiens
ggagattctctgtgtgggtgccacgacgttggaactcttcgtttcctcgttgacctgaatcccggcattagcaccagcttcctgccactggctgactgaatgcccagcccagcctcagtccctcgcctctcccatgctctggggcttccctatcccaccattcccctcccgtgcctgtgctccactctgaaaccccttctcttccatcccactctatctgagccaccacgcccggggacgtagtggtgggcgcctgtagtcccagctactggggaggctgaggcaggagaattgcttgaacctgagaggcg

SEQ ID NO: 645227 - DNA, 105 bp, Homo sapiens
ccagacgtgaggcgacgagcaagactccgtctcaaagaaaaacaaaaagttcactgggcacgtggtgcgtgcctgcagtcccagctactcaggaggttgagggag

SEQ ID NO: 645228 - DNA, 378 bp, Homo sapiens
cgaggatccccgccctgataagacatcactgctagcaagaggtactagatctactggtgacagaaagtagctcactggtttcaaaaaaaaaaaaaaaaccagaatcatgggttatcaagcaacccccggataaaggtacaacagtgccaaataccaaaagcgccggaacaacctatccaaagataaatgatttggtccactatctatattaatacctacaccaaaactaaggggtgcacagtaggcacagttataccacttatgtcaaaattggccatacaatactcatcctccaactgtgcagtaaatggtactgtcaataaccccaagtaatttaacaacatacattctttaatgctcctagctctgccaactctg

SEQ ID NO: 645229 - DNA, 1174 bp, Homo sapiens
gagtcgttttctcttgctgtaaaccgccagcacgacctttggcatacattgaaggtggggtaatcatttatatgtcgccttacttttgtctctgtatagtctcgagcttaattcacaggggcgatgatgattatacgtctgagtagtgctatcatcatgcacgtgtaggtttgctacatacaggttataaacacgattgtgggagaaagaaacatgttccatacaaggcttatggtgttcgattcgccttatagctcatgtattctttcagtaagtagttccattttgaatgattcatgtaacaatatatgtgaattgacagtagctggaatttggcaatagaacaattgtgttcagctgattcgatgtacatgcttgacatacattggttggagcataatttcgacatatcagtaacctcattgtatattggaagaaacacatatttcatgtcacctaagattgccaaacgtacgtgttcgtgaaaaggctaatggctgatgattggattgacgtggctgtgtgtctatatcgaaggatgacctgaaggagaaaatgcacatgcttttctttgcaatcatctacaaggaatggactaaccctaaaatcattaccgctcggattgggttggaagaccaagcagtgttcgaatggtgattgtgataatgagtttttgcagtggtagcaaatgtgggggaatgaacaattttattttggcacacagaattacgtttaataattgatcaattgggctcaaagtagagtacacaatttcctctagactttttttagttagctgcccggggaaatcttcccatgttttctccatgtgtggcttacaaaacagggggttacttacaaattgcgttggcatttttctaacacagcaaaatggtttggtgcaaaatgcattggcttggacttaaactgcgtttgaacctggtccttggttttggaccctaaaagggcttacggatatgaaaactttcccggagggaatcgaacaaagggggacagggagctttacaggtatctgtgggcgcaaaaaacaaggacaagaacatacgaatgtttagtggtcccaaggttcattcgcacagacatctatatttttgggggcagtgacacaaggaggcttttttataataagcgctattaggggagaggagcctag

SEQ ID NO: 645230 - DNA, 121 bp, Homo sapiens
tgaggatcccggcgtcccactggttgccaataaagcaagagggaaaggaaaacctcgttcagcgcaagtgtgaaaccacctaagaagcaagaggaaaacggagaagaagggaaagggaaag

SEQ ID NO: 645231 - DNA, 208 bp, Homo sapiens
acggccggaccgctctccgtgaactggcacattgacaatcataatacaaatatcgttgttggaggagccctttgttgactgttacataaaaatagtgatggaagatgagttcccattgtggttcagcagtaatgaacctgactagtatccttgaggacacaggtttaatccttgacctcacttggtgggttaaggatcagtctcacgg

SEQ ID NO: 645232 - DNA, 1278 bp, Homo sapiens
agcgagtgaggaggttataccgcggaggtctcgaggctgcgttcgtgctggttgcgtgttgccggtgggtacggttctgctgccagtgcttgagtcgctcgtctcggaggcgaacgagaagcacgtttgcggtggtcaataccatgaacgagatacagacctgaagcacggagaccatggtgagagattatgtcatcacaatgactgtctgtgcacatccgatgagtgtctacagtggcacatatttccatggtgaacggctggaagtgtgagaccatggcgagatatatgcgtttggatgaatggaatacgcttggataatgtgctggatagtgactgggaaaattggttactagcagttttcgccactaatctgtcataacatggtatggaaaaaaagccacaaggccgaaacaggtaagtatagataactgtagtggagagtagaatggaaagaagccaatatgggcaggctggatgggattctagataatcttgggctccgctattgaagtgatatttcaaggaatatgcgagtggtaattacgcccctggatgggtactactattttcccggaatcgctctgaggaggcaagagctccacgttgtgtacctatccttgtgacaagttgaaagcttgtagaacgattggctttggtccccaagtcctcgaagagagagttttagtagtcttattagtgcgttgccaaggtaatagatagtcctttgcgcgagatttttgaactcttcacataaggaaggcgctgtggaggtatggatagaaagaagaaagaggtatagatagaatgggccaaggtttgctaaaattacttggaggggtaattaattaggaaagggaaaggcccaagggggcaggatttcctattttttaccagttttcgggagtgggttgggaaatcaaaagcctagggtgttggggccattttattaactttgttggggtattccaggcgaaacacttgcgagggtcttgcttaaaatgaacgccaagggtacaagcttggttggttttacttgcccaagtctttaggaaatatgtctcgtttgtgggagaggttttggcgcctttggggacaacaacttatcgtttggatttcaaaagaaaaacggtcgacagaggaatcttcacgttttaaatcattccctgcgtgaaactgagagggttttttcccaaaattggtctacaaaggaagaggtgtgtctggtaaaggaaaagccttaattctgttgtcacaatgtgttattgataaaaaaca

SEQ ID NO: 645233 - DNA, 329 bp, Homo sapiens
tcttaaatggctctcattcatggcggagctctttgaggtgagagtgttttaatcattttatggccggtacctgacacattgactggcatgtggtataagctcaataatcttctgttaaattaatgaataaatgtgctcagctgccaatccacttaggctcaagaaaaaccagaggtaaacagaaccttaaaaatggacttttattaattattttctatcattttgcttaattctttaaagtaaactcttattgacttggatctaaatagtttgtgaaaacaccgtctgaggaaaaaagtgtttgctaatagtaaaagcctcccttgaaa

SEQ ID NO: 645234 - DNA, 812 bp, Homo sapiens
agcggggggagatggcgggctgtgtcggtgtctgctccagcagttggaggctcctcttttgataactgccgctacgatatgccgccttggaagccgacttttgcaaataggggatactagcttccaaaagtccggaaaagtggcagcgaccatcggtgcggtggtctatcgaggatggcatatgtatctatggagcatatacaggaccacctgaagggttggttgtcgctgacaggatctgatgctgagatacacttcatatctcctaatattgagttgttgtgggtgctgggacatgctgacagacacgagacagtgagcaatccgagctcaagtttcttccaaaccgtggagctccactcccatctccactggccgtcttcccagcagtcgtgaccggaccagaatacggtatggcggacgtcagatgtcctttaacctagcgtatctagggcctacatataggtagcacccccattgttttactggggaagtagatgttaaactggtacctgctacctctgagcattcatctatccttctagtggatctagactgcattaattgtgccatctatgtcatcccactggtgtttctcgcgtctccattggctaggaccttgtgctgtagttggaaggataatgtgagatggccacgacagtggacggagggaggacgccacagaatctggtgacgcgaagagccatcgcaggcatggcatcttaaagacgagcctggagctccggataggcaacatttagaacctctgacgtcatccagcaggaaacaagctggaattcaactccgaccat

SEQ ID NO: 645235 - DNA, 163 bp, Homo sapiens
atcgtatcttgcccacgacatcgggagcgactgacccatgtacaactagctgttcacatggcaaccctatctccacattcggccttcaacagttctcgctttgaagtatttgcatactaccaccaatgatctgcaccatgcggacggctccaccctgggcccg

SEQ ID NO: 645236 - DNA, 812 bp, Homo sapiens
agagacattgaagatgatggggtagaaaaggggtatcaaataggttagaaagatggcttgaaaggaaatgagggaaatttcagtgagtttgaggaatggcagactgggtatgtgacaaatgagtgggtaaataaggaaatctcagactgagaatcctggcagatctttcaatgggttagactgcaggaatattgattttaaagccagactgaagcaaattctagtgataaaggaaggggaaagggtggctgaatcaaatgttctaccaatactgctttttttagtatttgagttaaaattcagattaaatgcttggcttagaagaatgcaaagcttcactgagcctaataatatggatcccagtgggtgagtggaggtgagttaaagtaaaaaactctgaggcaaatcttacttaactgaagttgtgtttttagtacagaatgccaagttaatatggttaatactgaacaaaaaataatggaagggcaactacagtagcttaagatggcactttaaggaagtgtaggcagaaagtcaagaaattaaaataattatgaatcattatatggcaggcaatatttccagtgaaaatcagagaaaataaactcacatacatgtactgttacagctgatcttagtatgaatattttctattaaagactgttttaaaataagttattaatatttgttgaaatggttccagataacaagaaatatgatgcaataaaacctgataaataaaagcaatataaagattagaatggttttgaataggtagtggaataaaaagttaagttggtagttgcattaaa

SEQ ID NO: 645237 - DNA, 375 bp, Homo sapiens
actgatgccgtggtcaagattattgcgatcacttgagtatagtacttccgctttgactggtgaagtcatagcatgtacctgctcggaggttgggttctgctccgaggtcgccccaaccgaaattgttaactgcaggtttggtagtgtaggacctgtgggtttgttaggtactgtatgcattaataaattaaagctccagtagggtcttctcgatcttgactgtgtcatgcccgcctcttcacgggcaggtcaatttcactggttaaaagtaagagacagctgaaccctcgtggagccattcatacaggtccctacttaaggaacaagtgattatgctacctttgcacggttagggtaccgcggccgttaaacatg

SEQ ID NO: 645238 - DNA, 487 bp, Homo sapiens
tgcagtttctcacaatcttcaggtgatttctatggtcattaaagtttgaaaagctgcctcgaaacagtccttcctaaaactgaagtggaggtgccacaaaaatcatctggtaaattgtttaaagtaatcccaaatgcaactcaaatctacagaatcccaggtgaagctcagtaatctgtatttttatccttctccccaaataattctgatgtgcaggcaagtttgaaaaccactgctttaaggaaaatggttcctccctttaccaagcagaaggtagaatttggaaacctgttccagggaagccaaaagataccttaagaagcgccattaccaccggattgatgccaaccgaagctgaagcttaaccaaagacattaatatacgcccacaaaagtggctaaggatgtcaagtgctctgttagaattctaagaaatgggaacccagacacaaattggaatgaacctcagccacactatgttggtgttt

SEQ ID NO: 645239 - DNA, 118 bp, Homo sapiens
  misc_feature (74)..(74): n is a, c, g, or t
atcagtgtcctgcctctgtgcataattattaggaaaaaaatatacttcaacttctagtgtcaacttcaaattantggatgttatggtggtagtattcccaagaggtccaatcttccgg

SEQ ID NO: 645240 - DNA, 262 bp, Homo sapiens
  misc_feature (11)..(11): n is a, c, g, or t
  misc_feature (137)..(137): n is a, c, g, or t
  misc_feature (149)..(149): n is a, c, g, or t
  misc_feature (159)..(159): n is a, c, g, or t
  misc_feature (161)..(161): n is a, c, g, or t
  misc_feature (168)..(168): n is a, c, g, or t
  misc_feature (179)..(179): n is a, c, g, or t
  misc_feature (189)..(189): n is a, c, g, or t
  misc_feature (227)..(227): n is a, c, g, or t
agaagaaaggncaccattaccatccatttgacatcgcatttccatagaaatgccaaagaaagaaggtcctggggttttttatagaaagctcaaaaagttcaacctttgatgctatcccccagcccaatacaaaatanacagaaaaagcnattattaaanancgcttcntttctttttcncctttgaatnttaatgtttacatactagtgtgcagcacctacttcttnatcgccgtgaactgaaatctagattttaaactgaa

SEQ ID NO: 645241 - DNA, 711 bp, Homo sapiens
agcggggcaattctttcgaatggaatcgggctgattcatcgcgcggtttgcagacagagccgcgtcgggtgtgcgccgctgctgctgttgcgctctgtcttcgcgtctaccacaggaggcaagacaagggtccatatcggcggcatccggctcccggcccgtcttcagtgagagacagatcaaataacatatacttggcggaagttgtacctgccagaattagcaagagctgtctttaacacgacatgtgtacaaactcaacaaattgaaggtgtaacagctataagagtgtgtacgttgacgtgagccagaaatatggacagacttcttagacttggagagaggtatgcctggactgggccaggggtccatcctacagatgctcctgcagtggacacagacagaacaagtctatatctcttccctggcactgttaagagaatgttaatagacactggctcgatgctggagttccaactggaatgttactgggttttgatgcttggaggaattcgttgagtgattataccgtcagagtgattgatgtgtagagcgtatggcaaagtcgaggaacaggtgtcagtgtggaggcagttgatccagtgtttcaagctacaatgtgggctctgttgaagccagacaggaaggcggagatgggggaggttggtatcacagtacctggcttaggatgtgggttctggtgtggatata

SEQ ID NO: 645242 - DNA, 92 bp, Homo sapiens
acaccactgagtcacttgtaacatttagaattacctctaaatgctaagtttatttaagaggtaaacgtcctgctattttcagaatggagaac

SEQ ID NO: 645243 - DNA, 843 bp, Homo sapiens
cggctcttcgtttatttcagagagttcacgacggctataatcataaggaacaatgtcaacataacggattttattctggttaaagggctttcgagcttcctcttataggaaacttgctgaacacccgcgggatgctctgaaattcagccagaagaagtcttccttcatcagcaatctgcctcttataagtttccaacaaaatatctgcatggatcggctccacattcatcagttgtttttcatcatccctttcaacaagctcctgctgttcatctaaattgcacgatctttccttatgtagatcatagattttcgagagaacaacaagcagggctattgatgtcacactaatcagaactgccagaaatgctatcagtgccttacaattataagaggttgaatgatgtacaataaagggtgctccacgatagtctccattgtgaaaataagccttaaaagtgtagactgctgaatattgaagatctttgacacggaaatcgcaattcttatgcaactcatttctaaccagagtatttccagcttcatcttccacatggatacgtccatggaggccattaccgtccctgggaggcctacacttgacatgcatactattatctgatgtcatggagacagttatgttccatacctggcttggaggagcaccttttagctgtgaaatgacacattgcagcactttcattacctgggccttttgcattgacgtaggcatgtgatgataaaacctattgccgataaaggttcaacatgtgcaaatcaaatgtggaccaggtttgtatccagattgaggcaatcctattctgtctcttcatataccagagg

SEQ ID NO: 645244 - DNA, 461 bp, Homo sapiens
cgaggctgtgtcactatctcttgtgatctgcgtccttccttttcagataatgcggatcacacctctccacggcgcaccacatatgagagatgagcttcctacacgcacaacaaatgtgaatgcgcaccacagaaagatatgagcgcgacacagaaaaaaaatcagttcgaggaaagggaaaggggccaaaaccaaagcgcaagaaatcccggtataagtcctggaacggtccctgtgggccctggtcaaaacggagaaagcatttggttgtgcaagatacgcagacatgtgaatgtgtcctgcgcacacactctcgttgcaaggcgaggcaacttgagttaaaccaacgtacctgcggatgtgacaagcccaggcggggagacgcgcacgaagaaagagcctccctcaaggtttcgggaaccacaactctttccacgggactggtacacgcgatcggtccg

SEQ ID NO: 645245 - DNA, 145 bp, Homo sapiens
cagatctagcatgcgggatctccaccgagaggattgcattctgacgacagatttgtgaggatacagaggagatgccacttctcactcaccactaccagccagcctcagaaggccccgagaccctgcaggaccacggaggtagcga

SEQ ID NO: 645246 - DNA, 134 bp, Homo sapiens
gacactcttgaggtgacggtacttcatactgcttgtgcctggacattaaacaccactgcgcagctaatcacccctggccgcgggctgtaaaatgtcctgtctcatggaagcactggaggataagcggttgaggt

SEQ ID NO: 645247 - DNA, 507 bp, Homo sapiens
tgggagctgcagcatgccaggcgtggtgagagtatgtgagccatgcctgcccttatctgaggctcaggcaagtggagtggagctagagagacaacaggaaagacggtgctgaagaacatagtgtctttcctctatagtggacctaaagaggtggggaagcaaggacaagaggcaaagagccacactgcccttggcatcatccaaagcatagtctggttgacaccaggtcctggtttggtgtctttggtcaatacctgaatccttgacaaaagaaaaagtggttttgatgatttaaagaaataagggtgattttgacagaaaatatattttaaaaatttggaccaattgcaatagttatcctgaagccgatttccagaacctgccaccagggggaggtggtgcagcatgaatcattctgatggctttgtctttgaagtgttcccctatggctgttaccatctcagaggaagtaactgggcatggtgagactcctaaaatgatcggagt

SEQ ID NO: 645248 - DNA, 794 bp, Homo sapiens
gattctctgatcagtgctatcacttcttcggagaactcagctggtgtgctgtgaaagactacctagtcaaaacctgtctctctactgatcacgatggttccagtgaggcttcaaagcaagatagcctggctcctctgcctggggccagcccctgggcccctgacgtggcccaattgtcctcactatccatgtaacccatgtaccctggaacctgtacagtgcccgcattgctcacagcgccgtatgcatgcatctgttcatgcttaacagcttatggatgaggcgagtcagctgcacacgcagtgcagacaatacgtgtatggcaatcagtagacagtgtcgtcgatacgtagtgaatggaggagggctagggcgccagcgggagcggcctcacgcatggatgcgcccgcacggcgtcagctggccacatgtctgtggcagttcggcatggaggaagctcataggacccacatcctggtcccatcagggggacggctgcctcgaacccgcgtgggcgtccgattcggagaggcaaaggctacgttgggccggacgttaaggacgccagtggttgggttcccgcgcccataccccttgcccattcaacaaggcaagagggttggcggaaagccataggcgggtcggggtttttgacccgcggccatctaatttccgtggccccgtaaaccccccggaatctcggtacggaggcttgggcctgataacgggcctccagatatgggttcacccccggtcgcggcaccgcggttggaaccgtcgcccccgaagtacaa

SEQ ID NO: 645249 - DNA, 322 bp, Homo sapiens
tcatacaagaggttggtttcatttttccttatactcacccaaccagggggggctaggaatgaggtgaataggtgagtcaggtatacgggtgtggtggataaaatggttatctattcccaacgctgcagcaagagatgagacatgattctgttattaaggctaaaatactgcatttctagcaatttttctcctttctgatatccccttacactcaggtgtgcagtacttaaaatagagccgggatggcctatagggggggcttttcccacccttgctgggctatgaaatagttcatttcataggtagagagccgggcaagggt

SEQ ID NO: 645250 - DNA, 489 bp, Homo sapiens
aatctcactgaccccaaaattttgaccagtggtgcatatgtttttaaagtaattttttctgacttaaatctcacaattaaatccactgatatgaagatgattgaaatattattttgtctactttctattgcatgtttaaactgagtgacataaatcaagtttttttttttgtcatgatccactcattgctttttttttttacatgctaatgtcatggaattgaccgtcctttgtctttgcacatgtattaagtgtttgtttgtttaggtgttaaacctaaccctagaaagaaaacttacactgttacaccttaagtcataattactataaaagagaaaatattttttgtatgttttgtataaaaggtgcaattttctaaaaaaaaattacttgtaatcatttaaaatgacagtgaactaaatacataacataaaatcgcagatgtacttttgatttaactgattttcacacaacaataaatctttttga

SEQ ID NO: 645251 - DNA, 292 bp, Homo sapiens
taggatagcagtttcacactgcattgtagttccaaatagatcaaccccagtatcctctcacatcgattccaccgcaccagggacagggctctcttttttcctcagacagaaatatccaaagcgcacagcgtccaggcgtgactaccaagtcttctgtggggtggaactgagcacacatcaccataaattgcgcttttgattgccccatggttaacacacaaacacaggttctagatagccaattccacactcggatggtctgatcatcggaggcactcagaatccagggata

SEQ ID NO: 645252 - DNA, 469 bp, Homo sapiens
  misc_feature (11)..(11): n is a, c, g, or t
  misc_feature (360)..(360): n is a, c, g, or t
taacccatccngatgtattctattctagtgttagtataaaaatgcatttcacgtgcatggctttttatagcaatatgcttttaaaaaatgcattctaaagtcatgatcaatttacatatttacccatgcctccattagacagaaaggattatgcttctctcaaatatgttttggcaaattaagacgttagcatacatttgaaggctgtatcagtttaaaatgaatgtttaatggaaggtatttcctcccattaaaaaatgtgaaatcaagtaatataaactgtaccatagtgcatactaagacatgaaattcagctccagaaattcagctgtgcagaacagggccccgagcaacacttgnttgggaccagtgcctaactctcctggagagttcagagaagagtgcttcccagttgagcctaccctccattttagaatacaaagagcagaaaggtcggcctccacaactg

SEQ ID NO: 645253 - DNA, 528 bp, Homo sapiens
  misc_feature (100)..(100): n is a, c, g, or t
  misc_feature (189)..(189): n is a, c, g, or t
  misc_feature (192)..(193): n is a, c, g, or t
  misc_feature (195)..(197): n is a, c, g, or t
  misc_feature (205)..(205): n is a, c, g, or t
  misc_feature (208)..(208): n is a, c, g, or t
  misc_feature (210)..(210): n is a, c, g, or t
  misc_feature (215)..(215): n is a, c, g, or t
  misc_feature (272)..(272): n is a, c, g, or t
  misc_feature (277)..(277): n is a, c, g, or t
  misc_feature (329)..(329): n is a, c, g, or t
  misc_feature (331)..(331): n is a, c, g, or t
  misc_feature (333)..(333): n is a, c, g, or t
  misc_feature (354)..(354): n is a, c, g, or t
  misc_feature (361)..(361): n is a, c, g, or t
  misc_feature (421)..(421): n is a, c, g, or t
  misc_feature (425)..(425): n is a, c, g, or t
  misc_feature (431)..(431): n is a, c, g, or t
  misc_feature (434)..(434): n is a, c, g, or t
caagagctgttcaagggcaagaagggtgtgctgtttggagttcctggggccttcacccctggatgttccaagacacactgccagggtttgtggaacaggntaaggctttaaaggccaagggagtccaggtggtggcctgttttagtgttaataatgcctttgtgactggagagtggggccgagcccccnggnngnnncaaggttnggntnctggntgatccccctggggcctttgggaaggagacaaacttattattaaatgattcgctggngtccntctttgggaatcgacgtctcaaaaggttttccatggtggtacaggatggcanantnaaggcccttaatgtggaaccnaatggcncaggcctcccctgcagcctggcccccaatttcttttcccaggtttggggccctgggccanattncttccnccncccctccctatttcacctgcccagccctgtgttggggccctgcaattggaatgttggccaaatttttgcaataaacccttgtggtttgcggcca

SEQ ID NO: 645254 - DNA, 245 bp, Homo sapiens
caaagtatccaaatcaagatgtgtaatcagcagtcaagtatatgagagcagccattaaaactatagtcatggggtgaagaaaaaaaaaaattgtcataaatgaatagaatacatagtggaatctcagcagaaaaatgcacattattaaaaagagccaaatagaaagataatgaaattttaaataggacttataggttgattcatagatgagaacgacgacagaaccacttgacattattcactct

SEQ ID NO: 645255 - DNA, 435 bp, Homo sapiens
tatttatttatttctgagacagcttcctgctctgtcacccaggctggagtgcagtggtgtgaacagggctaactgcagcctcaacctgcagtgctcaaggaatcctctcccatcagccttccaaatatctgagactacaggcgggccaacactacggccagctaatttttaaattttacatagagatgaggttctcactgttgtccaggctggtctcaaaactcccttggctgaagtgatcctgtcgtctccggcttccgcaggtggctggggattaccgggcgtgagctaccaccatggcctgggcttccattgtctttgtgtgtgtgtgtgtgtgactggggtttcgctcttgttgcccaggctggagtgcaatagcgcaatctcagctcactgcaacctctgcctccagagttcaagcaattctccttcctc

SEQ ID NO: 645256 - DNA, 493 bp, Homo sapiens
  misc_feature (100)..(100): n is a, c, g, or t
  misc_feature (189)..(189): n is a, c, g, or t
  misc_feature (192)..(193): n is a, c, g, or t
  misc_feature (195)..(197): n is a, c, g, or t
  misc_feature (205)..(205): n is a, c, g, or t
  misc_feature (208)..(208): n is a, c, g, or t
  misc_feature (210)..(210): n is a, c, g, or t
  misc_feature (215)..(215): n is a, c, g, or t
  misc_feature (272)..(272): n is a, c, g, or t
  misc_feature (277)..(277): n is a, c, g, or t
  misc_feature (329)..(329): n is a, c, g, or t
  misc_feature (331)..(331): n is a, c, g, or t
  misc_feature (333)..(333): n is a, c, g, or t
  misc_feature (354)..(354): n is a, c, g, or t
  misc_feature (361)..(361): n is a, c, g, or t
  misc_feature (386)..(386): n is a, c, g, or t
  misc_feature (390)..(390): n is a, c, g, or t
  misc_feature (396)..(396): n is a, c, g, or t
  misc_feature (399)..(399): n is a, c, g, or t
caagagctgttcaagggcaagaagggtgtgctgtttggagttcctggggccttcacccctggatgttccaagacacactgccagggtttgtggaacaggntaaggctttaaaggccaagggagtccaggtggtggcctgttttagtgttaataatgcctttgtgactggagagtggggccgagcccccnggnngnnncaaggttnggntnctggntgatccccctggggcctttgggaaggagacaaacttattattaaatgattcgctggngtccntctttgggaatcgacgtctcaaaaggttttccatggtggtacaggatggcanantnaaggcccttaatgtggaaccnaatggcncaggcctcccctgcagctgggccanattncttccnccncccctccctatttcacctgcccagccctgtgttggggccctgcaattggaatgttggccaaatttttgcaataaacccttgtggtttgcggcca

SEQ ID NO: 645257 - DNA, 824 bp, Homo sapiens
  misc_feature (532)..(532): n is a, c, g, or t
gatggacaaatcttatttgcttaagtgttgtgtgtgtgtgtgtgtgtgtgtgtgtgtgtgtgtgtgtatgtatatatatatatataaatatctctccaatatgccgcgggagagtgttaaatccagactagagagtggtgatctgcaccaatattaatattatggtggattactgcgacgcactataatccatcactcagggcttcaggtgggcgtctgctgcgtctccctccgcgaccaatctagcgggagtgctgtggagcagagtctcctctcacttacgaagatctccgtagtgtgttgtcgacacaagcagggttgctcgcagatgatgaagaaaacgagcgatgatgatctgctgtcggtcgtacgtagatagtcgtcgctgcagcagggggctagcaactagctgcgctgcggaggcggtcctccctactctcctcgccgcgcgcccgtcgctcctcactccaccaaggagttagcgggcgtcggcgctcctgtgcggggcgccccacgtcaccccatgaccagnagattgaatgcccgccgtggtagataacaacacacccccattccaaagcgtggctaatccaaagtgaagtgggcagttgcgatggccattgacaatggtccttgtcctattcgatgccgtgattgcaagaaaaagttgccttgaagttgaggtaatgaggtgggggttaaattttactgtacagggcccaagccccggttattgttaagaaggaacagaacaaaacaaaagaaaagaagacaaaatagtgactgtggagcgacaacttcttcatataaacaagccactataa

SEQ ID NO: 645258 - DNA, 486 bp, Homo sapiens
agaacgaaggtggttcactagaaccagccacagcagatgacaaaaaacttcagttctcctttaacgaaagttaaggggtaaacaatatctctggtattgacgaggttgacatatgtatacaaaccaaggaacagtcatccactttaacaaccctaaagttcaggcatctctggcagctgaacactttcaccattacatgtgccatgctgagacaaagcagctgacagacatgctacccagcatcttaaaccagcttggtgcggatagtctgactagttcaagtgagactggccgaagccctgcacaaaacaatcctgtagcatggaaaagcaccacttgctactggagaggatgatgatgatgaagttccagatcttgtgagaactacgactgaggcttccaagaatgaggcaactggattgagccaactcctgcgataaacctgaacagttactggaactgtattatatatgactgcaataagaa

SEQ ID NO: 645259 - DNA, 732 bp, Homo sapiens
cttcgcggtgaggtgatgtattctctggcttttgtgttccccccccagtggggggcgccgcctcgctgttttggtgggccgctatcgggggggaaacccctctgttgtaggaggaggtgtgaaaaaattttttgcccccccctctctttggggcgcgtcttatgagacgcgccccccccccctctctattagagaggcgccggttgtcgagcggggtctctcgactccgccgcgctcctgcctctggtgtgatgtttctcccccccgcacagctgttggtgtgtgggggctcttctcgctcccccgccccttgggcgcaccccttgttctctccccccctcttgagagaggagcgactcatgggtgtggttggagttgaagagtagtgatcgacactgggtgtatcgcgctctctgttcctcctcgccatataatacgcggcggtgtcgagagagtgttacacacactctgccgttagaacaatcttatcacgcgccccccatatttttcccatccacgacccacgtagttttttttaccaccctccttttctccccccccccccgcggccctcttttatctaaagaggggagaggaggtaaaaaaaatataataaagggaggtctcgcccctttttttccccccctttttctcccaaaaaatcccctttttgtcccccccttttgggggcccccccccccccgaaaaaattttttccgccccgggtcccca

SEQ ID NO: 645260 - DNA, 904 bp, Homo sapiens
  misc_feature (213)..(213): n is a, c, g, or t
  misc_feature (225)..(225): n is a, c, g, or t
  misc_feature (273)..(273): n is a, c, g, or t
  misc_feature (292)..(292): n is a, c, g, or t
  misc_feature (349)..(349): n is a, c, g, or t
  misc_feature (358)..(358): n is a, c, g, or t
  misc_feature (372)..(372): n is a, c, g, or t
  misc_feature (378)..(378): n is a, c, g, or t
  misc_feature (399)..(399): n is a, c, g, or t
  misc_feature (401)..(401): n is a, c, g, or t
  misc_feature (410)..(410): n is a, c, g, or t
  misc_feature (421)..(421): n is a, c, g, or t
  misc_feature (468)..(468): n is a, c, g, or t
  misc_feature (522)..(522): n is a, c, g, or t
tactaaatgctcttatcattttgaaatgggctcttgattaatagacccatattttttagtggcttctatgttgtatatttgtctaaaatgaaagctcttttgcgttctaaaactacaatatatgtcatcttattttccctgagtatccaagtatagtgcagattctatgtaaaactactaaatgacactggaatatgtttagtagattagggngaaaaactatanaggtttatacaattgtttgagttacatttaggatggacttatcccttntgagaagagtgaagttggntctcttcgcatgtgatgaagaccactgtgatttttaaaaaagtagattatacttaanatggcgtantaattctgcacttngacttngactgggtacagcacacttgnangactttaanactctttatgnctataaatagcattcacttattactttgatatttaaggttccattangttacactgattttgacaagtgtgaccaatagccagtctgttcttcatgctaantagaatgagaggtgacgtactcacatcacaggcagcagcaatggttaaaatcccttctaaggttgcctctagtctggccttcatgcttattttacagacttgtagcactgaaggaagctggggagcttcatctaacctatgtttctacttaaggtggacaatttcccactggacgctaaatgcctttgatttattcacaagctagggtgacgtataacaccttttctaaatattttccaccctttcgacaacctcttggtaccccccttaactgtcttcaatacgaacaactctttctttccgccacctcttttactctattactctcttgaactaataacctcgtactcggctcctcgctcttcttctatacattacacaa

SEQ ID NO: 645261 - DNA, 957 bp, Homo sapiens
cctactggagactttgattcgaagcccagttgggccgatccaggtgcgcaggaggagggggagtgacgacaaatgtgtcaccagcgagctcctcaaggggatccctctggccacagtgtgaccaccagtcccatgagccagagtgtactgccggtagtctccactgacgctcccaaggaggtcatcaacggaaacataaagacagtgacggtagtacaaggatagatgcacggtatggccaaagtaagctatcgaagagtatgtccggcaccttcagtcgattggaggagcccggtgacagggctgtcaaaggtctggtcgcgaggatggcaagtaactgtatacaagcttcggtgaactcaggagttttgactccctcccgggagccagagtggtggccacgcgagcaatgatcatctgacggaatcttctcttagtggagcgctccatcgatcaggcaatggagggatctgacactgccaggtgtgggaggagcctatgaatcatctcaagggcctgatgatcgtgtcctggcgtatctgcccgtggcgaccgttgtacctgccgctgtccctactcgggatacgctgtcggtgccctgcggtacggtggctggccgtggcagctgggactgtgtgcgtgtgggacgcatggggaagctgtgcgggagagctagagccgggtgctcgtggcaggccagtactcaccacggcgtcatagtagtgtcgccggcgaggcctgtgcgaagggcgcctggcgtccgcggggagtccaatgctcgcccggactggagagtccgtgtccacgcgccatccggtgtcagcccagttgtcggagcggcgcgtggagacagacctggaggagttcttcggccttgggggcgactccagggtttctgggcaggaggggacctggcgcccggggcgggggtcacccccgcgggggacccggcccttg

SEQ ID NO: 645262 - DNA, 1097 bp, Homo sapiens
gtgcgagctcctgtgagtgcggctgggatggagtgcggctgtgcctgagcctggaaacctggcctggctgtcagtgcacatcatcctgtgtcctctcagtgaaatgtgtgtgtgtgctgttgtgtgaaaatgcaccatctccactgtgagctgtgccctggcactgctgccatgcagtgcaagaagctgctgataaagcagttttgtgtcctgactgtgtgcctgtgggggagctggactacctgtgtgtgtggacactgccaccctgggtgacctccgatgagcacatggccaccatagaagacctgctgtccctaccagcaccactgtggaggccactcgatggtcaccactgcacccagtgcgagtgtcctgttggtgtggactgtgatggtgctgatgccttgacccttcattgtagtgaatgactgtggcttgcagggctgaatgcgagaaaactacgaagcgcagcaactattgacagccgaacacttcacagcaatgaaacccaaccaccaacgacacacaccgtcatcgtccacgaacgcagagcaaacgagagccaacaatccaccaacaccgtagaaatggccaccataacattaatactcacatcaaccgtatgaccacacaatagattaaaacacattcaaagcaataccaaaacactgctcatcctcctttccacacccacattcaatacaaagaccataaccacaattccaattatactcatacaacaactccattataataatctcttcatactacattcaacaacactacacaactcatcactaatcttacctaatacatccctcactaataatataagaactctcactctaaataccacttcctcactttgcccccattctagtcatccccctcacacccccatgcttacagcacccctcaacataatcctgacaccacaacccttcacatatatcttcaataacataacaacccaacttctgtataacaccctctaacactctaaacaataatacatcaatccctaccaaagtcttactctctccatcaatatagtcacaaaaattaacaaatcgtaaacctcattacaaactcacccg

SEQ ID NO: 645263 - DNA, 483 bp, Homo sapiens
cgtagcacctccttggtggccactggaagcctggcaccacactgtcttgatctcgttgaggtactgcacctccttggtgatgtcggtgaggctgttggggccgggtgctgtcgggcccaaagccaccagatcttgcggggcttagccacggtccactcgtacttctcggccaggtagcgcgcccgctgcttgagctcctgacgggcggacacctcgcctaaatcgttgtcctcggccaggccgtcggggaagggccgcgccttcatgtacagccggtatgtgcttgttgggggacttggagaggcagatcacgttcgactcttcacttgaccgtctcgcggtacgagacgaccgggtcagatatcttgatggggatgcatgcgtggtcctcctccaggtccttcaggcagatctccaggtgcatgtcgccggtgcccgcgatgatgtgtctcccgactcctcgatgatgcattgcaccatggg

SEQ ID NO: 645264 - DNA, 335 bp, Homo sapiens
  misc_feature (52)..(52): n is a, c, g, or t
  misc_feature (130)..(130): n is a, c, g, or t
gggctccaaggccctggtggaaacaacccgggacctagccccctgccccaantggctttccccaaaataaggggccccttccccggggccctttttccccatgggttggccaaagagggggcccattaanttccaagcatcccaaaacttgttagtggggtggaaaaccaacgagccccctcccccggccgggggttgccccaattagggggtgccccactgttccccttccccccaggccccccggggtgcctgccccctctgcttggggggggggcagccccaaattgggtttttttttaaaaaaagaaaaaaatggggtgccccccccggga

SEQ ID NO: 645265 - DNA, 462 bp, Homo sapiens
ggagctcggtaccacttgtccacggttggctagtccatatattctcctgggcggaaggcatgtgtgcctgttgtgacagtgtcctggaaattcttttctatacgggtgagtgcatgttgaaggtgctcacacgtggtttcctaaagtcctgcaaagtggcagttaggacttttgtttgtttgtttgtttctttgtttctttgagacggagtctcactctcgcccaggctgtagtgcagtggcgtgatctcggctcactgcagcctctgcctctcgggttcaagcgattctcctgcctcggcctcccaagtagctgagattccaggtgcccgccaccatgcccggctaattttttgtatttttggtagagacggggtttcacgtgttggctaggatgttctcgatctcctgacctcgtgatccgcctgcctcggcctcccgaagtgctgggattgcaggcgtg

SEQ ID NO: 645266 - DNA, 167 bp, Homo sapiens
gctccaagtgttgggatacaggtgtgagcaccgcgctggctggtgtggcatatctgaagtgtgagctgggtgtgtgtgtgtggatggatatgtgtgagtgtgtgtgtggcgtggtatatgtgtgagtgtatgtgattggtgtatgtgtgtggtctggcatgtgtgtg

SEQ ID NO: 645267 - DNA, 146 bp, Homo sapiens
ggggggggggggggaaaggggggtccccccccccccccccccatgggggggggccccttttttgggccccccccctaagggggggggggggggggggggccccccccttttttttttttgggggcttttgggggtttttcccccca

SEQ ID NO: 645268 - DNA, 334 bp, Homo sapiens
cagtgctggggacaccccaccgccgctgtcactcgccaccccgcgctccagcaggtgcacggagcctccctcccggggcgtgcgggcgcctagctcctcagtccagtcagccgaacggctcagaccgtccgcaagaccacagtctgaacggtgcttcttgaccgggacggctacgaagtccaggtcagttctgtaccctcggctcaggaagggttccgaccgcctcttgatcctggggctctgattagagaaactcagtcggggagtgattgggcgagcttagctgccgggtggtggtcttgatgtagcagggggtgatgagcgggtagggctt

SEQ ID NO: 645269 - DNA, 531 bp, Homo sapiens
  misc_feature (8)..(8): n is a, c, g, or t
  misc_feature (54)..(54): n is a, c, g, or t
  misc_feature (101)..(101): n is a, c, g, or t
  misc_feature (150)..(150): n is a, c, g, or t
  misc_feature (161)..(161): n is a, c, g, or t
  misc_feature (238)..(238): n is a, c, g, or t
  misc_feature (244)..(244): n is a, c, g, or t
  misc_feature (373)..(373): n is a, c, g, or t
  misc_feature (391)..(391): n is a, c, g, or t
  misc_feature (401)..(401): n is a, c, g, or t
  misc_feature (468)..(468): n is a, c, g, or t
ccccccancaccaaaaaacgggaccaggaagggaaacccccagtattgaggaantgtaccccaaaaaccccgaaaaccccccctagccccacagccccaanccaggagtgtgtgtgtgtgtgtgtgtgtgtgtgtgtgtgtgtggttaanaccagtcctantttgttttggtggccaccataagttttaaaatgtttttacccctgtaaaaagtttccttcctgtgtaccttcccaantttaancgggtaccttttaataatgaactagaccctagaggttgggcgggtaactttcttggacaagataaaccctggggagctgtagagtttaatggggacataccaactctgagactttcgcagacacaaaantgtctaacacttttaaantctttttaantctttaaggagttttctttttattttcagcaagtagaatatgtgctctttggcactgttcttactantctttcttctttggcattgtttgtacttgcaatatcatagtattcagtaagtaaagaagatgt

SEQ ID NO: 645270 - DNA, 122 bp, Homo sapiens
tcatattagacacctaagtagcctaagtaaatatgctgaagatatattatggagaattattcaatgaagcaccatagttattccttcagagtcaaatcattgcaaacttgaatgggccccaa

SEQ ID NO: 645271 - DNA, 192 bp, Homo sapiens
  misc_feature (4)..(4): n is a, c, g, or t
catntagaccagagggaagagcatctcaacagaatcgcacaaactatactttcaggatgaatttcttctttctgccatctgtggactaaatattttcctcctttctatggaaatctgggctcggtgttgtaaagttcatttttataagcttttctatcgctacataatgtctttttaaaaaatgattttgta

SEQ ID NO: 645272 - DNA, 693 bp, Homo sapiens
tggcgattttcaaatggaaacagtcagacgatgattccgctccaagtacaaggtaacattgccaatcagattgttgttccgaagagaacagcagatgaggacaacaatacctcgataactgaggccaattcttagtcccagccagcagccgttccgacagaactgtaattgtaatcttcacctccgtagttacagaggagtgtgggccagtgtcatcagacatcagctcatgtctcattaatcacaccaacaaaaagatcctgtggtacagattcacagtctgagaactgaggcttcaccagtaaaacggcacgactacttgagaatacggaacggtccgaggaaaccatgtcgatctaaacagaagagtcgacgtcggtgcttccagtgccaaaccaaactggagctgtgtgcatgcaggaattgggatcgtgtcgctgcggttatgtgtactgtatgttacatcgcctccccgagcatgagactgcacattcgacacatgggcccgtggccgggaggaagccatcatgaaaatggtgaagcttggaccggacagtggggcgctcctgccagcgcatcggggagggggtgctcctgaagtgccaggcatgtgcacaagtgacgctgttcttagttcaactactgttcagccttatttaggacaaaagtcagccagacaccttgtactgggca

SEQ ID NO: 645273 - DNA, 151 bp, Homo sapiens
catgttcatgatccacaggcacggcagcttcggcgtggcgatcttgaccatcagcatgcgaaccgtgtgattggtgtattgcggctcctgcatcgaaagcgcgaccatgtcgtagcgcgaaacgtcgacgtcctgcggcgtgaccgcgtcg

SEQ ID NO: 645274 - DNA, 153 bp, Homo sapiens
aaacccttcccagcaaagggcagtacatgagtcttgtcccagcagaaaaggtccttcagtgccacccctctaaacacaggagccaagggtgttgacatgaggggcaccctattgcacccccaggcactcctcatggcattaatacgtggtcct

SEQ ID NO: 645275 - DNA, 852 bp, Homo sapiens
gttctcttgcttgtggctttgtctagtagtaccacagtggcttaagagtatgtaaacccaaatcaaatgggatgtgttcttttgggaggatgtactagacacaaatctggtcacgtaggcagccgtggcaccagtggaaatacctgtcagggaatcaagagcttgtagtgttagttgcaactgtctcaacgattgctgtgtggcttcagacccagaacaagggcctctgaggaacggagactctcatgttccccaacgcataagcggcaaggacgacggaggaattcctaggagccaaacgagttttgtggagcgtgagtggtaaatacaatggcccataatgccaactaggtgaacgttgtgaccatctggctgggaagcccatggtccacacagtgtaggagcagatgttttgtggggtctagatggtttacgtagatgttggctgccttaagaatacacaatacagaaatgcagaatttctggggctgctcctaggaccagaacaagtgaagggtcctggtgcttacacttcattaccttcatggtaaatccaccagagggccggttagatgctggccccgctcgagagaaatgctgtcactttcaggcaaagctcaaaggtcctaggtcccacagttctgtttgagctccagtcatggacattaggaagtaaatcctgcacagccaacctggaataccaaagattagatgggagatagatacgcaatgactttagatggcaccaggaagagcaagttctggactataataaatgagggtactttccgtcaaagcttttcatgtctatatttatcactgaatagtcccaaactgctgggaagcagttta

SEQ ID NO: 645276 - DNA, 346 bp, Homo sapiens
tcccttcttcttcggactctgattcttgagacagagactcagcccatgctctcatattcataagattttatcctgttttttgtgttttcctctctggtttttttgaaagtctcttaagcttcgcctttcttctttttcctaaaattcccatttcgaatagaaggtaaattctcttcaggacacaccattctgtcttcttagttccatatccttttgtttaatgtctttttcacagttttctaatatccggcataaagtcgtgtaactcttgcgcattgtgtctcacgtgtagttgtaactcgagcgctatatgtgctagagtcaatatggtctgcacagcccgtct

SEQ ID NO: 645277 - DNA, 499 bp, Homo sapiens
ggatctcgcagagcctccattgcatgctgtccccgcccgagcccagcgcagccccgcggccccaggacacatcctatagaacgataaggttttattagcgtgaatcctataggataataccgtttgtccccaggaaacacacgttgttaataacgcgagtatcgcggcaattgccgtacgcttattaatagcagagctcatgtataatgatccatgtttgatcagctaatgaacacgcgtgaggggaccgcggtacacgcttagggtcccttccgagaggactaacatctagcaatgccggcctggcaccgatctgctggttgagaaggacgtaattccaaacaaatatgctgttatgaacaatggtatagctcaataccttgaaacacttcatgagtctatacgaaattagtccttaaatcaacaagaattgactccaaaagaaccgcaataccataggaacatgagaatggagggacacccactatttaatacaacc

SEQ ID NO: 645278 - DNA, 159 bp, Homo sapiens
tctggtcagctgtatcagggggtggtcgctgtatcgagggggatggggacctgcccctgcctgacgattacgagctcttctgccgggatctcaaggaagttgttcaaaaacccgaacagtttttgctgagtaccatgctagtggttacctagtcccctg

SEQ ID NO: 645279 - DNA, 334 bp, Homo sapiens
  misc_feature (44)..(44): n is a, c, g, or t
  misc_feature (175)..(175): n is a, c, g, or t
  misc_feature (222)..(222): n is a, c, g, or t
gaaatcagccgtgggcaattcgagaacgccttcaacagcgagcntaatcgcatgcagcaacagctgggcgatcaatactccgagctggcagcgaacgaaggctatatgaaaaccctgcgtcaacaggtgctgaatcgtctgatcgacgaggcgctgctggatcagtacgcacgtnagctgaaactgggtatcagcgatgagcaggttaaacaggcgattttngcgaccccagccttccaggttgacggcaaatttgataacagccgctataacggtatcctcaaccagatggggatgaccgccgatcagtacggccaggcgttgcgtaaccagt

SEQ ID NO: 645280 - DNA, 418 bp, Homo sapiens
tactactactaaattcgcggccagtcgaccatcggatcccatgacagatggttgtgagctaccatgtggttgctgggaattgaactcaggacctctggaagagcagtaagtactcttagccacagagccatctccagcccccacgataccctcaaatcttaaaggtagagatcaaaaggacccagactaggagaatttggccccagacacatcagagatgtcacggttagtcccagcttcacgacaggaagccaggatgagctgtggttctgcagaatgagtgggaagaccaccctgacagagtgagttgcacatatagtaggccggatcccagatacagggaaagagtggaagacggggacttcatttctcaaacacacatgcacaggcacatgcacacgtgcacacacagtcgacg

SEQ ID NO: 645281 - DNA, 359 bp, Homo sapiens
  misc_feature (279)..(279): n is a, c, g, or t
  misc_feature (336)..(336): n is a, c, g, or t
  misc_feature (349)..(349): n is a, c, g, or t
tcaatcacgctggcagagccatctgctccatcctactctcaaacttttgagtggtttgtgtctcctgattgactcctactactaccgaattcatgctaggaagggtacaggagatagacgcacacagcatcggatttgggaataggtttggttatccaaggagcagtgctgagctccttgcaatgcgatatgggatgctggtgatttccaggaagtgcgctcactatgactcacgctgccccatactcgttcattgttacatgccagtcgaagcatatntcctgcaagcttacgggtgctacaagttgaccactgcggacactccagatcactctnaagaatggcgtgngatggctcac

SEQ ID NO: 645282 - DNA, 157 bp, Homo sapiens
aatagtggactcaaagcggctctctggctgagaaaacctgaggatatctcaggaagaagcctgtcagtgtgatggccagcgcactggaaaagggtcaggtcagtgttggatgctgacaggagtgtgttggagccatagagctgggaaagtggaaagt

SEQ ID NO: 645283 - DNA, 298 bp, Homo sapiens
  misc_feature (95)..(95): n is a, c, g, or t
  misc_feature (136)..(136): n is a, c, g, or t
  misc_feature (241)..(241): n is a, c, g, or t
tagccctcatgtctgcgtgcagcagctgccactgctttgatacttttagaggccctaaaaatcgcaaactatgctcaactcactctctacatttntcctaacttccaaaatctatttttttcctcatacctgacgnaaatactttctgctcccggctccttcagctatactcactctttgttaagtcccacaattaccgttgttcctggcccggacttcaatctggcctcccacattattnctgataccacaactgacccccatgactgtatctctctgatccacctgatatttaacc

SEQ ID NO: 645284 - DNA, 360 bp, Homo sapiens
cctgtgaatgtgtggtgttatgccgtacacaactaataaaagatatgaaagtccatagaagcctgtgcacctccgtacaacaagctaaatcaagatatgatatgagagggttataattcggcttgtcaaaatatgagaaactgtaccctcataggtatccgtgtctgtgcaccacgtgcacaatatgcaactaaatgtgtatgattatgtactaggtctctaatgatacgaattcataatggataacacaagccccgtgcatatccgtgcatcaggtaacaatacatcagtgcacggtgtaccgtcgtacacgtccgtgcaccgtacatcgcgtgcaaacacccataacaccacacaatt

SEQ ID NO: 645285 - DNA, 112 bp, Homo sapiens
  misc_feature (105)..(105): n is a, c, g, or t
gaggctacaagtggtattgtgaccatccatccttttgtagagactcctcagatctcggtacgtgcacatgctgttgaggacctgagatgcagccttgaccacttntcggaga

SEQ ID NO: 645286 - DNA, 214 bp, Homo sapiens
  misc_feature (168)..(168): n is a, c, g, or t
  misc_feature (183)..(183): n is a, c, g, or t
  misc_feature (190)..(190): n is a, c, g, or t
  misc_feature (193)..(193): n is a, c, g, or t
  misc_feature (195)..(196): n is a, c, g, or t
  misc_feature (198)..(198): n is a, c, g, or t
aaatctccaaaaccgcatcttgaccttgacgcatcatcgctgaggtcaaggcccaatatgaggagattgctcagagaagccgggctgaggctgagtcctggtaccagaccaagtacgaggagctgcaggtcacagcaggcagacattgggacgaactgcgcaacaccnagcaggagattgctngagatangcngnntngatccaagaggctgat

SEQ ID NO: 645287 - DNA, 105 bp, Homo sapiens
gccagcccccacagaacacctgaactcaaatgagatgccggaggacaggcgggaggaggtgtgaggaggaggctcccgaggggaaggggcggtgcccacaccggg

SEQ ID NO: 645288 - DNA, 901 bp, Homo sapiens
ttaccactgtctttgtcagcagtgctccggcgagaggtgcagcatgaggtctgcccggctgcgtcactgtccgtggtcgggcgagccacgggggcctgcgcagacaccatggctgaccaccgtcagcactcagctgccgggccggtgtacatcgtgtgagctcccgcaggacttcctccgcatcacgcccacacagcagcagctgtgcatgtgtccatgctgggacgcccagtgcgggcccagcagactgcatgtactgtgatggcagcaggattggagcacctgtgggaccgacttgaacatcacgtgttggtacatgtgcaaatgtttggccaacgaactttactgtgcattgaccccggcattggaaccacccgtacattgcgcggacgtgctgccttgtggcttacagctgtggatgttaccgatggactgccctcatcggtgctaccacaaaatgtgtggctggtcgcaaattgaaaattacccccctagaattggagaaaatgaatgggtcaatcccaacatagcaactgagtgcccccaagtgctgttggaaactctatatcgttaattcttcaggaagcagtcgtatcagagtcgcgcaacgacgccctatcctcccaatgggggaacatgagccctgttatttttgcccttagtgaagccgctagaaattcaagcaattccccccggagaatgttacccctgtgaatgtggcaaagagcgccagatgagttggcgaatgtgacaaaaatgttgggggtacagagccgtttgaagacgaggggaaggtgccaagcgggggcacggacgcaaggggcatgtgcgcgtttgatccaacaccgtgctggttaatggtccactaacagccagcgtgggttcccaaggtttgcctatg

SEQ ID NO: 645289 - DNA, 586 bp, Homo sapiens
  misc_feature (514)..(514): n is a, c, g, or t
gcccacagagccgcgtgaccatgacacatggtgaacgcgcgggcggcaagacggggagagaacctcagtggaacctaggggagctgctggacgctgaggtgagagcgaatctgttcacaccggggggacatgcctaggcaaggcctggggccgttgtaaaacacttggacgggaaggtcctgagccttaatttatccctgtcacgggatggatagcgtaatggaggccttactaggtgcctggtgctgtacaaagtgctgagctcaagttatatactgatgttcacaatgatgcccatttgacatgtgaggaaactgaggctcggagagtcaggcaaataggtcagggttacgggtccagaccagaggcgagcgaggcacagaagactagattttagacagaagtctcgcacacattgtatttcctcaaccgagcctcggacgtagctatgttgggttatccgaacggggaaatttatggactgatccctcgcgatttggaaaaagaatgctgncctggccaagctggacttgctagttacccggtgggccttaactagttcttggcggcccacatagatctccgc

SEQ ID NO: 645290 - DNA, 307 bp, Homo sapiens
  misc_feature (259)..(260): n is a, c, g, or t
  misc_feature (262)..(262): n is a, c, g, or t
  misc_feature (300)..(300): n is a, c, g, or t
tatgtgggaaattggctctgaaataatcaaatgccaaacaaagcccatctgaaagtccaataaagtaaaattattgtaattgcaaaatagcgttactgagctaaatccccacagtttgaggatctttcatttatagaatagatgctgttgtgttgtcagagtggagggaatgtagtttgggccagctgggggcaaatgaggagccaacggttcatttttctgctaggggttagaggagtctgatgagcaattagtagcnnanggttcacgtacagttgctagctcttatgtgttagcacngggttcc

SEQ ID NO: 645291 - DNA, 1253 bp, Homo sapiens
tggtcaactttggaagttttttatttttattttttgtggggttttgggtgtgttctcaaatttctccctttttacagataaaacatacgtgggggtgacggcgaatattcccgccacccttagcaatattcaaccattataacctttccctctatacacttattctatctttcacacaattctcttatatttcttagcgtggaacatatctccctagaaactctcggcgtggtggcccttataatctccagagcccttagcgtgtttctccacactttcttagtatagaggcctctctatacgcgtggccgcgaaaaaccaccttataaacaacaaaaaaacaaaaaaacaaacaaaaaaaaaaaagagagaggggggcgcgcgccacacaagagaattctctcccgcgggagggggcccacaagtctatgcgcgcgcgagacccaccgggatttatgggttaacccaagggggggcgccccaatattgggaggaggagcgttatatatataaaacagagagagccgcgggggcgcgcgcggcttgttaaaaacaaacgggcggagagacgaggcggagaaaaacacagcgcggcaaacgcggagagagaaacactctgtgggaaaagagagagaccccctatatattctgtggggggggggggaggggaacaaatattatgtgggggaccaacaaaatcatcctcaaaagagaagatttatttaagagccctctataaagaaggggaaaaatatatatcaaaaattcttaacagagggggtatctacaacggcgggtggtgtttaacaacacaacgaacgcggcacgaaaatatatattatccgtccgcgcattagaaagcaacaatattgtgagccatcccacacgaaggaggaactataatatttttagacgaaccagaaacatattttttattacaccggcggggacgtatctttcatagatcaacatatcataaatcaagacaaacaccaaacaacaccactcgacgcacagagaaacaaaaccaacccaagaaagaaaggcgggacagcaaacgggagcacagagaaagaagaagcaacgacgcaagagacagaaaaaacaaaaaagaaagacggacacaacaagaaaagggcgcgagcagagtgggaggggaagagagaagagagacaagaaaagagagcgaaagcacaaaaaaaaacaacgaaagtaaaaaaacgcaaaaaagaacaaacgaaacaaagacagca

SEQ ID NO: 645292 - DNA, 850 bp, Homo sapiens
  misc_feature (83)..(83): n is a, c, g, or t
  misc_feature (175)..(175): n is a, c, g, or t
  misc_feature (269)..(269): n is a, c, g, or t
  misc_feature (420)..(421): n is a, c, g, or t
  misc_feature (455)..(455): n is a, c, g, or t
  misc_feature (477)..(477): n is a, c, g, or t
  misc_feature (495)..(495): n is a, c, g, or t
  misc_feature (509)..(509): n is a, c, g, or t
  misc_feature (554)..(554): n is a, c, g, or t
  misc_feature (580)..(580): n is a, c, g, or t
agcggaatggcttcacagcaaggttaccaagaagcagatgggctgtgaaggagacaaacccttctgtctaaacacaaatagcnttgataattaattagctgaagcagcaggggaaattatgaaaatgtgtgaaagcacagctgtgaggcatgtaaagccttcctactccagattnggtctactcaccagcagcatctccatcgcctaagagttttattagacatgcgcaacgtcaagccctactccagacacaccgaattagaacctgnattttaacaagatccccagtgactcatatacaaacaaaagactgagaagcacaggcctagaagatgtctcctcccactgacaaagggcaaagaaaggagttgtctcagaacttggagtaaaaaatactctcctgtggtgatagagagaaanngtgtggagggaaagaggggagcctgtgtatatgngtgtgtatgtgtgagagagatngagagatgaaatgaggtnacaagattcactgncaacagcctgctaaattttcagaactctggatctcagtgtagtanttactcttattgatactaggcatatntagtttctatatcccccctgagatgttcccaaaatgtcataagcggcaggaagataacctgaatttttgtcctttatccaagcactaggtctgacagaggtagtcttcctgacattggcctcactggcccagggttaagaaagctcactaaatgtttctgactattatttgaagcatgcatttccagccatgctattctaccaaaaagcagcacagatctctcttcttgatccattttgggattcttcatatttacatcatcacccttaa

SEQ ID NO: 645293 - DNA, 778 bp, Homo sapiens
  misc_feature (225)..(225): n is a, c, g, or t
  misc_feature (437)..(437): n is a, c, g, or t
  misc_feature (737)..(737): n is a, c, g, or t
gcacgaggccataactgacaccgtataaatgtttgtcacttatggtagaaaaaacttcctacaccagatgcccttgccccatgcccaattttcattctcactttatatgtgtaataataaaatattcaactttccaaaaaaaaaaaaaaaaaactcgaaactatttctctctctctctgggggccgcacccattgagttattgcttcaggctttcagaaagaggnctcgccttcttagtgtgtctccttccggcttgttggcaagaaagaaggtctctggtttagacccccaatgtgaagcccaagtgaaattcgccaatgtgccaacttcccgttcagcagatctccggaagcttcattcaaagattgggcttgattcatctccgcaacgccttgtgacgggctccattctcccggggctctcgattcgccggaanaaacacctttgggcccgccggaaggggcagggcacattgggcattaggtaacgcggaagggtacagccaattgcccgaattgccagagaagggtcccatgtggatgaggagaagtgaggatttggcgcccggagtgctcagaaagaataccgcgaatctctaagaagattcgatcgccacatgtgttttcacagcctgtacctgagggtgacaggggaactgtgttcaaaaacaaggcggatcctcatggaaccacttccacaagctgaagggcggacaaggcccgaaagaagctcctgnttgaccaggctgaggcccgcaggtctaaacccaaggaagcc

SEQ ID NO: 645294 - DNA, 121 bp, Homo sapiens
  misc_feature (14)..(14): n is a, c, g, or t
tcagatcggggtgngctttgaatacgctgggacacacgactaatcactcctggggtgtcgatgctcgtgagcgcaacaccgggcggggcgcaacaccggggcggggcgcaacaccgggcgg

SEQ ID NO: 645295 - DNA, 122 bp, Homo sapiens
tgaagtcgaaatagaggatccccgatgttttccttacgataattttatacctcagcattcatttttaaaatgtagtgcaacaaacaaattaaagaacacacacttgtggaaatcagcattat

SEQ ID NO: 645296 - DNA, 225 bp, Homo sapiens
  misc_feature (15)..(15): n is a, c, g, or t
ccggactacgccganctacatcagaaaacccacctacatgacaagcccagcaggtgctctgagtgtggcaagaatttccgatgcaactcccatctagccagccatcagagagtgcatgcagaaggcaaatcctgcaagggccaagaggctggagagagccctggggctaggaaacggcagcgtgctgtgccagtgccaaagtgccacgtgtgcaccgagtgtgag

SEQ ID NO: 645297 - DNA, 670 bp, Homo sapiens
tcccccccccgacttttgaggcccgggttgcccagattagccaaaccccaaccgagtgctgagttaaacggccaatttccaggtaaacccaagatgaattttcgtaccacttgatatgcccccccgccatatttgggaccacttatgtggaaaatgatttgtttttcttgaaattcacctgttctctctggagtcccgtgaacatgtcccccgaggggattgacgccagaagctctcgggtaatgagcccctgaggtgtgacatgcccggttatattttctcgtccctgggagaccagccctgacacccacactcccctgtcgtcccaagtagcccacgtgaggggagggggagacaccacgacccaccaccacgccacggggcgtccccactggcgagctgtggcccggcccctcctctcttgcctgaactctcctctcttgcctgagctctagacacctaacttagttccacggttcggtgccctcgttggtgctcccgtttcccatagcttaggtcccctggtgggggaggaacctcaggggctatgcagcccccgcccactgccctcgaatcccgctcccggcccattcccagattttaaactgatttttttcatgatattgtccaaaccgtgaggaaaccatttaaaaaaaagccccttaagcca

SEQ ID NO: 645298 - DNA, 217 bp, Homo sapiens
agcaatctgcatgtcatgtcatcgcggtgacccttggttccagcctagcaggaaagcggcttgcgtgagatctacaacgcgaaggctgtagaatacaggagaaaagctgcttaagagctgtaatagtaacacggcttggcttgccttggccctgcgcgtctgtcgacaaccatcttgtagtactcctagagtgaatgtagaagagatgatgagtgaa

SEQ ID NO: 645299 - DNA, 359 bp, Homo sapiens
tagaggttcaccgccaaagaggtttcaccgctagtagtctttgattttgacttactctccagtatattacaggtaaatagatcgcccatcgatctctgttccctgctattcttcaaaggttctctctgcatcagcttctgtcttaaattcaatataagcaatccctttatttttcccttccttgtctgtctaatctgatctccgcaacatcttactaaacacttctttcatattcatcctgagtgactttgtaatgtagattttaagccaaaagtgttctcgcatctcgctctttcttactgtcttttccttttggtttctctagttctatttccttgccggagactttcaaaccagtt

SEQ ID NO: 645300 - DNA, 84 bp, Homo sapiens
ctagaagattcagcaaagtacttttgtgctcttggggactgggggacctttgggggatacggcggagacaccgataaactcact

SEQ ID NO: 645301 - DNA, 234 bp, Homo sapiens
ggtggtcacagaagtagagtcagaagtaggaagagaacgctcggaaggtggttgggtcatccgagatcattaaaatggcggaccctaacaatatgtacaagaatataggaaatgtaaagtaaaagagtacaaacaaatttcctttttaagagtacttttaagaaaaaaagcagggcctggaagtgtgggttttttttgtcctccccggttgcaaattctcatggtttgggttgg

SEQ ID NO: 645302 - DNA, 389 bp, Homo sapiens
  misc_feature (27)..(27): n is a, c, g, or t
  misc_feature (48)..(48): n is a, c, g, or t
  misc_feature (78)..(78): n is a, c, g, or t
  misc_feature (108)..(108): n is a, c, g, or t
accccccctggcccccccaaaagtgcnggggatacaggtgtgaggccnccccacgccccagccatgcgggggcttccncctcacgggtggtaaacctgggctgcatgnttgaatagcctagagatttttaaaaaatacctgatgcccctgggcctcacccttcagagatttagatacaattattggggtccccagaatatttttaaagatagtattgtcataagtatttagtttacgttgcacttcaaaaaaaattgtagatttaacttttatgtctaatatttaaggttttgaattatttgtgaatgaaaaaactctaaaacagagaagtggtaccttttcattttaggtgtactgcctcagctaaagggtgtgtgtgtgtcttgact

SEQ ID NO: 645303 - DNA, 502 bp, Homo sapiens
ctgacgtcaacccaatcaacacactcactacccaaattcaagattatttcaataaaaatatgttcttcccataagaaaatgactgagagctctccagagtcctactagtggatttctattcctaaaagagaaagtgggctaacccaagtgaattatatgctgagcatcccaaatccaaaaatctcaatcctgggctgggtgtagtggctcatgcatgaaatcctcagcatgttaggaggctgaggtgaaaagatcacctgagcccaggagtttgagaccagcctgggcaacatggtgaaacgctgtctctacaaacaatacaaaaattggctgggcatggtggcacgtgcctataattccagctactcaagaggctgaggcaggaggatcacccgagcccaggagttcaaggctgaagtgagccgtgattatgccactaaactctgggcaacagagcgagaccctgtctcaaagaacacacaaaaatccgaaaatctggaat

SEQ ID NO: 645304 - DNA, 211 bp, Homo sapiens
ccagctatacagtaccatgagtactatatagtaagtctttgtatctctgctaggtatctcatgcacgtcccatctctgtagtaagaataactcataaatattactttattagccacctagtgtgggaaatctttgggacttcagggccttgaggtaacacgaacttggtcgcagatattatctacagtacatccctgtgggatgttcaact

SEQ ID NO: 645305 - DNA, 297 bp, Homo sapiens
  misc_feature (77)..(77): n is a, c, g, or t
  misc_feature (90)..(90): n is a, c, g, or t
  misc_feature (198)..(198): n is a, c, g, or t
  misc_feature (207)..(207): n is a, c, g, or t
  misc_feature (232)..(232): n is a, c, g, or t
  misc_feature (249)..(251): n is a, c, g, or t
  misc_feature (262)..(262): n is a, c, g, or t
  misc_feature (289)..(289): n is a, c, g, or t
tagccgacggagtggctgccgtataatgtgatgaatgcagtggatccatgcagtgtgaagaattggaaccctcttgnatgcatggatttnatgcagcatgattgaatgcattggattccatgcagcaagattgaatgcagtggatttatgcagtatggcccaaatcatcccgattgaatacagtggattccatgcatngtgattganagcagtgtaatccacgctgcgtggnaaaatggatcccgatcnnntgcagtggatncgatgcagcgtcattaaatgcgtcggntaatttta

SEQ ID NO: 645306 - DNA, 865 bp, Homo sapiens
tggagacagagtctcactctagcttgggtgacagaatgagaccccgtctcaaaaacaacgaagaagtagataatctgaatagccctatatctatagaaatttaatagtgcggggagatataggtatattatcctcattttcacagatgtgaaaatggaggctcagagaagtaaagtctatggctcagggtcatgtggctagaatatggcagagccaggattcagatccaggtcttcggatcttattccagtgtcctttctagcataccatgtggcctctaaagatggcagctccttatttacttagaaaatggtcccggccccaatctacatctccacttcaccccatctttctataagcactaggtggggtagaaatacagatatcatatccatggtccttgggaatacatgtactggtcgggtgggaaaaaacctctcttctaccagcgttgcaatttcggacaacgtgtggcacaaaaaaaccttaaacgtgtgtggctatgtcccgttacacaatggacgttgcacttaaccttttgtaagaacatctattaacctgctaaagggcgacttgaacgggaactaggaacggcgggagtaagcaatcacttgccggccagcgtcggtgtaaaactgctcccaatggcccaacctattactcgaagtgagaacgcaccggatgacggacaacatgcgtaccatgctgttacaacaccaggggtaaaaaggcggcccaacacacacacgcaccaacccagccagcacacaagcaacagatccagagggcgaacccgccacaaccagcaactaacacacacgagcgagaacgcgagaacaatggtgtaaacgaaaatagcgacgca

SEQ ID NO: 645307 - DNA, 296 bp, Homo sapiens
ggagacatttttgttttgctctgtcacccaggaggtagaggttgcagtgaatcgagatcatgccactgcactccagcctgggtgacagagtgaaactccgtctcaaaaaaaagtctttcaagaaaataaattccaggaccagatagattcacagatgaatcctaccaagtatacaaagaagaactaataccaatccttgtaaaactattccaaaaaattgaggaggagggaattctccctaactgattctacgaggccagtatcatcctgataacaaaatcagacaagaacacaac

SEQ ID NO: 645308 - DNA, 643 bp, Homo sapiens
ggatctgacagtagcattccatgtgttcctccgtggttctggagttggaccatgacagtatgattgctgctactcgtgcgcaactggcaagacgaatgtcgacaaatccaggcaggcagatggagaaatatgtccaccttggttctggtgagtagggcagatcacatgattctgtggcccatatcctcaagtggaagagaagctcaggtgtgcagttgaaggttgtgaccggacatttgtatggccagctctagctttagatgtaccacctcaagactcatcgtaaatgaccgatccttcatctgtcctgcaggaatggttgtgggacaagcttctatgtgctgcagagggctgacaggtgcacattgaggacccatcaattggaccagaagccctttatgtgccatgagtctggctgtggtaagcaggtgaactacagctggagacctgaatgaaccatcggcgcatccacacaggagagagacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaag

SEQ ID NO: 645309 - DNA, 200 bp, Homo sapiens
tgtaaggtagcggtcatagagaacacgcagatttgggaatctttgtcaggtccattattaatggaggagcagcatctagagatggaaggcttcgggtgaattgatcaatcgtgatagcagtaaatggagaatccctgttgggcaagtacaaatcaagtatgccatgagaaaccctatagaaggtctagtgtctacgtgaa

SEQ ID NO: 645310 - DNA, 677 bp, Homo sapiens
gatggggatagcattgaatccataagttactttggacagtatggccattttcacaatattgattcttactgtccatgagcatggaatgtttttccatttgtttgtgtcctctcttatgtcctttagcagtggtttgtagttctccttgaagaggtccttcacatcccttgtaagttgtattcctagatattttattctctttgcagcaattgtgaatggcagttcactcttgatttggctctctgtttgtctgttattggtgtataggaatgcttgtgatttttgcacattgattttttatcctgagactttgctgaagttgcttgtcgcttaaggagattttgggcaccactggtcccacagaaatacaaactaccgtcagagaataccacagtattctctaatactataaacacctctatgcaaataaaatagaaaatctagaagacacggataaattcctggacacattacaccctcccaagactaaaccaggaagaagtcgaatccctgaattgaccaataataagttctgagattgaggcagtaattaatagcctaccaaccaaaaaaagcccaggaccagattagattcacagcgaattctactggaggtacaaagtttccattccttctgaaactccattccttctgtaactatgccaaccgtagaagaa

SEQ ID NO: 645311 - DNA, 313 bp, Homo sapiens
tgatagaatcagctcggtaccggtgttttatgatgcactacgtgactcatagccacgctgagatgtctccgacattctacaatatccgggtagatcgtggactaggcttgtgcctggaggtggacgtgtgagaagatggtcattatgatctaacgtaacattgataactcgctcattgttggctactgacttcgatgaaagccgcgagatcgaaggtaccgaaagcacagtaagtcactgggtgatcgatagtcaggatccatcatagaggtcgaccttgcatggacttgcaagatttggtgactgatgcgct

SEQ ID NO: 645312 - DNA, 577 bp, Homo sapiens
ctactcgcagcacctgtgcgggtgtactatgaggctgatacaacataagagaaatcaagctctgttagggcatggggttattattattgtggcggggtgtctagtagagtagctttatattgctcttaggtctggagttggccatgtacctatgtatcctgagcattcacggcagtgagctcctttactaacattcatgtgatggcaagagttgtcctctagatgggaaagctaatcctacctagtcagtaacaaccaactgagttttatcttaaagaaaggtaaatttcgtcagctagtttactatgtaccttgaatcataaacaggttataatactcacctgttcactttcactaaatctacgtacagtcatgctgcctaattcgaacatgaggtattctaggtcccatgtatgtcagccttggcatgtcattaacagttatgatgtacctccctgacttaaaaacagaatacttttttcttgatgtaggccttactcagataagtcaaaattctatagaatgactcacttcgaatactaagagacaggaggtatagcctgataacttaccaaat

SEQ ID NO: 645313 - DNA, 739 bp, Homo sapiens
aaccgtggggcccgcggcgacccaagttgtttgtactggccgccttgtgctcttttttctcccgcaaccacttgtgtgcacacccgatggggcgggcattgcgaaaattgtaggatattcgctcgttccactcctccttgcttcccaaccggcttccccctgctctctcccacgcacggttcgttccggtgggggttcccccccgctagatccttcatttatggcctcttcgccccccctcattcgtctccgttgcacctgtccccacgcgctgtgcgctggttgcttgtgtcaaacctctgtcagtgctgtgtgctatagacttgtgtaactaggccccccaggcggtgcggattactcaatctataaatagacggggtgccccctgttaggcccaacgaacgagttgttattgccacagagcagcactcgcccgccgcttctgccaacattgtcggatttctttctggcttgcctccgggaagggcaatagttttcccatgtttggcaggggaaaattcgtggttggaataaaattggggttctgtgcacgcccgcacctataatctgtaggtatacgaacccacaggccaccccagggttgtccctgccacgcagcattgttataaccgatcgtttaaacacgaagtcccctcttttttttttctccaaaatttttaatttcgggaaccccaatttttttaaaaacccacaaaacaaaaaaaacagaacataaaaa

SEQ ID NO: 645314 - DNA, 117 bp, Homo sapiens
aaaatatttattagtatgaatcagtgtgtgtgaaccaaaaataacagatacgattaggctttgttgatggaaatgctttactacagaatagaatacatgcggaaagaggagagtggg

SEQ ID NO: 645315 - DNA, 271 bp, Homo sapiens
  misc_feature (211)..(211): n is a, c, g, or t
cagagatgatgccactgcactccagcctgggcgacagagcaagactccatctcaaaaaaaaaaaaaaaaagctgctgaaatcaggcagcgcctttcaaattcccggcccaggtgatttcgtaactcgtgggcacccggggctacggccctttcctaggcccggccaattacccttcttcctccattttagcacttgggcccatgtgtctcnttacattctcctttaccacagttttaacaggggccggtgtaagagcctttcacccagtgg

SEQ ID NO: 645316 - DNA, 420 bp, Homo sapiens
  misc_feature (19)..(19): n is a, c, g, or t
  misc_feature (222)..(223): n is a, c, g, or t
  misc_feature (236)..(236): n is a, c, g, or t
  misc_feature (395)..(395): n is a, c, g, or t
ttccaaaaaaggcggcctngggcttccgggaagccgtttcccaaagggccaagacccctggccaaccaacgggggagagccttccctcttccacggagcgcaccaggcggcggaggatctcgggagggacgaagccggagcccctaagggtgaggttgcggaggtagaggtccctcaggtccaggtccgccttgggtccggcgatggccccgaggtcacgtnngcgccccggggcncagggcctcgaggagggcggggaacagggaaccccccaccacgtcgccacggcgtccacgtgggcctccccgtggcgcctccagggcctttgggaggtttccggggctccggggaaggcagacgtccgcccccaaagccctcagggcctcgtgcttttncgggctcgcaagggcatcaaccggg

SEQ ID NO: 645317 - DNA, 107 bp, Homo sapiens
atgagtgatgaaaactatattaccaacgggaatgaagtacaataaactactaacaaacatactaactggctacatatactaactaaaataaattagagtggtcaagt

SEQ ID NO: 645318 - DNA, 990 bp, Homo sapiens
cttgaagccaaaaggatttaaaaccgctgctctaaagaaagagaaaactggaggctgggcgcagtggctcacgcctataatcccagaggctgaggcaggcggatcacctgaggtcgggagttcaggatcagcctgaccaacatggagaaaccctactgaaaatacaaagttagccaggcatggtggtgcatgcctgtaatcccagctgctcaggagcctggcaacaagagcacaactccagctcaaaaaaaaacagaacgaaaagaaagctggacgctgggtggctcaggccatcacccttccctgggctggaactacgggcacagacccttcggacactgtgccgtgtggctgctgcggccactgccgcgcacggcgcctctacgctcatacgctccgagcctccgccgctgctgctctccgccgtccgctccttacgctcggctctgccgacccctccggcgcgctgctgctccggccggcgcctcctccagccccccgcgcgccgaacgactggcactccctactcggcgcacccgcactcacgctgccccgcccccgggacacactcacacaccctgcgccccgcccaccggcaccacacaccagcacgcgcacccccacccaaagcgcgcgaacacacgagccaaaacgacccggacccaagacgcctcacacaaggacacgaacaccggacaccccatgcccacaaaaacgccaagaacccaagacaccccgcgacgccgccaccacaccagccgccccccgcccacacaaccagacgccccacccccaggcccacagcccccccaacacccagccccccaccccccacaccccccagcacacacccgcccaaccatgccacgccgcaaccgccccacgacgaaacgcgacacccacaccagccaccaccacagcccacaaacaaccaaccccaccccacgcaccacccccgaccacacaacaaccacacccgccccaacgacc

SEQ ID NO: 645319 - DNA, 640 bp, Homo sapiens
agaccaagggctaaagctgggagactgaaaaaatgcatacgtcgggtgatgatcatgtctccagctcgtgatccgctgttgtccaggggtactaatcaggcctgtgtctgccgccattctagaatagcacacgagggcaatgctagtcgtaaacagtcgttccatactaacaacgttcaccactctcaggtgggacagagctgggagcttcccagaccagtgttgtctcccgggcgtacaattgaaactggcgagcctacagtttcacttcggtgcatgtgggcaagccacagtgagggtgtggatgggttcagtgcgcatggcagtgggaaccggtgtgggcagcttgatgcatcggctatgccaggaagccggtctctcaaagcaggagttcttctcctatgccattcttggactaaggccctggtcggaggccatggggcatatccggtttgatcggtccgcttcctcatacctctttcgccatgtgaggctccaatggggggtcaccgggcgtgttgtgttacatgcaagttcccacacacattctcggtgcctggcaatgttgttaaggctttgaccataaaaacaaacatggttttcttgtgacataacttcgccttcccaccaagtcacaaag

SEQ ID NO: 645320 - DNA, 991 bp, Homo sapiens
  misc_feature (268)..(268): n is a, c, g, or t
  misc_feature (288)..(288): n is a, c, g, or t
  misc_feature (991)..(991): n is a, c, g, or t
gcatcaagcgcttcctttccgtgtgctctctcccgcgcgtgcgtgctgttgccctgtgaactgcacggatgggagcagagaagagctgctcagatctatgagagcaaggtagtctcttcagcaacttgtctgtggctgtgttcgtggagccagcagcagtactctccgcatgatgactcctggtataacaatggtcttgtgcaccttaggggcgcccctactctccaatggagattaccattgtctggtgagcgatgagttggtctgncaacctccttctactggagncttgtgcctagtagggcccatagctgtggtgcatgggataggtgctctggagtcgtgttggtcctgcattcatagccaagacgcacccagacgtaccctaataggcagatcggacaagcacacatctttcgcagcggtaggagtccagcgtgagaacgatacgttgatacatgccatatagctgtacgatccaaatgaccttcttgcttcggaagttttcgagaagatctaaagcagtccgaaggatgagttcaagtatatgcttctctcattgggggtcctttctggctcatgcattcagttcaagtagtacctgttagtccctaggttcagagatgctgactttctgaagaagatcatctgacctctagcaggttgtgccaatgttcttgaatcaatcaggaaatgggatacaattgctttcacgatgagtctcaccttcttctggtttagcccttctgttctctgtacacggtgaacttctgtcatctccttctggcttggttgcctctgacaatggagggaaacgtctcgttggctaaaattactctcttatagtgctgggtattggctggtttactcttgctgcccgtctttgcaaggttctcctctcactgggtttgcaaggctttcataggtaaggcttggcgaagcaattgttccaaacattacacttttggaattctaggggtggtaaccctcn

SEQ ID NO: 645321 - DNA, 241 bp, Homo sapiens
tgtgggtcgatcactgtactccagcctgatcaacagagcgcgatccgtctcagaaacaaaaaaaaaaaaaagaaaacggtttaaccagggtgtactaaccacaattaaaatattgatggtaatggccctatcatctataaggattttaagtactctggcaatatttcaatttaaattcccatttccatttggtggacaaggttgaagaaaacccagtacggtgttcgaccagggatcccgg

SEQ ID NO: 645322 - DNA, 370 bp, Homo sapiens
tctggtaatctagaggatcccgaagcgcacgatggttacgtcaggcagcctgatgttccgctgctgggccactgaggcggctccagctgcgttgggacgatggccgacacccccagagatgccgggtacaagcaggcgcctgaatacacggaacgagaaggccccggtggacttctggctacgttggggattgactccatcctggacgcagatgcgccggaaggccatgacgcaggggctttcgagttcaaacatcatggtggtcgggcatgagcggccttgggtaaatccacctttaatcaacaccctcttcaaatccaaaatcagccggaagtcgtgtgcagcccacctcagaggagcgcatccccaa

SEQ ID NO: 645323 - DNA, 105 bp, Homo sapiens
  misc_feature (12)..(12): n is a, c, g, or t
  misc_feature (42)..(42): n is a, c, g, or t
  misc_feature (84)..(84): n is a, c, g, or t
ccaagatcaccnaagtcctgcacttcaccaaggatgtcaagncgctgctaatcagatgcgcaacttcctggttcgagcctcctngtcccttcgcttggaacctgg

SEQ ID NO: 645324 - DNA, 474 bp, Homo sapiens
acgaaccgagctcgtacccccttctacgtctcatcactgggccactagacataattaaagaaatctgagtcagagtaagatatccatctcagaattccaatctattgttgttgttgttgttgttataataatgttgagcacagaaggtgcattaatctttatttagtcttttacttcttcctacttttagcagtcaatacacagagatgtattgtcatcttctcaaagcagaacaacaatttgttctgtatcatgctatattatactacttttcagaggcattcctaccttgactgaagtagcaatgcacagatgacaaaagtttccgtcattatgtgctctgtagaaattgttatattgtccttacattaaggtagaatgtttattctataaatataatgtaagatgataaactcctctcttcacctctaagattgcacctctctgcatcctacagtgatgagacgtagaagg

SEQ ID NO: 645325 - DNA, 313 bp, Homo sapiens
gagctttgctagtgggtcagagcaagcgaagcttatgtgggtaccgccccagcctcgggcacctagctgcccctgagggccttgcctgtcagcccccagccctcaccccttcacctaagggtgggtgaaggggcctctaagaggagccatggccaggctggggtccaggtctgagcatctgctccctcccctcctgccctgtcttcctccagccctgctccgctcgttgccactagtccctgctccgttcattgacactggtccctgttctgctcattgacagacactggaccccactctgctcattgacaga

SEQ ID NO: 645326 - DNA, 173 bp, Homo sapiens
gcctagctgccgtcgccgccgccggggctctatggtctctcctagagctttgcgttggagggcggcctgctgcgggtcttgttgaagtttgaccagcggtcggagcgggcacaaacaatggagggagttcggacctcccaagactttcttctaccgtcggaggaggaccgaag

SEQ ID NO: 645327 - DNA, 681 bp, Homo sapiens
  misc_feature (103)..(103): n is a, c, g, or t
gagacgctgcagcgcaggaccccccgagacacatatgacccaccagcccatctctgaccatgaggccaccctgaggtgctgggccctgggcttctacacctgncggagatcacactgacctggcagtgggatgggggaggaccagatccaggacacggagctcgtggagagcaggcctggcagtgggatggaatcctttccagaaagttgggtcggctgtggtggtgccttctggtagaggagctagaagatagcacctgccatgtgcaggcatgtagggtctgtcgcgaagcgccctctagcgcatggagagtgggagctgtcttcccagacccaccagtccccagtcggtgggcactcattgctgggctggttctccttgtggagctgtgatcacttggagctgtggtgtcgctgccgtgatgtggaggaggaaagagctcatgatagaaagaggaggggaggttagcagagtcgaggactgtaaggagtgacagtgccgatgggctctgatgtgtcgtctcacagcttgtaacagtgtggggacagtggtcttgtgttgggactgagaggcaagagtcgttcctgccttccctttgtgacttgaagaagcctgagtttgttgctgcaagggcactgcatgtgtctgtgtacgtgtcaggctcatgtgtgaggacgtgg

SEQ ID NO: 645328 - DNA, 384 bp, Homo sapiens
ccggcagctgcttgacctggccctggaagttgctcttacggccctccagctcaccgatctggcgcatcagcgcctggtaggccgggtggtcgcgagtgaacttgcgatccatctccgcctgctgaagacgcagctgctggatgctggtttccaccgccacttcctgatccagaaggcccttggtctgcagagtcagatccaccgagttggcacgcgtctggtaggcactcggcgccttctgggccgcgtccacctgatttcggacattcggcagctgctccttcacgaaggtcagctgcgccgatgcttcggccgagttgcgctcgacgttcaggcggacgtaggcctgggccacctgctgcaggaagctctgtgcgagggtcg

SEQ ID NO: 645329 - DNA, 465 bp, Homo sapiens
  misc_feature (31)..(31): n is a, c, g, or t
  misc_feature (38)..(38): n is a, c, g, or t
  misc_feature (40)..(40): n is a, c, g, or t
  misc_feature (44)..(44): n is a, c, g, or t
  misc_feature (67)..(67): n is a, c, g, or t
caggcgatgtctgctcaccttgcctgccttnagcaagntncctnttacctgggttccttagcctctnccacctccaggccgtgtctgctaaccctgtctgccgtcagcaagcttcgttttacctggtcccgaacaaaatatgtgtttcaactgctatccagttctggtttcccttgacattgacggcacctgcagaacttaatttcggtgtccagcaagacttatggagcccatactgccagcgagactcagaagccccaccctggagttctgcaaggggctgatgaggaggagggatgaaagcgacagccggaagccaaggcggagggaccaggggtgggaggggaggctgcatctgggcccagaaaaacgtggaaatgcaggaagggaaacaggagggtggtggggctgcccctcggagagaccttctgtgagcattaaagggcattttttaaccaggtgtca

SEQ ID NO: 645330 - DNA, 127 bp, Homo sapiens
tcttacctgcatgctcggctcccaaagtgctgggattactgcgtgagccagtgcgcccggccttctcatcgtacttgggagaagtcaggttcctctttacacacccatgtttccaaatgtgaagtcc

SEQ ID NO: 645331 - DNA, 321 bp, Homo sapiens
ttttagaataaattcccaccttctctggccttttatgcgggttggggtgaaataatagaatgggccccccttcccaagcttttttccccgggggggtggggcctgtttgaaatggggtttgtttaaaggggccattcccgatgccgtttgggggggccgtttttttcccctgaatttctttcgataacccccagggggggggggtttttttttttttgaaaaaaacttccttttcggggggcctttaaagggggcccagggccccccgggggcttaggggtttggtttggttttttttttattaacccctttttggtttta

SEQ ID NO: 645332 - DNA, 455 bp, Homo sapiens
caggatgccttagctgttgtcagtggaaatgggtaacatcctgacacttttcagacctgttgtcatcaatgatctggtcacacacaggcagcaggtacagccatgacttaggcctaatcctggcagctacggctgctaggccacttgtggtgtgtcacacagaggagagtaagagctttcaaaggggctgccagggcctgggagtcagctggtccgcagggctgagggaagagactcctatgctgcactcctgcttctctgcgcgttggtgggtcaggttcgcagcacatgagcagtcaggatcagaacctctaaggtgacactggagtccctgttctcagcggggtatggaaaagatacttcacctgaattagagaaactggtcagagtgaacaccattgatcattctggaacagacctagccactgggctactgacctcactgacaacggact

SEQ ID NO: 645333 - DNA, 702 bp, Homo sapiens
tgtgaccaatgcatccgtgcctgagtctgagataaaatgaaacgcatagaacgccagatagtagtgccaatatagctgcaagtacaaggccaaattcctttatgcctattgctgctgtaactatatatctcagagtcaccacggatgtagacccctgatctggaccacacagtgaagcatctagctaagcaagcaatcaatgcatgaaagcagaaataactctctacgaaagccaccttcttgcggcaccaaagacattatcaatagctgcaagactgctaacagtctcttaactgactattctgcatacgtattcttcagctacgcagacaatatgagtatacgtgactagcttgcatacggactgatcacggcacacacacgaatccgtctacccctacgcaactggcaagtactacgtactggtagctcacacctggcacatacgtatcttactatattactcttacctgactcaatgcacagctccagccccctataacattgtgtaaccaacttacacgcactggaaacaatggcgacacccagcattccctaaacatgccctagcacagaactgttacaatatgatccaacctacaaatgagctacctacaccccccaactcaaccttccctgcaatgtacgctacaccccttcatcaccacaggcttcctactacacccttccactaaagtcacc

SEQ ID NO: 645334 - DNA, 240 bp, Homo sapiens
agagggaactttgtttacagtttatagtttgaaacaaagatgatacagccctttctcaaaacaaacccccttcattcctggggactcggcggcccatggaggactaacaaattagtccaaagattagaaattatggcttaggagtcatgcagctggaggctacaagattctgaccctccccagtattgctcctggggataaaaccactattgttaaacctaagccagtacttgagatatt

SEQ ID NO: 645335 - DNA, 569 bp, Homo sapiens
  misc_feature (1)..(1): n is a, c, g, or t
  misc_feature (65)..(65): n is a, c, g, or t
  misc_feature (113)..(116): n is a, c, g, or t
  misc_feature (122)..(123): n is a, c, g, or t
  misc_feature (143)..(143): n is a, c, g, or t
  misc_feature (166)..(166): n is a, c, g, or t
  misc_feature (169)..(169): n is a, c, g, or t
  misc_feature (172)..(172): n is a, c, g, or t
  misc_feature (184)..(184): n is a, c, g, or t
  misc_feature (187)..(187): n is a, c, g, or t
  misc_feature (200)..(200): n is a, c, g, or t
  misc_feature (209)..(209): n is a, c, g, or t
  misc_feature (224)..(224): n is a, c, g, or t
  misc_feature (234)..(234): n is a, c, g, or t
  misc_feature (237)..(237): n is a, c, g, or t
  misc_feature (243)..(243): n is a, c, g, or t
  misc_feature (252)..(252): n is a, c, g, or t
  misc_feature (254)..(254): n is a, c, g, or t
  misc_feature (257)..(257): n is a, c, g, or t
  misc_feature (269)..(269): n is a, c, g, or t
  misc_feature (275)..(275): n is a, c, g, or t
  misc_feature (284)..(284): n is a, c, g, or t
  misc_feature (292)..(293): n is a, c, g, or t
  misc_feature (295)..(295): n is a, c, g, or t
  misc_feature (302)..(303): n is a, c, g, or t
  misc_feature (311)..(311): n is a, c, g, or t
  misc_feature (316)..(316): n is a, c, g, or t
  misc_feature (320)..(320): n is a, c, g, or t
  misc_feature (325)..(325): n is a, c, g, or t
  misc_feature (347)..(347): n is a, c, g, or t
  misc_feature (361)..(361): n is a, c, g, or t
  misc_feature (364)..(365): n is a, c, g, or t
  misc_feature (403)..(403): n is a, c, g, or t
  misc_feature (406)..(406): n is a, c, g, or t
  misc_feature (417)..(418): n is a, c, g, or t
  misc_feature (433)..(433): n is a, c, g, or t
  misc_feature (443)..(443): n is a, c, g, or t
  misc_feature (481)..(481): n is a, c, g, or t
  misc_feature (500)..(500): n is a, c, g, or t
  misc_feature (527)..(527): n is a, c, g, or t
ngggggtctatcaaacaaaattcatttttgttatattcaagtaactcatatatattcaaatttanaccaaatcaagacaacaatccaatacacagattattatatagctcaannnncaaaanncaacagtcttgtcaatacanactctacataaatacacaaatcncangtnttaatataacangancaaatcacaagtncatgtgttngtgttctttctccanatttctagtnggnaatctngtatatttngnaanggcatatggggngtgtangggcttccnccccatgnnangggggcnngggggggnaaatnaggnggaangggggggttttatatgtaaagnggtacatttcaganagnncccaacatgaagtaaattaacaaacatattgcgagggnggncgctcccaaanntgcttatcatttgcnattgtatacngggaacaaactgcccagatttttttttttttttctttntggggggtattatagtaancaaccttaaaggacaaataacttattngggggggtaaaatagcgggggtcggtgttttttttttaaccc

SEQ ID NO: 645336 - DNA, 302 bp, Homo sapiens
cgagccgctacccatttgcaccccaaaaatatgaggtctcagtaaagtcagaaagtttattttgccaaggttaaggactcacgcctgtgacacaacctcgggaggtccttgacaacatgggcctaaggctggtgagtggacacagcttggtttgatacattttatacgagacatgaaacatcaatcaatatgtgtaagatgtacattgtttcactcttggataggcgcggacacctcctaggtgtagcgttaacgtgcacacaaggggactggtgcttccaggtccttcctgctaatgttgg

SEQ ID NO: 645337 - DNA, 172 bp, Homo sapiens
tagaagtccaaatagcacctagttgagaagtttcaatcagccacatagccctcgctagtaacagccatgctcatccaaacccccggaagcgtcagcggcgcagtcatgctcataatcgcccacggacttacatcctcattactattctgctatggaaacttctaaaactagg

SEQ ID NO: 645338 - DNA, 125 bp, Homo sapiens
actggaatagtgagtgtatcccaaaagtaatccataatgaggtccagtttttccttcatccttggactggttagtcatgaaatcagcaaaattccagatgagctctccaaccagtgtggagagag

SEQ ID NO: 645339 - DNA, 220 bp, Homo sapiens
tctcctctccttaatgctttttatccacttttacacgtagcaatttcatctcattctatggcctttcatgtcgtcttcttctcaaagccttcttggaccaattaatcaacattaatctctttctctctgtattcccctggctcttactttttttctttactttacttgtctttctttttattttttggagacattactcacgacgggagggaactgccca

SEQ ID NO: 645340 - DNA, 179 bp, Homo sapiens
atcccccttctggccgctgggctgagcccctaccccacaccaggcctgtcctcccgggccctcccttggaaacctgtcctgcctgagggcccctctgcccagcttgtggcccagcgtgggctctgccaccactaccttgttcatgtgtccacggtgcgcattctagtgacgggggtacc

SEQ ID NO: 645341 - DNA, 458 bp, Homo sapiens
  misc_feature (202)..(202): n is a, c, g, or t
tataaagtatgacatgtcagaggatgatgagtgattgtgaggtcttactagatacccggttcttccttgtttgcttctttcagaatgctggagatacatgcagtgatccatctaatcaccctcagcactctttctctggtccctgctgatagatttagatttcctttcttttattagggactcagtctgctatctcctttgntggtaccaccactcactcccttgatatcttctactcccttgccttcaccttgcttaagactgagaagggagttagagttggtcactagctctgctgtttcctcactgtgtaccccaccaaagaagattagttcaagtgaaaaagaagctactgtaggtaaactgggagagcaagtgttggatctgggctggtccctttcccataaaattaggtccgtggttgtatgttgccatagcaccccatacttgctctctca

SEQ ID NO: 645342 - DNA, 171 bp, Homo sapiens
ctctggaccttggagcaggcctgccgccttcatgtccactctcctcatcaatcagccccagtatgcgtggctgttgagctgggctccgcgagtaaacgagggcgtgtataatggagctgggagccgggtagaggtattacgacctattgcctgctacacgagccaatagca

SEQ ID NO: 645343 - DNA, 401 bp, Homo sapiens
ccgacgacaagggcgacgcaccaggctgaataaaattaggctgagacctactgggctgcattctcagaacagtggaagcattactaagtcacagtgatgagacaggaggtccgtacaatatacaggtcatgaatactttgccgctcgagcagattgcagtaaagaagccaaccaaatcccaccaaaaccaagttggccacgagagtgacctctggtcgtcctcactgctacactcctgaacagcaccatgacagttttacaaatgccatggcaacatcaggaagttacccgatatgacccaaaagggggaggaatgaataatccaccccttgtttagcaaatgagcaagaaataaccataaaagtgggcaaccagcagctctaggcgctgctcttgtctat

SEQ ID NO: 645344 - DNA, 252 bp, Homo sapiens
caatgcttatgctatttgttcagtcagagggtagagaatgagtgtgaggcgtattataccataggcgcctagtataagagtactgcggctagtactattgacccagcgatgtgggcgttcgagcggggcgttcgatagtcctaagtggagtccgtacaggggtgatcttcactatgacagctattgtgtccgctagtcatattcagtagtaggcccaggagtttgacagttcttgggcttacggggtcagcg

SEQ ID NO: 645345 - DNA, 1424 bp, Homo sapiens
caggcgtgagccaccacacccagtggcaaattccaatttttattttattttattttagctttgagactccaccacaaaaaaaaaaaaaaaaaaaaaaaaaaaaaagtttctttttttctggaaattaagtttttccttttcgaagtggttgtgcgtgggcgaggaattacaggggaactttccttatttcgacgaccaattttcttgcacagtggagataggttttccgcaaaaggtaacgtcgctatatgtggtgttgctccaatttggaggggaagaagaagaagaagacacccttcttcaaattatgtggctcctaatatccctcagaaaagagaggaaaagaagaagagagagaaacattaaaggggcggagtgttcacccccaaagtgtggcctttgagagaacaccacagcacctgttgaaaaacaccgaggcgctctatgaaaggcctgtcgcgctgggcacaataagacgccggtgtggttgagttaacaacatttgtccgacaccccggtgtgatattttacagaccagtcgtggtgagtgtgttcttctcttataagggatctctctcgattttttttcgtgcgtctctttgtgcgacaccacgacacacttttttgtggtgtgaaaaaacccccccttcacaagaggtctgtcctggtgtatctcggtggttaacccgcctctcgtgttgacaccccccagtggtgagttggctcttgtgttgcaagacccccccctgttttgtgtctgtgtgatttcaccccccccattaaagtgtgtgtgactccaaaagatggaaacttgaaatgtagacaccccctctctctagagtgttgtgtggaggatctcccccttttattaaaaaacgtctttgttgtagagcgccctctttatataaagcgcagccaaacatagttgattgggcgccgcaccccttataaaaaaagcgctctggcggctctctttgagcaaaccacggagacggcgttttcgcgaaggaatggctctcccaaagaagcgagaaaaaaacaccccctatcactttcttttataaacccccggggtcgcacgagcaacggcagttttggcgcataagagaggacacccactcgttgcgaaaaaaaactgggggtcaacaacaagagaatatcagggggagggatgcgcccatggaggtgggcaaccacacgctgtatatggccccccagaaatctttgggggccacgtataggtttgggggagaaaattctttttagcactcctcgacaaaactttaaaaacacgtgtgcgctgtgacaacaaactatatatgtgaacagagtctgtgcctcattaaccaaaacaatttatagaacattttatctcccgatggtaatgtatgtgaatacatcaagttgcttgtggtggatccaca

SEQ ID NO: 645346 - DNA, 806 bp, Homo sapiens
  misc_feature (336)..(336): n is a, c, g, or t
agcggggcgggcggagccggggctggagagcggagaccactgcggatctcggaaggaagaaatgatgtaaatcactcatccaaaccttaaggtcaaaggtgagaaggaaggtcaggaagaactatggcctggccaaatgttgttcaaagatgggtctcgtgcatgtcccacgttcagctcatcatcatgttgtatgtgttcgctgcatcagctttcattcagtgtatctcgttgcatccattgcttcacagaagaaacattgagcaaatgtcaacagtcacgtatctactgagcagtggacccgcaagtgacttttaactacgtcagtatgagctngcctgtgggagatctggcagcaggcaaccatgttgttccgccagtgcagagaaagcgagtcttgttcctcgagcacactggaataccagtttatcctcgttctcctgtatgctgtgggccatattcatcaagtggatcgttggcggatcaggttgaagtttgcgaatgggttctagtctattatgggcatgtgcgtcttctgcgataagtgagatgtgagtcttatggaagcgctcacagcaatggctgcgtttctacaacagaatggctgtactgctgccctgtggattagtgaacgagctgctgcagtccacttggttggccctgtgtggttgctgttatgggcaactggttcgggaaagccggacgacgagtagtcgtaggtctctggagtgcctgtgcttcggtgggcaacattggaggagcgtggcctagcattctttctgttcttcagaatggtctatgaataa

SEQ ID NO: 645347 - DNA, 362 bp, Homo sapiens
gccgcgtcgacgccctttcagcccacatgactttggcgcaggcttttactaccagggcccaaacacagtgtccaagaatggcaccaattatactgcatattgctgtatattattttatccagcactgtgaaggccaacctgaactgcctgaaaaatctttgtcatttagtggtttagggtatgtgcaccctccatacaaatgcattaaataaattaaataatggtgtgtgtgtgtgtgtgtgtgtgtgtgtgtgtgtgtgtgtgtccagctaaattgcactgctttcttagatcatttaagcacacttaatctaatggaacatggtaggatttcagcagcttctgaatagaagttggagaga

SEQ ID NO: 645348 - DNA, 217 bp, Homo sapiens
gtcatacccttttgcacagccacactctaccacatgcacaaaaatgtctgcatgacctcttagaatcatccacttggtcccgtgacacattgatgcaccattcatacactcagccacacactggtttgtgtcacagtcacggaagtgcatatacaccacacacacaatacaatcacatatgcaataatacactacacttaaacacaaatacgtagcc

SEQ ID NO: 645349 - DNA, 325 bp, Homo sapiens
  misc_feature (8)..(9): n is a, c, g, or t
  misc_feature (50)..(53): n is a, c, g, or t
  misc_feature (71)..(71): n is a, c, g, or t
  misc_feature (120)..(120): n is a, c, g, or t
  misc_feature (122)..(122): n is a, c, g, or t
  misc_feature (143)..(147): n is a, c, g, or t
  misc_feature (163)..(163): n is a, c, g, or t
  misc_feature (192)..(192): n is a, c, g, or t
  misc_feature (211)..(211): n is a, c, g, or t
  misc_feature (231)..(232): n is a, c, g, or t
  misc_feature (322)..(322): n is a, c, g, or t
ctattatnntctctactgaggaacccaatgtagaacttgcactgatattnnnnttactgcctttatatgantctataggtatctaaatgttaaggcatgtatgatctttgatcatttctntnttcaaattaaagttgtataannnnncaatatcttgccttanattagttgcctattctttctaggattcanatattgtgacatttaaaanagaaaacattcacttttganncttagacttcagatcaaaaaggactgaacccccactatcataatccatacattcatttccatgttgtttgactagcagtgcatatatggntgg

SEQ ID NO: 645350 - DNA, 254 bp, Homo sapiens
agtacatcttaaggacgacacattccctacaccggggttaactcagcctgtgcatagttgagctctgtggctgtgtaatactttgttgtatgaggctgtcctatgactagtaggagtacttagcaacatccctggcctctacccacaaggtgccagagaaccttactgagcgccaagcgtgaagcttgaattaacttattttattatgatgtgcactactgcgttctctcccccaaaccccagaacaagaaaca

SEQ ID NO: 645351 - DNA, 255 bp, Homo sapiens
aagatccgtactgtggtgtaccgtctgtgctcagaagatccaaaatccctggaatttgaatttttaacggaatttggttttaaggaagggtttttaaagacagtgtaagggagagggtcacagggcgcatgatcagcttcttgcacaattctctgactggttgatgatgagggaacagggcaatgtttcaggaacctctgtcatcaatcttccagttccaaccagtctggggtcttcattgctggtggtcagcat

SEQ ID NO: 645352 - DNA, 145 bp, Homo sapiens
ctgccctcacatccctgcagatcttttctggccacactggtggcccgcggggtatggctgcttccgtctcgcggcgttggcctccctgactggccgccggtgtagggcgccgtgggcggggtccctggggcgaggctgcctggcc

SEQ ID NO: 645353 - DNA, 122 bp, Homo sapiens
gtcaattgaaacaggatggaaacacacctttatgtcacccacaggccttgggtggtacacaacctgactagggaggccaggagcgtaaagagagacaggaacccctgggccaaccctttatt

SEQ ID NO: 645354 - DNA, 916 bp, Homo sapiens
agaggatcccggaaagcacactgcaacataaagtaaacctgagcccccacgtcccaatttttttaatagattatgtgatgtggaaagctcattgatttgtatatgtttcagcgtgttacctttctggcttccagttcccaggtgttctttgtttgcctttgataaaatacaggatttaagaacagagagtactgcaaaatgccatgcagactttaaagagaatggcctgtttactaattgctgcccttctgatgtctttatgtatagctctgatagaattttcaccagtctatgtatctctggagtgagatctatgtacaaagtgacatacaattggaaatccatttttgttgtaaagacattgtttttcagacttttcagatcaattagaaaaatgtcattgctttaaaatcatagctgttctgtttaagaggaattgaatttaaaaatgagagagtattaaaactcatgtggcagtatcctggtcttaatcaggtattgcagtgttcaaacaaggtatggacacatcaacatattcaccttttggaaggactagtgacttggttaaaaactaatgagtgttgcgtgtggtgtttctatgcgagcacccattctcaattttttctccggaacagcgttcatggtactgtgtggtgggcagccgcgtgggggcggatctctctctgggtcgccagggggttggggcccccgtataaggataaatgtgtttccctcctttaaaggcgtggtgcccatattagcacccggctgggactaaagcgcgctaatgtgtggaccgaccctctcccgtcgacaatatgcgcttttttgcccgcgtcttgtgcgacacttcgggtatttgcgaccgcatggtcttggggagcagcaggacgggaagcatatctcttcttggagc

SEQ ID NO: 645355 - DNA, 759 bp, Homo sapiens
agcggattgggggagtggaaacggagcagtgacaggtatcccggagggtgctgctgaggcgacgatggccgagagggcccgaggaagcccgaggccacctcccggttgcagggacgactggacggaagagggaccacagagcaccgtcaccattccacatgagaaggacccatcgatacacaaaccgcacagatactcaatgaccaaccgacgatagtacaacactagtgaacagaaagcacagggtacctagtggaaggatacacaaaagaacacaggaaacaacaagaaaatgctagaataaaagaagaacataaatgaatacagagaaagaagaagatagaaaaagaaagaaaaaagaaatgtagagaaaagaggatagatatgtataagaagaaagaaatatgaaagaggaaaagaaagaaaaaaaaagaaaaataaaaaaaaataagaaagaatgaaaagatacgaaaaaaaagcacaggtaaaggtacagaaaaatagagacagaaaagaagagtaaaagtagagtataagaatacctaaaagagttgaaagaacaggataatcgtgatcaacgacacataacaaagaagcaagaatggagaaacaaacaaaaacagagaaacaaaacgaaaaagacaacagaagcgaaaaaacacgaaaagcaacccggataaagagagaaaaataggaacaacatcgtaagaaagatagaagacaaaacacaagaaaagaacaaacgacagagaggaagaa

SEQ ID NO: 645356 - DNA, 123 bp, Homo sapiens
ataccactagtggtcgcatcctactaaatacccaaccagaactccttagaactgtcatgtgtcatcagaaacaagacatgtctaatgatgacaacatgccacagccatagaggcacctcacag

SEQ ID NO: 645357 - DNA, 368 bp, Homo sapiens
aatgtcggtgtgtctaatgtcggtgtgtctaatgtcggtgtgtctaatgtcggtgtgtctaatgtcggtgtgtctaatgtcggtgtgtctaatgtcggtgtgtctaatgtcggtgtgtctaatgtcggtgtgtctaatgtcggtgtgtctgtgtagaaagaagtagacatgggagacttttcattttgttctgtactaagaaaacttctgccttgggatcctgttgatctgtgaccttacccccaaccctgtgctctctgaaacatgtgctgtgtccactcagggttaaacggattaagggcggtgcaagatgtgctttgttaaacagatgcttgaaggcagcatgctcgttaagagtcatcaccact

SEQ ID NO: 645358 - DNA, 1161 bp, Homo sapiens
tacaagtgcagccaccattgagaatgaaagccacagcaaccatcagtgccaagccacagatcactaatcccaaggcagagattactcgatttgtgcccactgcactgagagtacgtcgggagaataaaggggctactgctgctccccaaagaaagtcagaggatgattctgctgtgcctcgttgccaaagcagcacccaaatcttgtccttctgttcctgtctcagtacaaactaaggatgcatgtctatgaggctttcatgacaagcagcatggaagggctcactgtgacagcttttgatgcccagaaacaggcttctgttcacaacagtggccccatggcgaaagaggctcttattaacacttagatgacacgagctgacttccactcgtcagggtatacgactaataaacagttacaaggcatatcctaaaatctagcctatgttcagaattgactgcacataaaacagggtatatcatccagaatagatcagttattgaagcagctgctgctacacatccattcccttacataccaccataacaccctgtatacttccccatcctaccagttactttgagcacatttgctgatcggggggatcttacgttgctaattggacaagactctagtgatgctgatgggcactggacgtacgagatgctcggagaacaaaaaacacagcacaaatcacaatactggccaacaagggaaagaagcatacacgacaagacatacccccgcacaaccacatgaggccacgacacgtagcacacagcacaatggcacacccacgacaatcccctaagctaccaggcagcaacatgcgcgacagccacacccgccaaccacatacgagaaacaaacataagaccaccacggtgcaccaaagccaaccaaaggcacaaaagggaggagaacaaacgacagcaccaaaggctcatacacgccagagcccagcccaacagaagcggagcacaaaaaacagccgggccaacaacaagaaaaatacacaagaagcacacaacacaccgccacaccgacacgaacaacaagcccccccacagaagagaaccaccaagcacgcccccgcgacaccgagacaccaaacacacccacagcactcagtgacacaacgcgacaacgaagaaacgacca

SEQ ID NO: 645359 - DNA, 280 bp, Homo sapiens
aatgtcggtgtgtctaatgtcggtgtgtctaatgtcggtgtgtctaatgtcggtgtgtctaatgtcggtgtgtctaatgtcggtgtgtctaatgtcggtgtgtctaatgtcggtgtgtctaatgtcggtgtgtctaatgtcggtgtgtcttgtatgttcaaactgtcattttatttttacgttgttagatatccggagtagtgtgattgaggtggagtagattagacataggtagaagtagaggttaaggagagtgatggtggctatgatgggacacatc

SEQ ID NO: 645360 - DNA, 232 bp, Homo sapiens
  misc_feature (232)..(232): n is a, c, g, or t
aatgtcggtgtgtctaatgtcggtgtgtctaatgtcggtgtgtctaatgtcggtgtgtctaatgtcggtgtgtctaatgtcggtgtgtctaatgtcggtgtgtctaatgtcggtgtgtctaatgtcggtgtgtctaatgtcggtgtgtcttcagtgcctctgcctgcggagaatgtgacaattactgctggtcagagaattgaccttgctgttctgctggcagacacaccgn

SEQ ID NO: 645361 - DNA, 358 bp, Homo sapiens
  misc_feature (176)..(176): n is a, c, g, or t
  misc_feature (256)..(256): n is a, c, g, or t
aatgtcggtgtgtctaatgtcggtgtgtctaatgtcggtgtgtctaatgtcggtgtgtctaatgtcggtgtgtctaatgtcggtgtgtctaatgtcggtgtgtctaatgtcggtgtgtctaatgtcggtgtgtctaatgtcggtgtgtctaatgtcggtgtgtctaatgtcggtgngtctaatgtcggtgtgtctaatgtcggtgtgtctaatgtcggtgtgtctaatgtcggtgtgtctaatgtcggtgtgtctnatgttgaacgtgtgcccatcatccagaaagagctctccttgagctgtaccctgagggctaagtgcaacaaagagagtgatgggcacacgttcaactatcaga

SEQ ID NO: 645362 - DNA, 290 bp, Homo sapiens
cggtaccctgattgctgcaccgctgcttgaaggtcccagattctaccacacagcagcagttacaaaaaccttccccaggctggacgtggtgggtcacgcctgtaatcccagcactttgggaggccaaggtgggtggatcacttgaggtcaggagttcgagaccagcctggccaacatgatgaaaccccatctctactaaaaatacaaaaaattagccgggcgtggtagcgggcgcctgtagtcccagctactcgggaggctgaggcaggagaatggcgtgaacccgggag

SEQ ID NO: 645363 - DNA, 449 bp, Homo sapiens
tgggaattaaaagttttattgggtgtgttaaatgggttaatttctccaaaaataatttaagggagttggaggggaaatttaaatcggggatggggggataaaaaattaaatggggtaaaggggaggaaaagggaaaaaaaaaaaaaaaaagaggtcccggggaaaattataaaataacagccgagggaggttgtacaaaaacctttcaagaattttaaaatataacaaaagaaagacaaaagcaaaagcggggaagacattcgacttacaagcgttgtcacagctttataaaaagaactctcctgtgtgaggaaacaaaagtggtgtgcacaggcttacaacgggtgctccacagaactatatattcatcgaggaaacagcggtggaaatatttatcttttagatcaaaaaaaaaacatctcccgcggtgtctccctatccgtgtagcc

SEQ ID NO: 645364 - DNA, 151 bp, Homo sapiens
ttagctggtacctgatcgacgcatcaatgagagcgtaacggcttcatcctgcacgcgatctgcgcgttgggcgcctgatcagtcctgttctgcatgttgtggtgaatgtctagatgtctgacctgcatgtgcgatcaatgcttgtgcactg

SEQ ID NO: 645365 - DNA, 293 bp, Homo sapiens
tgaggatcccacgtaccaccctcctctttcctacatcagcatcctggagaagaggtagggaaggaaggtggagacggagacgcccagctttgaagacacccagtgaggaaagagcttgaggatgtggcctagtttagtgggatggtcagggcacagagatccatttgtgcctcctcaccacgagacagggagccttatgcccgaagcgaagaagttgtggcctcgaaaaaagacatgtatttgtaatacgtagtagaactgtatttgtgatacaaggtggtttaattccactg

SEQ ID NO: 645366 - DNA, 235 bp, Homo sapiens
gggaatacttactctacgaaaactgcgaaacttacttgcgatgaactgtattaccttagaggaagaggaagaggtgataaagaggggcaggaatatcaaaggcatatgcagaatggctatctccatattcaaaactggtaactaaaaatatttaaatacatggcacatagggcaccctttgaaggacaaagaacactcttaacccagcagtaggctacattagcactaatatctt

SEQ ID NO: 645367 - DNA, 885 bp, Homo sapiens
ggacccgccaacatgggccgcgttcgcggcaaattgcgtgaagaaggcggcccgggtcatcataagaagtactatatgcgacctgggcaaggattttcatgaaggaacaagcgcggctgtgcggagcgcgatcgccgttatccgcacaggcacaaaagctcccgcagaagagatagctggttcatgtcatgcgatctgcatgaatcgagttccgtgagaggaccagtgagaggtatctcgcatcagagctgcatgagcgaggaagcagagcaacggagagaccaagttatgcttccgtggatgctgtcgaagcttggagtcaggggagactaatgtgagatgtggatctgtgacgagtagggcaaatgctggaagcttgcggacttcgtgcagctctgtccaggcttcaggttgactcagcactagagttgggatgaaatttcaggacgtctgcggggacctggtcggaactggtgtcactgtacgtggcggaagttactgcatcaataaactcgggtgaccacaggaacgagagcccgaagcaacatgaaggggctgtccaggggggggcggaagcagggctggttgtgcctagcctgaagccgagtctggggaccgagctggacagagtaatggatgaaccagtaatgggcctcgtggaggctaccaggaaaggggtccgtaggcgagagggtgaagcggaggtgacagccggacccgcagctgggaatccccgggccctcggcctggcggaatgggacgtcagctcacgggacgggggcgaaggcgggaatgagacacagggaggggacagaaggagcgaaggacgagagcggagaaaggagggagatcaaacgagggggcacaaaccagaaaaagggtaag

SEQ ID NO: 645368 - DNA, 922 bp, Homo sapiens
gatctctggtgttaccttcgttctgcgcggtggttctctgagagcaggcggtaactttctatcattcggtccagcgcttctctcacgtagccataatggtgcagtgcaagccacgcctgattggaagacttccgattggatcatggtacagtgaggccctccttgaggccccagtaactcatctgtattcggcttgtgagcgtatcggccgactaatgattatcactttaaggtgcgatcaactgatgcacacagtgagcacccagttatctttagatgaacggctcattttacgggctggtgcacaaggatgcagttgcacattagttgcaagctataggccaatgaattacgaatgcacgtccaattacagtaacgactggcaatcttttgacacattgtctgtactaggccaatcgggtttcccttggggggctttgagagagtaacacgcagacagtggtcttaatggtctgaagcgtgtaggttcatgggccatgtgcatattaggtggacaagtacttagtatcttgtggaggaagatgcatagtcagaagatgaagaggaggaggactgtgaaagctcttaatgtatatctggaaagcggtctgtccctggaggtgtgtacgcaggttgcactagaaaataggtataacttgctgtctgactgaagattactgacgactgactgactgaccggaggactgatcgatgatccagtgcctgagttgcttgagtgattaccggattaatggacgtgaaccgctcgatggactgaaaagcgcgtccgtggacgcatcttgatacggaacactatcttcgccttcagtgaattggcagacccgtgatagatcagaaaggcgcacacgacttcaatccgagtagtcgacgccacgctcactaagaggctaatccttgacaa

SEQ ID NO: 645369 - DNA, 326 bp, Homo sapiens
ggggccttaggcaatctttccaaagtaaaatcagggccccattgctacttaagccaaatttggacaaacttttttttttttcaattttgtaaacttcctggaaagctgttttcactaaggatcccctagtttctaaaaatgtggttagtagtcatggaaatgacacataaagtacgccaaaagtttgatggaacgtgttaaaaactgttttgggcttttatggatgtcaaacttgacaaaacatgggtaagttactaaaatatgaattgatggtaaaaaaattttacatttgaattccttttggataaagttattttttgatgtga

SEQ ID NO: 645370 - DNA, 120 bp, Homo sapiens
tgtcatgagcatcacacgtggctgtttccacttcttactaaccaccctcctcctttgtgactcgtggaaatgtccggcatatggcatacagattcataaagtggagactcgtgaaaatgt

SEQ ID NO: 645371 - DNA, 351 bp, Homo sapiens
  misc_feature (186)..(186): n is a, c, g, or t
  misc_feature (221)..(221): n is a, c, g, or t
  misc_feature (329)..(329): n is a, c, g, or t
  misc_feature (341)..(341): n is a, c, g, or t
aaccctccacccattgatccagctagcctggaggaattcaagaaaaggatcctggagtctcagcggctccctgtagtcaaccctgctgcccaacccagcggttgaggacccagctgccgcagacgctgggtgccagaatcgccacctgtggatgggggcagcaggtgccacagtgctggacaccgnccgtgcctgccggaagcctccacccccacgccttntctggcaccccttcactgtcccctgcatccccgccattccccagacactggatttaaggcacacacagctgtgagatgactttcacatcgacccctttgtgcagtganccggatggtggnccacccacaa

SEQ ID NO: 645372 - DNA, 270 bp, Homo sapiens
ccattcagtgagggatggaaagaacgatacagagttcaggcaaacgtggatgccgtttgagtagaattgcttgtgcatcctcgttgggggctggcctctgccataagtcaattctattgatgatacttgtgcacttatcagaaatactcctcttctccctcctttctgtcaaaacactttcccctcaaggattcctctgtttttcttgaatggtcctttggacaatagaatgccagcatacacgcaaaaacgcccgcgaatttagtagta

SEQ ID NO: 645373 - DNA, 304 bp, Homo sapiens
ctctcagctgcaagttacctttgaaaacttagtctaaaaaatcatacagcccgtgcccggccaaatcatatacattttaacttacagctcatgcctgtaaccctaccactgtgggaggctgaggcaggtggatcacttaaggtcaggagttcgagactagcctgaccaacatggtgacacctcgtctccactaaaaatacaaaaattagccgggtgtgtagcgcacacctgtaatcccagctacttgggaggctgaggccggagaatcacttgagcccgggaggcagaggttgcagtgagctga

SEQ ID NO: 645374 - DNA, 177 bp, Homo sapiens
  misc_feature (2)..(2): n is a, c, g, or t
  misc_feature (5)..(5): n is a, c, g, or t
  misc_feature (9)..(9): n is a, c, g, or t
  misc_feature (77)..(77): n is a, c, g, or t
  misc_feature (79)..(79): n is a, c, g, or t
  misc_feature (81)..(82): n is a, c, g, or t
  misc_feature (86)..(87): n is a, c, g, or t
  misc_feature (127)..(127): n is a, c, g, or t
  misc_feature (160)..(160): n is a, c, g, or t
  misc_feature (163)..(164): n is a, c, g, or t
  misc_feature (166)..(166): n is a, c, g, or t
  misc_feature (170)..(170): n is a, c, g, or t
anagnaacnataatgtgtcccctgagtagaaggatgctgctatgcgtgagttcatggacacaagttgattacatggntntnngaannataattatggattcttcttatttcatggtaggttgtcttnaaagatataaaaattaggatgcctttatgaagnacnnantatncccaaaa

SEQ ID NO: 645375 - DNA, 320 bp, Homo sapiens
gaccacttccagttttaaaaatatatgattaggccaggtgtggtggctcacacctttatcccagcactttgggaggccgaggcaggcagatcacctgaggtcgggagtttgagaccagcctgaccaacatggagaaaccctgtctctactaaaaatacaaaattaatgtggtggcgcatgcctgtaatcacagctactcaggaggctgaggcaggagaatcacctgaacctgggaggtggaggttgcggtgagctgagatcgcaccattgcactccagcctgggcaacaagagtaaaacgtcgacgcggccgcgaattta

SEQ ID NO: 645376 - DNA, 307 bp, Homo sapiens
ctacagcaacatattacaggaatctcagcaaatgccttggaagacttattccagaaaaacagatactcaatgaaccaattaaaacaagttcagcagaacagttttgcacagagattcacttgttacacttaaaagagccttagaagcaaaagaaacctagctcggcagcacctacgaagaccaactggatgaagtggagaagaaactagattcaaaacttacagggagattgataattttccaaattaatcaagctgaaggaactaggaatacacattagcacaaccttccagaaggcaaaagttcc

SEQ ID NO: 645377 - DNA, 231 bp, Homo sapiens
  misc_feature (4)..(4): n is a, c, g, or t
  misc_feature (7)..(7): n is a, c, g, or t
  misc_feature (213)..(213): n is a, c, g, or t
  misc_feature (216)..(216): n is a, c, g, or t
tttnttntttttttgtatcagctttatttccattggtccaaggctgttaggatagttaaggctgcctattggctggagggagaggctaggcagaagccctatactttgcaagggcccttcagaatcgcgggctcagaaggctcttaatcgtgctgagagtgagccttcgaagagatactcgcccagcccagcctccgggccccagccgtggangtngtcagtggtcacccc

SEQ ID NO: 645378 - DNA, 250 bp, Homo sapiens
ccccaataggaatccaactatatgctgtctacaatagatccactgtagatcttaagacacaaataggctgaaagtacaaaaaaaaaaaaaaaaaaaaaaaaacccaaagggtgggttttaggggcccacccttgttttcccaacgggtttccttttaaaaaaaactggaaaatcccttaaatttatacacccttctcaggacattgagaaacattaaaacactctgggcctgggcccctaggggctctca

SEQ ID NO: 645379 - DNA, 1720 bp, Homo sapiens
  misc_feature (271)..(271): n is a, c, g, or t
  misc_feature (1371)..(1371): n is a, c, g, or t
cgttgcggtcttcctccatcaggatggtgggttgcacttctcgtcggttggtgttgtggtggttgcgccggccccgcgctgggtgttcgtcaagatcgcgggaggtgtgtgtcggtcccgccgaggctctctgtgtgtggtgtgtgtatggaatgctgtgcagcgaggccttcttgtccagatggtgtgcgccagcgttcgctatctaagggcgtttgaggcgccccgccgcctggcgtgcacaatccgctagccgtgtgcaaccgaaagncgttgtgtgctctgtgaatatgccgacgggggttgttccgcgtctggccctttgttgtggcgatttgatggaggtagtctcgcgcttgtggtcccccatgttgggggtcctttgggagaaacacatatatagtggtgcgctgctttagatggagtagtggctctggtcttgttgggcggacccgctttttgtagtggtcgttgcgccggtggcgtccatcctagaccgctgggtcggtatgtccccccgtggcgcactaggagtgtccttggcaaaggggactccctcgtgaaagggagcgggaagtatccagggcctacgcccccgtttctaccacgggaattatgggagtccgccgtcctgtcgtcggtgccgtggtgcaccgtggcacactttgggcgaccacaggcggtctaatgccgccacacgtgcgccccccgttagaaattggccgcggtgtttcttattggcgctttggatggggagattataagggcgcttttataggggacctttgtcccccctggagggccccttcttttgcgacaccccggtgctctggtcgttgtctctttggagggggcccatagccctccccagggggacccacctttttgggcgccagagttctgcgcccacggggtcttccccagggcgctcgccaattttgaaggggttctcggtgccccttggtgcgcacacaaggcgcccacggtgcgcttaagcaccaccgtgtcgtgagagacccacggagtttttttcccaacacatgcgcgtgcacattgcacacaaatctggggcgccccacgataaatattgttttccgtttgtgtgggcatgtcttttggtggtctaatggtttagggggtcgcctctcacgccagcgcatcccctgtgtgcctcgtctgcgcccacatgtggcgacacactctcaggaagaccacagtctctctctccaggagtttggtgcacacacaccccacacagacatagtctgtctcccagaacaccttgcgccacaagtggtgtattctgtgttgggggcgacaaaatgtgcccgctccacacttgtagaacacccacctgggtctgtgagactnagaaccctgccacgtgtgtccccaggtcaccagatgagacccaccctataataacacacgagtggcgtaaacattctaaatcttacagatttaatattaagaatctaaaacgactccagtttttccagtccaccatatagtccagatccaagatgttccagcaccagcccacacatagaaggggcaccactgccagctcaccaggataatagcccatcctaggccagaaaacttctgttgcgttggcaccacctttctctatactgactcttatttctcccgggagcatccccagcccacccttaattcacccacgatacccttttcctaaacaaaaataaaaaaaaac

SEQ ID NO: 645380 - DNA, 630 bp, Homo sapiens
  misc_feature (38)..(38): n is a, c, g, or t
  misc_feature (238)..(238): n is a, c, g, or t
  misc_feature (301)..(301): n is a, c, g, or t
  misc_feature (334)..(334): n is a, c, g, or t
  misc_feature (337)..(337): n is a, c, g, or t
  misc_feature (350)..(350): n is a, c, g, or t
  misc_feature (398)..(398): n is a, c, g, or t
  misc_feature (420)..(421): n is a, c, g, or t
  misc_feature (437)..(437): n is a, c, g, or t
  misc_feature (460)..(462): n is a, c, g, or t
  misc_feature (477)..(477): n is a, c, g, or t
  misc_feature (481)..(481): n is a, c, g, or t
  misc_feature (484)..(484): n is a, c, g, or t
  misc_feature (533)..(533): n is a, c, g, or t
  misc_feature (587)..(587): n is a, c, g, or t
aactttaagaactctggatgaatacatggtggcaacantccatgacacctgaaaacatcatttgtggagtggcgtagagttcagtgttcgcagtcgcatattacaaccatgtttcacacagccctgctcggtttgattttctccacgtggttgataattgtcttcagttgctgctaagtgattttgcaaatttcatttataatcctcgccctacaattacctaagtactgtttctgcnggttaacctgtatgctacgctcagtcatatacctttcaaagttactaatgcaactgccaaagngggacagtgtcaatatcattgtcttcattaganggncggctgccccccnctgtgagaacactgctgttcctaacagtagtttagagggatgtgaganttagtttgaccttaattcccgnngtgcatgcctcaaaanccaaatcccattctccttccttnnncggagcacttttggnggcnccngggctggtgtggggtggtggggggggcgctgggcttagggtcacaaccnggtgtgactgctctggtcttcgctggctgtgtgacttgggcaagcggcttgcgntctctgagcctctgagatccctgatggacgaggagaacaatga

SEQ ID NO: 645381 - DNA, 228 bp, Homo sapiens
cccaattaatttttgtatttttagtagagactgggtaacatgacaagatgccattctacaaaaaaatagaaaaattggccaggtagggtggtagtcccacgcctgtggtcccagcaactcaggaggctggccctgggaggactgcttgagcccaggatgtccagactgcagtgagccgtgattgcaccattgccctccagcctgggtgacagaaccagaaccggtttc

SEQ ID NO: 645382 - DNA, 130 bp, Homo sapiens
atccccgcgcgttgttgtttcagaatgtgcgatgtggcaggttatggttggtttcgatggggcccttcagggccacgcggttccggcggatggccatgatggcattgcgaatgtcctcttcaccggccat

SEQ ID NO: 645383 - DNA, 448 bp, Homo sapiens
cacaatcgaatattctcattagtcagatgatttactgctcttgtgcagatgacagaaaaagaacatggcgatagggtaatatttggtaaaaatttagcatcttcatttgacatgcatgatttggaccactttgacgaactgccaataaatggtgaaactcagaaaactataagcctagattatatgaagtttctgaatgaacatctccaggaggcttgcaacccagaactcaagcctgtggaaaaaacaaatggctcctttttgtggtgtgaaagttgaaaagtacctaaattcaactttgaaggacatgactgaagtgccaagagtagaagatctttgctgtactttatatgatatgcttgcttctattaacagtggtgatgaacttcaggatgaggtatagtcgacatgattcatcactaatattaatgttgaactatcctaatga

SEQ ID NO: 645384 - DNA, 138 bp, Homo sapiens
tcccctttagagaccctctcttaccctcgttctgggaccatctccttctctccatgcgctgcgttttgcacctgatgaggaccccatccgcggctctcagaggcttcctcctccctcgcgaggtcctccaggagtgca

SEQ ID NO: 645385 - DNA, 99 bp, Homo sapiens
tcttctgagattgtagcagattattccatcagtatgagcaggagtgaggtggaagtacatgagatgttaagtcaatatttaataaatggatgaccagtt

SEQ ID NO: 645386 - DNA, 348 bp, Homo sapiens
  misc_feature (342)..(342): n is a, c, g, or t
ccaccacttgagcagctagagggacctctttaaaacatccactggtcaggccgggcacgtggctcatgcctataaccccagcactttgggaggccgaggcgggtgcatcacctgatgtcaggagttcgagaccaccctggtcacatggtgaaaccccatctctactaaaaatccaaaagctagctgggcatagtggtgcatgcctattagtcccagctacttggggaggctgaggcagggagaatcgctttgaacctgggggaggtgggaggtttgcagttgagccgagatttgttgccacttgcgcttcccagcctggggttgacagagttgagattcttnatttca

SEQ ID NO: 645387 - DNA, 240 bp, Homo sapiens
tgcccatcccccttcgacaaacctgcccgttatccatcctgtttgaccacgctatgctacaagcccatcgcgcgcaccagctggccattgactcctaccaggagtttgttgattcctatttccctttggtcctgttgttttctttcctgcttgtctccctttccttcttctgcttctctgtctcttttccgtctccctccttcttgtttgtttcgcttctgttttcctttcttgtgctgc

SEQ ID NO: 645388 - DNA, 556 bp, Homo sapiens
ggggtgggcgggctgtcccagggctcaccgccattcatgaaggggtggagcctgcctgcctgcgggcctttataagagccactggctggctttccgggcaggcctcctggcagcacctgctgcagtgaacaggccggctgaggtgcacgggagcccgccggcctctctctgcccgtgtccgtccgtgaaattccagacagggctgcccgcgatggccctcccgaaaccttcagacggcaccctccccgcggaagtccagggacggggacagcgaaggagactcgtttggaccccgagccaaagcaaggccctacaagcctgctttgagcggaacccgtacccgggcatcaccaccagagaacggctggcccaggccatcggcattccggagcccagggtccagattctgtttcagaatgagaggtcatgccagctgaggcagcactggcattaatctcagtcctggcctgggagatgcggcccacaagaaggcaggtgaaagcggaccaccgtcaccggatcccagaccgccctgcccctccgagcctttgagtag

SEQ ID NO: 645389 - DNA, 804 bp, Homo sapiens
  misc_feature (59)..(59): n is a, c, g, or t
  misc_feature (203)..(203): n is a, c, g, or t
  misc_feature (774)..(774): n is a, c, g, or t
tgaagaagtgggatatcctgaagaagccccttatgatgccatggatgtgggagctacancccctgttgtaccccaggcgctaatagatcagttaaagcccggaggaagattgatattgcctgttggtcctgcacgcggaaaccaaatgttggagcattatgacaagctacaagatggcagcatcaaaatgaagccttctgatnggggtgatatacgtgcctttaacaaataaagaaaagcagtggtccagggatgaattgtaaaagaaacatcaccttgaccaatataaaattacagtggattgctcatctcagtcctcaaagctttttgaaaaccaacaccatcacagcttgttttggactttgttacactgttattttcaacatgaaaatgtgtgtttttttaaggtttctgattcttcaaagaggcgcaaagccaaatttgtaaaggaaagattcaaagtttaaatttgttgaatattactttaacattcccatattttactttgaaatattaaaaaaaagggttctgtaaaattaaaacttaatttgtgaattgatcttaaagagtgggttttctttttttaacccttaatcctgttctaaaattaataataaaatggctttatacattgaataaccccacatttacaagttaaaatccttggattttgaatatttttaaaaaccttccaaaaaaataaaaattaacttttttttttaaagcttttggacctggcgtgactaaaaataatagatgagaaaaacatataangatcctttggaacctcaacaactagcactt

SEQ ID NO: 645390 - DNA, 301 bp, Homo sapiens
ctcatctgctcccttccctgcgacactatgcaagacgttgtaccgcagctggtgatatgctgtcaggacaatgccactgaggagcgcagcatccttgctcttacttgcgcgaacgacctgctgactggcttccgacaaccgaacatgtctgctccatgcaacggagatagtgcactcctacctccctgtcatcctggacatcacttaaacgcgagaacatgagccgtcctgggcaggtgtgctctgctctcaacctctgcgagtctctccagaagcacctagcagatgaggctggtggtgt

SEQ ID NO: 645391 - DNA, 924 bp, Homo sapiens
cttaccataatcatagcgcaactaatacctaatatattactgttccacactatttacctatttatatgttccaaccattcagttactcgcgccaatttttattcctcttacgttaaatcccgataaggtccccctcaccgatactctgtccaaatttcatagtctctcccaaatctttccggataccacacttttatttcctattcatgcacctttccgagttacatattcttcgtcccgaataattcccgccccgggaaaaggtattctctgggcgcccatacacgtaaagttattatcgggggcaccttctccggctgaccgcaaaaggttatatatcgtgtcgcttatagtccgtagtgccatgggctgcgtataattaatggggggtgggaaaacgccccccctcttccctgggtgcccgacagccgtatcatggtctcctattcaatgacgaaacagatccgtgtgttgactctactaatgggtacaccgcacggctttttctatatctcatattgaggtgcgacactatcgcttggttgtcggtgtgatacaagcgctttatgttaccccgggaggggagcaccttgtgacgtcacaaggagcgcacgactgtctccttccccctacccacgtgtttctctcggcgcatgtaactccggaagtttcccttgctacagtctttctgatttgtgaagaatgcccactggaccttctctcccggtgtatcgtcgccgcggcccccccccagggcggggtgcctcccccaggcacttcctcgctaactgcgcactcgcagagttgacgccttctggtaccaggcggatcaccccccttcttcccgtcctcccgtttcccttgactcccttgtgcccccccggccccgatcaagggcggtccccccccaacccacaatacaac

SEQ ID NO: 645392 - DNA, 384 bp, Homo sapiens
ttggattttagcacttttatttaattgtgctccttaaatttggcaatgagcaagtaatttagcccccatatgttggccgccctaaacccaatttaatgcctaatattgattaactagtgtattccttatcaatctcacccctcatgcctgtaattctagtactttgggaggccaaggcaggaggattgcttgagccccaggagaccagactgggcaacatagcgagaccatttctacaaaaaaatcatttaaaaaaattagccagtcatagtggcacgcactcgtagtcccaattacccaggaggctgaggtgggaggaacgcttcagctcaggagatcaaggctgttacattctagcctgagcaacagagtgaaactgtctca

SEQ ID NO: 645393 - DNA, 110 bp, Homo sapiens
tcgactcttaggatcccctgatcttccgtgccctgacctcggtggtgttcattatccttcttgagtgttcacggaagatcagggcacgggaagatcatggcacgtaagat

SEQ ID NO: 645394 - DNA, 817 bp, Homo sapiens
attaatcccctggcccaacccgtcatctactctaccatctttgcaggcacactcatcacagcgctaagctcgcactgattgtttacctgagtaggcctagaaataaacatgctagcttgtatgccagttctaaccaaaaaaataaaccctcgttccagcaggaagctgccatcgaagtatttcctcacgcaagtaaccggctatccagtaatccttctaatagctatccgtcttcaacaatatactcgtccgggacaatgaaccataaccgaatactaccgaatcagttactcatcagttgaataatcatagatggctatagcaatataactaggaatagcccccttgcacttctggagtcccagaggttgacccaaggcacccctctgacatccggcctgcttcttctcacagtgacaaaatagtagcccccatctcaatcatataccagatctctccctcactaaacgtaagccttctccgtcactctctcaatcttgatccagtcatagcaggcagttgaggtggattagaccaaacccaggctacgcaagaagtcttagcatgactcctcaatgtacccgacataggatgaataatagcagttctaccgtacaggcctaacataagcattcttaatttaacctatttgtttatatcctaactaatacgtgtcctactaactcaattaactccagcaccaagacctatatatctcgcaactgaacaggtagatgataaaacccttattcatccacctcttctcctaggggcggcccgtaacggttttgccaaggctttgggaatccaaaaatgc

SEQ ID NO: 645395 - DNA, 1791 bp, Homo sapiens
gccgagctgagtaacattatggaaggcaatatcactctcgtggcactctcctgctatctcctgtcagacacgactcatctgggaatgcatcgcagcacttcgcagtctccagctgcgctctgcgagccacgtgacgtgaaatccattcgctggagtcatcgcaaacgaggcttagtaccgtagccgccatggaccgtatcgtcattgccagacgttgtcaaacgcctggcacgtgtataacaatcaaaatcagtgcgcggtagtcttgtcggaagtgcagtacactgtataatgggtctagtatgtcaatctcgggtgaggcatttcaatggcacaaacatgttgccacagtcaaaatgaatacgtgtagagtgctcgacgcatttgtaccccttatggagccattcagtgaggctgatgggcgcattactaagtatatccgaggaatacgaatttaatcttgcgtaactactatgacaagacatgggaattgcaatccgcgacatattttcagtacccttccccttggaaccttgtgggaacaacgtaaataaaggtacattcaagtcaacaaacagtcatgtgcaaaagcatccgtcatgcggagatttgaacacaaacagtattccattcacgtggatgtaggtctcccccatgactaaagatcatccataaaaacgtcaaaaggtaaatctacattaaacaattcccctaatgaaaacggtctcgagaggagccattgcagcaccttatgtctttgccagagctaggactattcgtggaagagaacgtgtggtcctccatccttccaggtggtaacgtgacccgcaaggtaacattataaggcgcctgcgacaatcggtatattccctttcaaacacttcttatttaggagcgtaacgaatacgtttgtacattacttctacaacaggacatctctggacacatgctccctcaaaggcatagttcattggttcacaataccctctcttagtttccctatggcaaactttactaatcgaagaggaaagcagaatcacaactcggaacctgatagtaagtgctgcgcaacacgcgatcttccgaaatcatagatcctaaccatatgtcggagttcctttagctagttggcatattgacagataattggggcatcacgggtttgtgaacattgacgcatattctagttagcgtacctacgtctatatatgtgacaccactaagtacggatagtacttggctgtgaccacaagagaagcagtcgctattagggacaagaaaacctaggcacagtatgagagtgtgcgcagaagacgccagaggtccacccatttaccaagtgatcgggttgcacacaacattgtcgaaaagacacgaggaattgaagtagtattccccatcttttgtgtccacttcggtatagtttcatcccgaaattcgtggaccatgtattaggccacaccataagagggagagtcgttttgctgtttacacttaaggtataggaaaatacaagtcacgttccaattggtagaaaaaatgaaaatcagcgaagtgacatactgttggtaattcaccacaaaaggaagagaggattaatattaattgcagggccacgttagtggccacatgcaaattgatatggcaatcgctatacgagagagtacatgtgtgattttaaacaggtgattgtgggaagaaaacaaacaggaaagttccctgattgacagtcatgatgacccagaaagtaggggataataacaatgccacaaccatatctcaagtacaaga

SEQ ID NO: 645396 - DNA, 743 bp, Homo sapiens
  misc_feature (7)..(7): n is a, c, g, or t
  misc_feature (85)..(85): n is a, c, g, or t
  misc_feature (87)..(87): n is a, c, g, or t
  misc_feature (93)..(93): n is a, c, g, or t
  misc_feature (103)..(104): n is a, c, g, or t
  misc_feature (178)..(178): n is a, c, g, or t
  misc_feature (180)..(180): n is a, c, g, or t
  misc_feature (185)..(185): n is a, c, g, or t
  misc_feature (306)..(306): n is a, c, g, or t
  misc_feature (335)..(335): n is a, c, g, or t
  misc_feature (340)..(340): n is a, c, g, or t
  misc_feature (345)..(346): n is a, c, g, or t
  misc_feature (348)..(348): n is a, c, g, or t
  misc_feature (414)..(414): n is a, c, g, or t
  misc_feature (432)..(432): n is a, c, g, or t
  misc_feature (487)..(487): n is a, c, g, or t
  misc_feature (535)..(535): n is a, c, g, or t
  misc_feature (547)..(547): n is a, c, g, or t
  misc_feature (550)..(550): n is a, c, g, or t
  misc_feature (574)..(574): n is a, c, g, or t
  misc_feature (576)..(576): n is a, c, g, or t
  misc_feature (641)..(641): n is a, c, g, or t
  misc_feature (674)..(674): n is a, c, g, or t
  misc_feature (707)..(707): n is a, c, g, or t
cccaggnctcaatctggcttcggaatcgctgcaggaagcggtcagggtgccagcggacctgctggaccctcaagtacctcctcanancccccngttcctccannggggggcccctggccaccagggctgcagcaatggcctctgggtcccctcccccagggcagggccagggcacaanancaaancgccagacgctgcccctccccgctcctctggggtgctcttccctgggcccggccctggttggcttgggttctcggtcccctaaagcctcctgcgcccccctggctcggctctaacgcagcncttcctccttggcccgggctcgctccctnaaganccgcnncncctcctcctgctgtagccagcactggctggagccctcaacacgtgggggtagacaggatccctctncttctcgctgctgctgcnggaacttctgggcatgttcccgggccaggtgatctgaccaggctgagaaggactnaggttcctgggtttcatgggaggtatcaccttcaaacctccccatganttcctgccactngtnctccagctcaccctggagcttctntnttcatttccgctccttgggaggcatcatcttcttcctcctcttcagcagattcccagggggggtncccagcccaaaatttggccaggggtctccccancctttattctttattcccatggcagagggacancggcttagcagctggaggtagatatcggtgtgggat

SEQ ID NO: 645397 - DNA, 157 bp, Homo sapiens
tgagcggcatgggggtacccaatctgaagtcatgtacatgaactaatctacaagcgtggttatggcaaaatcaataagaagcgaatgcttgacagataacgcttgactgctcgatctcttggtacatacggcatcatctgcatggactctgctgggg

SEQ ID NO: 645398 - DNA, 111 bp, Homo sapiens
tacttccacagggtgtgtcgatatggtgtccactggactctgttccactataggtaaacacttccttcatgaagttaattatgtggaactactacaggtacttctactttt

SEQ ID NO: 645399 - DNA, 430 bp, Homo sapiens
  misc_feature (317)..(317): n is a, c, g, or t
aatggtaagataactgtataaactatctgagctgtgaaaagaagtcactgtcggccaggtgcaatgacttaacgcctgtaatcccagcactttgtggggctgaggcaggcagatcaattgagctcaagagtttgagaccagcctggacaacatggcaaaacccagtctctaaaaaaaaaaaacaaaaaaccaggcatggtggtgtgcacctgtggtctcagctactcgcgatgctgaggggggagaattgatttagcttgggaggtcaaggctgcattgcacttcagtctgggcaacagagtgagactctgtctcanaaaaacagaaaaccagaccaaccttccccttcaaaactttagtaccttgggattatatgtagccttggaatatttatcctggtgttggccaacattgaaccggatagcttgcc

SEQ ID NO: 645400 - DNA, 137 bp, Homo sapiens
acgagtgcgacaatcgccgatcttcacgcgtgaagatcggcgacttcggctttcggcgtgtgcagtctggagactcggcgtgtacatgcacacgccgaacgaccagactgagcaaaccgtagtcgccgatcttcacg

SEQ ID NO: 645401 - DNA, 1613 bp, Homo sapiens
ggctgccggcagccgagtcgcacggtagttgaggtttgcgcgccgctgccggttagataagtcgatgtgcgccgcgggtgtgtggggcggccccgcaccgtgatgggtgtgctgcccggcagcgacgggggtgtgctgcagacgggacgaggcagccagagcaacgggggtgccacacacgccggtcgtagcgcggagtgggggggtataaataacacaagggggggtgggaacaccgcgccgaagaacaagccgctacgaggacggtgtgtgtgaagaatgtcgttcctccgccttagaagcgcgacactgttggggggggggaaaaaatatcccgctggggaaagatggtgggagacgatgtagggggggacgacatgtttcctcgccgcacataatccgctcgcaagacagaaggtgaagagaagtatggggggtgccaaaaaagagaagggggagagtgggggcgaagaggtcgctccgcagagagggggacccaacgagaggggggagaggggggggttgtaaagacgaggtggggtagcgcgaggccgtgaagtggcgccccgacgaggggagggtgtccacagccgaggacggggggggggcggcgccggtgtgagaaagagtgtgcgccgcgccgcggggtgggaccccacgcacgcaaggagtggtgccacgcggcctgggggagagaaaaaatattcgccgagagagggagatggaggcccgccgcgactgttttgttgccgcggcaagagacccagcgccctgctgtggaagaagagccacttccccccccgcggcgttgtagaggggcagaaaatagtcgctctcttctgtataaggaggggggagaggacccactactgtgtgggagaaaaatagctgggagaaagatgttgggggcccgcggggcacacgcggggtgtttacaaagcgccccgcggtaatgatccccgcgcgcccctctctggggggagagagctcaaggagggggggggcacgagatagcacccccctctagaggtctcacgcgggaggtttccaagaagatatagagcgctcggccacaacacgggggggagaagacccccactcttgtattcttgaagagaaatcccaccactctatagccgcgcggcgctcggtgtggcgcgcggcggggttaatatgtgagagatgtccccgcgctgatagctctccgcgagagggctcgagaggcccgcgagagagaatccgccttgagaacctgggagaaatgaaagggttgcacacggagagcccgcggagtatgcgcgcgcacacttgcgcgcgctccacccacacagagagcgcggaaaccccacactctctccacaaaaaaaaaaaaacaaaaaaaaatctgaataagttggttatattataccctcttatagccacccctaaatggtttccacgaagtggaggggggaaaacttttataaaattgctcacattcctggaaacttcacgtcacatttgaatgtggttttaaaattatgcctaaatccgtacctatatgtacgtattatctttggccatcttttttccctgccccccttttgaaaccataaagagtatagtattttcca

SEQ ID NO: 645402 - DNA, 190 bp, Homo sapiens
  misc_feature (145)..(145): n is a, c, g, or t
  misc_feature (172)..(172): n is a, c, g, or t
  misc_feature (180)..(180): n is a, c, g, or t
agagattactcgtgggcagggcttgtccctaggggggccctgtcattcaatggttaaccccgtggtcccagggtttactctgtggttcctgggggtttattccatggttcctggcggtttactccatgttcctgggggtttactntgtggcctggggggtttactccatggncctggggngtttactccg

SEQ ID NO: 645403 - DNA, 307 bp, Homo sapiens
agttagcgctcgcccctgagttagcagctcgcccctgagttcgtgaagtgcgtgtagatctccttggtgtctttgcgcttattcaggtcctcaaagttactgttgtttttgcttgctgatgttgtgaagaacctgctgattctctcctccttggagttgttcttcttctcttctgggctgctaatctgctcctcgggcgcgttgttctccacgtgatgactcctcgctccgctgctcctcctgaagcagctcgcccctcatttgtggatccatcttcagtagacctgctggcgtccataggcttgtt

SEQ ID NO: 645404 - DNA, 740 bp, Homo sapiens
cgaaaaaaaaaaaaaaaaaaaaaaaaaaaaaaaaaaaaaaaaaaaaaaaaaaaaaaaaaaaaaaaagggggaggagaagaaaaaaaaaaaaaaaaaaaggaggagacaagaaaataaagagacgaggaacgcagaggatggaagaggggaaaaggggggccccaaaaggggggccgcttattatataaaagagagaagaagggggcatgaggaataaaaagaggagaagaggggaaaagagcgggcacacagtgggagtaatatttgtggtgtgaaggagcagccctcattatattgtgtgggaggagagggagaaagataagggtgtggagaaaatatctccaatgacgaagagaatatattataagagggtctattgtagggagatatttatataaaaatatctaagaagcaggggatcaaaagggggggagagaaaacacaagaggcggaatgcggaggcgcgaggagaggcggaaggaagaaaaggtgagggaaaaaaagggaggagcgagaggaaaaatagagaggaaagaatatattttaaacacaagggtgggtgtagtgtttatgttggtattaaaaaaataataagatgagtgtaatgaatgatgagtatagtcgaagagagagatagtgagaatgtaggatagtaggtgtgagaagagagagaaaaaaaggaggcacgtagaacttgagtaaatatatatggtgaaataaatcgtgttagaaagagagag

SEQ ID NO: 645405 - DNA, 741 bp, Homo sapiens
gaggaccattcttgattctacataatcaacactattatcacacccaagaatattaacaggaatttagtaatattatttaatatatgattcacaactggagaaatccaattatgaatcatatattaaataatattactaaattcctgttaatattatttaatatatgattcataattggatttctccagttgtctgtagccgtctttttgtattttgtttttccagttcaggattaatttttcatttggttaaatctgtagttttttcaaatttgaaagagtacctcattcatgttttttgttttctataacactaatttaacttttcatgttgcagtaatttcagatttacagaatagttacaaagatagtataaatcactcttatgtacgctttacccagcttcctcaaatattaacatgttatagaactgtaccacagttaacaaaagtagacagttaatactggtatgttattactaactaatctgtagaccttactcaaatgctgtcacttttctcacaagtgtcctttttctggttcaagacagttgaggcctccacgttgcatttagttggtgtgtctcctttgtctcttgtatttaatcagtgtataaatttgtatttaatcatcttgacaatttagaagagtgccagtctgtaattatgtggaatgtcttttatttttgagtttgcctaatgtttcctcatgaataaattaagattattcatttttggcaaga

SEQ ID NO: 645406 - DNA, 895 bp, Homo sapiens
  misc_feature (291)..(291): n is a, c, g, or t
ggctttgcggtgtcgtcaagcgcgggttgggccggcgggcgggggctgaggggctgccatggggcgggggccggtcccgagctcctgggccctcttctcgccgctcctcgcagggcctgtgcactactgggagtcgggccggtcccagcgcgggcgctgcacaagtcacggcgagctcttttgggggccgaggcctggggcaaccctgtgcggctttcggggacctcaattccgaaagcagaggatcttcttcgtgctgcgggaaaagaaatgactttaatcgtctttttnggagaccagaatgcaccctatttgaaaaccccaaaagtaaggtatctttcaaggaatcacagtgctggatcacaagtgtagtccctggggattatgatggagattctcaaatggatgtccttctgacatatcttcccaaaatttatggccaagagtgattaggagctgtatcttctggggacaaaatcaaacattagatcctaacaagtatgaccatactcaataggactttcaaggatgagccactaatttatggactttcaatggtgatctaattcctgaatatttcggtatcacaaattgatccaaccagcacagatactataggcggaatttatcagtgtcttcacagcttgcccacttacaagtaaaatgcgaattcacattctcatgcattttgatcttggtgagattaacagcgattattcctgccgaattgatggcgcatagtccttccgtggactgggagatggcgacttctggcgccattggaacccaaatgtgtgtgggcgcttgggtcgttcggcgccccgcctttgcggggaaagcacgcgccacggggggagggccaaaaagacggcggggccgccaccggaggcggacc

SEQ ID NO: 645407 - DNA, 91 bp, Homo sapiens
tattattggagatgatttattcggagccaaacattagtgaccctgacctgttgacacagcctcggggttcccaggaactcggtcagaggtg

SEQ ID NO: 645408 - DNA, 862 bp, Homo sapiens
ctttgtgtgttggggggggatcgtgttgtctactcggccccggactcatcatgcatgcgactgtcagcgttccgccttttctgttagcgcctggcattcgccggacgcctttattgtacccccctgtctcttcgggccttttccctcttttgctctcgtccttccatggggtccttcccgccgtactgttcttcatattggccttctacccagccgtgaccgataccagatggccgatgtacccgggagcacttcccaaggccccccacacaccaccggtccgaaaaggccttcgataacgggataatcctatttagttacctcagaaggtttttttcttcgccggatttttctgagccgttttacccctcccgcctatgcccctacccccccattaggagggcactggccccccacaggcatcaccccgcttaatcccctagaagtcccactcctgaacagcatccgtattactcgcatcacggagtatccatcaccctgaggctcaccatagtctaatagaaaaccaccgagaacccaataattcagcacctgcttattacacattttactgggtctctattttaccctcctaccagcctcacgagtacttcgagtctcccttcaccactttccgacggcatttacggctcaacacttttttgtaagccacccaggcttccaccggagcttcacgtcacttaattggctcaactttcctcactatctgcttcatccccccactaatatttcactttacatcccaacatccctttggcttcgaagcccccgccctgatactggccttttgtagatgtggtctgactatttctgtatgtctccctctattgatgagggtcct

SEQ ID NO: 645409 - DNA, 447 bp, Homo sapiens
  misc_feature (24)..(24): n is a, c, g, or t
  misc_feature (41)..(41): n is a, c, g, or t
  misc_feature (72)..(72): n is a, c, g, or t
  misc_feature (76)..(76): n is a, c, g, or t
  misc_feature (89)..(89): n is a, c, g, or t
  misc_feature (186)..(186): n is a, c, g, or t
  misc_feature (194)..(194): n is a, c, g, or t
  misc_feature (230)..(230): n is a, c, g, or t
  misc_feature (235)..(235): n is a, c, g, or t
  misc_feature (245)..(245): n is a, c, g, or t
  misc_feature (247)..(248): n is a, c, g, or t
  misc_feature (277)..(277): n is a, c, g, or t
  misc_feature (290)..(290): n is a, c, g, or t
  misc_feature (293)..(293): n is a, c, g, or t
  misc_feature (298)..(298): n is a, c, g, or t
  misc_feature (307)..(309): n is a, c, g, or t
  misc_feature (334)..(334): n is a, c, g, or t
  misc_feature (342)..(342): n is a, c, g, or t
  misc_feature (348)..(348): n is a, c, g, or t
  misc_feature (359)..(359): n is a, c, g, or t
  misc_feature (384)..(384): n is a, c, g, or t
  misc_feature (427)..(427): n is a, c, g, or t
ggttcccggcacgtgtctcggcangtggcagcgcgcctggncctgggcttggaggcgccggcgccctggatncgcnggccgtggtcgcngagtcggtgtcgtccttgaccatcgccgacgcgttcattgcagaccgaggcgatgagctcagctccgaccccgcctgctgacccgcgcttcccagtnggttcatntgctccttccttgtatttgtcagtcgccaattaaantaaancttgcgatancnnttatgcgctgccattctttgcatattcantacgtgggtgatntcnttcangtagattannnttcttaaagtggtagggagccgatnccaatccngtcgcngttcaaggcgntgtgtgcctgccctcctgttggtanacctagtgtgtggtgtgtgtgtgtagtagtgaaggggtggtgnccaaagtgcccgtgtcagtc

SEQ ID NO: 645410 - DNA, 212 bp, Homo sapiens
agtgcttacttcgacggtgtctggttgggcaggatcagaagtcgggctggggaagggagtggtaagggaggaacaggcctccaggtgtcattcgagtgagtggcccccacagcaccagatttcaccaacacatggtccctggcaccgcgaggaacaagctgaagtgctcttgatcctcaagtggagctccggagaatgtttccatttaattc

SEQ ID NO: 645411 - DNA, 940 bp, Homo sapiens
  misc_feature (703)..(704): n is a, c, g, or t
  misc_feature (769)..(769): n is a, c, g, or t
  misc_feature (771)..(771): n is a, c, g, or t
  misc_feature (800)..(800): n is a, c, g, or t
  misc_feature (802)..(802): n is a, c, g, or t
  misc_feature (809)..(809): n is a, c, g, or t
  misc_feature (815)..(815): n is a, c, g, or t
  misc_feature (838)..(838): n is a, c, g, or t
  misc_feature (846)..(846): n is a, c, g, or t
  misc_feature (883)..(884): n is a, c, g, or t
agcggctgcttcagcccaggcaaggctggggcctgggcagcctccaggtgcagtgccctcccgtgggccgcacccttgccactgccccagggcatgtctctactcaccaattatgaagggcttcggcatcagatagagaggctggtgcgggaaaatgaggaactgaagaagttggtgcggctcattcgggagaatcacgagctcaagtcagcgatcaagactcaggcaggcgggctcggcatcagcgggttcacgagtgggcttggtgaggcaacagcaggccttccctcacgccagaacaatggtgtcttcctgcccccgtccccagcagtggcaaacgaacgagtcctcgaagaagtggggatcatggccttggcacccctggccgagatgctaaccagcttgcagcccagcgccacaccgggctcactcatgagccccctgacaggcaccctcagcacgctgctgtctggcccagcacccacgtcacagagcagccccctcaccagcttcctgaccagtcccattgcgggacccctaacaggcacactggccagttccctgggcctgccctccactggcaccctgactcccagcagcctcgtggcaggccctgtggccatgtcccagagcagccccctgatagcccctgtgatgggcacggtggctgtctctctgagcagcccctcctcagctccactgnnatcccacaggggtctctcagaacctgctggccaacccatgagcaactggtcctgccagaggcccnangctgcggctggctgagccactccgcggangncccactnggcccnagtcccagcttgcgtggtaccantggcacancaaagtcccaatctccactgagccccccagtcgaccnnggaccaaagctcttcaaatggcggtttgcaggaaaaccctcaaaaattccacccta

SEQ ID NO: 645412 - DNA, 143 bp, Homo sapiens
cgtgtagtcccatgctactctgtgaggctgatggtcggagaattgcttgggccctggaattcaaggctacgagtgagccgtgatcaccatgtgcactctacgcctgggctacatacgaaggaccctgtctcacacaaaaaaca

SEQ ID NO: 645413 - DNA, 666 bp, Homo sapiens
taaaacccctttttttttaaaaatctattccgccctttggttttccccccaccccggggagctaaaatttcaggggtttccaacctcttttggctaaggtgcgtcgcttttgtgggctcgccttcttagcagcccgccatggacgttctttttaacgactgcttgtggcttctacccttttttggcttcttcctttagcaccccttggatagctttgtttctcgtggagctttttctaacttttcggagttcttctgaatctccctcgtggggccattattttctacgtaagagagtgcactcagtaatgtcgcccctcgtgatatttgtgcacttgcactccggggaggatctcatttcttcttctgtgtgaatatttctctcccgagtgtgtctcccctttgtgggtggctcctctttgtgttaggaggaaacgagctccgattttttttcgtgcgcggaggtatcccttctgttggagagagcgaaaaagccgcgacctcgtctctttcccctattaagaaacatgtgggaaacaactctcccggtcggctccgggcgttaagcgcccccccgtgtgttccgggggataacattattgtttcccccgtataaacacttgcgtcaggttcagccctttcatgggcgagacacgcgtctccatat

SEQ ID NO: 645414 - DNA, 732 bp, Homo sapiens
  misc_feature (495)..(496): n is a, c, g, or t
  misc_feature (561)..(561): n is a, c, g, or t
  misc_feature (563)..(563): n is a, c, g, or t
  misc_feature (592)..(592): n is a, c, g, or t
  misc_feature (594)..(594): n is a, c, g, or t
  misc_feature (601)..(601): n is a, c, g, or t
  misc_feature (607)..(607): n is a, c, g, or t
  misc_feature (630)..(630): n is a, c, g, or t
  misc_feature (638)..(638): n is a, c, g, or t
  misc_feature (675)..(676): n is a, c, g, or t
agcggctgcttcagcccaggcaaggctggggcctgggcagcctccaggtgcagtgccctcccgtgggccgcacccttgccactgccccagggcatgtctctactcaccaattatgaagggcttcggcaaacgaacgagtcctcgaagaagtggggatcatggccttggcacccctggccgagatgctaaccagcttgcagcccagcgccacaccgggctcactcatgagccccctgacaggcaccctcagcacgctgctgtctggcccagcacccacgtcacagagcagccccctcaccagcttcctgaccagtcccattgcgggacccctaacaggcacactggccagttccctgggcctgccctccactggcaccctgactcccagcagcctcgtggcaggccctgtggccatgtcccagagcagccccctgatagcccctgtgatgggcacggtggctgtctctctgagcagcccctcctcagctccactgnnatcccacaggggtctctcagaacctgctggccaacccatgagcaactggtcctgccagaggcccnangctgcggctggctgagccactccgcggangncccactnggcccnagtcccagcttgcgtggtaccantggcacancaaagtcccaatctccactgagccccccagtcgaccnnggaccaaagctcttcaaatggcggtttgcaggaaaaccctcaaaaattccacccta

SEQ ID NO: 645415 - DNA, 286 bp, Homo sapiens
  misc_feature (11)..(11): n is a, c, g, or t
  misc_feature (18)..(18): n is a, c, g, or t
  misc_feature (25)..(25): n is a, c, g, or t
  misc_feature (29)..(29): n is a, c, g, or t
  misc_feature (67)..(67): n is a, c, g, or t
  misc_feature (75)..(75): n is a, c, g, or t
  misc_feature (77)..(77): n is a, c, g, or t
  misc_feature (95)..(95): n is a, c, g, or t
  misc_feature (100)..(102): n is a, c, g, or t
  misc_feature (105)..(107): n is a, c, g, or t
  misc_feature (110)..(110): n is a, c, g, or t
  misc_feature (239)..(239): n is a, c, g, or t
  misc_feature (244)..(246): n is a, c, g, or t
agtgtttgcanccatatntgtcatntaanaaaatccctaaccctggggaccttgtgaaatacccagnaaccaggnanaccatctggtccagtggnttttnnncannnctncttagcacctggaattccctggtcagggagatggagtcagtggggcattgcagcttggaatctattttatgtcaccagttggtcctcatcaaataaaatttccttaggagtgcagagggctcattgggnaaatnnnaataataaaaataaataaaacttcctaaaagaaaagattg

SEQ ID NO: 645416 - DNA, 132 bp, Homo sapiens
cactgatctcatatctctctgtctgattgacttgtgcactttgctagcccatagcaatcgcatttgaaattcagtcttacagatttcattcatttcttcatctgcgttgaaaacctgccaggatcctctctg

SEQ ID NO: 645417 - DNA, 226 bp, Homo sapiens
  misc_feature (2)..(2): n is a, c, g, or t
  misc_feature (46)..(46): n is a, c, g, or t
  misc_feature (132)..(132): n is a, c, g, or t
antctagaggtcccctgtacgctcagccaagcgatgcaaatccaancccaaccaccctagttcctccggtagcttttcagatgctgaccttgcggatggcgtttcaggtggagaaggaaaaggaggcagtgntggtggaggcagccacaggaaagaaggggaagagccgacgccccaggctgatccccgggattgtggggctgtcgtgtcccgtgctagagcgtat

SEQ ID NO: 645418 - DNA, 134 bp, Homo sapiens
ttctcatggtgcaatacaatgagcatctgtagcgtacacgaaaagacgctagtgtggtctcctcatacctctcgggcattcttagttgccctttgagctactcctcctctgatagaccttaagtgctatgcccg

SEQ ID NO: 645419 - DNA, 479 bp, Homo sapiens
gtctgcctattggtcagctagctgcgattttcagtacaattcgcactgtggccaatgtttcgcacccattttgatgacatcatggtcgctgtactacatgttcagttcatacaccttcaagtaccgcacctttacgccagagtgcgcgaatggcacctcaaagttcatggaaatgaatggtcgatcccatttcttcttgtcgttggtacgcagaaactcaatctctgcgctgatctgcaataccttcatgcctgccatgcgcttgatcttccacatgattggcattctcgctgatcttgtacttgatcttccccttcatgcagatcacctgcaccccgcttgtgttcagtgtggtctgggatcctcatctcgatcttctgagccagcatctgagagtttaaagttgtacttgatgaccacctttacctccattttgttgcttaccacttttcgcactagcgggatcagccggaatggaa

SEQ ID NO: 645420 - DNA, 484 bp, Homo sapiens
  misc_feature (270)..(270): n is a, c, g, or t
  misc_feature (378)..(378): n is a, c, g, or t
  misc_feature (392)..(392): n is a, c, g, or t
  misc_feature (477)..(477): n is a, c, g, or t
  misc_feature (482)..(482): n is a, c, g, or t
ggaaattagcagctttgacaaaaaaaagtactgtttcatctgtcttccctatgagaaggctctcactttgtcacccaggctggagtgttgtggtgcgatctcagctcattgcaacctctgcctcctgggttcaaacaattctcctgcctcagcctcccaagtcgctgagattacacacacccgccacatagcccaggaagtcagggaccccgaactgagggacgggctggagccatggcaggggaacataaattgtgaagatttcatttnaatatggacatttattagttcccaaataatgcttttataaatttcttatgcctgtctttaatctcttaatcctggttatcttcataaagctgaggggtatgccctcanctccaggaccactngtggataattggtggttaaactggtacaaatttgatttgtggaaacatggtggtggtttgaaccaattaagaaatccaggtggcncttgngt

SEQ ID NO: 645421 - DNA, 310 bp, Homo sapiens
agccaagaagacaccccaccactgtcccagtagcatcccccgcaccagagcgaagtcgatggacaaaaaacgcgcacacacaagtgagccatggagtagggatggggacggtaaggacgccaggcggcaggggacctctgtaatggtcaagaaagtgatgtgaagcccagccaccggtcaccccgggtattcctccccctattggataaagaggcagcgcggggcacaaaggccttaatcacaggcagactggcacacggtagcaacctcgggcagagcaaggagaataaattactgtttaaagccgcac

SEQ ID NO: 645422 - DNA, 370 bp, Homo sapiens
  misc_feature (7)..(7): n is a, c, g, or t
  misc_feature (97)..(98): n is a, c, g, or t
  misc_feature (131)..(131): n is a, c, g, or t
  misc_feature (152)..(152): n is a, c, g, or t
  misc_feature (172)..(172): n is a, c, g, or t
  misc_feature (174)..(174): n is a, c, g, or t
  misc_feature (177)..(177): n is a, c, g, or t
  misc_feature (196)..(196): n is a, c, g, or t
  misc_feature (244)..(244): n is a, c, g, or t
  misc_feature (349)..(349): n is a, c, g, or t
gaaccantcagggtcctgtgcgacagctcacctcagtggcaatggatccaggctcccggacgtccctagctcctgcgcttttgccctgctctgcctnncccccgcttcaagcgcgctggtgccgtccaaancgttccgttactccaggactnttgcaccaccgctactcctncnagnccactcccgtcgcaccagntgcgacattgcaacacctacccaggcagctttgaagaaaccctatatnccaaagcaccagaaggtattcattcctgcatgactcccagacctcctctctgctcctcagactctattccgccaccctccaacatggaggaacgcaacagaaatncaatctagagctgctccgcat

SEQ ID NO: 645423 - DNA, 4240 bp, Homo sapiens
gatcgactgttctactaaacaacgggaaaatgtgtatctggcagcctgtggagaaacactaaacattgatttttctttgccttttacggacttgttccagctacatgtaataccaagttctctttaagaggagaagatgttgatcttcatttgtttctaccagactgccaccctagtaaatattctttatttatgctggtaaaaaattgccatccaaataagatgattcatgatactggtattcctgctgagtgtcaaagtggccagaaaacagttaaaccaaaatggcgcaacgttactcaggaaaagtctggttgggttgaatgctggactgtcccaagtgtcatgcttacaattgattatacatggcatccaatttatccacaaaaagcagatgaacagctgaaacaatcattatcagaaatggaagagacaatgctatctgtattaaggccatcccagaagacatcagacagagttgtttcttctccctctacttcttcacgcccacctattgatccctcagaacttccacctgataaacttcatgtagaaatggaactttctccagattctcagataactctctatggacctctactaaatgcctttttgtgtataaaggaaaactactttggggaagatgacatgtatatggattttgaagaggttatctcaagtcctgttttgtcactgtcaacatcatccagctctgggtggactgctgttggaatggaaaatgacaaaaaggaaaatgaaggttcagccaagtcaattcatccacttgccttgcgtccttgggatattactgtacttgttaatttgtacaaagttcatgggcgtcttcctgttcatggaactactgatggtcctgaatgccctacagctttcttggaaagactatgttttgaaatgaaaaaaggatttagggagaccatgctgcaacttatcctgtcacccctgaatgtgtttgtcagtgataactatcagcagcgaccccctgtggatgaagtactcagggaaggtcacatcaatttgtcaggtctccagctgagagcacacgctatgttctcagcagaaggtcttcctttgggaagcgattccttagaatacgcatggttaattgatgtgcaggctggaagtcttacagctaaggtcacagcaccacaggtatggttttcagagtactatctcctgacttattttctttttcctttctctacccaccttctcaagaataacttgtatgcctgtttgaatgttcattgcatttccactgatggcattctgatgggagtcattcttgccattcagaattttagttataggtgaatcagagacaagtttgacttttctgagccacatataatttgttgggtgtaatgtgtgtagacctatataatatttcaaagaatttgagactttctttgggaaaaattcaggatgagtacttttctagaagtcattaatatattattaaaattatattacttggccctccattgttggaaaaatcttatttttctactatatggagtaattttctaagaactttgttttcttacatatgtttaaagtaggatttgaaagtagcccttatgatactaaggattaggtaataaggttctttgcttgtcatgtcccaaagcaagattacatcatttgtacctgctgttagtgatgtggataatagtttcaaaaaacaaaagtgaatttactggtatgtaagtctggtctagaattctagatgtgatccttttggataaattgtcccccaccacccctttcacttaatccttagaaggcacaaaagccttaatgtattatttgtttctaattggccactgaagtttagttgaattgccgtattattgtaacatttcacctgagtcatatatttattataatatgaatgctcatcttgatatttcaaaagactggaatttgataggaatgttacatactcaattttgataaaaagttttagaatgggtataaaacatataatttagaggtaggtagtagcaacaagaaagtaataaagaacctagatgccctttatacctggaagaaatcgtcagagggtagcaaaaattaatattctagaaatggtgagaaaatgaatagaattgaaaagggatattttggagttgaacgtcatctcaatataatattagaatgtataatgatatttataaaaatatgtgaaaagaaatgcataatggaatgtataaaaatggatgaaaagcaatagtcattgctcactggtcttgtaactgtcctctccttattatctcccatttcccatccctaagtatactagtaaaaactgaagcatattccaaagcagcttgttccctacgaagggaataaagccatgctgatcctgcaagactgggtacaattcctttattccaaggcctgctagaatcttacatgtttataaattgcctttataaggtaaaacatttctctttctcctgcataaaatcttggcatcactgtttgctgcacagttcatgactctgtaggcacttttatgtttattccattctctgtatgttttaaaagtaaaatttatattttccaagagtttaaattatgtacttatttgaggggataatgtcatgtgtatctatccctcaatgtttttaacagctctaatcaattagggtgttttttttttttaaactgaagatttgaagaattatgatatatacttacttaagcttctatttacataaacaaaagtgctttaatcttcaaaatacctggttttaaaaaaactgtagctcaatgtgatatttagatactttttcacataaaagtttggtttatgattggagaattttaggtgcttttctatgtggagatttcagttagctatataagagggaagatatataaccttgaataaaaggatttgcgttaaaagttgctgaagtgaaatttttcagttgcaattagttttcattttgacagtgcattttgtcattcataaaggaaaagtaacataagcatgtaaatgatattaaaggtagaaaaaaatcattggctaacaagttgcttatttagcagaagttttaagacagtgtttgggttctttcaagctacgttaacattcttcagaagcttttgaactctaaacccttgtttagaatgctaacagtgttgtcaacttgtcactgattatctgtagctggcatgcctcttggagtggggacagacatttgtttttcatgtggtatgtcgggagtatgaactggaaagaccgaaatcagttataatatgtcagcatggaattgatcgtcggttctgtgaatccaaggtatattaacaaatatgttagcaatattataaacatttatgaattttaaaaaatggaatattgagatatcagcttcaagtcaaatacacatagccatgcagcaaactacagttttttcagttaataaaattattttttaaattcttacccattttagttttaagtatctaaaatatgagataattattaaaacatacaaattaaaaaagaaacagaattataaaaattatattttgcttacatttttactgttaacattcatgtcatattgcattattatacttgttgggatatggctatatatttatgtagaagatttagaaattgaagcaaagagaaggttgaattcttcacatgacatggtttgcagaccactctggacatgccgtttctcccataatgtaatagcaaggttggtcatttgccaggtttcctgactccacatgttatgctcttttcacaacattgtgccaccttcattaagagtcattacaatatcttcacaagggttgcaaaaagtagatggtaatccctaaaaccatgtgcagtggcaatgaaatgccatagtattattgtgcaataaatactctcccttatgaatttggggagggaggcattttcttcccctgattttggaagcatggttatttcagaaaatctggaaaacatggctgtttcaaaagagaaaaataacttaccctggttctacaacacagtggttaacaacttagtttttctttctagttcgttcctatatgtctttccttttttgttcttctgctatacaaattatatttgtttgctgttatattactgtgaattgaaattagttcatcctacttttatgtccaaaaaaaatctgtaacgcatccttatatattgacaataaaggaaacagctatacttggtgat

SEQ ID NO: 645424 - DNA, 1901 bp, Homo sapiens
  misc_feature (1375)..(1375): n is a, c, g, or t
  misc_feature (1380)..(1380): n is a, c, g, or t
  misc_feature (1385)..(1385): n is a, c, g, or t
  misc_feature (1434)..(1434): n is a, c, g, or t
  misc_feature (1511)..(1511): n is a, c, g, or t
  misc_feature (1703)..(1703): n is a, c, g, or t
  misc_feature (1705)..(1706): n is a, c, g, or t
  misc_feature (1801)..(1801): n is a, c, g, or t
gatcgactgttctactaaacaacgggaaaatgtgtatctggcagcctgtggagaaacactaaacattgatttttctttgccttttacggacttgttccagctacatgtaataccaagttctctttaagaggagaagatgttgatcttcatttgtttctaccagactgccaccctagtaaatattctttatttatgctggtaaaaaattgccatccaaataagatgattcatgatactggtattcctgctgagtgtcaaagtggccagaaaacagttaaaccaaaatggcgcaacgttactcaggaaaagtctggttgggttgaatgctggactgtcccaagtgtcatgcttacaattgattatacatggcatccaatttatccacaaaaagcagatgaacagctgaaacaatcattatcagaaatggaagagacaatgctatctgtattaaggccatcccagaagacatcagacagagttgtttcttctccctctacttcttcacgcccacctattgatccctcagaacttccacctgataaacttcatgtagaaatggaactttctccagattctcagataactctctatggacctctactaaatgcctttttgtgtataaaggaaaactactttggggaagatgacatgtatatggattttgaagaggttatctcaagtcctgttttgtcactgtcaacatcatccagctctgggtggactgctgttggaatggaaaatgacaaaaaggaaaatgaaggttcagccaagtcaattcatccacttgccttgcgtccttgggatattactgtacttgttaatttgtacaaagttcatgggcgtcttcctgttcatggaactactgatggtcctgaatgccctacagctttcttggaaagactatgttttgaaatgaaaaaaggatttagggagaccatgctgcaacttatcctgtcacccctgaatgtgtttgtcagtgataactatcagcagcgaccccctgtggatgaagtactcagggaaggtcacatcaatttgtcaggtctccagctgagagcacacgctatgttctcagcagaaggtcttcctttgggaagcgattccttagaatacgcatggttaattgatgtgcaggctggaagtcttacagctaaggtcacagcaccacagctggcatgcctcttggagtggggacagacatttgtttttcatgtggtatgtcgggagtatgaactggaaagaccgaaatcagttataatatgtcagcatggaattgatcgtcggttctgtgaatccaagttgagttgtattcctgggccttgtccaacttcagatgatttgaaatatactatgattcgtttagcagtagatgganccganatttncattgttgagcatggttgtgctacaaatataaagatgggtgcaattcgngttgcaaactgtaatctccacaatcaatcggttggggaaggaatcagtgctgcaattcaggattttcaagtgagacngtacattgagcaattaaataattgcagaattggacttcagcctgcagtgctacggagggcctattggcttgaagctgggtcagccaatttaggacttattactgttgatattgctttagctgctgaccatcattctaaacatgaggcacaaagacatttcttagaaactcatgatgccagaactaagaggtngnngtttttatggccagatgatatcctgaagaataagaggtgtagaaacaaatgtggttgtctcggtggctgcagattctttggtggcacagtaactngcctagatttcttcaaacttgaagacttgacaccttccagtagctctgcattttcaagcacaagtgcagagtctgatatgtatatggacacgaatgttca

SEQ ID NO: 645425 - DNA, 205 bp, Homo sapiens
ggagatgctggtgcaagagcagctgctcgccatcctgcccgaggggctcgcgccggcggatccgcccgcacggatgtcattcactggctgagcggtggactgcgggcggccagggcggcgctctgtgcggactggggccatgatcgggcccgtggggctgtagtcctgggaccccaccccgtgttaatgaaaaatgagttttggc

SEQ ID NO: 645426 - DNA, 920 bp, Homo sapiens
gtcggtctcttgcttccatcagtgttggacggaacgagatccggtggactctcttccagcctccgaccgcctccgatatcctctcgggttgtaacctccgggaccatcttctcggtcatctcctgcttctgggagcctgattcagaccgtctttggtggttagttccttcttgccatctcaaccatgagctcccagattcgtcagaattattccaccgacgtggaggagagcgattcaagagacctggtcaaattttgtgacctgtcagtcctcctacacctacggtctgctggtgggcttcgtgatttctgaccgtgatgatgtggcttcttggaagggccggtgttggcatttcttccgcagaattggacgatgagagaagcgcagatggtgtaccaagcggtctcctgaagatgcaaaagcagcgtgaaggccgcgctttcttccaggacatcaggaggccatgctgaagagtgatttgggtttaaaaaccccagaagccatgtaaaggttctcatgtccctggttcacaaatgctagacaggcttccttgttggatctacatcgccctggtgttctggcgtgggatcccgcatctactgtggcttacctggtgactcactatcatagatgaagagtgagttgccacggagagggtgcactgactagctcacgggtgttgaccggagctgggtggcgagaccttcaagggcaggtcaaagaggaaaaaggtcggggcagggagtctggggcctggaagaatagggtgagcaaggtctccgcatatgggttctaactcaaaactggcatgaaagttggcccacgaaaaaacaaatgtgcgcaccagaatacccgcggggcacagaggattatcgaggatgttaaccagcgacacgtggtaagacccacagaggacaac

SEQ ID NO: 645427 - DNA, 1968 bp, Homo sapiens
  misc_feature (1375)..(1375): n is a, c, g, or t
  misc_feature (1380)..(1380): n is a, c, g, or t
  misc_feature (1385)..(1385): n is a, c, g, or t
  misc_feature (1434)..(1434): n is a, c, g, or t
  misc_feature (1511)..(1511): n is a, c, g, or t
  misc_feature (1703)..(1703): n is a, c, g, or t
  misc_feature (1705)..(1706): n is a, c, g, or t
gatcgactgttctactaaacaacgggaaaatgtgtatctggcagcctgtggagaaacactaaacattgatttttctttgccttttacggacttgttccagctacatgtaataccaagttctctttaagaggagaagatgttgatcttcatttgtttctaccagactgccaccctagtaaatattctttatttatgctggtaaaaaattgccatccaaataagatgattcatgatactggtattcctgctgagtgtcaaagtggccagaaaacagttaaaccaaaatggcgcaacgttactcaggaaaagtctggttgggttgaatgctggactgtcccaagtgtcatgcttacaattgattatacatggcatccaatttatccacaaaaagcagatgaacagctgaaacaatcattatcagaaatggaagagacaatgctatctgtattaaggccatcccagaagacatcagacagagttgtttcttctccctctacttcttcacgcccacctattgatccctcagaacttccacctgataaacttcatgtagaaatggaactttctccagattctcagataactctctatggacctctactaaatgcctttttgtgtataaaggaaaactactttggggaagatgacatgtatatggattttgaagaggttatctcaagtcctgttttgtcactgtcaacatcatccagctctgggtggactgctgttggaatggaaaatgacaaaaaggaaaatgaaggttcagccaagtcaattcatccacttgccttgcgtccttgggatattactgtacttgttaatttgtacaaagttcatgggcgtcttcctgttcatggaactactgatggtcctgaatgccctacagctttcttggaaagactatgttttgaaatgaaaaaaggatttagggagaccatgctgcaacttatcctgtcacccctgaatgtgtttgtcagtgataactatcagcagcgaccccctgtggatgaagtactcagggaaggtcacatcaatttgtcaggtctccagctgagagcacacgctatgttctcagcagaaggtcttcctttgggaagcgattccttagaatacgcatggttaattgatgtgcaggctggaagtcttacagctaaggtcacagcaccacagctggcatgcctcttggagtggggacagacatttgtttttcatgtggtatgtcgggagtatgaactggaaagaccgaaatcagttataatatgtcagcatggaattgatcgtcggttctgtgaatccaagttgagttgtattcctgggccttgtccaacttcagatgatttgaaatatactatgattcgtttagcagtagatgganccganatttncattgttgagcatggttgtgctacaaatataaagatgggtgcaattcgngttgcaaactgtaatctccacaatcaatcggttggggaaggaatcagtgctgcaattcaggattttcaagtgagacngtacattgagcaattaaataattgcagaattggacttcagcctgcagtgctacggagggcctattggcttgaagctgggtcagccaatttaggacttattactgttgatattgctttagctgctgaccatcattctaaacatgaggcacaaagacatttcttagaaactcatgatgccagaactaagaggtngnngtttttatggccagatgatatcctgaagaataagaggtgtagaaaccacaacctcttagttctggcatcatgagtttctaagaaatgtctttgtgcctcatgtttagaatgatggtcagcagctaaagcaatatcaacagtaataagtcctaaattggctgacccagcttcaagccaataggccctccgtagcactgcaggctgaagtccaattctgcaattatttaattgctcaatgtactgtctcacttgaaaatcctga

SEQ ID NO: 645428 - DNA, 187 bp, Homo sapiens
aggtacgccatgtcgcccaggctggtcttgaactccaggtctcaaagtgatctgcccgcctcggcctcccaaaatgctgggattacaggtgtgagccactgtgtccggccgcagcttgtcatttttagtctcagtgtctaagactaagattctgtaacacaaaagccttcttcctggttcgtcatct

SEQ ID NO: 645429 - DNA, 497 bp, Homo sapiens
  misc_feature (19)..(19): n is a, c, g, or t
  misc_feature (61)..(61): n is a, c, g, or t
  misc_feature (132)..(132): n is a, c, g, or t
  misc_feature (141)..(141): n is a, c, g, or t
  misc_feature (147)..(147): n is a, c, g, or t
  misc_feature (174)..(174): n is a, c, g, or t
  misc_feature (224)..(224): n is a, c, g, or t
  misc_feature (264)..(264): n is a, c, g, or t
  misc_feature (351)..(351): n is a, c, g, or t
  misc_feature (496)..(496): n is a, c, g, or t
gccctgggcctccggctcntcctcgtcgtcttcgttcatctcgccctcttcctcggccgtngcgtcctggtactgctggtactcgggcaccaggtcgttcatgttgctctcggcctcggtggtctccatctngtccttgcnctcgcncgtgttccagtgccggggggccttgcnccgggtcgtggccgtggtctgctcggcggtgcgcttgttcagctcctggntggccgtgctgttcccggtgggggtggtggttatcttgtngttgcggggcgggatgtcacacacggccaccttcacgttgttggggatccactccacgagtagctgctgttcttgctctggatgganagcatctgctcgtccacctccttcatggacatgcggccccggaacacggtggccaccgtcagtacgcggccgtggcgcgggtcgcaggcggccatcatgttcttggcatcgaacatctgctgggtgagctcgggcacggtcaggnt

SEQ ID NO: 645430 - DNA, 467 bp, Homo sapiens
ttctggggacatctttaagcccagtagaggggtgtaaactggagacaaataacgatgggaccggtgatatgggttttcccctctaatcttctagcccattcatccagatcatccatcaccttaaagggcatccccagagggaggcaggtcgggccagagctgaagatggccgggcaattggcgggcggggataagtcgtggtggtgcacccaccggtctagatcgaagtcttttttccccaggtcgtgggacaagagggcacctcggcccagcaaactcgggccgggattaagtccaggggccctcgaggggctttttaggggggtgggtctttccagggaggtgacgacttcaagaggggatacaaggggggaaatacctttacagcctcggacctgggtaacaatctagtttcctttaaagggagcatggtgggggccgggggccacatagaccttcggatgctc

SEQ ID NO: 645431 - DNA, 1210 bp, Homo sapiens
ggagagatcgtccaggaggcggtgtagatgcggcgaacagggcaacagggacagggcacttgaggacttggaaatccggagacgcacggctacgtggtgagtgcgagtccatgctgtcgggtagacccttgcgtaggccctgggtaggaactccgggcttttctgtcttgcgtgagctggcaggagagtagccgaaggtttctgcgactgagtacggacctgccgtgcctcatgttctagaggacacatcaccgtgggccgacgcttggtgacacgcagagaaagggcgcgtagcgtggggagccacggaaccacaatgggctggctgggaaacgggtggggcgtgtcgtgagactgtactagggaagagctagcaggacctactagtactctctgcctgcagaacgcaagaaaaaggggcgccgacgaagacgagcgggacaagagggtcgaggaccagcccaggggtcctgtggcggcgcggaatagggatgctaaggcaggatcggacgtgatcgactgggtaaggtgcgcatgacctgacgcaaggtcccgacacaccagacgggcctcaccaccgaccaggcccagggaaccattgcggagagggtacccctattgcatttgtcagagggctgatcttggctctggtaggcaaacagaataagtcggaggcaaacagatgatctaggtagaggagccagcaacatggcgggtagggcctgacggcatatgatcacagataacgcgttcacaaccagatttggcaggcaccctggttgttcccccctgcatagcacagccggggtgtgttccaaggcaagaagcaaaggtccaaggttcaaggtgaggtatatcggttcggcatagagacattcccgtggcgcaaggggaccttctgcaaaatggttcccacggtggtgacaaaggggaattcgcgacacagcacttgtgggcgggggattcgagagagcagggcgccctggaatgtggcagggccccggggcccgcacaggaccccgattcctggaaggggcgatccaaacgcaatttagaggggctcccccatgcggcgccaaggacacccattattcacaccaggacgacaaagcaaaccacaaaatccccaaaaagcccaagaacaatacagcaacccaacgcgggccgcgaaactaccataggccggcactcacccaggggagcacacatg

SEQ ID NO: 645432 - DNA, 145 bp, Homo sapiens
ctattccatgtcaaacagttctcagcatggcaagcacccagcatggccactcctcccgggggcaaggggttcccagccccccaccctctccagccccgtccccgtgcccagctccaactcgtgccagggtcacggcagctcgcaa

SEQ ID NO: 645433 - DNA, 599 bp, Homo sapiens
cggtggcggcccgctctaaaacaaatgggtcccccggggctgcagaaattcggcacaaggttcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcaaaa

SEQ ID NO: 645434 - DNA, 111 bp, Homo sapiens
atgctggctcatgactatcgttaaggtgtattaaaaaagaaaaaaaaatccttccacttcagcaacagtgttggcctgtcagttcatatttgttaaagggcaaaagtattc

SEQ ID NO: 645435 - DNA, 244 bp, Homo sapiens
gaccggggtttgaaccaaatgtcatgtattttccgggcattatctggccctgtttaactttaacaggctgcttgagagagaatgccagcttctatcttgtgcaaaccaacagcagaattgattaattagaaataagctgaaccctagattcaataagaactgggcttaggttcagaaccttggagcaagagatacaccctggaagagccaagaaaaatctagggagactttttatactcggagt

SEQ ID NO: 645436 - DNA, 692 bp, Homo sapiens
gctatgaccatgcgtttggcgcacatggccggaggtgtaagtccatgatgctcgtaggtggaggctatcgtcatgctgcgcatgactagtgttgggattctcacggtacatgatgggccggaaggtgggtcggacgtacgtggagaaggtgccctcgatcgatgtcttggcggtcattactgaatctattaagaagtgagcttcggatctgacgtccgatatcggagatgaaagaccagacctgcccgaggccccattaccaacttccggggcccccaagcccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcaaaa

SEQ ID NO: 645437 - DNA, 458 bp, Homo sapiens
ctacacccctctcttgactacagaaagtggaactccctgaccccttgcacttcccaagtgaggcaatgcctcgccctgcattcggatcgcgcacggtgcacgcacccactgacctagcgcccactgtctggcactccctagtgagatgaacccggtacctcagatggaaatgcagaaatcacccgtcttctgcgtcgctcacggctgggaagctgtagaccggagctgtaccctattcggccatcttggctcctcccctgaagctcttaagtgtatttcacaatttcattcagtgaattctttagtaccagtatatgtctagattctttttaaaaaatgatatgtatctcttgtatacatatttcattcatacccgtggatggttatcctaatttcttagtattgtctatctctgttctcttaatatctccctgagcttatatagtgtcattatattg

SEQ ID NO: 645438 - DNA, 128 bp, Homo sapiens
ccacgcgtccgcttatttaatgctgtaaagttgggggcaaccgttcaggaggggaacgatggccccttatttaatgctgtaaagttggactgttgttcaataaaccagagcaatgcattagctcctca

SEQ ID NO: 645439 - DNA, 1105 bp, Homo sapiens
  misc_feature (1)..(1): n is a, c, g, or t
  misc_feature (914)..(914): n is a, c, g, or t
natttcggcacaagcggctgccgaagatggcggaggtgcaggtcctggtgcttgatggtcgaggccatctcctgggccgcctgcgtcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcaaaatgcgttgcctgcccttcctccattgttgccctggaatgtacgggacccagggggcagcagcagtccaggtgccacaggcagccctgggacataggaagctgggagccaaggaaagggtcttagtcactgcctcccgaagttgcttgaaagcactcggagaattgtgcaggtgtcatttatctatgaccattagaatgagcagcagttactatgagtgaaagggagccagacgagtgattggagggcctatcntgtgaggtgggggatctgttggatttaccactggttatatactctggcagctgttagaattgtgcatgcacttggggagagcatgaggttggtgtgtccacagggtattctagaagcagaaatagactggaagatggaaccaaggttaaggattgccagttcctactgttttttatcggaatagttgcttt

SEQ ID NO: 645440 - DNA, 101 bp, Homo sapiens
agacgtctgtaaacctatggcagaagtatcgatacattgctctcgggtcgttacatttgtcgggagagcaaaccagaattgcactgcgaggtagacggtac

SEQ ID NO: 645441 - DNA, 698 bp, Homo sapiens
  misc_feature (18)..(18): n is a, c, g, or t
  misc_feature (38)..(38): n is a, c, g, or t
  misc_feature (618)..(619): n is a, c, g, or t
  misc_feature (622)..(622): n is a, c, g, or t
  misc_feature (625)..(626): n is a, c, g, or t
  misc_feature (637)..(637): n is a, c, g, or t
ataactccgctccccccnctcggccattatggccgtgncttttccaagcggctgccgaagatggcggaggtgcaggtcctggtgcttgatggtcgaggccatctcctgggccgcctgcgtcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagannatngannataacagaggnctcagaccacggatactggtcgagccattaagatgttctcctcaacaaaaacacgatatgg

SEQ ID NO: 645442 - DNA, 142 bp, Homo sapiens
  misc_feature (44)..(44): n is a, c, g, or t
  misc_feature (79)..(79): n is a, c, g, or t
  misc_feature (100)..(100): n is a, c, g, or t
  misc_feature (106)..(106): n is a, c, g, or t
  misc_feature (129)..(129): n is a, c, g, or t
  misc_feature (132)..(132): n is a, c, g, or t
cgccaaaccatttctccacttctgcgccaaaacgcttccactanaagatcaagagttcctgaattacgctgaacttgtncgggccacccctttcttactncatcanaaactatatccagccagctgttntgngagcctcttc

SEQ ID NO: 645443 - DNA, 388 bp, Homo sapiens
gaagcttgtaaggacatgcttgttttagtccagtggttccacagctgctaagccaggagtcacttggaggcttttaaatacaaaacattggagctggaggccattatccttagcaaactaatgcagaaacagaaaatcaactaccgcatgttctcacttataagtgggaggtaatgataagaacttatgaacacaaagaaggaaacaatagacattggagtctatttgagaggggagggtgggagaaggaaaaggagcagaaaagataactattgagtactgggcttcacacctgggtgatgaaataatatgtacaacaaatccctgtgacacatgtttacctatggaacaaaccttcatgtgtatccctaaacctaaaataaaagtt

SEQ ID NO: 645444 - DNA, 450 bp, Homo sapiens
  misc_feature (18)..(18): n is a, c, g, or t
  misc_feature (38)..(38): n is a, c, g, or t
ataactccgctccccccnctcggccattatggccgtgncttttccaagcggctgccgaagatggcggaggtgcaggtcctggtgcttgatggtcgaggccatctcctgggccgcctgcgtcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttttggcggaccgcgcgaggcatcgctgccacaaaaccaagcgaggccaggccgctctggaccgtctcaaggtgtttgacggcatcccaccgccctacgacatgaaatagccgccggctcctcccgttgccccaagctctgccccccgccctctggcc

SEQ ID NO: 645445 - DNA, 905 bp, Homo sapiens
ataatgttcatgaggtacatatatattgttcccatagtcttcagactataaaactataaatatgcccaactctatgttcatttgccctactttaacctagggttgatagtgtctcgtaatttcagctgactgtgtaccgtctctgcctgagactcaggaattctgaaatgtgaaatggtctcatgttgtctctatctcttgatagcatgaaactcagaagtgtattaccattcaatagcacttatgactatagaatcctaatttgtcatcctgattcactattacatatgatacttcgtctatcattggtacgatagtagcttataagacttaatgatgctattgacaaatgcaggttttagaatattagtgcctgagattctgcgtaggtaggtatctctacctctgctatgatgataccaagttactcagagacctcccattatgcctgtggtcaggctacggtgaaagctttgccctctactctacctactagttcaaggggaattcttgggaagcagatgattctagttcttgtgctagagatgagattgatcatcttgcatgtgtgctctttgttgctctatcgggctataatctgtttgcctttccgttaataaatgggtaaagatttactccacgctggacgtaacaggtcagagtacgagattgtcgtcccgtagccttggaaggagcctgtgcaatactttgagagcccctgagtctacgggacataatggctctaaatccccattttgcttttaggtcggaaacccaatatagttaggaaacacttgtgtctctggaccaaaaccacatggataggcccttgagaactggggcgtgaggtttccgaaaaccgccgaacagtgttttacgaggccggacctgccactggggatagc

SEQ ID NO: 645446 - DNA, 258 bp, Homo sapiens
tgaaataataataattaaatttccggccgcgtcgaactggctcaacgagggtggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcaaaa

SEQ ID NO: 645447 - DNA, 662 bp, Homo sapiens
  misc_feature (1)..(1): n is a, c, g, or t
natttcggcacaagcggctgccgaagatggcggaggtgcaggtcctggtgcttgatggtcgaggccatctcctgggccgcctgcgtcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcaaaa

SEQ ID NO: 645448 - DNA, 337 bp, Homo sapiens
ggaggtgaggggcgcctctgcccggccgcccctactgggaagtgaggagcccctctgcccggccagccgccccgtccgggagggaggtgggggggtcagccccctgcgcagccagccgccctgtccaggagggaggtgggggggtcagccctccgcccggacagctgccccgtctgggaggtgaggggcgcctctgcccggccgccctctactgggaagtgaggagcccctttgcccggccagcccgcccatgtctgggagggaggtgggggggtcaggcgccctgttccggccagctgtcctcgtcctgtgaggtgatggtggcagcctctgcctc

SEQ ID NO: 645449 - DNA, 894 bp, Homo sapiens
  misc_feature (8)..(8): n is a, c, g, or t
  misc_feature (80)..(80): n is a, c, g, or t
  misc_feature (320)..(320): n is a, c, g, or t
  misc_feature (352)..(352): n is a, c, g, or t
  misc_feature (354)..(354): n is a, c, g, or t
  misc_feature (383)..(383): n is a, c, g, or t
  misc_feature (400)..(400): n is a, c, g, or t
  misc_feature (412)..(412): n is a, c, g, or t
  misc_feature (420)..(420): n is a, c, g, or t
  misc_feature (574)..(574): n is a, c, g, or t
  misc_feature (594)..(594): n is a, c, g, or t
  misc_feature (677)..(677): n is a, c, g, or t
  misc_feature (733)..(733): n is a, c, g, or t
  misc_feature (789)..(789): n is a, c, g, or t
  misc_feature (806)..(806): n is a, c, g, or t
  misc_feature (818)..(818): n is a, c, g, or t
  misc_feature (822)..(822): n is a, c, g, or t
  misc_feature (875)..(875): n is a, c, g, or t
cgaagccnggtcagggacagaatccccaaagggtcacagttccttgaggaaggtggcaagaggtgtagatcaaagctganctgggacaaaaggctgctttgagcctttttgggtgagctcttcaggaaccaggaccccagaagggcaagctcctcttttcacggccattgccatggagggatcctccaagctcccactttctgttaattcagagttcctcagactcggccgatgggtcatttttcttgtatattttctcttgatttcccttcttcatggctgcatattttgctagcgttaagagatagttacttagtttntttaagaacttggccacgttcgcatcggtctntnccatcttgacaagaggcaccacacgtctnttggcccggcggcacanggcccggcaganattcagcnccgagctgatcttgccttccgaagcaggatgaaggccgttagttgtgggagctggctggtgtacttgttgatccacttctccagccccaggatgggccccgccttgaacgtggtatactttaagttagctttccgggccgaggagcatggtgtngccagggccgagccgacgtnctgcaatgtgcactggattttctgaagctcttcggcaaatgtatggcccttttctgttacttatttcagagcaaacccaatanctgaacttaattcaactgttgtcccacggcttcaaacacttgggcatctttgggtnttctttctcctgttaaggtactagaaaaccctttgtcttccgttttggtgtaaatnttggggatctgggtgtnttcgaggaaggntgtngcctgttcccgttttccacgccctgagggccgcggctcttgaaaaggggatanaggagccttggggcgcgaa

SEQ ID NO: 645450 - DNA, 87 bp, Homo sapiens
cccgaggacacggctgtgtattactgtgcaagagataggagtggttattactttaagggtttgtggttcgacccatggggccaggga

SEQ ID NO: 645451 - DNA, 203 bp, Homo sapiens
cgttatggttatggaaatgactgcttccattagtacacaggggagtggtcgtgcttgtgaaagtcaagcctggcgtgttgctggggttaacatgaaagaattaaataaagtcaagcatgagatggattttgatgctgagtggctatttgaaaatcatgattagaaggattccagagtctatgcgagtaagactgctgacagtt

SEQ ID NO: 645452 - DNA, 696 bp, Homo sapiens
  misc_feature (18)..(18): n is a, c, g, or t
  misc_feature (38)..(38): n is a, c, g, or t
ataactccgctccccccnctcggccattatggccgtgncttttccaagcggctgccgaagatggcggaggtgcaggtcctggtgcttgatggtcgaggccatctcctgggccgcctgcgtcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcaaaa

SEQ ID NO: 645453 - DNA, 714 bp, Homo sapiens
  misc_feature (14)..(14): n is a, c, g, or t
  misc_feature (17)..(17): n is a, c, g, or t
  misc_feature (52)..(52): n is a, c, g, or t
gaggacttacaagnttngggtcaaaaaaaaccccccgggcggttatttatanactgaacggcatactataagtctagtacagctggtggatcgacagcgagatggagtgcagtctgtgctgatgtcagcatctctggcgctgggcatcgtgctaacagtactgtggcgggagtgtgtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcaaaa

SEQ ID NO: 645454 - DNA, 191 bp, Homo sapiens
taaggaagggtccacaagttgggagagcccaagattgagaacaataatgaacacttattagtatgaacaattagttagaaacagataatcacaaacaagctgagggacacaatgacctcattccacacgtagcgcaccctcagcaggaccctctaaaactttcctccagacccttgacctcatttgcagag

SEQ ID NO: 645455 - DNA, 592 bp, Homo sapiens
ggggcccggaagtggtaggggcctcgggaagggttgttgttcatccgcttgcggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcaaaa

SEQ ID NO: 645456 - DNA, 231 bp, Homo sapiens
  misc_feature (23)..(23): n is a, c, g, or t
cctagggagagatggcatgctgncaatcactatttctttaaatggaaggatttcttttcatggtctagcatttaaatccctcccaataggagctccctaagatagtgttggtatttcccagaaaaacaggattcgtggttaactattcctggcctagggagagacggcatgctgccaatcactatttctttaaatggaaggatttcttttcatggtctagcattttaaatc

SEQ ID NO: 645457 - DNA, 333 bp, Homo sapiens
  misc_feature (48)..(48): n is a, c, g, or t
  misc_feature (61)..(62): n is a, c, g, or t
  misc_feature (152)..(152): n is a, c, g, or t
  misc_feature (186)..(186): n is a, c, g, or t
ggcacgagcccatgtgacctcactgaggaaaaaggcatgccaaatgantcccatttatttnnttcataacattctcagagagttctggcagggaaataacagacaaatccttacctttatacagtgctttcctgctaaaagtacattctaantttcaactaggcacttgacaagtgtgtgaaattntgtgagcaagatggagaaacatagattggagagtggtgccgctggctggatgttagctaaggactatactcaaagagcatggattaaagagggcgaggtcccttgtagatgctgcaaaaatctatgtggagtggaattgaattgagg

SEQ ID NO: 645458 - DNA, 311 bp, Homo sapiens
  misc_feature (9)..(9): n is a, c, g, or t
  misc_feature (11)..(11): n is a, c, g, or t
  misc_feature (13)..(13): n is a, c, g, or t
  misc_feature (150)..(150): n is a, c, g, or t
  misc_feature (171)..(172): n is a, c, g, or t
ggtcgaccngngngcctgctcctgccgcgcgcacccccgggcattcggctccgcacggtcgcgccagctttcctgcacctgaggccgccgcagccgccgccatgggtgcctacctctcccagcccaacacggtgaagtgctccggggacnggggtcggcgccccgcatgcnngctgccctacggcttctccgccatgcaaggctggcgcgtctccatggaggatgctcacaactgtattcctgagctggacagtgagacagccatgttttctgtctacgatggacatggaggggaggaagttgccttgtac

SEQ ID NO: 645459 - DNA, 358 bp, Homo sapiens
cccacctgttctgcgaagtcggtcgctactagtggtatttccatcgattgctcaaacacaagtgtctggctactagaattaaactgactcgcttcatgcgactcacagtacattgagtcgtgtacccgttgtaggtaaatgtcggagctcgcagttaccaccagttaagagtatctgacagcagacctaaaatatcgcgtaaaaatgtaccagaatcactataataacactaatccttggcatatatatccgctaggggagattatatacgacgaaactttacaggcttcgacgcgagtcataacatagcatatgcaaatcaccactcgcggtataagatcctttttcaattgccctg

SEQ ID NO: 645460 - DNA, 142 bp, Homo sapiens
  misc_feature (135)..(136): n is a, c, g, or t
gcttaagagatgtgagcggtggatttacaggtgtttaatattattattatggtgtgggtttgtttctcatggtctttaggaaatattgagtaatttgtaatcaccgcattgatactataataagttcattcttanncttaca

SEQ ID NO: 645461 - DNA, 1250 bp, Homo sapiens
ggggtgcgggtgcccgggtgaggggcggagctgggggcatggcgctccggagtcggactcgctggctctgtattggcaccccgtcaggtcctggcggctctccgtgagcggtgcctagcattgagcgaacgactggcgagtgtctccgaccgccatggagcgggctactatgccgcgagacctggtaaccgtctgcacggtgcaggtcgatcgctctacccgcagatgtgacgggccattggtagcccaaaaccggatgaaaattggtccatcgagacttctccgggtgtctctccatttgtggatcacctttgctctaatagatccgggaccatctcagttacgccaaggaaccgtcttgggctggcctctatctagatggacagcactgagcattgatctgtggccatgcaggactgactgagtgactgatgagctacacacggtaacaagcttgactctcacccatagactggaagactacggaaggcgagggatgggatgcaatcttgctacttgatgaaatggctagggtcctaggaccatgtgtgtagcaagacatatcgtggacaactggaggtggcaagcaagacagattcagatgccaattgggtggccccactgttgtgctgccgtacactggttaggaccgtctgaggtacccgtgttagcctagagcacgagaagatatatccgcctcctgggtaggaccacagagcatggcatgtggcaatgggggctattggattctacggaccttgctaccttgggagacgcttccttgaccctttcccgaatggttgtacaaggccgcaactattcgtccccttggtcgcataccgatggaaccataagaaccgtagtggtaaagcccttgggaggcactttacaccaatgtacctacttgtggggaccctaacttggagtagaccaatttgagacaatttaaaaatgtaagaatggggggtaacattttctgagctcaaggcgatcacagaaacggaaacgggagaagagatcatagcacatcacccaagttgggatcatcacggagcgcaacgaggggagcataaaacgggtcgcatggcaaagaagaaaactgcccaccagggaaagccctatcgacgagcgttggaaatagcaggagacaccacagaaggcattttgggagagcaactcatgagccacagaaaaagataggcacatagaaagaaaaatcatagccaagggagcacggttggaagagaccg

SEQ ID NO: 645462 - DNA, 837 bp, Homo sapiens
cacacagagctgatctgatcggccggtgacatcactcagtgagaccggccgggcgcgtgggccctgcaggcgaggcgaggaggccagtgccaagttctccgtgacgtcccctggcagcccttccaggctctcgcacccgcaactggcgcagacgtaactagaccgccatggctgttgggaatcgtaatgtgcgccctggcggtctctgccctcagtccgggctgctgcgctctgagcgcctttctatctgtccgtcggtcctgctacagcgcatggatgccagcccgccttgagacctgcgtctccgagctcgactgcgccagcagtcagcggcgagtgacctatccaggcttccttcacctgactgaggaagactgtgccagactccaacatggcagcctccgcttcggggccgcccgtcgccggcccgcaaggggctgcagcccaatatctcccgggcgatctgaggttccaggggcacaggacgacgagcaggagaggcggcggcgccgctggccggacgcgggtccgctccgaggcgctggtgcacgtcgctggcgcaggagccggcgcgtcaaggccaacgatcgcgagctgcaaccgagatgctacaacttgaacgtcggcctggacgcactgcgcagccgtgctgacctcgttccccgacagagaccaagcgtcacgcaataatcgatacgctgcgcttcgcctacaactacagtctgggctctggccgagaaagctgcgcctggcggatcaagggctgccggaggcggtgccggggagcgcctctgccgcgcgagtgcgtcccctgcttgcccgggtccccaaggcccg

SEQ ID NO: 645463 - DNA, 318 bp, Homo sapiens
cacccccagaaccctcctcctcccatccctgcttcgaggggcagccgacagcccgagacgggcaacccatcctgacctgggatgtccccaaggcctggccccacagcagtaagccagggacgtggggacggggctccacaggcctttcaggttctgccgcagtgcggtcggctccgcctgctccttcagcctctgtcccacccacaccaaccacccacaggtcccgacggcaggcgcagggcggggctgtgtgggctgcgtactgggggtccaggctggtgagctgcgacaggaggaggctgctgctctcagtgatgg

SEQ ID NO: 645464 - DNA, 331 bp, Homo sapiens
cacccggctcaatcctcatttctgtctcaccattttcccctgtgtctcatgcggttactgacgggatttccccagccgaagccagctgtgggctcccgctcccgcacccactccccaggcctgaaaagtcaggttccaacgttaactggggaaaaaattggtccccctaaaagggagcaccacaagaaatcctttccggtgatccagagccactaaaaaacgggagctcgttaaaccttggtcatggagctgacgtggattaaagtaccctgtactgcagccctgttagtattgcaggatggagccccactgacactttaactagatcgcc

SEQ ID NO: 645465 - DNA, 316 bp, Homo sapiens
catataaagtaggtgcccagagttacactcagtgccagttggtggccagtctgccaatgtctacagtcgggccctcaattcaaacacacaacttgtcaactcatgcccattcacattttcaatcccagtcaccatttttcttctaatcatgcatggcagcacattctgcaatcttcacatttctgcagggggtttcaatgcacccactagcagcttgtcctcatcattcagtccgagtttcaatcactgtcatgtctcagtcagcatgggctcatcatcattgcctctcattctttgcagtgtgcattctggccgg

SEQ ID NO: 645466 - DNA, 187 bp, Homo sapiens
cgctattcaccacactggcctgactgtgcttaggagaacgtacctcgcctctgactcagtccggaaggcagagacaaggctgggccccgtgaaaagggagtcacagtgcagcgctgccgtgctgtggctaggtccgcctcgtcagcatcctgggacagccctgtgtggggtgaggtggagagcgggt

SEQ ID NO: 645467 - DNA, 909 bp, Homo sapiens
  misc_feature (230)..(230): n is a, c, g, or t
gttcacagtcacagaactaatcatatttatatcttcttcgaaaccacagttattgcccaccttggctatcatcacccgatgaggcaaccagtcagaacgcctgaacgcagtgcacatagttcctattctacttagcctagctagagatccacttgcccgctactcatcagtcgaactgaatttcagcactctacaacgaatcctagtgactctagctagaacattctacntactcagctctcactgtcccaagcaactatcaaactcgctgatccaacaactgaatatagattagctttacacattgaacttttatagttaaagatacctctttacggacctccagttatgactccctatatagtccccactgtgcagagagactcccccatcgactgggtcatagtatgatgacttgcgcgcaagttacgtacttaccaagtagagcggtctaataggaatatatacggcctctgactgcattctcaaccccctgagaatcaagattagcctaacccgtccgagtatctatccctatgaggcttaattattagtaagctccgtcttgactagcgacgacacacaagaaccgtaagaaatcagtgcaacttgcaatactcgtctcaagtacaagccgacgtagtcctcgctagttcacatggcaattaggtactatccaaagaccctctggaagcttcgaggcggtgcagtcgattcggcgataatcgcccaggacttcctgtcctcattactattctgcctagtcataactgtagacttacgaaggctctcgacagtcggcttcatagtgctctctcagggacttgaaggtctggtcccataatagctttttgatgacttttagcaagcctcgtgactcggttacccccgataataactactgggaag

SEQ ID NO: 645468 - DNA, 471 bp, Homo sapiens
acagtcaagaaccaccatggcagcccataatatgttttcttatttctgtattctccttgctgtggcgtctggagcccttacagacccagggagacactatcctcccacagctcactaattactaaacacagtgacagcccacttaggagccggcctcccctgtcagccaacccctcagctagttctcacaccaagcctatagatatatatgtgtgtgtatatatgtgtgtttatgtgtctgtgtgtatatatgtgtatatatcggtgtgtatatatgtatgtatatgtttatacatgtgtatatgtgtgtatgtgtgtgtatatgtgtgtatgtgtgtatatatgtatgtgtgcatatgtgtatacgtgtatgcatacatgtatgtgtatgcatgtatatgtgtatgtgtacatgtatatgtgtttatacatgtatatgtgtgtatgcgtgtatacgtgtatgtatacatg

SEQ ID NO: 645469 - DNA, 184 bp, Homo sapiens
aagaaggtgggagggtcatgacgcacgagttcagtcgtgactttctgggggcatcgcggcgtcccttttttgcctttaaagtaaacgtcgcccgacgcaccccccgcgtatttcggggtggcggaggggggggtggtggggtggtggggtgtggggggtgggggggggtgggtgggtggggggt

SEQ ID NO: 645470 - DNA, 430 bp, Homo sapiens
  misc_feature (72)..(72): n is a, c, g, or t
  misc_feature (146)..(146): n is a, c, g, or t
  misc_feature (176)..(176): n is a, c, g, or t
aaccattgaccccttcaaaccccatcgaggtttagatctccctcactgcccgagaaaggctgccctgtgtancctttttagaagaggagtgctgtttcctatactaacccagtcaggacctagtacaagatgctgctggacgaatnaatgaaaaagcttctggccgggtgcaagtntcacgcctgtaatcccagatctttgggaggctgaggcgggcggatcacgaggtcaggagatcgagaccatcttggctaacacggtgaaaccccgtctctactaaaaatagaaaaaattagccgggcgtggtggccggcagctgtactcccagctactcaggaggctgaggcaggagaatggcgtgtggggtgaacccgggaggcggagcttgcagtgagcagagatgatgccactgcactccagcctgggcgac

SEQ ID NO: 645471 - DNA, 913 bp, Homo sapiens
gctgtggccgctgtcgtcgattgttgattgttcgtgacgccggcctgtgcaggggccattggtcttcctcatcgcgcagctctagctgctgaatcgattcgcacgagcgatattcttcgtatcccggaggtgctgagaagcatgctcacggacgcatgtctcgaggggagagggcatagatagagtccaggtggctcatccacgcggttcgagcggagtcacgagacccgctagatttgatgcccttttggtgacaattgcagcacaagagcccagatacctgtaacgaaaaatgcaaccagtgatggaaaccctctgggaatcacagtcggaactcaccaggcgtgctagaccagggaacactggacttgaaagttatccatgcgcttctattgggactggaacttaacggtgccacggtggtcatctcataggacggtaagatgtcctagcgggatctggcgcatcttatcgagccatgagacgttccagaattcttttgtgctgcctaggcacacgtctacgcgaggcgacccgaacgagatttgcctgcatgacctttagggaggattgtcgacccgcgaagccgtgaaaggcgttgctcccccacgacataggataggccccgataccccaacaatgcaaggcaccaggcagcgaggcactggacgtcaggaacaataggcacgcacggcagcgacactgtggcccggactcgggggcaggcatggactacatgcacgggtggcactcatacacgacccgcaactaaaaaacacaactgaggggattggcccgtgcacatcccctggcgcaaaaaagcctatcacagaactgaagtccaccgtcgccgtcgaagtcacccccaacgcgcaaacaaaacaccacgcccccaccacaaccaaaaccaacc

SEQ ID NO: 645472 - DNA, 297 bp, Homo sapiens
  misc_feature (53)..(53): n is a, c, g, or t
  misc_feature (107)..(107): n is a, c, g, or t
  misc_feature (137)..(137): n is a, c, g, or t
  misc_feature (140)..(140): n is a, c, g, or t
  misc_feature (287)..(287): n is a, c, g, or t
tttcatattgagtgagggaaaaagaaaattacttcagggagacacactcgggngatcagcaccaaggcaggcatcgtcattctgcatatgcaggccttgactggcancaaagctgagtggggggaggggtacgtcantancacacagaaggatgaagggccgaatcagctctgggttcaacagcgactcctcaagaggccggtccacgtggaagtcatggatgtgggggggccctggatgggccttgggggcaggtccccctatacgctggggggggtggggctcanatggatgggc

SEQ ID NO: 645473 - DNA, 408 bp, Homo sapiens
  misc_feature (24)..(24): n is a, c, g, or t
gaggcccaagaattccggcacggnggtacccaatctgatgactgttattttcttgcctaattgccctagctaaaacctccagtactatattgaatacaaatggtaagagtggatatccagccaggcacagtggctcacacctgtaattccagcactttgggaggccgaggcgggtggatcacctgaggtcagaagttcaggaccagcctggtcaacatgatgaaaccccgtctctagtaaagataaaaggaattagccaggcgtggtggcgagcgcctgtggtcccagctgctcggggggctgaggcaggagaatcgcttgaacccagaggttcactgcagaggttgcagtgagctgagattgggccattgtgctccagcctgggcagcaagagcgaaacttcattcc

SEQ ID NO: 645474 - DNA, 170 bp, Homo sapiens
acccccgtttttttttaaccctgccccccccttagtccccaaattaggggaggggggggtttatttttaaagtcccggcccttgggtggggcccccccccaaaaattcccccggggggggggggggttttttaaaggggtaaattaataataacccttgtttaaatttta

SEQ ID NO: 645475 - DNA, 953 bp, Homo sapiens
ctcctactcctcatagtacccattctaatcgcaaggggattcctaatgcttaccgaacgaagaattcgtaggctactactacagactacggcaaaggaccccaagcgtgtgtaggcccctagcgggctaagtactgacccttcagctgtacgccatgataactctatcatcaaaagagcccctctatagacccgccacagtttgacatcgacgcgctgctacgaatacagcgcgctcccgcaacctgtgagtcgtctcacctatgcgcctccttcatagctatgagaccccccacctgcaactcggagtaatacactgactccccgtgggtcatcgctcaagcctaggagctccggtatagggttcttagtctcacgctgcgtagccagctatcgcgttaacgtcaatcgctgctgtagtcaggtttagacgtcagttacgtcaatcactaagtccactgatctgggacgtcgtgaaacaacacgtagacccaagaaattccgtcatcatgaattcagcctacctcttcgattggtagttatgctgtaattactaatagagtggacatcggtcttgaaacccgtctctcaaccctttattcacaaagaggagagcaaacacctcatgcattactccctggcatctatgtaccctggggcaacgaatatggagtggaattctcacaacagctagcgagagaccgaccggaatcccgcttgccgaccttgccggcagggcgagtccgagaatcagtcttcaggcttcggaaattcgactctacggctgtagggcccgtgacggtccttatggctggcatagccggaattgagcaaaacgttcctataagagaattgccttacacctgtacaaattcttcctaggggaaaacatatgaggcattctcgcctgaatcgaacaaaggttttgggcaaccaggaccaaaatataacccc

SEQ ID NO: 645476 - DNA, 100 bp, Homo sapiens
  misc_feature (44)..(44): n is a, c, g, or t
  misc_feature (87)..(87): n is a, c, g, or t
atgctttgtatgttagttctcacataatgcaaattgtggctctnctgatggacaagacctcataactgtgattaatatcaataaaanggggatgttgtgg

SEQ ID NO: 645477 - DNA, 718 bp, Homo sapiens
caaaagctcactagctggaacgatgatttcgtctcagttggtactcctaaataagaagacaggaaaacaccagtaatggtgaaggtcttgataaaaggagaggagcttcacacattagtggtgtgatcctgtcttctctttagtatgatccctcatagcctcactaactggcaaggatgattgtagtctcaggtgttgtactccgtacaatatacaacagttaaactagcgacagcctcgttaaagaaccgacataccgaagaaatggagcgggtctgcttcgatgaggtcctcccgctctgaggaggcccaacagattaaagcatgaccgcagaagtttgctgtgcgacaagagtggttcaccttgtgagcgtgaggatcgcgatataaaggcctcagagcgtggtgatccgcacgctagtggaccatatgttctttcgcactgcggcaaaatatacgggctaggcctagggcgagatcttggtggtgacatggatgcctcatgctcttctgggggcgtgatgcctaggtgtgtccaaactgttgcctccccgacgatgttatagacgcctacttgcggattccactttaaaagtgttctgaagcgctgtcctcctcgctgttctaccctaagtattggtaatgcctggacgggtctaaggacgattgggcttactcgggactgccattctatgaaaggctgttttttgacgaccct

SEQ ID NO: 645478 - DNA, 410 bp, Homo sapiens
  misc_feature (58)..(58): n is a, c, g, or t
ctaattgcttcagttattgaatggataatatcgtggcagttatagcagaagtaaaganagtcgaacaagagccccaccgccttaaacaaacaaacaaaaaagggacagcgtaaacaatgcaggccgggtgcggtggctcacgcctgtaatcccagcattttgggaggccaaggcgggcggatcacgaggtcaggagatcgagaccatcctggctaacacggtgaaaccccgtctctactaaacaaaatacaaaagttagccaggcgtcgtggcgggcacgtatagtccctgctactcgggaggctgaggcaggagaatggcatgaacccaggaggcggagcttgcagtgagcggaggtcgcgccactgcactccagcctgggcgacagagcgagactccgtctcaaaaac

SEQ ID NO: 645479 - DNA, 397 bp, Homo sapiens
atggtagtgatggttgcacaacactgtgaatgcacttaatgccgctgacttggcactaactctcaaaaatggagaaatattatttctatttttccacaataaaaaaaatgaaaataggccgagcgcagtcgtcacgcctgtaatcccagcactttcggaggttgacacgggtggatcacctgaggtcaggagtttgagaccagcctggccaacatggtaaaaccccatttctactaaaaatacaaaaattagccaggtgtggtggcatatgcctgtaatcccagctattccagaggctgaggtgggagaatagctggaacctgggaggcagaggttgcagtgagctgagattgtgccactgcactccaggctgggcgacagagcgagactccatctc

SEQ ID NO: 645480 - DNA, 418 bp, Homo sapiens
atatgagaaagccagttgtatttatttctgcgtatttgtattttgagcaatttattttttattggtatagaatgacccactgtgctctagagccacgggttagttccctgccccgtctccatctccctgtctgcactgtctctcccagaggtgtcggctggtgcttctttgcagtgcccggtgctgtgtcatgcccgtttggctgacccagccccggctgtgtctgccccatcccagtgtgactgtcgctcttggaagttcctccgtgtctccttggtttccttaggtgacttgtctttgccccactccctgcagtccgcagcacctgtggtctccttccctctcctcccgcttctcctcagacgtcatctgttcttactagagttgtcccccttgcccccaggttccagggttccta

SEQ ID NO: 645481 - DNA, 1259 bp, Homo sapiens
catgaatgttgatccctcgctatcagatatgacatacctgagtggcgctcagatgagagagacaaagtcaaatatacagtgcacacaaagaccacactgcccacgtgtcagaggccagagttttctgttacaaggcaacatgaagactttgtagtggctacatgacactcattattgacaacacacagacgtatgctagggctatatatattccaccgtgcatcctacgcaagcccagacatacgactggtacctcgagcagaagatgcagaaagcatgggagaaggtgacagcggctctaatgacccagacgacgacactcacgccaagactgacaccaagaaactggaagcttgaggtatctcgctgggctaaacaaaaagatctagtgtacataccacaatgacagtctaaacattacagacggcattatgtcttactcaacccttggttactcagataaaagaatcgcacacaattcaccagtaaaccctaggacatactgatcaaggactactacaaggatgcagaagggcgacccacacacccctaacagacagaacagatccagcgcggcgcatccactcacaaaacaaacaagtggaaaggcaacaaagtggcactgcagtcaaacgcacccattgaacaacccagggacagttcaccccaccgggataaacatgcaacacccaaaggcagacccacacaaacgaacgaacaacgtcccctgacgtcaaccctgcaatcccacaaggaggcactccccaggaatgaccaaggagggaagaaaacaacgtggaccaacacgcaacccgacacctccataacaacgagaaaggccggcataacctcaccgttcgccaaagggcagcccggctaaaacaaacccgggacaatagaaaaagaccaaagggagaccacaagaggtaccccaatacacacagccgacggaacgaaataaggaacaccaaggaagagaaacgaaaaacaggaccccgaacaccacaaaacaaacgaagaggacggaaagagagggacacgcgggaagaacaggtgaccaccaaatgaccaggtaagggatcaaagccgagctgacaaagcacaacggagcagacgcccaacagagtacggaacagcccaaccagacaaactgctggggcatgcaccaccaggaagagcgaaagacagcacagacaagaaaagaaaaaacatacagcagcgaagcagaggaaacaatcaacgaacggaggcacaacaaa

SEQ ID NO: 645482 - DNA, 300 bp, Homo sapiens
  misc_feature (258)..(258): n is a, c, g, or t
cagcacatcagcagactgtaggttctagattctggttatttctgcgtccagagaacatgataaactgtctctggagtccgaccggaatccgtggctgccatgtgaacctgagcatatcctcagactctgccaagccccgggttcctcacctataacgtgggcccgaagtttacgtacctgtcacgttgttaccagcatttctcacgattgtgtcttctgacctgtcggacacgcaggccagtttcgggttatacgcanacgtatgtttctttgttgaatcgcattatttccaggcagcac

SEQ ID NO: 645483 - DNA, 578 bp, Homo sapiens
tatccccggttctgggtaagagccaggccctatataagtgactaagggggctcatatttgtgctttcttaggggagacccgatacctccgttctgccaagaagtttaaaagagagagatagcatgggcgttgcagtctctttgagaggggctacacaggagcagatcattaacacattgaaggagagtggacggttttagggataaggtacagaggtcatgagcaagggcctgtccaaaaagatgggggctgtctctgaaaccttgaggtagtacgcaccaggtgagctgatgtgaaaggtgggtgtcggggttttcccatgtaaaggcaaagaggttttgggaatcagggtgtaaaggaattgtggaaaaaagcatcctttaggtatagaacaggaaaatgggtggtattggagggaattgcagaaagtaaagtatatgggttaggaactactggacatactgggagtacagcttggttaatgagcctgaggtcctggactaagtgataagtccatctggctttaaacaggtagaactggtgtgttaaaggagagttcctgggtagtgaggtgagta

SEQ ID NO: 645484 - DNA, 695 bp, Homo sapiens
  misc_feature (350)..(350): n is a, c, g, or t
cgtccgttttgagtacatgtagagaacaatatatacaccaccccgttgggggtagtgccaccctcgtcgtcgtctactacacgctctggtggtgtagtaatataaggaggagatgtgattacgatgggcgtccccccatctataatacaatagtactattgtgctttatagaccaaacaattatagtggggtatcctctactcttgctttgtagtatattgtacacatgtggtgaagaataaactaatatagggctactattatataatagaagactatctctctactattatttagagaccaccccatctctatatttaatattttctataaacaacttctttcagagntagaaatatatataactctatgtgtattaacacaccaatcctgatctatctaaactccgtagcgccccttgaaaacaaatatatctcccctcttattttgtcgactctcctttgtgtttgtctaatagtatatataaacgtacacgcgcctcttgatgtccctcagaatatctcgacatatatccgctctcatctctttctctgtttaagagaacatatgaagcatatcccccctattctcccacgatcatcactctgtctgtgcacacagagacatcaccaccttgttcggagatagacccgttccaatttttaccctcaccccgctcaatcaatgtcacaaaa

SEQ ID NO: 645485 - DNA, 1245 bp, Homo sapiens
ggagaactagtctcgagttttttttatggtttttttttcaaaataaaaacatttcagctcaaatttaattaagttaattactatttttattctttttggtagcatcggagatctggatatgtcactcatagcgggcctcaaactccgggcctcacagcgattctctggcctcagttggcaaacggtcggggattacagactatcaccaatgccaggccacaacccacatttgaaaaagaaaatctaaggggccttagaagatgttggcaagtcagctgaccaaggtggtcacctccttaaggagggcctcgtgaggcccgatgaaaaggggcttatataaacaggctcatgaccagctcgtgccaggtgatgaccatgtgtcaagtcgtcactgcgtgtccccaattcccggacccagggtggctctgaataagcttcagctaataaaagaacaaagacggggggcacaaggggtccccaaatcttggtggcaaatccagtgagaaacacccttggcacatcatctggtgctcagctggatctggcaggtgaggccacactcaaacctggcaccaccccaggcaacgcagtaggcacaggacaccgggggcctacagggtaacatcaacggggaggcctaccgcactgaacacaaaaaaaatggggcctgggcacaagggacaagacctgtcctactaactcacttgctagcaacacctagatctacacacagacgcctgggtccacctctgaatccgtcggaagagccacgacaagggcttggaacacttctcacaatgaagagagacgcccgcacacaaaggggtacacaggaaatgaccaatgattggggggcccgaacaaccccggaaaagtgcccccgagagaggagacaggacaatcgcgacgatcggagcaactggatcgacaagaccggggcaaccagaagccccccaaacagacgcaaaccaggggaaaccccacgagaaaagccccacaggttcgaggaaccccggcgggggaaagctgaggcccacaaggagggtaagtcaacacggatagaggaacaagaccgccgtgcgtaaaaagggaggaacagggaggcgataaaaaggggcgcccatgtaaacaccgaaagagaacaaacgcccccagagggtgaacagctaacggcaggcgggtcatgggcaccgtaatgccaagaacaactattgcaaaagaggcttggccaccgcatatgaggag

SEQ ID NO: 645486 - DNA, 212 bp, Homo sapiens
tcggagatggggtctcactatgttgcccaggctggtcttgaactcctgggctcatgctgcatcctgcctcagcctcccaaagtgctaggattgcagatgtgagctaccatgcctaggctgctttaattcattattctttattttcatgtttttaaataatattattatcttgattcttcttgccttttcagccctacatattgcctgctgac

SEQ ID NO: 645487 - DNA, 534 bp, Homo sapiens
gctcccaaggggagtaggacaagacaacttggctccagaatgatggatcttctctaactgtcatagagcacatgtccactccagaatcaacaattgccgtgataatcctcaacagtgtggaatctaatctcagcatcgtctatcatccagctttcaactcgagctcgacattcaaaagggcaatcttgggattgtggtactttatgggttgcatttcaaacccagacgtaagagaaagtctacattgaatgaaacaccagaataccagctgagaatcctcgagggctccaacctgtaacttcttgattccaatcattctacgcagcagcaaatcatcgagcatcatcactgcatacaccaccatcttagcaaagaaagctttctgctgggagatcagcttggagctcagagcggtcatggcacacttttccagcagattcctctgctccaactttatctgccttcttcacggtcacagcaatctctttgatcttgttaactgccagctgggtggctgtgcggacaagctcgaat

SEQ ID NO: 645488 - DNA, 671 bp, Homo sapiens
tcacaattttcttcaagagttttaaactattttatttattaatattttaaattaacacccgtgaatctcccagaaatttccagaatagcgtgctccacactctccctctcccgcggggcacaggaggagagagggaggcaccttcaggggcaacacagagggggggtgggggtgctcgtgcgcggggaagcctcttcgcgaactctccccacaagccgcgccatacgtggcgggggaggctccacaggagagggaaggggtggcgggttgggatccacctcttcagagaggtgaaacccccacaaccacgacccccccgcggcgaagcgggagaggcaatatgaccacatattcaacaagcgcgcgaggcgtgagcgccacccacgccacaacgagccacacaacccggtacaaggaccaccaccacccgggccgaagaccccctcgggggcaccacatacacgtacgaaacgagcgcaagagccccgacacaactgtagcgaccccagccaacacacccccaacctgccccgaagcgaaaacatcaaccccacgcaccccgccgaccccctctgctacaaccaccgtcaccccccagcgacccctcacgccctgcacacacccctcccctctccaaagccaccctaccacgactacccaaacaacaagga

SEQ ID NO: 645489 - DNA, 87 bp, Homo sapiens
  misc_feature (13)..(13): n is a, c, g, or t
tctagaggatccncttcattccaggccttcatgctgtgtatagcttctgcgctacagcctaggcaacgtagctgagaaccatctcag

SEQ ID NO: 645490 - DNA, 194 bp, Homo sapiens
ctcctacgggaacttagcaccaaccttacatcccccgccccatctttccacgcctgcctgttgtgttcaggaggggacactctctcccgcattacgggctgcctgacaccacagcttgtaatagcaggcgctgtctccactgctagagaaacgtacccctggcctgaaggtatcagaggtggcaagacctacaa

SEQ ID NO: 645491 - DNA, 111 bp, Homo sapiens
tgaaagggggtggggaaaaaaaaaaagtgtattcacttaaagatactatatcacgtttggtatatcattaaatctttaacaagaatatgaaataaattcattggttcacag

SEQ ID NO: 645492 - DNA, 184 bp, Homo sapiens
attcgcgtccgcgtcgacaactttggcatcaaaaaccaaataccacatgttctcatttataagtggaagctaagctataggtatgtaaaggcataaagagtgctataatggacattggagactcagaagttgggaaagtgagaggggagtgagggatgaaaaactccctatggaatacaatata

SEQ ID NO: 645493 - DNA, 182 bp, Homo sapiens
tcgaactacctgggctcaaggtctcaccgtcccaaagcactgcgcattacagatgtgagccaccatgccccatcttattagaaggctatgagataggacagtggtgtggtgatatctgagctctagaaagatcattcacaaggcagtgtccaagatggcctagactacagacaaggaacata

SEQ ID NO: 645494 - DNA, 362 bp, Homo sapiens
tgcgagctactctatgagtatccccgtcggcggcagagagaacagtgtcaagcagacttgtggccaccagcgccaagattaggatggcagcaggcactgttcacagagatgtggtctgggcccactggtagttgacggacaaattgctggctgccatggacatgcccttgtgagtaaacagaggacacagaaaagggtatgaacagacctcttttgatagtacggtccatggacatggcctctgtggcacttgggttctgtggacagggcctccattggttgccagtgcagtgttctgtgccttccgtggctgtgggttgagtggtctgtgcctccggtggcttctggtgcagtggtctgtg

SEQ ID NO: 645495 - DNA, 140 bp, Homo sapiens
cccgatggcgcgccagccaagtcctctctatctcttatgctttctatcctctgatctctgcttatcacctctcttgcgttattcaggatctccttccctcctttctcgtccaaatcatgaaatggtttgggcctatagtc

SEQ ID NO: 645496 - DNA, 719 bp, Homo sapiens
gatagtactcacgtggtggctgacggtggtaaaggggtcactgtcgtctgacaaaatgttaatcctaccaggaacgttagtctttcatacgaacatgtaagatgtgactggtgagaattgcttgacatcgctgtagtcgagtagagactatgcctcggagaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcattta

SEQ ID NO: 645497 - DNA, 781 bp, Homo sapiens
  misc_feature (11)..(12): n is a, c, g, or t
  misc_feature (17)..(17): n is a, c, g, or t
  misc_feature (26)..(26): n is a, c, g, or t
  misc_feature (29)..(30): n is a, c, g, or t
  misc_feature (43)..(43): n is a, c, g, or t
  misc_feature (52)..(53): n is a, c, g, or t
  misc_feature (71)..(74): n is a, c, g, or t
  misc_feature (76)..(76): n is a, c, g, or t
  misc_feature (78)..(78): n is a, c, g, or t
  misc_feature (82)..(82): n is a, c, g, or t
  misc_feature (84)..(84): n is a, c, g, or t
  misc_feature (101)..(101): n is a, c, g, or t
  misc_feature (132)..(132): n is a, c, g, or t
  misc_feature (134)..(134): n is a, c, g, or t
  misc_feature (136)..(137): n is a, c, g, or t
  misc_feature (142)..(142): n is a, c, g, or t
  misc_feature (144)..(144): n is a, c, g, or t
  misc_feature (146)..(146): n is a, c, g, or t
  misc_feature (153)..(153): n is a, c, g, or t
  misc_feature (156)..(156): n is a, c, g, or t
  misc_feature (167)..(167): n is a, c, g, or t
  misc_feature (194)..(194): n is a, c, g, or t
  misc_feature (203)..(203): n is a, c, g, or t
  misc_feature (246)..(246): n is a, c, g, or t
  misc_feature (257)..(257): n is a, c, g, or t
  misc_feature (268)..(268): n is a, c, g, or t
  misc_feature (305)..(305): n is a, c, g, or t
  misc_feature (361)..(361): n is a, c, g, or t
  misc_feature (435)..(435): n is a, c, g, or t
cccccaataannccagncaataatgnagnngctcagatgacancagtcccanntgtctaagtcctggtttnnnngnangacnancagaaccagttatgatnacaggtgatagatccaaataattgccacatntntnnacatntngnccatttntcnaccatccttanagaaaatcatatatggggtcacaccantcctcacgntagtccaatagagcaaccatgccatctggattcatgttttcancacataaaganctggtagtttntttgaaattaacaaggatgtgcttgatttgttctgcnagcccctgtcataaaaggttttactctttctggtctctgttcttccaagtttcccntattgattgatttcatgtaatctttgatgtacttcttgtaggcttcttttgtgaaacttgtttcctagcaggtngatggttcatgacacatatcgacaccagtgattactgtgcttttcggtaccttcgccctcggggccttcaacaggaggcattttccacccatgagcgagtcatcaatgttaccttctgtcctactgaccatcttcccctccacctccaggcacaacccgtccgcgatctcccggatcttgtagatgtcggagaacatctcatcgtggctgatgaggtcccggtagataatcatgatggcgactgaagggagacgacgacggcgctagcttagcacgagcctgaaactcggagcgagcgcggtgcaccggagcggcgctcggggggagggggagcgggcggaaaagc

SEQ ID NO: 645498 - DNA, 449 bp, Homo sapiens
tctagagatcccaggttcagcatgtatatgtttgggccccctctccaaaggttcttgtgggacagtgtctaattccagggggcggggggggtgtggagtagtagtggggattaaaaagggccttgggaggggcgggaaggaaatgcctgagaagagggcaagtaggactggaatgggctcaaataggatggctcagggctagggctggcaatacggtagtagtagtgggggcccaggaccaaccctcgctcttgggcgtagtctggcatcttttggggtgtgtggaagaagaggatcgggttggcctcagtgaaatggatttgctcgtaggcttcctcgatgcacccagggatctcatccctgatagggtcgagcaggatgtcattgaaaagggggagctctcggcggggatggacccttggccaggacatttggtgtagttgcctcaa

SEQ ID NO: 645499 - DNA, 841 bp, Homo sapiens
agcggcgtttttccgccgcgtcccccctccccccgagcgccgctccggctgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtggaggggaagatgagtcggtcgggcctgcgcgtgggggagatccgggccgagcgggactcgaggtattcctccgcatcccaccgccatgaggttgtgcaaatcctccccgaacgatcatcctggcggaggagacgctcattatccgggcattgaggattaacatagaaaactggaggcggagctgatcctggaaataggcccgcacgactcgagagacccaatacactcctcccggggtatgtaccgaggacatgactgcttccaggcattaggcagcctggagatccattcacgagatagaacctggtacaccacattacacaagcggaggcatcaacaatgccacgaaacctgggcaacacacagtagtcatggaacgcccagatacgagctaccgggccaacacagaacaacatcatacagcaaggtatacgagcacggaagagaggaaaatcaccgcggtacacaaacgtttaatgccaccaaaaactggtagcaatcaaaatagttgtagaggcaagaaacatacgaaatacttctttatccgtgaactactgggagtgaaaaggtgattaggatggcataagtgtcataatgaaggatacttggttttattaaatgcaatgg

SEQ ID NO: 645500 - DNA, 346 bp, Homo sapiens
agcggcgtttttccgccgcgtcccccctccccccgagcgccgctccggctgcaccgcgctcgctccgagtttcaggctcgtgctaagctagcgagcgagtcatcaatgttaccttctgtcctactgaccatcttcccctccacctccaggcacaacccgtccgcgatctcccggatcttgtagatgtcggagaacatctcatcgtggctgatgaggtcccggtagataatcatgatggcgactgaagggagacgacgacggcgctagcttagcacgagcctgaaactcggagcgagcgcggtgcaccggagcggcgctcggggggagggggagcgggcggaaaagc

SEQ ID NO: 645501 - DNA, 323 bp, Homo sapiens
tttaaccccccccctttttttttttgggggagggcccttctttttccctgcccccccggggggggggtaaggcctgttttttggttcaattttcaggggaaaattttttttgtttttgccccaaggagtttttattgtttgtttttttggaagtggggccttggggccccccccttcccctttttttttcccccccctttgagggttggggggtttttttttccccggggggggggggggggggcccggggtttccttttttcttttttttggccggttttgttcagggggcccccctttttaagaaacataaagagaagtaa

SEQ ID NO: 645502 - DNA, 843 bp, Homo sapiens
agcggcgtttttccgccgcgtcccccctccccccgagcgccgctccggctgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcattta

SEQ ID NO: 645503 - DNA, 119 bp, Homo sapiens
acagaggtcagcttcaggttgtcctccgcattccaggttcagcacatgcaggcaggtctgcggctcaggcagtccaatcacaagtgcgattggacttcagatgggacgcaacatcattc

SEQ ID NO: 645504 - DNA, 369 bp, Homo sapiens
gtcgacgccagaaggaggagccggagagacaagctaacgtgcagaggatgtgccagctgtccagactggatactctctggagtagcaaaaaccaaagggtttcttatagctcttatcaactacaaagaaggctagaaggtagctgggtttaagtcaacaagcttctcaattaagcacgtatcatggcgcgaagcagatcaccgcacctcggggactcagcatccccaaggatatgtggtatagtcctcctaagagccagcacatgaaccggctcagggggcacacgcctttaatcccaacactcgggaaaccgaggcaggcagatctctggaattcgaggccagcctgatctacagagtgaggtcgacg

SEQ ID NO: 645505 - DNA, 931 bp, Homo sapiens
  misc_feature (25)..(25): n is a, c, g, or t
  misc_feature (33)..(33): n is a, c, g, or t
  misc_feature (36)..(36): n is a, c, g, or t
  misc_feature (66)..(66): n is a, c, g, or t
  misc_feature (81)..(81): n is a, c, g, or t
  misc_feature (83)..(83): n is a, c, g, or t
  misc_feature (91)..(92): n is a, c, g, or t
  misc_feature (110)..(110): n is a, c, g, or t
  misc_feature (118)..(118): n is a, c, g, or t
  misc_feature (123)..(123): n is a, c, g, or t
  misc_feature (141)..(141): n is a, c, g, or t
  misc_feature (149)..(149): n is a, c, g, or t
  misc_feature (155)..(156): n is a, c, g, or t
  misc_feature (163)..(164): n is a, c, g, or t
  misc_feature (171)..(171): n is a, c, g, or t
  misc_feature (174)..(177): n is a, c, g, or t
  misc_feature (180)..(180): n is a, c, g, or t
  misc_feature (219)..(219): n is a, c, g, or t
  misc_feature (227)..(228): n is a, c, g, or t
  misc_feature (233)..(233): n is a, c, g, or t
  misc_feature (251)..(251): n is a, c, g, or t
  misc_feature (257)..(257): n is a, c, g, or t
  misc_feature (262)..(262): n is a, c, g, or t
  misc_feature (268)..(268): n is a, c, g, or t
  misc_feature (274)..(274): n is a, c, g, or t
  misc_feature (296)..(296): n is a, c, g, or t
  misc_feature (312)..(312): n is a, c, g, or t
  misc_feature (314)..(314): n is a, c, g, or t
  misc_feature (316)..(316): n is a, c, g, or t
  misc_feature (319)..(319): n is a, c, g, or t
  misc_feature (321)..(322): n is a, c, g, or t
  misc_feature (329)..(329): n is a, c, g, or t
  misc_feature (332)..(332): n is a, c, g, or t
  misc_feature (336)..(336): n is a, c, g, or t
  misc_feature (360)..(360): n is a, c, g, or t
  misc_feature (399)..(399): n is a, c, g, or t
  misc_feature (414)..(414): n is a, c, g, or t
  misc_feature (427)..(427): n is a, c, g, or t
  misc_feature (450)..(450): n is a, c, g, or t
  misc_feature (469)..(469): n is a, c, g, or t
  misc_feature (477)..(477): n is a, c, g, or t
  misc_feature (511)..(511): n is a, c, g, or t
  misc_feature (547)..(547): n is a, c, g, or t
  misc_feature (562)..(562): n is a, c, g, or t
  misc_feature (572)..(572): n is a, c, g, or t
  misc_feature (585)..(585): n is a, c, g, or t
  misc_feature (604)..(604): n is a, c, g, or t
  misc_feature (816)..(816): n is a, c, g, or t
  misc_feature (929)..(929): n is a, c, g, or t
tatgggtatatggtatttttttgtntagatatngangttgaagtttatatattttatatgtaaggntaatttagttactangntgatttannaatttatatttataagtnttagattntttanttattataaatttttgtnaagtagtnttattnntttgttnntttaggnttnnnntanaatatattgttattttttatattttttttttattttttnttacgatnnttgcnagttattttttttttttntaggtnttgtntttttngtttantaatagcacaaattatgagganattattaagtggtatntngnttngnngttgatnttnttanatcaagtgctggtacatttatctnttaaggataaatttaatgaggtacttgatattatgaacngggcggtgttcttcnacgttggtaagtnaggattttattttggatgttctngtttaagttttagattttncacatgtnaatgatatagaattagagttttctggttcctgtnggcagcctaaatcttaggttacacttttgcacatantaacagattcttacnctgctgaatngggtatatggttngctggtattcattgttcangtttattatgactgagagggggattttttctgagtggagactgacttaagctggatttagatgatgttagtctaaccccaggccccgccctcttaaccactgtgctgtgtggccttttaaggctcattcatgcctgagcatgctgcttaggtgacgcatcttacagtgtggagtttggcacgcggtctgacacttggtgattgctcagcctntaatcagccccattttacctgttaaacagtaagatctactttataggctaaaagggagagtgagttcatgcttgtgtatagccttcaataggtggtgtctgtgttgtcaaaanag

SEQ ID NO: 645506 - DNA, 1268 bp, Homo sapiens
agcggcgtttttccgccgcgtcccccctccccccgagcgccgctccggctgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcatttgagagaatgcctttaagtttaatgcataatttaaagctaaattgatcctgtagctgtccctgggcagaagctagagcctgattgtgggctactactcatccaattaaccttctaccaggggacgactacttctgggactggagtataacacaagaattcaaggggttcttggattttgagctctgcactaaacgggaaaggaacatgcttcatagcagctgccacattcttgaatgtgtgaggccttacccttttatcacctacaaggagtccgttacttggcagaagatacccagagatcaagggctccttcgtggcaaaacactccaaagccaacgaaaaaaaaaacttttggggcgcccaagattcaaaattaggggggcccataacatttatccacaaactctccaggtgcc

SEQ ID NO: 645507 - DNA, 130 bp, Homo sapiens
ttacggatagctcgcggactcctcttggtatcgctctacttcatctataggcagatgcttgcttacgacagtgtagatttcgcggtagacacctgtgttattccatcaggttctctaccgcttcttcacg

SEQ ID NO: 645508 - DNA, 1019 bp, Homo sapiens
agcggcgtttttccgccgcgtcccccctccccccgagcgccgctccggctgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcagggttcattttgaaggacacctcactgtgccttttgatatatgctatcacgattgcagtggtagaccacttttgtgtatacctgtagagctgtactgagccctctctttggggctctttctttctagggtagacgaggcccggaaacgagtctgttgtcatcgtgctcctcatatgtataatggtcccacaataccgctcaataccattttatacactagcatgtggtg

SEQ ID NO: 645509 - DNA, 1194 bp, Homo sapiens
agcggcgtttttccgccgcgtcccccctccccccgagcgccgctccggctgcaccgcgctcgctccgagtttcaggctcgtgctaagctagcgccgtcgtcgtctcccttcagtcgccatcatgattatctaccgggacctcatcagccatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcatttgagagaatgcctttaagtttaatgcataatttaaagctaaattgatcctgtagctgtccctgggcagaagctagagcctgattgtgggctactactcatccaattaaccttctaccaggggacgactacttctgggactggagtataacacaagaattcaaggggttcttggattttgagctctgcactaaacgggaaaggaacatgcttcatagcagctgccacattcttgaatgtgtgaggccttacccttttatcacctacaaggagtccgttacttggcagaagatacccagagatcaagggctccttcgtggcaaaacactccaaagccaacgaaaaaaaaaacttttggggcgcccaagattcaaaattaggggggcccataacatttatccacaaactctccaggtgcc

SEQ ID NO: 645510 - DNA, 1140 bp, Homo sapiens
ctctggtgccggctcattgggtggctcgttgggtggcacattgagaggctcttcgggtggctcctggcagcggcgcgtggcacgtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcatttgagagaatgcctttaagtttaatgcataatttaaagctaaattgatcctgtagctgtccctgggcagaagctagagcctgattgtgggctactactcatccaattaaccttctaccaggggacgactacttctgggactggagtataacacaagaattcaaggggttcttggattttgagctctgcactaaacgggaaaggaacatgcttcatagcagctgccacattcttgaatgtgtgaggccttacccttttatcacctacaaggagtccgttacttggcagaagatacccagagatcaagggctccttcgtggcaaaacactccaaagccaacgaaaaaaaaaacttttggggcgcccaagattcaaaattaggggggcccataacatttatccacaaactctccaggtgcc

SEQ ID NO: 645511 - DNA, 1222 bp, Homo sapiens
ctctattttgtggtcgcttgcttcgtcccttttctctctcttttgcttttggtttctgtcatttggtttttcgttttatgtttgctttttctgtgtctcttcgtcttgtttcttcctttcttgttttctcctctttctgctcttgttctttcttttttttttctttgttttctcttcgtttcctctcttgtctctttttttctttttctttttgtgtttttccttttgttgtcctttttgtttttcttgtttctggttgtgttttgttttgtccttttgttgctttttgttttcctttgtttattctacttcattctctccttttttctcttttctttttcttgtttttttttcttttattcgcctggtgttggttttttttgtggccttgttttttgttgttcatgttccttgtgcttggtttgctcttttctattttttcctgtttatgttttgctttttttgtctgttgtttcttttgttgtttgtttctttttcatttctttcgtcttcttctttcccctgcttttcttcgtttgtggtgtgttttttcgctttttattattttgatttgttttttcttcggtgtgtttttgtttctggtttctttttgttcttgtgtctgttttcttgtcatgttttttgttgttttttcgtggtgttcattgtctctgtctagtgttttcctgtttccatgtgtgttgttttcttctgtttgtccctttctcccgtgtttctctttttctctctctatgttttgtttttgctgtctttttgtttcttttgtgtatttttgtgttttctgctccttctcttttctatggttgtttctctgttgtttgttttttatggtcatgtttgtctttggccttttgatttgcctttgtatgtgttttctctatatttgtttgtctctctcctgctgcctcccggcatttccaggtatatcttattggagcctcccccacttggccccggggttcacagtggtattttaataacttgcctcttcttcctcgtgaaacgggctcgggaaaggctgtgtgaggggagagaaagggagagggtgggcctgctgtggacacatggcataactcttttccacgccctaggagaggaggggctcctaaacacgtgtaaacttattgtgtccccgcgtaatttaatttgttgtaaataatttgagtatttttatattgaccaattaaatggagaaaatgga

SEQ ID NO: 645512 - DNA, 150 bp, Homo sapiens
aggatccccctgcaagaatggcattcaggactaggaagccgactaggaacatgattctcagggcgtgatcatcaaaggtgaattagctcttctatcatacgggaagttgcgtcttgtatacctacttgcgctgatatgccattcttgctg

SEQ ID NO: 645513 - DNA, 664 bp, Homo sapiens
agcggcgtttttccgccgcgtcccccctccccccgagcgccgctccggctgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatgactcttgacatcttatggacctgatgatttcataatcccttacctgcacactgtcatgcccccatgctcaggggacacccttctgcaccagcatgttgcaacccctgtctaac

SEQ ID NO: 645514 - DNA, 198 bp, Homo sapiens
  misc_feature (23)..(23): n is a, c, g, or t
  misc_feature (26)..(26): n is a, c, g, or t
tggcaagtggctcctgactgtantcncagtgagcgagatcacaccactgcggtagcacacacctgtagtcctagctactcagaagactgaggcaagagaatcacttaaacccaggaggtgttcatggtgagctgtgatcaaccttctgctctccagcctgggtgacagagcgagattccgtctcaaaaaaaaaaaaaa

SEQ ID NO: 645515 - DNA, 176 bp, Homo sapiens
agctcccatcgctgggtcaatagtacttgccgcagtactcttaacactaggcggctatggtataatacgcctacacactcactctcaaccccctgacaaaacacatagcctaccccttccttacactattcctcatcacccaactcaaaatattaaacacaaactaccacctaccg

SEQ ID NO: 645516 - DNA, 216 bp, Homo sapiens
  misc_feature (137)..(137): n is a, c, g, or t
  misc_feature (141)..(141): n is a, c, g, or t
ttgactctccccagggctgcacggggtttcggggttcaagtgtcgccgagcggggaaaagatcacgcataccggccaggtaacggccgcagcccgccatgcctggaacccaagacatgacggtagcagggagcgcanaagngtgtatgatgaaaaagactacaggagggttcgttttgtagatcgtcagaaagaggtgaatgagaactttgccaaa

SEQ ID NO: 645517 - DNA, 286 bp, Homo sapiens
  misc_feature (43)..(43): n is a, c, g, or t
  misc_feature (48)..(48): n is a, c, g, or t
  misc_feature (84)..(84): n is a, c, g, or t
  misc_feature (114)..(114): n is a, c, g, or t
  misc_feature (195)..(195): n is a, c, g, or t
  misc_feature (219)..(219): n is a, c, g, or t
  misc_feature (242)..(242): n is a, c, g, or t
  misc_feature (275)..(275): n is a, c, g, or t
attcggcacagggcgtagtggggcataagggaatagagcaggncaganataatgttttaaagaggttaatttgggtggggtatngtcgcttacgcttgtaaccccaacactttncgaggccaagccaggcagagtacctgagttctggaactcaagaccagcctcggcaacatggctaaactctgtctttaccanaaatacaaaaattagccaggtatngtggcacgcacctgtaatcccanctattcaggaggctgaagcaggacgatcacctnagcccaggatg

SEQ ID NO: 645518 - DNA, 231 bp, Homo sapiens
cggtcctctctcagtcaggataatagcacagaccgaatgtcgtgaggatgggagagctgctgtatacccgcacatggggattactgtgtctgcttggagaactccctgcttgtacgttctaggaggtgcacgggccagcatagtctcactgaccctgaagagaaagcgttgccctggttattctttcccccccatttgtaatgttccctgatcaggaagtgcagcttgggt

SEQ ID NO: 645519 - DNA, 306 bp, Homo sapiens
aggatctccggaattgtgtggtgttatgggatctattttagctctgataccaaaatgatgcgggacagaaggggattgtagggtttgaggtgggaatttgatggattggagaagaacgggagaattagggtttgagatgagatttgggattccacctaggagtatctcatacccactctccatgaattcatgaggaaagatttaatatatgaccacggatcacaatccaggctttggcttcaccacctattgattcaatcttttagatcaaaatcaacacaaagtttcacataacaccacacaatt

SEQ ID NO: 645520 - DNA, 692 bp, Homo sapiens
ggcgctggcgcggctcctagaaggcatccgtctatttgcttaccagccggctggccgcggtggagcctggctcggttcctcaggcgcccatcaccgccgctcccggcaacccggagcgcgcaccgcaggccgtcggccgagcttcgcgcttcccagccatctactcttccaccgtgctccttagtagaagggacgatgagtgagtcgagctcgatgtccagccagcccttggcctccaagctaggacaaggcacggcactgagcaacgcgtgggccggtggcatggcctgggcaagcgagcctccgaaggagcccagcgaagtgccaacatcctaatatacctcggggccgaccaagggggaagcaacaaacatcgggtgctgccaatacccggaaaaccaccacaactccaggaaggaaacccagagggtgcagtacccaaaaaaactgggacgaaaggaggcgaagaggagggcatctcgcaggagtccctcggaggacggagccagtgacccttgtcgtgccgatctgctccctcacttggagggagcagccttccattctggggactaggacagctttagttccggtcccaagcggccccaggaccctgagtgcaagagccaacaatcaacatttcgcattaatgcaaacacccatgaaatggcaggcttcaacgtaaaaacaagggt

SEQ ID NO: 645521 - DNA, 125 bp, Homo sapiens
ggctagtgaagttgaacatctaatataataactgatttctgtctatggacctgtttatttttactagactgtgtttacatttgattgtagtatatagtaggatatttatcctattgctgaatact

SEQ ID NO: 645522 - DNA, 148 bp, Homo sapiens
tggtgtggattaggagcgcgaggcacatgacctaagtgtgtgctcttcatcacctcgtttaaagaccctatcttcaggccagtcccagaggctcatgcctgtaatcccaggcactatagggaggccaaggcgaggagaatagcttgaa

SEQ ID NO: 645523 - DNA, 174 bp, Homo sapiens
tctagcaggatcccctgcatatccgggagttgatcagcgcccggcttctgatatttcaacaatccgacacactctggtcttcggacgtttcgtctcaaatctcctaggctccggtccccggcatatcgatgagctcctgtccccatctggagacaccacgggcttccttgagct

SEQ ID NO: 645524 - DNA, 541 bp, Homo sapiens
  misc_feature (235)..(235): n is a, c, g, or t
ggagccgcagggccgtaggcagccatggcgcccagccggaatggcatggtcttgaagccccacttccacaaggactggcagcggcgcgtggccacgtggttcaaccagccggcccgtaagatccgcagacgtaaggcccggcaaagccaaggcgcgccgcatcagccccagcgccccgcgtacgggtcccatcctggcccatcgatgcgcttgccccacgagttcggtaccacancgaagggtgcggcgccaggccggcggggcttcaagccccatggacggaggcctcaagggggtgggcccggggcatttccacaaaggaaagggtggcccgggaaccattcctggcatttcttgtgagataccgagagaggcgggaacacagtccacggtagtcccgtgcaggccaaacgtgcagccggctgcaaggagtaccagtccaagactcatcctcttccccaggaagccctcggaccccaagaagggagacagttctgctgaagaactgaaactggccaccagctgaccggaccggtcatgc

SEQ ID NO: 645525 - DNA, 517 bp, Homo sapiens
actaggtcatgcatctgtgagaatctagtgctgccgtgatctgtacatgaggtggggttcagtgtggtaatgctcactcgcctgctgttcacctgtatgatgtagtggcccagttcgtaataggccgtggtcttggtactggtccatggcccagagggtgcggacccctgtactagaccaaataggcctaacatttacggaatatttctctcaactgctgcaggaatacccattctttaccactagcacaatgagacatcatccagaatacaccatattttaggccccagacaagtcgtacaagttcagaagaatagaaatcatattgagtatcttatgattatcatgggatagaactagagatcaataaccggaggaaccttggcacatacacacacacatgggaattaaaacactcttcctgaatgtccagtgggtcaattaagacattacgaaggacatttaaaaaatttattggaggcacatgaaaatgtgaatgtggcatatcaaaatctat

SEQ ID NO: 645526 - DNA, 391 bp, Homo sapiens
gacaactacgcagagttcggctactgctgacgcgcaggcagtaagcctacgggttttagatgggatagcagacaggtggattgcagagctcctgaaagacccagccgggtgtcaaggagagccctcctagtttggcctctaactggctgtgtgaccccaggcaggtcacttgtcctctctgggaagcagctgaataatgaacactgggattttcccaggctggcttctcactgcagagcagaggaaaagcattctgggggcctgctatggagggtcatttatccagtttacaacttccacggccggccctcaatggcttcctttctctcccacaagagcgctgggccaagccagctctgcaccagttggacgccttccaagaaaaactcag

SEQ ID NO: 645527 - DNA, 122 bp, Homo sapiens
tcccacggatgagagattgcacaattccaaacaaagacatctatttggttgcctatctgatcattaggatgtcttgtaaaagttaatgtagaattttagtcaggattccacaaaatgagcac

SEQ ID NO: 645528 - DNA, 197 bp, Homo sapiens
agcggggaacaatcacttgaccaagaggtggaggttgcagtgagccacgatcgcaccactgcactccagccgggacaacagagcgagacggtgtctcaaaagaaaaaaaaagggtctgtagcaaatttttttcaacctaaactgggactcattggtctgaagggataagtgatggttcccggtggggtaccgagctc

SEQ ID NO: 645529 - DNA, 1423 bp, Homo sapiens
gcccttttatttatttcttttttaccaacgacggtttttatttaaaatatactgggaatagggtgaactattacttcgtacagcatttcccttactcacttttataaaactgtttatactagtggtactttgggtattctaacactagctacagatagttctcagctaagcaccagtgctacaaattggcgcattctatacaccacgctataacgggtggtacaaatctcaggtgaccatttatacttatatattctataacacagtggtgtggtgcacaccaatatcaccactataattctcactcgaaattctctgtacactaattcttttataatttcttgtgagccagaatttatacgcaggatggaggggccttacttattacccacactttatacagtgcaacacatagagtggtatcacataacgttctctgtgaatacacccaactatacacatctcgagacacccagctgtggtacattcccatctccaaaaatttctccactctacctccccatacacagagtgcacatcttccccgatatagcgcacatcttagcagcacagctcaccgctccccttcattttacgaaccccactctcccctataagtttccccgtggattaactctacaataatttggggcgcattggggctcacccaggtggcattgggccatatctatggggggactattttatccatttaatacacagtggggcaaactccagtgtgtgggcttgggccactctcccttaccaacatttataggccacgtgctttgccctactagggcgcttcacaacttcagccattctatatttcccaactacagctgtattactcaacggcgcccctccatttggccaatcacccacgtgggccgtggaaaactaattccccacgtaaaatatgtggcgcaccgcacactttggcacccatctaacctccccaactcgcacacgacgccctggcacttaagaacacactcgggcgatcgggacacaaacccacatcacagcgaccaaactgttacagctagagaggctacccacatggaacaacaccgcggcaccataccaggcatacaaggagcgagaagcccccctaacttccgcaaactgcccatagggcgcgggacactacaccacaaacacgcacctcactccacaccaacacccaggagcctaccggcccacccctccgttaagacaggggagccacactcccttcaccaacaggccgcactacaacaacccatagagcccaccacccacagccaaaaaaccgcggccaccacatcacaactacaatagaagaaaatcaaaccacaacacactcacccacggctcccccacaacccgcgaggcagccccaaccaaacagcgccaccaacccgacaaacacacacacgca

SEQ ID NO: 645530 - DNA, 479 bp, Homo sapiens
cccctcctcgagtttaatgtggtcatttcttagactctttccattcttgtacacaggttcttgccttgtcaccatcgaagcagtcaccgagatgaataagcttttgatcttcattttctctgtctatattctcatggtaggctaataggcttttaaatgtgatgttataagcctaagacagcttgacttgcaccagcaagtttttagccctcctcggcaaaccaggtctctttatggacagccgtccagcacttctctacgaaacctgggaaatcatccataacagctttcagttgtctcttttgatgccttgggctctgtatgtcacaagctcatcaagtccagtttgtttcttactctgtctctccctcagatcaagtgtgcatatatcggcatgtaaggtatatgtttcagcgttatactcatgtgtagcgtatgtataaaggacctccagatctgaagcgcatgctcgtgtgcct

SEQ ID NO: 645531 - DNA, 277 bp, Homo sapiens
ggggggggggggggggattttttttttatttgggggggttttttccccccccccttttttggccccccctgtggtggtggggggggggcccccccccaaggggggccgggccccccaggggctttgtttttggggggccccccgcccaaccccccccccggggggttttttggggggcccccccccccccgggggggccctttttttgggtggccccgggggttttttaaaaattttttttttttttttttgaaattaacccccccccgggggggga

SEQ ID NO: 645532 - DNA, 160 bp, Homo sapiens
ggagaccaagatggcaggtggaggccaggcttaccacaacggaatagacctcccgctggggccggtcaggcctggctcagctgccacaggcatatggtggagaggggggtcccttgtccacattgatatgttaacaaactacctctcgcttattacactc

SEQ ID NO: 645533 - DNA, 545 bp, Homo sapiens
gctgtgcggacatcctcaatcttactccttgaccactttccagtgaacaatttttatcttttatttttttttgagaaacgggagttccgctcttgttggcccaggctggagcgcaagggcgtagatcttggctcaccgaaacctctgcctcccaggttcaagcaattctcctgcctcagcctcccgagttagctgggatttacgggcttgcaccaccgcgcccggctaattggtattttagtaaagatggggttctccatgttgaggatggtccgcacagcggcatgtgctgtaggccagcggagctaggaaggagcacaggcttctcccagcccagattgttccccacttaactgctttgccctcttcatcttttttttcccccaatagcttcaggacattcagtacatggtgcttttaagaggttgatgatcccattgcctgagctgccttcacctctctttcttgggaattggccatctttgagctttgtacgtctctgtaacatctctgcatctccttttcacgctggcctacagcacatg

SEQ ID NO: 645534 - DNA, 338 bp, Homo sapiens
actacatacttccgatatataattttttatcttctctttgtcttataccaaacatttctatagcattacatattggaaaacatacttgttagtagctacatgatatagttagggtgttaaatttaaattttccgtaatctcatttttctgtggcctattttgcttatgtttttaaattataaaaatgcactagcaaatatttttgtgcataagtctgtgattttctggatatttccttccagaagactttttttttttttttttttttttttgaaaaaaaatcttttttttttcccccgggtggggggaaagggaaaatttttttttttttttttttt

SEQ ID NO: 645535 - DNA, 263 bp, Homo sapiens
tccaagcgattctcctgcctttctcctgcctcagcctcccaagtagttgagattacaggtacccgccaccatgcccggctaatttttttgtatttttagtagagacggggtttcaccatgttgggcagtctggtcgcgaactcctgatctcaaatgatcggcccgcctcagcctcctaaagtgctggaattacaggtgtgagccaccgtgcctggccaccaggcttaactttaggaattacttcactttccccagccggaatt

SEQ ID NO: 645536 - DNA, 131 bp, Homo sapiens
gatctacgatctcattaagcggcagtgatcatgtgttttgagtgggagaatggaagctaaatggattggctgtgggtggatggatggaggaggcagaatactggaaagaaccaatgggaagaggaagaaga

SEQ ID NO: 645537 - DNA, 588 bp, Homo sapiens
cacggtggctcatgcctgtaatcccagcactttgggaggccaaggcaggcagatcacgaggtcaggacatcgagaccatcctggttaacacgggtgaaaccccgtctctactaaaaaaaaacgtgaaactaagaacaatgtgtgtaataagtcgagacgaaaactcaagtaacatgggactcaaagtctgactggaaaaagtcaaagagcaattactgaattctgacacacagtagctacttgggaacggcaacgctttagcccagggacacggcaacggccccacaagggaaacttaagcgcagggggcaacacccttattgaggaaagcgacgtgttcacaggtgtgacacattagccgcgtgtgggaactgggacaggaggggcagctacaaagttatatggggggtgccccttccagcactcacctcccaagaaggtgtgtcaggcgcccaagccccgagaaaagcagccgtgtcgatagtgggaaagaggacagccttgagctgtagtaagaaaacctcgaggagaccggggtttcgtgtttagcgaaggggttctttgtcagaaaagaagagaaaaaaagcc

SEQ ID NO: 645538 - DNA, 355 bp, Homo sapiens
  misc_feature (128)..(128): n is a, c, g, or t
  misc_feature (201)..(201): n is a, c, g, or t
  misc_feature (297)..(297): n is a, c, g, or t
aggacacgtgcagacagggacggggcgaatcccaggtggagacaatgcgatcacgcctggcactggcgtataccagagcagatggcgtgaatgtatgtcaccggagcactgtggggcgagggcgaaanaacaagtggtgcccaggcatgcgcccggtagaaaggggatcaagtggcctttccctgagtgccaagggaacanaaagaagacctgggaacctggacggggcttgtgcctcagccaagccacatgttgaaatgcctgccagaggaccacagaggtttctgcaacagtcancccacccccaaccctccaccacccagctagccctgacgcaacctcccctgcgtcgacg

SEQ ID NO: 645539 - DNA, 438 bp, Homo sapiens
  misc_feature (36)..(36): n is a, c, g, or t
  misc_feature (45)..(45): n is a, c, g, or t
  misc_feature (49)..(49): n is a, c, g, or t
  misc_feature (82)..(82): n is a, c, g, or t
  misc_feature (90)..(90): n is a, c, g, or t
ggtgatctagcaggatctcttacccgcgtcatcagnccctggggngttncctcgacatgatacgggcttgggctggggttangaaggcantgccctgagcttcagcgcatacgttggcgcaagcgattcgcgcaaggataaaaatgaaagcatgcatgccggctccaaacgcctcaaaggcatgggcgagatcaagtcacgtccgcaattgggggtgagtgccgcctacaacctcggcggtgtgatcatcggcgccaccctggaacatgcgcttgaagaagataaacacaaggaaaccggcaaggcttttacccacctggagttgagcctgggtaccaatctctatgaaggccgctacggctccgtcgatgccgccatcaacagccacttcggtgaccgcaactacctgcaaacctggtacggcgtgactgccgacca

SEQ ID NO: 645540 - DNA, 134 bp, Homo sapiens
gagactagtctctatatatctaagtacagattacaccgcaatgtatgaaagccattgcattatataaactcgtagtgcccagaaaaccaaaaacaataaattagttcctcccactcctacgtgcatctgttcat

SEQ ID NO: 645541 - DNA, 446 bp, Homo sapiens
gagcacgctaccgttagagtaaccagacactctgcaaggccctgcggtaataggcccccgagctggcttcccttctggagcaccatggtagtctggctattgcccgttgcccagtgcaccagcctctcccatctggagagcttttgtgctagctcctcccctctctgtgatgttcctttcagcccctcacaagagtgactccttgctggccttcaggtttcagctcacagaacattttgtcatatcttttctcttgtgacagaggtagctcgaggtgccctgctctgcgtcctccgtctgttcatttccttcacatcccacagcacaatccatgatatggcctcgttgatctactgcctgctgtgttactgcctgccttccccactctccaaggcccagctccatcctggtcaacattctaccctcagaatctatcaaaggtcttt

SEQ ID NO: 645542 - DNA, 292 bp, Homo sapiens
  misc_feature (284)..(284): n is a, c, g, or t
tggccgttttcaaagttatacaactactgcaggcgtatccaatcttgtggtttccctgggccacattagaagaagaatagtctggggccacacgttaaatacacttgacactagagatagctgatgagctaaaaaaaaaaaaaaaaaaattgcaaaacatatctcgcagtgttttataaaagttttacaactttcgcatttgtgccccatttcaaagccgctcctgggcagcattgcagtttcatgggcccaggggttttgatcgagtctacgggataccgagnctcgaatt

SEQ ID NO: 645543 - DNA, 346 bp, Homo sapiens
tttctaaggggggggggggcctggaaaaaatttacccccaaatttttcctaaaaatttgggcggggaaaaaagggaaaaatgggtttttttaaacccccccaaaaagggtctggggggtttttggggtttcctcttaacgggggtaaaaaaaaattttttctatggccgaaatggggtggggggggaaatttttagccccaaaaatttttttctaccccttcctaaaaaaggtttaaaaagggggtttttaccggatttcctttggttttttaaaggggttttggggggggggtaaaaaccaaaaccaaaaccccctttcccataaataaaaaacttgggattcca

SEQ ID NO: 645544 - DNA, 692 bp, Homo sapiens
gtcgctgggctgtttggaaccccttgctggaagctgattctggaagggtgaccctgcctctgtagggtgggatccagcccaacccctcgcactgtctggtctacaaggtaccctcagccagcatgagctctgaagaggtgaagcaggtggagtcgggtacactccggttccagttctcgctgggctcagaagaacacctggatgcacccacggagcctgtcagtgtgccccaaagtggagcggcggccttccaggaaaccacccactgtccccattactgagccctgctcagcagcctagtacctcagagttctctgctgcccctgcatcaactcacctgtcgggaccagggttgtcaatttcccagctggctggactcccctggggtccccgactcagcactgcttggccaggcctacttcacagctagcccatggctctcaggcctccccggcccaggcacaggagttcccgttggaggccggtatctcccacctggaagccgacctgagccagacctccctggatcctggaaacatccattgccgaacagttacaggagctgccgtacacgcctttgcatgcccctattgttgtgggaacccagaacaggagctctgcagggcagcctcgagagcctccaaggatgctcctgcagtcctccggcttcccgagattctggatgcaataaa

SEQ ID NO: 645545 - DNA, 126 bp, Homo sapiens
acggacgtgaactgaacacctccaatgagagccatgttataattgattaacaaagatcatggaaggattcttgaacttttcgtttaaaatcaaacagagcttgtgttagaccatataaatatgtat

SEQ ID NO: 645546 - DNA, 1037 bp, Homo sapiens
  misc_feature (814)..(814): n is a, c, g, or t
agagggtgtatccgcagggccattgttactatgagaaaggccatatcttggggaaacgacgtatacagaggtgggtataaaagcacgtataccccgggtttgccaaagttgcggtccctacaagtttacgatcaagtgcctttggagacagtcacaaacgggatcggcgaccaaagttggtccttatggtatatcatgaagggttgccatcatggaacagggtttgctaccgcgtagcaaatgtgtaacaaaggccacggaagatgattccaaatggtcaaaagttacggtcctggcccgtgtgacacgcctgcgttctatatgccgcgtggataacgcacatagtgccaaatgtaggcgcgggtgcacatggtgtattcagggcgcaaaaggtcgccgaggtatgtgctcgctaggaacaggtgtaggcgacagaggcagaccgtatgtggttccgggaaaaccgtgcgcgtaacagcgctgctgcgcgctgatggtcacgaagtgtgccgcgtacgcgcgctataggagtgacagtggtatagccaactctgagagcaggtttccttcggttgatacttctgatgaggcaagaggatttgcgggttaagcaggcaagaatgcacgccacgtctgtagctagctatgatagtggatgcatatttggtaggataagaattccccatggatgtactcgcaaacgctgacataaggatggacaagaagcctcaaagtaggcccttcgttagccgtctagccgagaggtgagtacggagcagtctaggcttgccagcaaaggtactgttcgaccganacagtactcactaggctaatgggaatgtccaagacatcagaagtgtgagggccaaaccttgctatgcagagttaaaacttttgacaagggaacgaaatctcataactgatccatcagtcatgtagctagctgtagagcttgcaacttaatagcagcagctgccgcaatgcacatgtgaagtaacaaacgtggtgttgtggtatatttcttccccttcagtttt

SEQ ID NO: 645547 - DNA, 330 bp, Homo sapiens
tggctgtgggcgtgcctgtctactgtgtcttgtctcctctggttagcttgggcttgagaacttctgtgttctcttcccattgggtgtaccccgggtgggtggcctgggagatcctgcgtatgtgtgctcagctgtcggcatgtatgtgtgcgtcgtggcggtctccctccttgtgctgtactgggtggccctggtggctactgcagacggcccaacatccagtctttccccaggacagagctaacaagggcccctttgccttctcatcctcaggagttccaggcacatgagtcaccgtccatccacatccagtgtggcctggagctgcta

SEQ ID NO: 645548 - DNA, 229 bp, Homo sapiens
gtgactctgaggatcttcaaacaccgcaatctccacctcctgggtctagggattctttgcctcggtttctgagcagctggaattacaggcgtgtgtcaccaagtccagctaagttttgtgatttagtagagatggggttttgccatgttggccaggccagtcttgaactcttgacctcaagtgatctgcccgccttgcgctcccaaagtgctggaattatgggcatgag

SEQ ID NO: 645549 - DNA, 113 bp, Homo sapiens
ccggaagatggacctctgagggctatatgtgggctcagttacacttcaacataactgaagatactgcttcgataggaccatctaaattcctgacttcttatttattctgtatg

SEQ ID NO: 645550 - DNA, 277 bp, Homo sapiens
tgcggtctcttcagtttcgtccgagccagaaacttctctgggaacaaaatcgtctcagtggtgtacagtaagtctcggcaaatatcgcccagtcgggccgcccctgtcctttgctggggataagcggatggcattctccaggatccaggcgatagatgtcacagtgctcatagtcaaaggttccattccataagtgcttggccagctgaaatgctatctttcgtggggctactgtgacttctttcccatgccatacgtaaacttcactaccagaatc

SEQ ID NO: 645551 - DNA, 384 bp, Homo sapiens
  misc_feature (89)..(89): n is a, c, g, or t
  misc_feature (91)..(91): n is a, c, g, or t
gagccccacagcataaactattcagatggattgaaaacagctgggagacctaacagaaaagactcaaaaggtcactgcttgccaagacngnatgctccaagacctatcaaaggagatagcgagtatgtaactggttaactgcagacatatccctaccagccaggccataggaagcgacatcatcccatacttcatggcataccagtggtcttccctagacaagcaaacactttgtatgccttgtggcagcaggaagtctgtgttctacaaatcatgtcacatatcacatataaggcatacatataaggcatacggcacctgtcttaatgggcttgtctggtccattcagggtaaggaaggggaactctcagaagaggcagaaga

SEQ ID NO: 645552 - DNA, 260 bp, Homo sapiens
tcgagctcggcccgtataatggaaaaaatgcagtggatacagtactaattacatcaatcataaagccagtctccaggagtgcggcaacagatctgtactctatcttaaaaagttgtaataagtaggatacaggaaagttctcaggtactttataaattggagcagagtaaatccaaacgtgaaccacagactgagttaaccaaacagaacccttactgtaactttacagcagtataaagaatttctagtgcccatttcaa

SEQ ID NO: 645553 - DNA, 697 bp, Homo sapiens
agccggcggtccttgcgctccccaacatgcggcgccgtggggcgcggggggctgcctgtctgtggcacatgtccctggtgctcttctgtttctcagtcttcgctgcgaccctcgtctggtgccacactggggcgggctacgatgctgctcatccatgaacgttcctcagcctgtacaggctgaccagatcgacatgcacctgcaaattcgtgtgtgcagcttgttctgcctgaggatgtgtgggccagtacgtgtgacttgcccaatgggcttcgcggtgagcgagctgctgcaaggtgcgcctcgtgcctgctgcagatccagctcactaccctgggaaatcttacaccttcaaggcactgtgtatatctgctgtgatatgcaggaaatggttcagaccagccatcaagtatttatggggatattattagcgtgggcacagagattgttgcacggggcccggattcaagtgaattcctgtcattgtaacagaacaatacccgtaaaggtcttgggagcacggttcaatgacattgatttaacatggtgtaaaacgtgtgtacttccacaagatccaagtttcaattggtataaccagacgtagaagcggcataagcagagattcccggagtcaggagtgttgtatcatttggagtagaactcatgtgtgcgttcaaaaactggcctggagctagtt

SEQ ID NO: 645554 - DNA, 1504 bp, Homo sapiens
  misc_feature (108)..(108): n is a, c, g, or t
  misc_feature (317)..(317): n is a, c, g, or t
  misc_feature (890)..(890): n is a, c, g, or t
ggtagtcctgctccagctgtgtgatcatatttttcgccctggtacgcaagatacgtgggtgggattcagcgcctctggtaatcacaagagtgctgtcccgttgttctnaatgactatagaggaactctcacccccccacgagtggggtggtttctatatcatcaggcagagtagaacgtcctcctctttcttgtgccccaccacacggagagtgttccttctggtgggggagcaagcgcctgtctgtccgccacagaagaaggtgtttctccaccacagacgcaccatcgtgggtccgcacagtgggaaatttcacnccacggggtctaatgttgcgcggcgcgaaatatgatattttccttcgcgacccaagtgcgggcgccccagagtccgcccgccaaatgtgagggggtttcctgccccccccaaagggccgccgcgtgggatgaaccggcgaggaagagtgttcctctctggccgagagaaagcgccgtccccaccatggcgttcccacaagaaggggtctcacaaccccgcaggaatgtgggggccgtccgcctcggtggagccgccgaaggagtcctgtcgttgtgccacagaggcggcgtgtgccaaaacaccgtggggtgcccccaagagggccccccaaatgggttttgggggcccgcttacacactagggtggtttcttcccactccgctttctcgcggggggggaggacccctctgacaacgaagttaccccgctttcacttgccgcccttggagcccctcgggtttttttgggggggccttcgttggcaccctcggggggccacagagttccccaggagacacttggggtgggcccgcccctttggcccccgaattctttgagggcgcgctttttgnccgcccacggtgatccacacgcgcacagcgtcccttcactagaaatttcgagaaagagaggaacccttgggcacaagacacaaaggcttaaaagtgtttgccccgcgcacaggaatctcttcacagagaaacccccctcttgggccacacgtataaacctctgtggtgggcacgggcacaagcccctttccggtgcaccctctgtttggcgtaacaccacagagcgccctccccccttcgtggtgcacagctccacaggcacagctctcgaaggccccccgacccaccacttgcaaggggtcccctgcgtaagttatgccgcccccacccgcccgtggagagttctcgtatcccgcgttcccttatgaacacttcttaccaagaaagcccaagcgtcccctggagagccccgttggcagacttctagactttgcacgattcgctgtaattgggccccagatcacttgttttttcttcgccctccactttgcccccacagatgttctagaggatcactagtgagacctccgtgtcatattcccgcgggtggccccaggctagatcccccgtggttttgtgctccaaaataaaaagacctcagtgaccccatgtta

SEQ ID NO: 645555 - DNA, 324 bp, Homo sapiens
gtgatttttttactagatacatggtgatagcaacgctacctggcaaagtcctcagccacttttggatagcggcttaggtattcgggactgctaccaaccagatcgagatcggcgtgataaatcaccaattcattttttgcgacatcaataccaacagtcggcttggagacgggaactggcattgccatagtgacttcctccgggctaaggttttgagcacttgaagggctcacccagaggcgcaggcttgttcctatcgtcggtcatagccagatgcattctttatcggcgcttgggtgaaaggaggaggggcgaaatctcgta

SEQ ID NO: 645556 - DNA, 156 bp, Homo sapiens
gttataggaacacaagctgttggtggtctctacgcacggacgcgcctaacactttgctttagtgtaagatgaccactcacctctataaggtagggcggaagaatgttcggttagttcctctcctctggccgatatattttttcttctcctcgcacg

SEQ ID NO: 645557 - DNA, 185 bp, Homo sapiens
taatgtgactcggcctagagggtctaaatttagggatctgactgtggtggtgagagaggtgggttattgaaatagaaatctcatcacatagattattcagatctccatgaagtcgtggtcggggatatgcctggggctctagccatctatcagctacagagagccagctaccatcctcagacagg

SEQ ID NO: 645558 - DNA, 1176 bp, Homo sapiens
cgcgtgtccctcgtgggccgccgttcagtagggcgttgccgtctagtgtttggcggtgaacttttcaccggtgctgtcctggccctgttgcgccttagcccgggtgtccaacgccctggttcccctccgtttccccggttgttcgcccccggtccgccggcctggcttggtcccccgaggcttttgagccgcggggccggctccacaccccttggggcgcggatataatcgaccggggtgttttgtccctcgcccactccccggtcgccccacagattggaagaagttctccccgcggcagcgagtgtcctgaggaccgaacttaaggtatgccccttccagggagatggaagtgaaggaagagtttgcaagcgaaacgggttccagttaaatcgattgcgcaaggtcccgacgtgagtattaacctgccccggctggattcatggaagtcatcagccattgaccagacgggagagaatttccctctgatctatgacccccagggtcgctttgctgtgacatcgtatgtaccacctgaggagggccccagggacccaagttgtggcccaagatgaggaaaggattctcttgtgggggcacccaaagggagattccctcccactttctgggtgaactccactgatggcgccgccacccacttccgcgctattcccccgattccctctcactctccaaggtgtaaatgagatacgccaccttcacgagattgagatttatgaagagctgtgcacacgagattatcctgagatttcacatcacacagtgtcgacacaccctgggtaaaccctggtgtattgtgggaactggagaggtgtctatacacctatggagagaaattggggtgatcaccccaccacgagagagggcacccctggagtcttttgaacgtggttcacacgtgagaaagaatgcccaatggccacacgctttgccacactcgaactttccacaccacatgttttgttattggcagggccaccaaccactggatttctcttccccgcaggaaagggtatccccctcacccacttgctgaagagagagacccaaagactggcggcccaaccacgagcacgctgggtgaaaatgggtccctgggtgacatgtcagatctttgtacgtaatttaaaatattgtggccggatttatagccca

SEQ ID NO: 645559 - DNA, 938 bp, Homo sapiens
gagcagcggggtcctgcagcggtggtcggctgtgggtgtggagtttcccagcgcccctcggtccgaccctttgagcgttctgctcccgggccagctacctcgctctcggggccatgagcaaaaccaccaccttcaagggagtcgaccccaaacagcaggaatagctcccggagtttgcggcctccaggtgtggcatccactttttcaattaggtttgatgaaccaaaagaacaaactgtgagtgaaggaacaaaagtggcctctaaatatcttttgggaccacctgaagaacactcaaggcttctgtgtggccaaatgtcaaggccgggtgccaaggtctcagtgggtgcagtgacagacttggagttcactctgactgcagatgaacggacctcctctgaaggcaagctcgggagatttcttagatctgaaaggcagcactggtgctactttcatgaacagttgtggacacaagatttgccagggagccttgggcagattggacaagagaagcccgtgccttgttgcggcttgtgcacagtcgggttgccccggccccatgttgcctcaagaagaatccccgtggggggagttcaaggcctcgatctggagttaacatctagcattgcattgaccgctggcgtcttgtgttgttcctccatggcttggtgacttggccacattgagccttagattgaactctcctggggtctggccataaacaagacgctttattgactggcggtgttttttctttgggagaaagggtccttgcctacatggggttggggcaggagagtggttcacataacattgggcgagacttggcactatttgtttcacaaaaattgtcaactttgaccttggcgggtcacatttgtcgcgtggagcacacaaggtggcccacatcgcgtggtgacctttaatttatagttttg

SEQ ID NO: 645560 - DNA, 243 bp, Homo sapiens
  misc_feature (24)..(24): n is a, c, g, or t
  misc_feature (30)..(30): n is a, c, g, or t
  misc_feature (58)..(58): n is a, c, g, or t
gggatggcgtctcactctgtagtnccagcnactcagggggatggggccagaggatcgnttgagcctaggtgtttgacaccagcctggacaacattgtgagactctgtctcaaaaataataaataacaaaacaaaataaaatatacaatgcattattatttaatacagtcattattctatgcaataaatcactaaagcttatttttcctgtctaactgaaactttgtactctttggatgaactt

SEQ ID NO: 645561 - DNA, 728 bp, Homo sapiens
gagcgggcggcgtagctgagcctgcctgctgatagggtccatcttccagtgaaccgggcgatgaggaagtagagctctgcgcaggagagaggcgacgggtgtaggacacacaagctgagcaggctcggagcgcgcgtggggcgcgcgcgtgtgaacgcaggagcggtacatcgtcccggatgtctctcgcggggccctgtacaggagcccgcgacatatagaccgactcgtcaagcgtccggagagggccctatatccgtctcgacagagtcagcaacgtgttgacatggcgttcaacatatcaagaggtcccgccgcgaaacgggagttacgaatcatacagagctcggaaacggagagggagagcagaatccgagaagataaccggtcttgtcccgctccagacacgtggccacacctaacataagagagtgggtgcaacgcaagcattgataggtcagccagcacaggaacgcgtcaagcacatttaccagcaagagatgcaccaaatcacaaagcgtacaggcacgagccaaaaaccgtgggcacggaccgacgattcggggcaacagacacattgaccgggaacgacggaataggcaccgccgacacacgcaatagcatcgcgttacattcacacgtgcacgcaggccggaacctttgaccacggagcccttcgaagggggcgcagtcactatgccaggcgcacgggtcggagaattctcagc

SEQ ID NO: 645562 - DNA, 379 bp, Homo sapiens
  misc_feature (310)..(310): n is a, c, g, or t
  misc_feature (316)..(316): n is a, c, g, or t
ctaaatttacctcttttaggctgttttaactttggtaagatgccaaaagaggttggatcaaagtttaaatgactgtgctgcccctttcacatcaaaggaactactgacaaccgaaggccgcgcctgcctttcccatctgtctatctatctggctggcagggaaggaaagaacttgcatgtcggtgaaggaagaagtggggtggaagaagtggggtgggacgacagtgaaatctagagtaaaaccaagctggcccaaggtgtcctgcaggctgtaatgcagtttaatcagagtgccatttttttttttgcntaaacntcctctaattattggaatgcacaatttttttaatatgcaaataaaaagtttaaaaacttaaaa

SEQ ID NO: 645563 - DNA, 807 bp, Homo sapiens
acatcctcggccgcgctgccccgaatactcggcgcgggtgcccgggccccgtcgcgctggttgggctttctcgtggaaggcgaccccccgtgcctgctcggccgagccgcaggactgcttgtgaagcgcgacgtgcccttagtgatcctgctgagctctgagtgacatgcacctgatttctaactgcacaatgactttttgaatagatgacccctacaagacactactagacattctatacaatcgttcaatgtgaacgtgtttctcctgctgagaaagccatcttctgatcgaccctgatgatccatcctggtgcaacacaaatgcttggcatgtctgtgcacagtgttatattggatgcctgtacaatcttatgggatgcctgcctgtgaccactgactatcatctgacctaggaacaagacatgaccacgcaccatcctagcttggtccttgaacttcaccgcaccacatggccatacctgctaaggtgccatcatcattgtattatacagccgcaacctggcagttctcgtacctgattgagaacattggccctgtgacttgtggctgagtacgcccacactcgctacttcagggtgcggcatgctgaccaacgctgcgcctcctctttgtgccccacggtccgcctgccgtgacctcatcatcttcctgcacacgctcaacaacatctttgagccacactgtggccgtgagagacgcagccagatgaacatccccaccgtgggcatcgtggacaccattgaacccctgctatacctaccctgtaccggcatgacaaccctca

SEQ ID NO: 645564 - DNA, 157 bp, Homo sapiens
  misc_feature (91)..(91): n is a, c, g, or t
gttatgacttagggtaggaaaggatctcccccctaaaccaagtatgtattcaggcgtttagtatgagtacttctttaaaaaacatttactnttctagcaggtaatataggcaacgaatctgatagacattttacaagtttccaacactccacatcct

SEQ ID NO: 645565 - DNA, 150 bp, Homo sapiens
cttctcctgtagctacagagtggcacaccagcagcatcacatactgagttctaacaacctgtgttggcgcaactgattcctcctttaacccctgttcaacacaatcttcagccatggcattaataacccacttctgcggactttgaatac

SEQ ID NO: 645566 - DNA, 189 bp, Homo sapiens
agacgtcatcttgcatagacgtcattcttgcatctcaattcccatcctaaaaagcactcatacttgatgcatcccagcagcaacttaaaccccagggaggtcagtggaggctgtgcagcttaagtctgtgatccgtgagactcgcggatgcaagacatggactgtctatgccaagacagtggacggggt

SEQ ID NO: 645567 - DNA, 193 bp, Homo sapiens
gtgaatatttcactgcgtcgatacaacccgcggtcgcggtcgcgtattcgagttgatcgccggacatctggacggcttgcgcatcgacagcctgatcgtggaaaagcccaagaccggcccggcattgcgcgaggacaggcgcttctatccggagatgctgggctacctgctcaaattcgtcctacccaaggag

SEQ ID NO: 645568 - DNA, 842 bp, Homo sapiens
gccacttccatttcactcaacttggctgctcagccttctctttgcaaatacgcggagattgacccacgcgcataggatccgtatcaccataaggccgcccatttacaacgatttactagccgctgctgcctcttccgcaccaaggatgtatggacccttgcccttccacttcccagaatgtttcttcttcgccatgacgttttctcctttgggaagatttattaccccaggcctctgtacattcttttcagatcacagaaatcggtgtactgctaatacgtctgcacctaattgttatgcacctgcctaatctgtcacacttttgttaagccttcacttaaatctgtcatagaactagtgatttgcaagattcgcttactagctcaaacgaggtgcaaacaattcctactataagatcttgccgtctacaatgaaagtactagcactagaacaacctttgctagaggatttttcgtgtggcatgcagataccataccttggcgaaatttctctgagcttttaccacttctctatcacgattatagtaccatctgtacacacacgtgatcatttcgtacagatccaaacactatagagctcacaatacgtttctcacagaactctatttctgaactcttggaattcttctcgtttgttctttcatgtttaaaaatgagtgtttttcaatgcatttttatcatgtaagccctgttttttagccaagaatgtagaatatatggtctgtaatatttaaaagcttataacatcttattgttggtaatagtgactttatatttggtctgatagttatttttcaaagttttttcatttatgacacacta

SEQ ID NO: 645569 - DNA, 195 bp, Homo sapiens
  misc_feature (50)..(50): n is a, c, g, or t
ggcccccccgggggggggggccccccccccaaatttggggtttttggggnccccccccaccccccctttgggggggggggggggggcaaaccccccccgggccattttttgggtttccctttttccccggggggccccttttaggggggttttttgggggcccccattttttttaaagggtttccctttttttca

SEQ ID NO: 645570 - DNA, 343 bp, Homo sapiens
  misc_feature (338)..(338): n is a, c, g, or t
  misc_feature (340)..(340): n is a, c, g, or t
tcaaaccgtttttcctctgctgttccactatgacaatcaacagagaagatttctgtgaccaaatatgtggaggcttccgctatatatcaagcagcagacactagctgggtgtcctttaattcaattccattctgatgctatctacctggagatagtggctgatcctgggggttgagggctcagtcctgaaggactgccccctccttcccaccagtcgcaagtccaggcttccaggacttctgatggactagcttcaagttggggttcccctgaccctctctttgggttcaattaatttgcaggagcagctcacagctcagggcacttatatttctggntnggt

SEQ ID NO: 645571 - DNA, 406 bp, Homo sapiens
ggggttaattttccccttgggaaactgggaaatttggggggccgggaaaaatactttttcccccggatttggtttcgccccaagaggggtacccttttttgattcatgttaggctttgaaggggctaaagaaaattttccagggggacaaaggcctgggaccccttgggggaatttaaaatttccattacccctttttttaaaaggggagatggttggaaagaaaaatttccgggggttaaatttggaatggggattggttcttttttttatggaaacccacacataaaaacctccccctttttttggggggataagaaaaattgggcccccctttaatgggccattgtttgcccccttttgtttgtttttcccctttacttgtccaattcccatccccgtttaga

SEQ ID NO: 645572 - DNA, 134 bp, Homo sapiens
gggtccgaaggggccgacagttgggagatggtgtggtcctggaatggaaaaagcatgaagtgaatatgtcttaagcgagccagtcatctgcaagttatgtccgcgggtaactatgtttacagcacagccgggag

SEQ ID NO: 645573 - DNA, 384 bp, Homo sapiens
gggttcaccccattctcctgcctcaagcctccggagtagctgggattacaggcgcccgtcaccaacgcttggctaatttttttgtatttttagtagagacgggatttcaccgtgttagccaggatggtctctatctcctgacctcgtgatctgctccctcggcctccaaaagtgctgggattacaggcgtgagccaccgcgcctagcccattatcagatattttgaagtagctattttgaggtggccattttagtatcagaactttttttctttttctcttttcttttcttttttcttttcttttttttttttttgagacagtcttgctctgttgcccaggctgcagtgtagtggtgtgatcttggcttactgcaacctccgcc

SEQ ID NO: 645574 - DNA, 395 bp, Homo sapiens
cgagttactgaatagcttgacacaagcgtgtgcacacacctagttattatagtatctttagtagagatggggtacatcatgtagccaggctgctcccgaattcctgacctcaagtgatccacccacctcggtctcccaaagtgctgggattacaggcataagccaacacgcccagcacttattcatttatttattgagacagggtctgactctgtcacccaggctggagtgcagtttcagtatcacagctctctgcagccttacactccttggctcaagtgatcctcctgtctcagcctcccacgtagcgggaagcatgggcataagacaccatgcccagatagtcattggatttttgcagaagcagggtctccctaagtagcccgccatatcaa

SEQ ID NO: 645575 - DNA, 470 bp, Homo sapiens
gaggggcccagactcctttttatcaggaacccacctccacattcatgacatcaatgcattcacaagggcggagtcctcacagcctaatcacttctgaatggtcccacctcttaataccatcacggtggcaattaagtttcaacattagttttggagggaatattcaaaccatagcaatatgatagttatgtaaaaaacaattatgatcagagataaatagtgaagtatttatggagaaaatgaccgatgacatgtacacacatacacatatatgtgtgtacatgtatatttatataatgtttaatttaaaataccatagccaaaaatactgtagtaaaaaaaaaactatagcaaaaaaatagcaaaatgttaataactgctgacacagggtagtggttacatggcagttcattatactctttttcctactttaaacatacatgaagtatgtttgaacgtgtctatggcaa

SEQ ID NO: 645576 - DNA, 397 bp, Homo sapiens
aaacctacctgtttactgttctctggatgacagacctcgtggcctcaatccgccctaagtgcagcctgagatggtcaggagcacactaacaggaggctactgcttcacacatagggccccactccagactcagcaggagccaggcactggacaaccagaggggcaggagacactaaaaaggcaccctctgatagctgagtgcccccaggatatccaccccttttgctagtgtctagtaggatagtatggctaggggccttgtgagaaacgagctagaagacgatgggtattagtatttgccccccaagaggtataatgggcaggccagcaaggccagggccactgacggagggaaattttacaaggtaaacatgtatagagaactcccttcaaatag

SEQ ID NO: 645577 - DNA, 331 bp, Homo sapiens
taccacatttgctatgaagcagcaacaccagcagagtgtgattaagaaaaatgtggaacgcgcaaagagaacacatgtggaagagggtggatgctctttatatgtccaagctgtgggcagtgcttttcataaccaccactgtgtggttggagaaaggcctagatgtaatggttgggtcatcattttgaattgtatgcattattatatcaaggaggtagatatcttgcatgaatgctctcttctgcggttatagtgttctctgcgcactcttggtgagaaattgaagtgcatgtgtgaatttatgcacagaggaatatttcttcgtatcttc

SEQ ID NO: 645578 - DNA, 298 bp, Homo sapiens
  misc_feature (138)..(138): n is a, c, g, or t
gggagccttaacctaataaaatgaccctatcatttggaacaagtttaggggcaggccgggtggctcatgctgcgatcccagcacttggggaggctgaggtgggaggatcacggggtcaggagatcgagaccatcctgnctaacacggtgaaaccccgttttttctattcaaaatacaaaaaaattagccgggcgttggtggcggacagctagagtcccagctacttgggaggccgaggcaggagaatggtgtgaatccggaaggcggagtttgcagtaagccaatatcgtgccacttc

SEQ ID NO: 645579 - DNA, 307 bp, Homo sapiens
taaggatccgatatgcgttcaggtacctctctggtcatccctaatgctgccacacttgtaacgctctatgcctgtgagacagcgtacatctgtttctgcaggccgagcatacggtgtgggcaggtttgtgaaatgcaggtcttagagttcaccagttcacttccttttaaaaatgttcactttagagacaggctcttgctctgtcacagaggctggtgtccaggggttgcatcatagctcactgcagcctccaactcctgggctcaagcgatcctcccaactcagcctccatagtagctgggactgc

SEQ ID NO: 645580 - DNA, 144 bp, Homo sapiens
gggcagggttcagaaaggggaaaggaacacgcgggtagataatttctagcaggcaggaagtcctagtagcggtgtacaccatagagcacctaccagctagtactagtagccatatagaatacataaatttagataaaggtaggt

SEQ ID NO: 645581 - DNA, 114 bp, Homo sapiens
tattcacagcgtactttacagtgtctggaacttaaggccaatttgtgctgaatcgaggaaaaacaccaggtctgggggccaattggtgctgacttctcaaagctggatcaaaag

SEQ ID NO: 645582 - DNA, 304 bp, Homo sapiens
  misc_feature (260)..(260): n is a, c, g, or t
  misc_feature (286)..(286): n is a, c, g, or t
tgtttcacgtagacggtctcagttccttcctccatgtcgctggggactctgatgtcttactctcctagctcctttaagtggaatggaaaaaactgaagtgtattcaaattgtgaggggatgcccaggtgatgctcaacaaccacagcttctcttgagggcagaccctgccaaaatagaaaagtgggcactagagtattcaggtagataatagctctttgatatggtctatttatgggggtcctagaaacactgatgggtnggagccaaggtcttcagggaaggttntccagtccatcctattgg

SEQ ID NO: 645583 - DNA, 728 bp, Homo sapiens
gctggagtgcagtagcgcaatctgggctcactgcaagtccgcctcccgggttcacaccattctcctgcctcagcctcccaagtagctgggactacaggcgcccgccaccatgcctggctaatgttttgtaatttttttttttttgtagagacggggtttcactgtgttagccagtatggtctcgatctcctgaccttgtgacccacccgcctcagcctctcaaagtattggggattacaggcgtgagccactgcgtctggcttttcttttggtttttgagacagtctcactctgtcacccaggctggagtgcagtggcacaatcgcggctcactgcaacctccgcctccggggtcctagtgattggcctgcctcagcccctgagtagctgggattacaggtgtgcaccagccacaccgggctagttaggggtttaagtacaagacagggtttgcaccatctaggccaggctggtctcgaactcctgacctcaagtgatccacccgcctgggggctcccaaagtgcgggggataacaggcgttgagcccacggtgccgggccccatattggttctgaggtggacgaatttggatcgtaagagctcctcaggaataatacaccacacgtagctgtccagtgacagatgtgggcctatattggtccaatgaaggcacatcccgtcggggccgaaccagcctgggaagaggccgtttcccgcccggtgtgtg

SEQ ID NO: 645584 - DNA, 402 bp, Homo sapiens
agggtggtggtgtggtgcagggtctgggagtgctgccttctccttgtactctttgtctctccctcagcaagttgtcaggcatttccctggtgctcagccttatgcttgaagtgggaagggtattcccaccctcaggagggacacgcttcacacacctgaagtagatcatcagaagcagactgagcagaaaagaaagggtgcaataattcaaaggggcctaacaagttcaatgggagggctttccaaagacctgctttttcaagtgtgtcctctttctgtgaatgtgggatttttttttttctttccctctctcttccatgcacttgttgtgcaatctggacttgattactgtgcttagggccagtacatgggttagaagaatataattatcagagcttgtta

SEQ ID NO: 645585 - DNA, 125 bp, Homo sapiens
aaaattcacgggctgaatgtcccctttgatgcagtggtagtggctaaatccactgttgagggagtcatatcgctccaaagagaaactggaatgagagctgcagaaagactaattcatttcaccat

SEQ ID NO: 645586 - DNA, 257 bp, Homo sapiens
  misc_feature (34)..(34): n is a, c, g, or t
tcgggtgactctgaggatcgccgggagcccttancctggtgatgtgcggagctcctatgaatagagcatacagttggaggagcgtgggggagagaggaaactgcggtgagctagcatgtctttcttctgacgttatggacttgaatacacctgttcagtctggcatggcagagatagtttagcgctttcaatgggcaaggacagccagctgcctgtcaatgttcacgaggcagaccaggccatctcgagaacttgtg

SEQ ID NO: 645587 - DNA, 674 bp, Homo sapiens
  misc_feature (185)..(185): n is a, c, g, or t
  misc_feature (387)..(387): n is a, c, g, or t
  misc_feature (601)..(601): n is a, c, g, or t
cttttacagggtgcatgtataaaaaaaaaactcctgagtcggtcagaacaacttgttacttatcattattgtataaaaaggaaattagcctttttctttttttggtatatctgtgaaaaatattgctaatagtgcatttaaggagattgtgagacaattcgctgtatggagagagtcagtctttntttctgccaaattattaatggtcctgagtctatgcacctctagcgtggctttttagtacttttgtggttccaaaccagtttattctatggtgctataataagctctcatataatctttgcttcttaaaaactgagtatcattaatatatatgtgctgcaagacttaaaactgtgtccatgataataccatatgaagacatgnatctctaaaaggcaactcaaagatgatggacacgtacttacaagtggtgaccataatttttaggtgaagtcgagcactctaattagagaactggaggaaccacatattacactcatcttcccctaccctgcccttgcccaaaagaaaccatgacaaacctaccttttaaaatatattttaagaaagagaatgaactggggaatttattggcagncaggaatgtgtgcattaacatgctgaggttatgaataaaagtgacttttatatctgaactgcggcccccttaa

SEQ ID NO: 645588 - DNA, 193 bp, Homo sapiens
gtagaaacccccccggagacaactttgaacctccgtgacaaggaatttttcggcgaaggggatgaaaactacatccaggacaggtttaatcttactggactcaatgagcaggtccttaactatcgacaggctctagacatgatcttggacctggagcctgatgaagaactggaagacaaccccaaccagagtg

SEQ ID NO: 645589 - DNA, 781 bp, Homo sapiens
gcccagctaattttgtattttcagtggagacaaggtcaccatgttggtcaggatggtctcgatctcctgaccttgtgatccgcccgcctcggctcccgagggtgctgggattacaggcatgagccactgtgccccgccctttttttttttttgctgtgttacacgggtggaaggtgtcattttgggtcaaattcgacctagatggttggccaaagtgtttctcaaacagcccttgtccaggagaagattcaactcagtgcgtgtccttccctcgtgactggctgagctagtctggtccgtgtcgtttagatctaagaatattttccatatgttcagaaagagggtaagtgtttatataccgtgtggggtgttgaaacaaggtgcggcgagtggcaattcggggtggtttggggcagtgagccgtggccaataagtggtggcacttttaattgtctcgtgggtttcctcaatcctcaagaagatccccttgtgtaggactgaaccagttgtaaacccacccttcttttgccccaataagaagaattaccccacgggggcatattaggttatttcccacattgtcacccgggctgtggcaacctgggttgccggtgtgggtgcttgggtccaaacttcacttttagcaactatttttgtgggaacccaccggtggttccgccgtggtttaaagagaagagaacatactcacgtattagcccccgcaccggcacccacatcagcacattaggcgtgccaagaagtgtaaaccgccccacctggg

SEQ ID NO: 645590 - DNA, 864 bp, Homo sapiens
tattttggatgagacatttttcttactctctataataaatcgtttcttatctatggcattctatagatcaatctcttgtcatgatatatagaggttaagctaaagagtatttcctcttagaagacaggttctataaacgtgaatatctgttgcacactggtcatgctaggaaaaacatttgatgcggcaatgaagatgctctgtaatatacatgtctcaggttatcacaggaaaacacaggagtacgcatgtaccaccaaactttctaaagtcaacaacatggcacacacttcacaggctactgcatctcatgaactcaaggcataacgagaccacgcgcacgcaatctaccccaagaacatgctgatacctcaacagcgactcaccatcccactcgccttccctgcctcgcaacctgaacgatactcaactgctacccatctctatgaccccaccatcatgaacaaaccaatccaccttcagcccccactgccactcctccgctctcaaactcaggacaactccacccacggaccccaccgctgaccccataaccctctcccccaccaaaccagggcccaccaccacccaacccgcagcagacaccgccccgcccccaacacgcacacacccaccccaccctgcccaaccaccgcacccttaaaccccactacccctcaaagctcggcacacccccacacccccaccgcgcaatcgacacacccgaaccccccaccatccctccaccaagcctggaacactagcccgacccaacccaccgaccaccccctcaatctacccaccgacacccacaccctccccccctaccacacacaaaaacaccccaccccgccgcacccccgc

SEQ ID NO: 645591 - DNA, 100 bp, Homo sapiens
ctgctgattaggctgaattgtcttctctagccatgccacactagaatgtctccctccaatgagcctgtgaggttggggctgctttactcggccagtggta

SEQ ID NO: 645592 - DNA, 987 bp, Homo sapiens
ccacgcgtcgacagattcgtcgttatcagaagtcgaccgagctgtctcatccggaagctggccttccagaggttggtgagggagcatcgcagcagagatttgcaaaatgcgactctgagcgttatcacgagccgcatgccatcggtgcgctgcttaggaggttagctgaagcgtactccgtggtgggtcgtgttctgagagtattacccaacccctgttgtgccactcgcgacagcatataggagatgtctaccgattcactgccgccaacacgaacaatcccacggttgcgcgtcgccggcagtacgggggagcagagagcattatcgtgaaaggcagtgttgggatggccgtttattgtactcataattctgtctcatactttggcgttgtaattggtgacctttgtattggtgacgcaaaattgtttagtaatactgttgctttttggtactctaacgctcattccgagtcttgtcagctcgaggatgcatatgcgaataagtgactgtttcaactacgagcctccaggtgatgtgagcagcgtgttgctcaggagtgacgtaggttgcctaatatgcaggaagggatgggtgatacttctggcttctcactgactgtcggtgtttctgtatgttaaatgatcttgtggggtagctattaaggtactagcagtggatatagagtgtgtacacgggtccttttttgcaatgaaatacatggttatgacttgaatccaaagtgtatacacaaattggggcgtgttaacgtgctgaccagtacgtcgcctgttgagtagacatggtgggctttttacaacggggtgaatgaatccatgtcttaaccagcaggtgtactttacaggtttccgttgtaaaaagacaatacgtagacccttggggtgtttaaaaaaccctaatgtccattaatgaagcccttcattttgggcatcccatttcaattaactggttacgttcggaaaaaaaa

SEQ ID NO: 645593 - DNA, 222 bp, Homo sapiens
tgtgatggtcttaacgtatgacacattagtacgcctgttaaatattgcactttactaccaccttagtctacttcatcttcatctccttccccttcttctcctcctccacatttctcctagcaaagaagtatcatcttttcttaacaatattatgacgcaacacatgtatatattttcctattacttgtactactagatgagcattgatgcattttttccaca

SEQ ID NO: 645594 - DNA, 171 bp, Homo sapiens
gggggggggaaaaaaaaaattgcccctttttaaaagcgggtaaaaaacctgggttagggggggggttccccctccaaattttttttttaccccctgggtcatgggcctttggggtgggaagttttttttcccctaagtgccccccaaaaattttttttttttcccctggta

SEQ ID NO: 645595 - DNA, 179 bp, Homo sapiens
catgggtgtcctaccagcatgtgattgataggcgactgccaaaaacactaagactaagaaggataccgaggccgtgcctgtgcacagctggacagtttactgtgattgatgaatgatgtctaggcattaaggcttccccctaaccgtaaggttttgaatgacaagcaaatccaatttgc

SEQ ID NO: 645596 - DNA, 130 bp, Homo sapiens
actattcgcgaagcttagtgctaacctgggactgcctgacttcctttagcctggacccttgctactaccttgaactgtgggatctaacctctctttttctgtttaactctttgctactgccattgaccct

SEQ ID NO: 645597 - DNA, 1185 bp, Homo sapiens
  misc_feature (632)..(632): n is a, c, g, or t
taggtctaggtacgaggctgggttttcgcgccgcctgactgtcgccagcagctcctcgtgcggcccaccgcagccgccgctccctgaggcgcgggaggcccgcgccccgcggctcgctgtgcgtgggagggcgcgatgcgaacgcgggcgaggagcggccgagccgctgaagaggagctgggcgccggccgcccggccgctgctcggcccgcggatcgcctccgcccggtcttcgccggccccggcccctggcgagatgccgtgtggggaggattggctcagccacccgctgggaatcgtgcagggattcttcgcccaaaatggagttaatcctgacttgggagaagaacgtaattgagtattttaaggaaaagctgaaggaaaataatgctcctaagtgggtaccatcactgaacgaagttccccttcattatttgaaacctaatagtttggtgaaatttcgttgcatgattcaggatatgtttgaccctgagttttacatgggagtttatgaaacggttaaccaaaacacaaaagcacatgttcttcatttgggcaacactatagagatgttagcagagttgtgggccctcaacaaagaacttgatttaaactctccacgaaataccacntttggaaaaggacagactttctattgtgtccggttgcctggggaatctacgttgggtaaaaagaagcctatgtaatgcaaaccaagctcgagtcagtccctcaaattctaattcctagtcgccacagaggggcgttttgaacgatctattgcgcattgtgcctaaagccaattagccgaaagaccccatttcggttcccgacaacaggggctgttgcgggggtcccaggcgttgggagccccgctttaacgtgaggtcttctgggcgccggtagcactctaagagtggttatccatagagaggaggaattccactgcgggggagaaagagagcgcccgaagctttataggtgtatcaaattggaggtgtaaaaaaaaaagaagcaattttgtaatattagtaatagagggaggtaagagggaacattataaacataaaaaagccgttatagataaggtgaagtatcacaagagagaagcatccttttttttactgtagtagagaaacaactgcgtgaagaaagtgatgatttaagataggagggtgctaatat

SEQ ID NO: 645598 - DNA, 590 bp, Homo sapiens
agcgggtgtttacagtatatgctcgactgtaatggcattgcagtaggccaaaacaagtccaagctcttaaaatgattggtgcttaatttcaaagcagaaatttaagccaaaacaaacgaaaggaaagcggggaggggaaaacagacctcccactggtgccgtgctgcgtcttcaatgctgactggactgtgttttacctatgcagtgtcagctcctcatgtctggttgtttacctgttcctgttcgtgcttgtaatgctcactttatgtttctctgtataacttgtgattacagggctgttgtcaacagtatacacaaagaattgtgcctctcccaagtccagtgtgactttatcttctgggtggttgctagtgtttcaacagtcactatataatgtggggtgaaatgggagctaggggggtggacaggggaagaaacgacaacacaaaaaagaaaacccaatcctctcactcaccccaaagctcaagttaaatcgcccactccaattttcctccaccagtgtgcttgggcatctctcaatgcaactggccttcagcttcttctgctgcactattgtcactcacatgaac

SEQ ID NO: 645599 - DNA, 812 bp, Homo sapiens
ataatattatacgtagcatttaccatctcacttctaggaatacatagtatatcagctcacaccgctcatgtcctccctactatgcctagaactgaataagtactatcgcgtgtgcattatacgctactctcataaccctcaacgatccactccctcttagccaatattgtgcctattgccatacatagtctttgccgctgcgaagcacgggtggtgctagccctactagtctcaatctccaacacatatggcctatactacgtacataacctataacctacttccaatgctaaaacttaatcgtccctaagccaattatattactaccacttgacatgacttttccatagaaaacaacataatttgaatcaacacgaaacgatccacagtctaattattagcatcatccctctactattttttaaccaagatcaacgaacatacctatttgaggctgttccccaaccttttccgtcgcgacccccctaataacctcccgtcctaatattaactacctttactccgtacccctcacaatcatgacaagccgatgccgattttatccagctggaaccattattcacgagaaaatgacttctacctcgtcgtattactaatctcgcctacgaaatctcctttaattatttacgattcacagcgccaccggaaacggaatgcatattctgtattatctgtgcttcgaaaaagccactgacttattccgccaccttgggctatcatcaacccggatgagaggcaacccgggccgaaagccttggaaagcctggcaccgttccttccttattcctaag

SEQ ID NO: 645600 - DNA, 104 bp, Homo sapiens
tgtcgtgtgtgccattccttgcagagcgtgggttccttgcagaggcagaggaagctccctgaggagcacgccaggttctatgcggtcgagatctgtatcgcagg

SEQ ID NO: 645601 - DNA, 336 bp, Homo sapiens
agagaatccaaccacttcctcatgcgacgagaccatcatgtcagtaggtggaggtcagctggtacttcttttacagagcagggtggcacaaaacgaccacccaggtaatggtagcgaccggtaaactgggttgcagatttgtggggggcttagtgagggagatgagcaatgtctggctggatccctccatcatctcccttctccacgtcccatcctgaggtaatgtcgatgctggcaatggcgcacagtgagtcccttcaggacactcaggatgctgtggaacggttcacgaacgtcgcccttgatgctgacgccaaagacgaagcactccctggt

SEQ ID NO: 645602 - DNA, 111 bp, Homo sapiens
  misc_feature (11)..(11): n is a, c, g, or t
gagctagaagngtgatcctgttagaaggctagatttgcattgcaggcatcagccaagagactacccctttgaatgccccatatatgtgcacgcagaagcatctcttatcgc

SEQ ID NO: 645603 - DNA, 139 bp, Homo sapiens
  misc_feature (36)..(36): n is a, c, g, or t
  misc_feature (112)..(112): n is a, c, g, or t
gtctacgatcgagctcggtaccgaattcgaaagtgngcacagccttggactgccagccactactcatgttcaaaactcaggtgtcagcttcccctgaggggctaggtctgcntccttggtacagaagcttgtcgagatt

SEQ ID NO: 645604 - DNA, 995 bp, Homo sapiens
  misc_feature (44)..(44): n is a, c, g, or t
  misc_feature (98)..(98): n is a, c, g, or t
  misc_feature (243)..(243): n is a, c, g, or t
  misc_feature (482)..(482): n is a, c, g, or t
  misc_feature (485)..(485): n is a, c, g, or t
  misc_feature (488)..(488): n is a, c, g, or t
  misc_feature (490)..(491): n is a, c, g, or t
  misc_feature (494)..(494): n is a, c, g, or t
  misc_feature (501)..(501): n is a, c, g, or t
  misc_feature (506)..(506): n is a, c, g, or t
  misc_feature (508)..(508): n is a, c, g, or t
  misc_feature (515)..(515): n is a, c, g, or t
  misc_feature (518)..(518): n is a, c, g, or t
  misc_feature (520)..(520): n is a, c, g, or t
  misc_feature (584)..(584): n is a, c, g, or t
  misc_feature (587)..(587): n is a, c, g, or t
  misc_feature (599)..(599): n is a, c, g, or t
  misc_feature (604)..(604): n is a, c, g, or t
  misc_feature (615)..(615): n is a, c, g, or t
  misc_feature (618)..(618): n is a, c, g, or t
  misc_feature (621)..(621): n is a, c, g, or t
  misc_feature (636)..(636): n is a, c, g, or t
  misc_feature (638)..(638): n is a, c, g, or t
  misc_feature (642)..(643): n is a, c, g, or t
  misc_feature (645)..(645): n is a, c, g, or t
  misc_feature (653)..(654): n is a, c, g, or t
  misc_feature (656)..(666): n is a, c, g, or t
  misc_feature (690)..(690): n is a, c, g, or t
  misc_feature (733)..(733): n is a, c, g, or t
  misc_feature (762)..(762): n is a, c, g, or t
  misc_feature (778)..(778): n is a, c, g, or t
  misc_feature (782)..(782): n is a, c, g, or t
  misc_feature (815)..(815): n is a, c, g, or t
  misc_feature (819)..(819): n is a, c, g, or t
  misc_feature (821)..(821): n is a, c, g, or t
  misc_feature (823)..(823): n is a, c, g, or t
  misc_feature (830)..(830): n is a, c, g, or t
  misc_feature (855)..(855): n is a, c, g, or t
tcacgggccccctgttttgcatctttggcgattccctgtcaggncctctgccctactaggctgtaaactcagggagagcacagtctggctgtgctgcnaaacctctcctctgctgcagtttattccaaaacaggagccccctggctgtcagtgcacaataataaacacacatttcttcaacgttccattcctaggtgattttcacatttttagttcctcagcatattttattgctgtgtgttnacacaatctggtataaaaaactttctctggattcagaggaagtttgaggaatcaggagaggaccaggccttctcctgtgcctgggtgaaggtacagacctcgctgtgtctccgatgaggtcagaagtgtctctatttcataccacaaaggaacccaagtgggagtagggaacagatggatggcgcgaagacccctgtgaccccccagagaaaggaagaaacttaagaaccaccaaagcnaanacnannaanatcaaanaaaanangtttacnaananaaaagcctgtgttttcagaaactctgaattcagaaaaagaaacggaatgtgcgtaagaaacagnccnccgcccggaaanacccncccccaacccntanccngaggcccagagaagnanacanncngaaacaanncnnnnnnnnnnnccagggaataagggaaccctttanaacctgtccagtgctgtcatctgggatttttctctgaagtacnagaatttcaggtgatttaagctgcttgancacacttatttgtgcnaaantgattttcatttaatgttaatgttttcctgctnaatntnanataactncagaatgtaaagagcttcaaagtanaattacaaggtgtttaacctggggagttaaatgtgtacacttgaattaataggagcacccggttgttgctagtataaagtaatttgtgtggcagtttgtactgtgctgagtttttaaaataaaccccatattttaaagta

SEQ ID NO: 645605 - DNA, 505 bp, Homo sapiens
  misc_feature (6)..(6): n is a, c, g, or t
  misc_feature (10)..(10): n is a, c, g, or t
  misc_feature (21)..(21): n is a, c, g, or t
  misc_feature (34)..(34): n is a, c, g, or t
  misc_feature (52)..(52): n is a, c, g, or t
  misc_feature (66)..(66): n is a, c, g, or t
  misc_feature (76)..(76): n is a, c, g, or t
  misc_feature (84)..(84): n is a, c, g, or t
  misc_feature (87)..(87): n is a, c, g, or t
  misc_feature (136)..(136): n is a, c, g, or t
  misc_feature (411)..(411): n is a, c, g, or t
  misc_feature (489)..(489): n is a, c, g, or t
gacatnaatngcatgaccgantttcaggttcatngcatctggggggcccgancgcgcatggacttnaaaagtatgntgataggntcnacgaccgtgtccgcgcgttaactttcagaccgagcgcctgcggtcaaangtcgcggacttgtggacgatcacgcgcagctcttgcgcctgttcggcgtcagttttggcatcagcatagcaaccggtgtggatctcgataaacggtgcgccaacctctgccgcagctttgatctgctcttcatcggcgtcaataaacagagaaacctgaatcccggcatctgccagacgtttgcaggcatcgcgcattttgtcacgctgccctgcgacatccaggccgccttcggttgttacttcctgacgcttttccggtaccaggcagcaaanatgtggcttcgtctcaacggcgatcgccagcatctcttcggtcaccgtccatctccagatttcatgcgggtatccagncgtctgacgcaggatg

SEQ ID NO: 645606 - DNA, 788 bp, Homo sapiens
  misc_feature (570)..(570): n is a, c, g, or t
gaaggtcgtgaaaaaaaaggtcttggtgaggtgccgccagttgtgcatctgtcctcattactgcatgcgccctttacgcagtagcttccagtagcggtatgttgggtcagagcatccggagagttcacaatatctctgatgggtgtgatatgagagatattgatgaggagggccctgggaagagattttgccatttatcagtggaaaacaagtggtcgttattagctatgatgtgtgtgtactgtaggatctgcattagctacgagtccttccttgtatgtaaggagagctcagagtgtgttaaatacaataaggatgtttcagttgctttcatttagaagattatgaagagcgattttacagaggtgcagactcatgtgaacgtggatcaagagctagaattcatatgtccaatattagatatgtttgtcaatatacttgatgaagtcgaaaaagataagtaggtgattaaaataatatgaaggcgagctggtaagggagagataaacgtatggtgatcaaagagcgggagagcgatgacgcagggtagaattgccgtcgtttacaagncgtagttaaagggatattacttgagaacgcagacgagggtgtggattgattacctctggtgaggtggggcaggatgaggcaactgggggttttgatagaaagttcgaaggtggaacttggggacagaagggggtggatggcgaagggaaccaatggaggacgatattggaaataagacgcgcgggtggtttaaaaaagtattatcgaagtgaggaaaa

SEQ ID NO: 645607 - DNA, 877 bp, Homo sapiens
  misc_feature (48)..(48): n is a, c, g, or t
  misc_feature (101)..(101): n is a, c, g, or t
  misc_feature (111)..(111): n is a, c, g, or t
  misc_feature (144)..(144): n is a, c, g, or t
  misc_feature (149)..(149): n is a, c, g, or t
  misc_feature (153)..(153): n is a, c, g, or t
  misc_feature (167)..(167): n is a, c, g, or t
  misc_feature (169)..(169): n is a, c, g, or t
  misc_feature (229)..(229): n is a, c, g, or t
  misc_feature (273)..(273): n is a, c, g, or t
  misc_feature (288)..(288): n is a, c, g, or t
  misc_feature (292)..(292): n is a, c, g, or t
  misc_feature (406)..(406): n is a, c, g, or t
  misc_feature (423)..(423): n is a, c, g, or t
  misc_feature (461)..(461): n is a, c, g, or t
  misc_feature (750)..(750): n is a, c, g, or t
  misc_feature (771)..(771): n is a, c, g, or t
  misc_feature (779)..(779): n is a, c, g, or t
  misc_feature (784)..(784): n is a, c, g, or t
  misc_feature (789)..(789): n is a, c, g, or t
  misc_feature (858)..(858): n is a, c, g, or t
tgtaatttttcaaaaaaagtaaaagctggtttatcctaaactattttncttgtggtagtagagattagtgggtcagaaaaaactcctgaccacttggtttnattttgaggngcgtaattaggaggaaatctgtaaaaatagcanaggtntccngctgttccactggntnacccacatgattaggagagtggaagaaaaaataaaaattctattaaagaatcatgctganaaaaagataagagaggttgtgaaattggaaaatagatagatggngggggggtgggggantggngttttccaaaggggtcccaacaccatctctcctctgatttttgtgaaaaatgtggaaagctacttgcttggaggtaatgggggaaatgatgggggaatttttattctgttaggnactttgctttttatttntgtgtttttgttttgctccctggagatggatggataanggagggggccacagttagctggggcagcaggtactccctacgggactagtttaaagggggaaggacgctctgtgctggcagcggtggctcacatggcctgtctgcactgtaaccacaggctgggatgtagccaggacttggtctccttggaagaaaggtctgatgtttggccaatccagtttttagaccctgcctgaaacttgtatcttacgtgaacttaaagaataaaatgcatttctaccccgatctcgcccccaggactggcacgacaggcccacggcagattagntcttttcccagtactgatcgntgcgtggnattcngccancacttctgattcgatttcacagtgatcctgtcctctgagtattttaaagaagccattgtcaccccagtnagtgttccaggagttggca

SEQ ID NO: 645608 - DNA, 956 bp, Homo sapiens
agcttcttcgatcccgccggaggaggagagcccatctataacaacacctatactgattaacgttcaccctgatcgtaatatctgatcctaccgaggcttctgacaatgctctcccgaatatggtaagttggtactactcctgtgtaatatcacagacatctatattggctcgctaagagtattgggtctggagctattcgcatcctcaaatctgacttgccgaagggttcatagtgttgtgagcaccatcgctatcatatcacacgggacagggaatagacggatacacccacacgtagcatatgtcaacgcgtcccggtaccagtattctatctcttatcccaaccggatgtcgatattattataagctgatctccgcacaaaatcttcggaacggtaagggcatgtgttgtcatgtgtcttgctggcggtgcctcagagcccctaggtatttcatcattatatgtattctaccgttagcgttgcgcccctggcccttgtaacattgtgttgataagactgatacgttcacttcagcataatgaatgcctctgtgatcttaacatctgacaagagttacttacccgtagatatgtgtcacttatctatctattgtccttagtccaatacgggcgcgtggtattttctgccatacagtatggcagggcgtccatccagcttgatttgccgccgtatgctcaaggttaggacccgttagatcaaggcctacggcccaaattttatttcccttagtgcatatttctggggcggaaatcgtaacttttcatcccaccacgaatttgctcggctgagtcggatgcccgggggtgcctgcggctaccccgaatggttacccagatgaaaagtcctgtagctggtggggcagttaccgtcccatacacgcggggctcacacatcaagatggaagcttctttgtaggcgcgacgctaatatat

SEQ ID NO: 645609 - DNA, 1012 bp, Homo sapiens
ttgaaatccagcctgggctacagagcgagactctacctcaaaaaaaaaaaaaaaaaaaaaaaaaaaaagggaaaaaaaaaatccacccgtggttatttattttcaaattctgggagtggccctaattttttaaattccattaaggggtggagaagggaattgggattaagaacgcaactttttctggcaggggattagaaccaattggggggtgggcgaaccttgcaccggaggggtccctttgccttacccttagggccacttgcacaccttcttatcgccttgtgcagtggggagaagccccattcgagggtacaaaaaaacggctggattcccttcgggagggagggagggtgggaaccaaggtgtggcaaccaaggcggtttatctatcaaagagacgttgggtgcgaaaaccttctttcgagagggcccaacaataccttttagtgtctcaaacaatcccctttggctttggacgcacgcacttggggcgagtgtctcttggttggacgccccacaaagggcggcagggggcacaacctatttaggggagagcgcccaagaaaggagaggtgtggttggtcgcttgggaaaaaagagactatctcgctgtggagaggggtggtttctggtcgagacaccatttattcttgcgcaagaaacgcttttttccaaaaagactttcgctttgcaattttccagaaccccaaaaaattcagggctgtgtaacaggtcagaaccgcaggggccaatctcgcacaaaagaaagggagaacccaagaacccaagggggggtgctacacgatgggggggcgctatacgagacccagtgtgaagcggcgctgcgctaatacagcagggggcgcttgggggccttctctttttggggccacattttgggacctctgtgggggccccccttctcataaaactcgagagatgggtctttggtacaaccatttccatttagggcgaggggatgaaatttcccacaaaataatttgaaacag

SEQ ID NO: 645610 - DNA, 169 bp, Homo sapiens
  misc_feature (42)..(42): n is a, c, g, or t
tcatcacatatgtgctgaaggacaagcagacagagaaacaantgtgaacaactgagcagtagcctttgaacacccttcttctcttgccacggtctattcggcagatactactggacacttactatgtatcatgcaaataatttctgctggagggatgagggtttgatga

SEQ ID NO: 645611 - DNA, 175 bp, Homo sapiens
atctagttaacatatatgcattcagtgtaataaataatcctctactcactgctttcatttcatctcacaaattttaatgttgcataattcatatatatcattataggctacaaatatttttatatatctctagcagatttctatctattgctaccatgcagtatatagtacgact

SEQ ID NO: 645612 - DNA, 242 bp, Homo sapiens
gtccgcttcttggcaaaagtagcttttgaactgatataaaaaaaaatgctgagtaacagaaaagtattaatgtgcttgacaaacaagatcatagtatttcagtcatggtgtcaagcacattaatacttttctgttactcaataaaaagcagctatctgtgaaccaggtaactgtgtgttttggaagatctgtttattaacagtaaataaataagccctgtacagaacacaggcactaggttg

SEQ ID NO: 645613 - DNA, 276 bp, Homo sapiens
tgatctacaggatccttaagctttggtcaggaactgggtttggcctgtaagccatatttgacaacctctgcattagaaggtgcaatgtaggctaggtgcactggctcatgcctgtaatcctagcactttgggaggccaaggcgggtggatcacgaggtcaggagatcaagaccatcctggccaacatggtgaaaccccatctctactaaaaatacaaaaattagctgggtgtggtggtgtgcacctgtagtcccagctacttgggaggctgaggca

SEQ ID NO: 645614 - DNA, 355 bp, Homo sapiens
ttgggttacaacctcagcttgagagatctgctctggcatttatacttcctaaaatagagaatttgagtgaatgaggtggccaccatccaaatgaagtgcctcaactgggaagagattcatgccaacctgctagggcatggtgtttagcctttcttatatttagtcaattcatgggctcatcatttggggtgaggtcatcaggatggtgccactcaattcacttggcaagagccacagcaactgatgtaggaagaagcctgttggagtttcttttactaaagggcacctgggggccaaggatacatggagtcttcatgaattaatgaatgaagcccctcaactggctcagtataaa

SEQ ID NO: 645615 - DNA, 2675 bp, Homo sapiens
  misc_feature (6)..(6): n is a, c, g, or t
  misc_feature (13)..(13): n is a, c, g, or t
  misc_feature (15)..(15): n is a, c, g, or t
  misc_feature (18)..(18): n is a, c, g, or t
  misc_feature (21)..(21): n is a, c, g, or t
  misc_feature (24)..(25): n is a, c, g, or t
ggctgntacgacngnganttnggnntcggggcgctggcgggcggggcggggtctgtagttagcggcgagagtgacaggaggacaggggttgtttcggcagtgacgcctggggagtgacgcaattgcacccctgtgcagtgatgtcacggcaggcttatggaagaagaaccagtgtcagatttcgcagttcaggaatgactttagacaatatcagtcgggcagctgtggatcgaataatccgggtggatcatgcaggcgaatatggagcaaaccgcatctatgccgggcagatggctgtcctgggtcggaccagcgtcgggccagtcattcagaaaatgtgggatcaagaaaaggaccatttgaaaaagttcaatgagttgatggttatgttcagggtccggccaacagttctgatgcccttgtggaacgtgctggggtttgcactgggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttcagctgataaagaaatttcgggatgaagagcttgagcaccatgacataggcctcgaccatgatgcagaattggctccagcctatgccgtcctgaagagcattatccaggccggatgcagagtggcgatatatttatcagaaagattataaagtgtgtccagttttgcctgtctataaaagatgatagtaatttaccaagtgacatttgcagagaaacaggtgtacagttatcgttgtacttttgtacaatgtgaattttgttaataaattataaggtttgtttttttttttaaactctgcagtgttgatttttctctgggttgttttttctgccatgagaccaacaggtcaccagccttgttcaagttacagcaaacgaagctgggccttgtttggtctcatacttaattttcttttatatacatgtttttcttttacatgcatatatatatattttattttattttatgttttttggagacagggcctcgctcttttgtccaggccgggtcacaactcactgcagcctggacctcctagcctcaagcaatccacccacctcagccttccaagtagctgggactacaggtgtgcaccaccacagctggctaattctatttttttatagaggcgaagtctcactatgtcgccaggctggtctctaactcctgggctcagtgatcctcccgtttcgacttcccaaagtgctgggattacaggtgtgagccacttcaccaggcccattttctcctaaaacttcaaggacaaatcattaataatgtaacaggaatctttaggagaaaaaacaatttggtttactgataacaaaagataattggaaacatgagagtatttgagattggccaagcagaactatgaagtccatcaagtaagtcaaagatcatcgtttctgttttgaattgtgggtgataatgggtgggagagtgctacagtctgtatgtctgtgtctccctagaattcatacgatgaaatcttcactctcaagttgatagaaggtggggcccttgggaagtgtgaggtcatgagagtggagccctcatgaatgggatcagtgccttatgaaaggccctagagagatacctcatcctctccacagtgtgagacttcaaggggaagtatgagacttctctgaggaagcagacccttcacaagcaaaatcagccagcactttgatcacggacttcccagcctctaggactgtgagcaataaatgtttgatgtttataagccacccagactgtggtattttgttatagcagcctgaacagactaagacgggggtgttgcttccatcaaaggatgtactaagttgtggattatttgtgaaattgaattacaaccttttccttaaggtcttttaccacctcccccccaaaaaaatcccccaaaactgattcagattttcatactttaatgaaatattttataatttgcaaatttttaagtaatttatgaaaaacctagatcagtggatctcctctctggctgcccattagaatgtcctgtggagattaaacttttttttttcagtttatggaccaagagttttgatttatttagggtggagttcaggatcagaatggtttcagaagctcccaggtgattccggagtgagttggagctgcaagcccctgagctagattataagatgcttctgggaaagaaccacattttaggaatttgcttcccacccagtgccctgcatttaatcagcacctgatgacttggcaggacttgccccaccagggtctggctttgaagggtagtggacaccaggatcctttggattaatcctctgccacctctctcttttcctcaaccgagagtgaatttatgtaattgagtgaaagtctacgaatcataattgtaataaattaaggctgggcatttgtttgaaattagataggataaagccaaaggtttgaacaagttgtggatggtttgtaaaaattaatcttacaaaataaatgctgtgtgtgaacacgttgattaaattcaaaagggtattatttggtttttctgtaaattgaaccttgaaataaaagcacaacaaggttttcttaaaaaaaa

SEQ ID NO: 645616 - DNA, 3999 bp, Homo sapiens
  misc_feature (864)..(864): n is a, c, g, or t
  misc_feature (873)..(873): n is a, c, g, or t
  misc_feature (907)..(907): n is a, c, g, or t
  misc_feature (967)..(967): n is a, c, g, or t
  misc_feature (992)..(992): n is a, c, g, or t
  misc_feature (994)..(994): n is a, c, g, or t
  misc_feature (997)..(997): n is a, c, g, or t
  misc_feature (1001)..(1001): n is a, c, g, or t
  misc_feature (1013)..(1013): n is a, c, g, or t
  misc_feature (1017)..(1017): n is a, c, g, or t
  misc_feature (1036)..(1036): n is a, c, g, or t
  misc_feature (1043)..(1043): n is a, c, g, or t
  misc_feature (1046)..(1046): n is a, c, g, or t
  misc_feature (1052)..(1052): n is a, c, g, or t
  misc_feature (1054)..(1054): n is a, c, g, or t
  misc_feature (1061)..(1061): n is a, c, g, or t
  misc_feature (1070)..(1070): n is a, c, g, or t
  misc_feature (1072)..(1072): n is a, c, g, or t
  misc_feature (1076)..(1076): n is a, c, g, or t
  misc_feature (1078)..(1078): n is a, c, g, or t
  misc_feature (1087)..(1087): n is a, c, g, or t
  misc_feature (1092)..(1092): n is a, c, g, or t
ctggactcatttacttttacagttatatcatagacttgctttctggcactggtttcctggaggaaactagcctcttttacggacattacaccattgatgaggtgaaatttcagaacttcacctatgatctgcccctggcgtatttgttaagcacaatcgcctccctggccctgagccttctttggatagtgaaaaggtcggtggaaggattcaaaatcaacctgattcggagtgaggagcactttcagagttactgcaacaagatatttgccggctgggacttctgcatcactaaccgcagcatggcggatctgaagcacagcagcttgcggtacgagctccgagcagatctggaggaagaaagaatgcggcagaaaatagcagaaaggacctcagaagaaacaatacgcatttactctttgagactgtttttgaactgtattgttctggctgttttaggggcatgcttttatgcaatatacgtagcaactgtcttctcgcaagagcacatgaaaaaggaaatcgacaagatggtttttggagagaacctcttcatattgtatctaccgtctattgtgatcacgctggccaattttatcaccccaatgatctttgccaagatcatccgctatgaggattattctccaggctttgagatccgtctgacaatccttaggtgtgtctttatgcggctggccaccatatgtgtcctggtgttcacgctgggctccaagatcacatcctgtgatgatgacacatgtgacctttgcggctacaaccagaaactctacccggtgagttgcggcgcggtggcgttcggctgtatgggtccttctggaatacagtgctggtcaagagaacagnggttgaagncatgggtttgaactgcatttgcttcgtttcttgntctaggatgagacagagtctggccccatggagtctaaccccaggcacttctgagggcttngaaaccaaggtctgtgctgaggctnanagnttgnatcagctgatgncctnactggagccacaggatctngagttgnggnaattanangtgtctngggagcctngntttntntgcctgctngggtntttcagtttccctcactctctttgatttcagtgctgggagacccaagttgggcaggaaatgtacaagctgatgatcttcgacttcatcatcatcttggctgtgacactcttcgtggattttcctagaaagctcctggtgacctactgttcctcttgcaagctgattcagtgctgggggcagcaggagtttgccattcctgataacgtcctggggatagtttacgggcaaaccatctgctggatcggagcctttttctcaccccttctccctgcaattgcaaccctgaaattcattatcatcttctatgtgaaagagtggagtctgctttacacctgcagaccctcccccaggccgttcagagcatccaattctaatttcttcttcctgttggtgttgttgatcgggctgtgtttggcaataatacctctgacaatcagcatatcacgcatcccttcctcgaaagcctgtgggccgttcaccaacttcaacaccacctgggaggtcatccccaagacggtgagcaccttccccagctcgctgcagtccttcatccatggtgtcacatccgaagcctttgcagttcctttcttcatgattatttgcctcatcatgttttacttcattgccttagctggagcacacaaacgggtggtcatccagctccgagagcagctatccctggaaagtcgtgacaagtgctacctaatccagaaactaacagaagcccaaagggacatgaggaactaactagactgagcgtgaagatggtgctgcctgttgcttctaagctgacctagtgattctgctgagcctacagagtctacctgggttttgagtggacatttaaaaatatatttttcttgagtttaggcttttccatatgtgcagctgtgtttacctaacccagcccttaattagggcttcagtgacttagaaaagcaggggaaacccaaggctttgcctgcagaccggccactctgtgacaactctaccaaaaaccaacaagccattcaagcttttacaagaatgaaagagcggagacggtagtttagtatttgagccacgagtttatgtgcacaagtgttttgggttgtggactgaagctcagcctgttaatcagaccagcccatgagtgtataacaaacagaattggaggctggtttcttaaacacacacgtccacattttttagggttgttttcctgtgcttacaatttttaatgcatgtgcctttatttcacaaaacatgtggctgggcgcagcggctcacgcctgttatcccaacactttgggaggccgaggcaggcggagcacctaagttggggagttcaagaccagcctgaccaacgtggagaaactccgtctccactaaaatacaaaattagctgggtgtggtggcacatgcctgtaatatcagctactcaggaggctgaggcaggagaattgcttgaacccaggaggtggagtttgcagtgagctgagatcacaccattgcactccagcctgggcaaaaagagcaaaactctccctaaaaaaaaaatgtagaatatctcttaagatttccgttatggtaaaaaccatatgcaataaatacctcattgtaagcttacccaaaattgatagatgtcaaccttttaacagaagaacagaagtttaagttattgtttaatgtaatcagttttcattttaatatctttgaaatctttttcaaaggactgtagttttgtaatggacttttcaagccttccttccattgtttttcttccgttcactggctccacacgtttcctggggagtagcctcttacttgaaggtttttaatatgttttgataactttaataacttcaggtgatgtctgtataatttttaaagtgcagctctctctaacaaatgtgccttacaactcctgattaaacggcgtcttgaaggttttaaaatgtgatcgtgtatactggaattcaaagaggcttcttgtcagcagtcaagtgatgatggaaaactgtaatagtttgtaaagttcctctttgctttttcgtctgctgtgcgtcatcagtccgagccaagggcactattggccagttccgttcaacgaagtggttgctttttttagttccggcaatgagttgcgccggggcggcggcggctccccgcctttggcggctgcgcccgggggcccggcggtccctctcagcttatggaagaagaaccagtgtcagatttcgcagttcaggaatgactttagacaatatcagtcgggcagctgtggatcgaataatccgggtggatcatgcaggcgaatatggagcaaaccgcatctatgccgggcagatggctgtcctgggtcggaccagcgtcgggccagtcattcagaaaatgtgggatcaagaaaaggaccatttgaaaaagttcaatgagttgatggttatgttcagggtccggccaacagttctgatgcccttgtggaacgtgctggggtttgcactgggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttcagctgataaagaaatttcgggatgaagagcttgagcaccatgacataggcctcgaccatgatgcagaattggctccagcctatgccgtcctgaagagcattatccaggccggatgcagagtggcgatatatttatcagaaagattataaagtgtgtccagttttgcctgtctataaaagatgatagtaatttaccaagtgacatttgcagagaaacaggtgtacagttatcgttgtacttttgtacaatgtgaattttgttaataaattataaggtttgtttt

SEQ ID NO: 645617 - DNA, 197 bp, Homo sapiens
tgagcgtccccgtgtatggcttcaatcggcaggacggtgacggtgtgggagctcatcagctctgagtgcttcactgcggagcagtggcaggagctgttgtgtcagttccgcacgggaaggtcaccgtggagaaggtcatcaagattctcattaccatcgtggaggaggtggagaccctgctggcaggaggaggctgt

SEQ ID NO: 645618 - DNA, 4076 bp, Homo sapiens
  misc_feature (864)..(864): n is a, c, g, or t
  misc_feature (873)..(873): n is a, c, g, or t
  misc_feature (907)..(907): n is a, c, g, or t
  misc_feature (967)..(967): n is a, c, g, or t
  misc_feature (992)..(992): n is a, c, g, or t
  misc_feature (994)..(994): n is a, c, g, or t
  misc_feature (997)..(997): n is a, c, g, or t
  misc_feature (1001)..(1001): n is a, c, g, or t
  misc_feature (1013)..(1013): n is a, c, g, or t
  misc_feature (1017)..(1017): n is a, c, g, or t
  misc_feature (1036)..(1036): n is a, c, g, or t
  misc_feature (1043)..(1043): n is a, c, g, or t
  misc_feature (1046)..(1046): n is a, c, g, or t
  misc_feature (1052)..(1052): n is a, c, g, or t
  misc_feature (1054)..(1054): n is a, c, g, or t
  misc_feature (1061)..(1061): n is a, c, g, or t
  misc_feature (1070)..(1070): n is a, c, g, or t
  misc_feature (1072)..(1072): n is a, c, g, or t
  misc_feature (1076)..(1076): n is a, c, g, or t
  misc_feature (1078)..(1078): n is a, c, g, or t
  misc_feature (1087)..(1087): n is a, c, g, or t
  misc_feature (1092)..(1092): n is a, c, g, or t
ctggactcatttacttttacagttatatcatagacttgctttctggcactggtttcctggaggaaactagcctcttttacggacattacaccattgatgaggtgaaatttcagaacttcacctatgatctgcccctggcgtatttgttaagcacaatcgcctccctggccctgagccttctttggatagtgaaaaggtcggtggaaggattcaaaatcaacctgattcggagtgaggagcactttcagagttactgcaacaagatatttgccggctgggacttctgcatcactaaccgcagcatggcggatctgaagcacagcagcttgcggtacgagctccgagcagatctggaggaagaaagaatgcggcagaaaatagcagaaaggacctcagaagaaacaatacgcatttactctttgagactgtttttgaactgtattgttctggctgttttaggggcatgcttttatgcaatatacgtagcaactgtcttctcgcaagagcacatgaaaaaggaaatcgacaagatggtttttggagagaacctcttcatattgtatctaccgtctattgtgatcacgctggccaattttatcaccccaatgatctttgccaagatcatccgctatgaggattattctccaggctttgagatccgtctgacaatccttaggtgtgtctttatgcggctggccaccatatgtgtcctggtgttcacgctgggctccaagatcacatcctgtgatgatgacacatgtgacctttgcggctacaaccagaaactctacccggtgagttgcggcgcggtggcgttcggctgtatgggtccttctggaatacagtgctggtcaagagaacagnggttgaagncatgggtttgaactgcatttgcttcgtttcttgntctaggatgagacagagtctggccccatggagtctaaccccaggcacttctgagggcttngaaaccaaggtctgtgctgaggctnanagnttgnatcagctgatgncctnactggagccacaggatctngagttgnggnaattanangtgtctngggagcctngntttntntgcctgctngggtntttcagtttccctcactctctttgatttcagtgctgggagacccaagttgggcaggaaatgtacaagctgatgatcttcgacttcatcatcatcttggctgtgacactcttcgtggattttcctagaaagctcctggtgacctactgttcctcttgcaagctgattcagtgctgggggcagcaggagtttgccattcctgataacgtcctggggatagtttacgggcaaaccatctgctggatcggagcctttttctcaccccttctccctgcaattgcaaccctgaaattcattatcatcttctatgtgaaagagtggagtctgctttacacctgcagaccctcccccaggccgttcagagcatccaattctaatttcttcttcctgttggtgttgttgatcgggctgtgtttggcaataatacctctgacaatcagcatatcacgcatcccttcctcgaaagcctgtgggccgttcaccaacttcaacaccacctgggaggtcatccccaagacggtgagcaccttccccagctcgctgcagtccttcatccatggtgtcacatccgaagcctttgcagttcctttcttcatgattatttgcctcatcatgttttacttcattgccttagctggagcacacaaacgggtggtcatccagctccgagagcagctatccctggaaagtcgtgacaagtgctacctaatccagaaactaacagaagcccaaagggacatgaggaactaactagactgagcgtgaagatggtgctgcctgttgcttctaagctgacctagtgattctgctgagcctacagagtctacctgggttttgagtggacatttaaaaatatatttttcttgagtttaggcttttccatatgtgcagctgtgtttacctaacccagcccttaattagggcttcagtgacttagaaaagcaggggaaacccaaggctttgcctgcagaccggccactctgtgacaactctaccaaaaaccaacaagccattcaagcttttacaagaatgaaagagcggagacggtagtttagtatttgagccacgagtttatgtgcacaagtgttttgggttgtggactgaagctcagcctgttaatcagaccagcccatgagtgtataacaaacagaattggaggctggtttcttaaacacacacgtccacattttttagggttgttttcctgtgcttacaatttttaatgcatgtgcctttatttcacaaaacatgtggctgggcgcagcggctcacgcctgttatcccaacactttgggaggccgaggcaggcggagcacctaagttggggagttcaagaccagcctgaccaacgtggagaaactccgtctccactaaaatacaaaattagctgggtgtggtggcacatgcctgtaatatcagctactcaggaggctgaggcaggagaattgcttgaacccaggaggtggagtttgcagtgagctgagatcacaccattgcactccagcctgggcaaaaagagcaaaactctccctaaaaaaaaaatgtagaatatctcttaagatttccgttatggtaaaaaccatatgcaataaatacctcattgtaagcttacccaaaattgatagatgtcaaccttttaacagaagaacagaagtttaagttattgtttaatgtaatcagttttcattttaatatctttgaaatctttttcaaaggactgtagttttgtaatggacttttcaagccttccttccattgtttttcttccgttcactggctccacacgtttcctggggagtagcctcttacttgaaggtttttaatatgttttgataactttaataacttcaggtgatgtctgtataatttttaaagtgcagctctctctaacaaatgtgccttacaactcctgattaaacggcgtcttgaaggttttaaaatgtgatcgtgtatactggaattcaaagaggcttcttgtcagcagtcaagtgatgatggaaaactgtaatagtttgtaaagttcctctttgctttttcgtctgctgtgcgtcatcagtccgagccaagggcactattggccagttccgttcaacgaagtggttgctttttttagttccggcaatgagttgcgccggggcggcggcggctccccgcctttggcggctgcgcccgggggcccggcggtccctctcagcttatggaagaagaaccagtgtcagatttcgcagttcaggaatgactttagacaatatcagtcgggcagctgtggatcgaataatccgggtggatcatgcaggcgaatatggagcaaaccgcatctatgccgggcagatggctgtcctgggtcggaccagcgtcgggccagtcattcagaaaatgtgggatcaagaaaaggaccatttgaaaaagttcaatgagttgatggttatgttcagggtccggccaacagttctgatgcccttgtggaacgtgctggggtttgcactgggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttcagctgataaagaaatttcgggatgaagagcttgagcaccatgacataggcctcgaccatgatgcagaattggctccagcctatgccgtcctgaagagcattatccaggccggatgcagagtggcgatatatttatcagaaagattataaagtgtgtccagttttgcctgtctataaaagatgatagtaatttaccaagtgacatttgcagagaaacaggtgtacagttatcgttgtacttttgtacaatgtgaattttgttaataaattataaggtttgttttaaaattttttccttttttttttattttttattatatatttaaatttttattttttatttgtttatagttttttttaa

SEQ ID NO: 645619 - DNA, 158 bp, Homo sapiens
gttgacttgcattcagaacataaatgcacaaaatcatgtacatgtatcccatcagataagattcataggaatgccacaggggatactcctcctatcatcctgtaaaggtcaaaaatcaaaaccaaattatggggcatgattcagtcacaactaacata

SEQ ID NO: 645620 - DNA, 4061 bp, Homo sapiens
  misc_feature (864)..(864): n is a, c, g, or t
  misc_feature (873)..(873): n is a, c, g, or t
  misc_feature (907)..(907): n is a, c, g, or t
  misc_feature (967)..(967): n is a, c, g, or t
  misc_feature (992)..(992): n is a, c, g, or t
  misc_feature (994)..(994): n is a, c, g, or t
  misc_feature (997)..(997): n is a, c, g, or t
  misc_feature (1001)..(1001): n is a, c, g, or t
  misc_feature (1013)..(1013): n is a, c, g, or t
  misc_feature (1017)..(1017): n is a, c, g, or t
  misc_feature (1036)..(1036): n is a, c, g, or t
  misc_feature (1043)..(1043): n is a, c, g, or t
  misc_feature (1046)..(1046): n is a, c, g, or t
  misc_feature (1052)..(1052): n is a, c, g, or t
  misc_feature (1054)..(1054): n is a, c, g, or t
  misc_feature (1061)..(1061): n is a, c, g, or t
  misc_feature (1070)..(1070): n is a, c, g, or t
  misc_feature (1072)..(1072): n is a, c, g, or t
  misc_feature (1076)..(1076): n is a, c, g, or t
  misc_feature (1078)..(1078): n is a, c, g, or t
  misc_feature (1087)..(1087): n is a, c, g, or t
  misc_feature (1092)..(1092): n is a, c, g, or t
ctggactcatttacttttacagttatatcatagacttgctttctggcactggtttcctggaggaaactagcctcttttacggacattacaccattgatgaggtgaaatttcagaacttcacctatgatctgcccctggcgtatttgttaagcacaatcgcctccctggccctgagccttctttggatagtgaaaaggtcggtggaaggattcaaaatcaacctgattcggagtgaggagcactttcagagttactgcaacaagatatttgccggctgggacttctgcatcactaaccgcagcatggcggatctgaagcacagcagcttgcggtacgagctccgagcagatctggaggaagaaagaatgcggcagaaaatagcagaaaggacctcagaagaaacaatacgcatttactctttgagactgtttttgaactgtattgttctggctgttttaggggcatgcttttatgcaatatacgtagcaactgtcttctcgcaagagcacatgaaaaaggaaatcgacaagatggtttttggagagaacctcttcatattgtatctaccgtctattgtgatcacgctggccaattttatcaccccaatgatctttgccaagatcatccgctatgaggattattctccaggctttgagatccgtctgacaatccttaggtgtgtctttatgcggctggccaccatatgtgtcctggtgttcacgctgggctccaagatcacatcctgtgatgatgacacatgtgacctttgcggctacaaccagaaactctacccggtgagttgcggcgcggtggcgttcggctgtatgggtccttctggaatacagtgctggtcaagagaacagnggttgaagncatgggtttgaactgcatttgcttcgtttcttgntctaggatgagacagagtctggccccatggagtctaaccccaggcacttctgagggcttngaaaccaaggtctgtgctgaggctnanagnttgnatcagctgatgncctnactggagccacaggatctngagttgnggnaattanangtgtctngggagcctngntttntntgcctgctngggtntttcagtttccctcactctctttgatttcagtgctgggagacccaagttgggcaggaaatgtacaagctgatgatcttcgacttcatcatcatcttggctgtgacactcttcgtggattttcctagaaagctcctggtgacctactgttcctcttgcaagctgattcagtgctgggggcagcaggagtttgccattcctgataacgtcctggggatagtttacgggcaaaccatctgctggatcggagcctttttctcaccccttctccctgcaattgcaaccctgaaattcattatcatcttctatgtgaaagagtggagtctgctttacacctgcagaccctcccccaggccgttcagagcatccaattctaatttcttcttcctgttggtgttgttgatcgggctgtgtttggcaataatacctctgacaatcagcatatcacgcatcccttcctcgaaagcctgtgggccgttcaccaacttcaacaccacctgggaggtcatccccaagacggtgagcaccttccccagctcgctgcagtccttcatccatggtgtcacatccgaagcctttgcagttcctttcttcatgattatttgcctcatcatgttttacttcattgccttagctggagcacacaaacgggtggtcatccagctccgagagcagctatccctggaaagtcgtgacaagtgctacctaatccagaaactaacagaagcccaaagggacatgaggaactaactagactgagcgtgaagatggtgctgcctgttgcttctaagctgacctagtgattctgctgagcctacagagtctacctgggttttgagtggacatttaaaaatatatttttcttgagtttaggcttttccatatgtgcagctgtgtttacctaacccagcccttaattagggcttcagtgacttagaaaagcaggggaaacccaaggctttgcctgcagaccggccactctgtgacaactctaccaaaaaccaacaagccattcaagcttttacaagaatgaaagagcggagacggtagtttagtatttgagccacgagtttatgtgcacaagtgttttgggttgtggactgaagctcagcctgttaatcagaccagcccatgagtgtataacaaacagaattggaggctggtttcttaaacacacacgtccacattttttagggttgttttcctgtgcttacaatttttaatgcatgtgcctttatttcacaaaacatgtggctgggcgcagcggctcacgcctgttatcccaacactttgggaggccgaggcaggcggagcacctaagttggggagttcaagaccagcctgaccaacgtggagaaactccgtctccactaaaatacaaaattagctgggtgtggtggcacatgcctgtaatatcagctactcaggaggctgaggcaggagaattgcttgaacccaggaggtggagtttgcagtgagctgagatcacaccattgcactccagcctgggcaaaaagagcaaaactctccctaaaaaaaaaatgtagaatatctcttaagatttccgttatggtaaaaaccatatgcaataaatacctcattgtaagcttacccaaaattgatagatgtcaaccttttaacagaagaacagaagtttaagttattgtttaatgtaatcagttttcattttaatatctttgaaatctttttcaaaggactgtagttttgtaatggacttttcaagccttccttccattgtttttcttccgttcactggctccacacgtttcctggggagtagcctcttacttgaaggtttttaatatgttttgataactttaataacttcaggtgatgtctgtataatttttaaagtgcagctctctctaacaaatgtgccttacaactcctgattaaacggcgtcttgaaggttttaaaatgtgatcgtgtatactggaattcaaagaggcttcttgtcagcagtcaagtgatgatggaaaactgtaatagtttgtaaagttcctctttgctttttcgtctgctgtgcgtcatcagtccgagccaagggcactattggccagttccgttcaacgaagtggttgctttttttagttccggcaatgagttgcgccggggcggcggcggctccccgcctttggcggctgcgcccgggggcccggcggtccctctcagcttatggaagaagaaccagtgtcagatttcgcagttcaggaatgactttagacaatatcagtcgggcagctgtggatcgaataatccgggtggatcatgcaggcgaatatggagcaaaccgcatctatgccgggcagatggctgtcctgggtcggaccagcgtcgggccagtcattcagaaaatgtgggatcaagaaaaggaccatttgaaaaagttcaatgagttgatggttatgttcagggtccggccaacagttctgatgcccttgtggaacgtgctggggtttgcactgggtacgtgtctctctagaagagcttatgcaagcttggggatctaggatgattaaatccttcaggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttcagctgataaagaaatttcgggatgaagagcttgagcaccatgacataggcctcgaccatgatgcagaattggctccagcctatgccgtcctgaagagcattatccaggccggatgcagagtggcgatatatttatcagaaagattataaagtgtgtccagttttgcctgtctataaaagatgatagtaatttaccaagtgacatttgcagagaaacaggtgtacagttatcgttgtacttttgtacaatgtgaattttgttaataaattataaggtttgtttt

SEQ ID NO: 645621 - DNA, 3205 bp, Homo sapiens
  misc_feature (864)..(864): n is a, c, g, or t
  misc_feature (873)..(873): n is a, c, g, or t
  misc_feature (907)..(907): n is a, c, g, or t
  misc_feature (967)..(967): n is a, c, g, or t
  misc_feature (992)..(992): n is a, c, g, or t
  misc_feature (994)..(994): n is a, c, g, or t
  misc_feature (997)..(997): n is a, c, g, or t
  misc_feature (1001)..(1001): n is a, c, g, or t
  misc_feature (1013)..(1013): n is a, c, g, or t
  misc_feature (1017)..(1017): n is a, c, g, or t
  misc_feature (1036)..(1036): n is a, c, g, or t
  misc_feature (1043)..(1043): n is a, c, g, or t
  misc_feature (1046)..(1046): n is a, c, g, or t
  misc_feature (1052)..(1052): n is a, c, g, or t
  misc_feature (1054)..(1054): n is a, c, g, or t
  misc_feature (1061)..(1061): n is a, c, g, or t
  misc_feature (1070)..(1070): n is a, c, g, or t
  misc_feature (1072)..(1072): n is a, c, g, or t
  misc_feature (1076)..(1076): n is a, c, g, or t
  misc_feature (1078)..(1078): n is a, c, g, or t
  misc_feature (1087)..(1087): n is a, c, g, or t
  misc_feature (1092)..(1092): n is a, c, g, or t
ctggactcatttacttttacagttatatcatagacttgctttctggcactggtttcctggaggaaactagcctcttttacggacattacaccattgatgaggtgaaatttcagaacttcacctatgatctgcccctggcgtatttgttaagcacaatcgcctccctggccctgagccttctttggatagtgaaaaggtcggtggaaggattcaaaatcaacctgattcggagtgaggagcactttcagagttactgcaacaagatatttgccggctgggacttctgcatcactaaccgcagcatggcggatctgaagcacagcagcttgcggtacgagctccgagcagatctggaggaagaaagaatgcggcagaaaatagcagaaaggacctcagaagaaacaatacgcatttactctttgagactgtttttgaactgtattgttctggctgttttaggggcatgcttttatgcaatatacgtagcaactgtcttctcgcaagagcacatgaaaaaggaaatcgacaagatggtttttggagagaacctcttcatattgtatctaccgtctattgtgatcacgctggccaattttatcaccccaatgatctttgccaagatcatccgctatgaggattattctccaggctttgagatccgtctgacaatccttaggtgtgtctttatgcggctggccaccatatgtgtcctggtgttcacgctgggctccaagatcacatcctgtgatgatgacacatgtgacctttgcggctacaaccagaaactctacccggtgagttgcggcgcggtggcgttcggctgtatgggtccttctggaatacagtgctggtcaagagaacagnggttgaagncatgggtttgaactgcatttgcttcgtttcttgntctaggatgagacagagtctggccccatggagtctaaccccaggcacttctgagggcttngaaaccaaggtctgtgctgaggctnanagnttgnatcagctgatgncctnactggagccacaggatctngagttgnggnaattanangtgtctngggagcctngntttntntgcctgctngggtntttcagtttccctcactctctttgatttcagtgctgggagacccaagttgggcaggaaatgtacaagctgatgatcttcgacttcatcatcatcttggctgtgacactcttcgtggattttcctagaaagctcctggtgacctactgttcctcttgcaagctgattcagtgctgggggcagcaggagtttgccattcctgataacgtcctggggatagtttacgggcaaaccatctgctggatcggagcctttttctcaccccttctccctgcaattgcaaccctgaaattcattatcatcttctatgtgaaagagtggagtctgctttacacctgcagaccctcccccaggccgttcagagcatccaattctaatttcttcttcctgttggtgttgttgatcgggctgtgtttggcaataatacctctgacaatcagcatatcacgcatcccttcctcgaaagcctgtgggccgttcaccaacttcaacaccacctgggaggtcatccccaagacggtgagcaccttccccagctcgctgcagtccttcatccatggtgtcacatccgaagcctttgcagttcctttcttcatgattatttgcctcatcatgttttacttcattgccttagctggagcacacaaacgggtggtcatccagctccgagagcagctatccctggaaagtcgtgacaagtgctacctaatccagaaactaacagaagcccaaagggacatgaggaactaactagactgagcgtgaagatggtgctgcctgttgcttctaagctgacctagtgattctgctgagcctacagagtctacctgggttttgagtggacatttaaaaatatatttttcttgagtttaggcttttccatatgtgcagctgtgtttacctaacccagcccttaattagggcttcagtgacttagaaaagcaggggaaacccaaggctttgcctgcagaccggccactctgtgacaactctaccaaaaaccaacaagccattcaagcttttacaagaatgaaagagcggagacggtagtttagtatttgagccacgagtttatgtgcacaagtgttttgggttgtggactgaagctcagcctgttaatcagaccagcccatgagtgtataacaaacagaattggaggctggtttcttaaacacacacgtccacattttttagggttgttttcctgtgcttacaatttttaatgcatgtgcctttatttcacaaaacatgtggctgggcgcagcggctcacgcctgttatcccaacactttgggaggccgaggcaggcggagcacctaagttggggagttcaagaccagcctgaccaacgtggagaaactccgtctccactaaaatacaaaattagctgggtgtggtggcacatgcctgtaatatcagctactcaggaggctgaggcaggagaattgcttgaacccaggaggtggagtttgcagtgagctgagatcacaccattgcactccagcctgggcaaaaagagcaaaactctccctaaaaaaaaaatgtagaatatctcttaagatttccgttatggtaaaaaccatatgcaataaatacctcattgtaagcttacccaaaattgatagatgtcaaccttttaacagaagaacagaagtttaagttattgtttaatgtaatcagttttcattttaatatctttgaaatctttttcaaaggactgtagttttgtaatggacttttcaagccttccttccattgtttttcttccgttcactggctccacacgtttcctggggagtagcctcttacttgaaggtttttaatatgttttgataactttaataacttcaggtgatgtctgtataatttttaaagtgcagctctctctaacaaatgtgccttacaactcctgattaaacggcgtcttgaaggttttaaaatgtgatcgtgtatactggaattcaaagaggcttcttgtcagcagtcaagtgatgatggaaaactgtaatagtttgtaaagttcctctttgctttttccttgttaataagtaattccctcatgatccttttccccaggaacttgggtgagaaatcataaccttgtcctgatctttc

SEQ ID NO: 645622 - DNA, 317 bp, Homo sapiens
tctttctcttaagacaatagaaaatctgggccgggagtgagccactgcctgtaatcccagcactttgggaggccgaggcgggcagatcacctgaggtcaggaattcgagaccagcctggccaatatggtgaaactccgtctctactaaaaatacaaaaagtagcctagtggtagtgggcacctgtaatccaagttactcagaaggctgaggcaggagatttgcttgagcccgagaggcagaggttgcagtgagcagagattgtgccactgcactctagcgtgggcgacagagcaaggctctgtctcaaaaaaaaaaa

SEQ ID NO: 645623 - DNA, 210 bp, Homo sapiens
cagggttggagaagacgagataggagggccattgatgcgtttgtgctccaatgaggtacgtgatgagcgcgatggtctggatggtcttcaccaggcccatctcgtcggccaggatgcccgttcagggttgttgttgtacagggacaccagccactccaaacctttgatctggtactgtttgaggacaccattgaccataagcgctgactg

SEQ ID NO: 645624 - DNA, 3621 bp, Homo sapiens
  misc_feature (864)..(864): n is a, c, g, or t
  misc_feature (873)..(873): n is a, c, g, or t
  misc_feature (907)..(907): n is a, c, g, or t
  misc_feature (967)..(967): n is a, c, g, or t
  misc_feature (992)..(992): n is a, c, g, or t
  misc_feature (994)..(994): n is a, c, g, or t
  misc_feature (997)..(997): n is a, c, g, or t
  misc_feature (1001)..(1001): n is a, c, g, or t
  misc_feature (1013)..(1013): n is a, c, g, or t
  misc_feature (1017)..(1017): n is a, c, g, or t
  misc_feature (1036)..(1036): n is a, c, g, or t
  misc_feature (1043)..(1043): n is a, c, g, or t
  misc_feature (1046)..(1046): n is a, c, g, or t
  misc_feature (1052)..(1052): n is a, c, g, or t
  misc_feature (1054)..(1054): n is a, c, g, or t
  misc_feature (1061)..(1061): n is a, c, g, or t
  misc_feature (1070)..(1070): n is a, c, g, or t
  misc_feature (1072)..(1072): n is a, c, g, or t
  misc_feature (1076)..(1076): n is a, c, g, or t
  misc_feature (1078)..(1078): n is a, c, g, or t
  misc_feature (1087)..(1087): n is a, c, g, or t
  misc_feature (1092)..(1092): n is a, c, g, or t
ctggactcatttacttttacagttatatcatagacttgctttctggcactggtttcctggaggaaactagcctcttttacggacattacaccattgatgaggtgaaatttcagaacttcacctatgatctgcccctggcgtatttgttaagcacaatcgcctccctggccctgagccttctttggatagtgaaaaggtcggtggaaggattcaaaatcaacctgattcggagtgaggagcactttcagagttactgcaacaagatatttgccggctgggacttctgcatcactaaccgcagcatggcggatctgaagcacagcagcttgcggtacgagctccgagcagatctggaggaagaaagaatgcggcagaaaatagcagaaaggacctcagaagaaacaatacgcatttactctttgagactgtttttgaactgtattgttctggctgttttaggggcatgcttttatgcaatatacgtagcaactgtcttctcgcaagagcacatgaaaaaggaaatcgacaagatggtttttggagagaacctcttcatattgtatctaccgtctattgtgatcacgctggccaattttatcaccccaatgatctttgccaagatcatccgctatgaggattattctccaggctttgagatccgtctgacaatccttaggtgtgtctttatgcggctggccaccatatgtgtcctggtgttcacgctgggctccaagatcacatcctgtgatgatgacacatgtgacctttgcggctacaaccagaaactctacccggtgagttgcggcgcggtggcgttcggctgtatgggtccttctggaatacagtgctggtcaagagaacagnggttgaagncatgggtttgaactgcatttgcttcgtttcttgntctaggatgagacagagtctggccccatggagtctaaccccaggcacttctgagggcttngaaaccaaggtctgtgctgaggctnanagnttgnatcagctgatgncctnactggagccacaggatctngagttgnggnaattanangtgtctngggagcctngntttntntgcctgctngggtntttcagtttccctcactctctttgatttcagtgctgggagacccaagttgggcaggaaatgtacaagctgatgatcttcgacttcatcatcatcttggctgtgacactcttcgtggattttcctagaaagctcctggtgacctactgttcctcttgcaagctgattcagtgctgggggcagcaggagtttgccattcctgataacgtcctggggatagtttacgggcaaaccatctgctggatcggagcctttttctcaccccttctccctgcaattgcaaccctgaaattcattatcatcttctatgtgaaagagtggagtctgctttacacctgcagaccctcccccaggccgttcagagcatccaattctaatttcttcttcctgttggtgttgttgatcgggctgtgtttggcaataatacctctgacaatcagcatatcacgcatcccttcctcgaaagcctgtgggccgttcaccaacttcaacaccacctgggaggtcatccccaagacggtgagcaccttccccagctcgctgcagtccttcatccatggtgtcacatccgaagcctttgcagttcctttcttcatgattatttgcctcatcatgttttacttcattgccttagctggagcacacaaacgggtggtcatccagctccgagagcagctatccctggaaagtcgtgacaagtgctacctaatccagaaactaacagaagcccaaagggacatgaggaactaactagactgagcgtgaagatggtgctgcctgttgcttctaagctgacctagtgattctgctgagcctacagagtctacctgggttttgagtggacatttaaaaatatatttttcttgagtttaggcttttccatatgtgcagctgtgtttacctaacccagcccttaattagggcttcagtgacttagaaaagcaggggaaacccaaggctttgcctgcagaccggccactctgtgacaactctaccaaaaaccaacaagccattcaagcttttacaagaatgaaagagcggagacggtagtttagtatttgagccacgagtttatgtgcacaagtgttttgggttgtggactgaagctcagcctgttaatcagaccagcccatgagtgtataacaaacagaattggaggctggtttcttaaacacacacgtccacattttttagggttgttttcctgtgcttacaatttttaatgcatgtgcctttatttcacaaaacatgtggctgggcgcagcggctcacgcctgttatcccaacactttgggaggccgaggcaggcggagcacctaagttggggagttcaagaccagcctgaccaacgtggagaaactccgtctccactaaaatacaaaattagctgggtgtggtggcacatgcctgtaatatcagctactcaggaggctgaggcaggagaattgcttgaacccaggaggtggagtttgcagtgagctgagatcacaccattgcactccagcctgggcaaaaagagcaaaactctccctaaaaaaaaaatgtagaatatctcttaagatttccgttatggtaaaaaccatatgcaataaatacctcattgtaagcttacccaaaattgatagatgtcaaccttttaacagaagaacagaagtttaagttattgtttaatgtaatcagttttcattttaatatctttgaaatctttttcaaaggactgtagttttgtaatggacttttcaagccttccttccattgtttttcttccgttcactggctccacacgtttcctggggagtagcctcttacttgaaggtttttaatatgttttgataactttaataacttcaggtgatgtctgtataatttttaaagtgcagctctctctaacaaatgtgccttacaactcctgattaaacggcgtcttgaaggttttaaaatgtgatcgtgtatactggaattcaaagaggcttcttgtcagcagtcaagtgatgatggaaaactgtaatagtttgtaaagttcctctttgctttttcgtctgctgtgcgtcatcagtccgagccaagggcactattggccagttccgttcaacgaagtggttgctttttttagttccggcaatgagttgcgccggggcggcggcggctccccgcctttggcggctgcgcccgggggcccggcggtccctctcagcttatggaagaagaaccagtgtcagatttcgcagttcaggaatgactttagacaatatcagtcgggcagctgtggatcgaataatccgggtggatcatgcaggcgaatatggagcagcagaattggctccagcctatgccgtcctgaagagcattatccaggccggatgcagagtggcgatatatttatcagaaagattataaagtgtgtccagttttgcctgtctataaaagatgatagtaatttaccaagtgacatttgcagagaaacaggtgtacagttatcgttgtacttttgtacaatgtgaattttgttaataaattataaggtttgtttt

SEQ ID NO: 645625 - DNA, 297 bp, Homo sapiens
tctgtacatctgcaactgccaacatcacactatcctgattactaaagctttatattagtcttgaaattagactgcactgactggagtgcagtggcccgatctcggctcactgcagactccgctcctggccaacatggcaaaaccccatctctactaaaaatatgacaattagccaggtgtggtgcacacgcctgtagtcccagctacccgggaggctgaggcaggaggattgcttgaacctgggagacggaggttgcagtgagccaagatcacgccactgtactccagcctgggcaa

SEQ ID NO: 645626 - DNA, 673 bp, Homo sapiens
ggtgggcgtgtccagcaggtcaggctgcccatctctggaccactcgatctccaacccaggctctctgtgccggtcagggctgagcgggagggaccgggtgtggcgatgctggtgcggtgggctggcgtggtgagggctggggtaggcgtggcagggtgggaccgtgggttctcaatagagggtgacggtagccaccgtgtgctcaagatggaaacgagaaggcggggagcgtgcatacgtgtgcaaccgttggaactcgtccctggtccagcgtgcgctttcatcggggagcgtttatgagcagccgcgtgtgcgtcctggacggtgaacaccgacccggcgtatggccctttgggggggggggcaaacggggctagggcgtgggctcgcgagagtggagcagtggaggctcgcgctgtggggcaggggtagctgggcccttggcgttcccaaccaaggaaggccctccttggccggcccgtcgtagtccgctcgtgtgcagtctgcttcgccagggagtattggggaagccctacaattgggctgggctctggactctggaacgacggggcgggcttgggcctataacggctaggcttggggttgggggaaacgttcccgggtcgagaaccaaggcctttggcgggaagggaaccccttcttggaggaacat

SEQ ID NO: 645627 - DNA, 536 bp, Homo sapiens
  misc_feature (529)..(529): n is a, c, g, or t
tggcctgaaactcagagggaaaaaaagaaagaaaagatccagtccttattaattaaaatgaaaaaggcactgcttataaaatcagcaacaaggctgaaggtagggaaacacaaagttagctctgcactagcagggaagagctatgcaagaggaacatgtacaggagcagcaagacccaactacggcccaaggttttctaagcagtgctctagaagcattttctcctccacacctgctatatttatatgctctttttggaagccaagtggctcatcaattacacattttattttattttattttattttattttttgagacagagtctcactctgtcacctgggctggagtgcagtggcacgatctcagctcactgcaacctccgcttcccgggctcaaatgtttctccagcttcagcctcccgagtagctgggaccacaggtgaccgccaccatgcccggacaatttttttttctttctcttttttagagatgggattcgccatgttgccaggctgtctcaactctggnctcagtg

SEQ ID NO: 645628 - DNA, 110 bp, Homo sapiens
tgaactcaagcaacctggctacctcggcctagcaaagtgctgggattacaggcatgagcccccacccctgcctatgtaaaaattccataataaacccgggcggaagcgga

SEQ ID NO: 645629 - DNA, 360 bp, Homo sapiens
gcccggtttgagtgtgttggcgcgattctcgtgtcgcactgctagctccgcctcccgggcttcacgccattctcctgtcctcagtccgcccgagttgctggcacttcaggcctccatccagtcatgcccggctaattttttgtatttatcgtagagaccgggtttcaccattttgcctaaacagttcatcaactcctgtcctccaggtacttctcccatctctgcctccgattagtgttgggatcacgggacttgcgccatcgtgcctggcctttagctagaattttgccctcaatttgtttcactactctttggtctttgcttatgttggccattgtcatgcgggaaacatcgcgaaag

SEQ ID NO: 645630 - DNA, 282 bp, Homo sapiens
tgggggggggggttttctttttgccccccgggtggaaaaagaaaaaaagtggtttggccccccccctgggggggcttttttcccttttagacttaaaaggggtggaaaaggggtctggtttcaaaaccggcctttttaaatcaacttttttaagggtccccgcggattggggggggaaaaggggggtttcggccccccttgaagggttttttcgcggggttttcgggaacccgtcccggaaaaggggggggggggttttccggcgggggactttttggcccc

SEQ ID NO: 645631 - DNA, 962 bp, Homo sapiens
  misc_feature (452)..(452): n is a, c, g, or t
  misc_feature (476)..(476): n is a, c, g, or t
  misc_feature (506)..(506): n is a, c, g, or t
  misc_feature (532)..(532): n is a, c, g, or t
  misc_feature (550)..(550): n is a, c, g, or t
  misc_feature (558)..(558): n is a, c, g, or t
  misc_feature (589)..(589): n is a, c, g, or t
  misc_feature (682)..(682): n is a, c, g, or t
  misc_feature (685)..(686): n is a, c, g, or t
  misc_feature (688)..(689): n is a, c, g, or t
  misc_feature (693)..(693): n is a, c, g, or t
  misc_feature (696)..(696): n is a, c, g, or t
  misc_feature (703)..(703): n is a, c, g, or t
  misc_feature (706)..(706): n is a, c, g, or t
  misc_feature (708)..(709): n is a, c, g, or t
  misc_feature (713)..(714): n is a, c, g, or t
  misc_feature (720)..(720): n is a, c, g, or t
  misc_feature (724)..(724): n is a, c, g, or t
  misc_feature (730)..(730): n is a, c, g, or t
  misc_feature (733)..(733): n is a, c, g, or t
  misc_feature (740)..(740): n is a, c, g, or t
  misc_feature (744)..(744): n is a, c, g, or t
  misc_feature (747)..(747): n is a, c, g, or t
  misc_feature (962)..(962): n is a, c, g, or t
cccgctctctggctcgagcatcccgtcaaacccctttttctttggcccgcgcggttgcttcagtcgctcgcgctccctcccctccggggaatcatattgaggctcccccccaatggtttttttgcgcccgactcgccggtttagcaaaggcctatccctcggccacccagagcgcccccccccagaaaccaggcgtgttctacaggacccacaagtgaccccaaggcctttccccccctggtatggcaattgaggtggcacccctctccccccccataggccaggaaaagtgaaagtagaacccagctcctttaagacttgccagcaaggcttgaggctttatgtatgtagctgagtcagcaaggtacatgatgctgtctgctttcaaaaggcttttctctcctagttgactgactccttcctcagtccaaggcacagctgagacacacctntgctgagtagctctgtgatgacanagccttggtttaatgaggtgatcctcaggntgtgaggtttattagtccccaaggcnaacacaaatattagattnataatccnactttaatagtatacatttaaaagaaaaaanacaaaagccctggaagttgaggccaagcctgctgagtattgcagctgcatttgcccaaagggaatccagaacaagtccctccctgtattttgntcnnanngggntcngtctagnagntnnatcnnatcagnatgnggagcnccngcccagngctngtntggatcagcaccaacgattttaaagaaaaaaggaagagtttcttagatgagtaattgttattgaagatagtcagtgataaccaatgaccagatgctatcaatacagtatgtgtcctttttagaataaccgcattctatatcatcattcctttggggaaaattgttattcaggtataaaaacaagagatcataataaaacccgagtctggccggan

SEQ ID NO: 645632 - DNA, 893 bp, Homo sapiens
  misc_feature (452)..(452): n is a, c, g, or t
  misc_feature (476)..(476): n is a, c, g, or t
  misc_feature (506)..(506): n is a, c, g, or t
  misc_feature (532)..(532): n is a, c, g, or t
  misc_feature (550)..(550): n is a, c, g, or t
  misc_feature (558)..(558): n is a, c, g, or t
  misc_feature (589)..(589): n is a, c, g, or t
  misc_feature (682)..(682): n is a, c, g, or t
  misc_feature (685)..(686): n is a, c, g, or t
  misc_feature (688)..(689): n is a, c, g, or t
  misc_feature (693)..(693): n is a, c, g, or t
  misc_feature (696)..(696): n is a, c, g, or t
  misc_feature (703)..(703): n is a, c, g, or t
  misc_feature (706)..(706): n is a, c, g, or t
  misc_feature (708)..(709): n is a, c, g, or t
  misc_feature (713)..(714): n is a, c, g, or t
  misc_feature (720)..(720): n is a, c, g, or t
  misc_feature (724)..(724): n is a, c, g, or t
  misc_feature (730)..(730): n is a, c, g, or t
  misc_feature (733)..(733): n is a, c, g, or t
  misc_feature (740)..(740): n is a, c, g, or t
  misc_feature (744)..(744): n is a, c, g, or t
  misc_feature (747)..(747): n is a, c, g, or t
cccgctctctggctcgagcatcccgtcaaacccctttttctttggcccgcgcggttgcttcagtcgctcgcgctccctcccctccggggaatcatattgaggctcccccccaatggtttttttgcgcccgactcgccggtttagcaaaggcctatccctcggccacccagagcgcccccccccagaaaccaggcgtgttctacaggacccacaagtgaccccaaggcctttccccccctggtatggcaattgaggtggcacccctctccccccccataggccaggaaaagtgaaagtagaacccagctcctttaagacttgccagcaaggcttgaggctttatgtatgtagctgagtcagcaaggtacatgatgctgtctgctttcaaaaggcttttctctcctagttgactgactccttcctcagtccaaggcacagctgagacacacctntgctgagtagctctgtgatgacanagccttggtttaatgaggtgatcctcaggntgtgaggtttattagtccccaaggcnaacacaaatattagattnataatccnactttaatagtatacatttaaaagaaaaaanacaaaagccctggaagttgaggccaagcctgctgagtattgcagctgcatttgcccaaagggaatccagaacaagtccctccctgtattttgntcnnanngggntcngtctagnagntnnatcnnatcagnatgnggagcnccngcccagngctngtntggctctggagtcaaggctttaagggaggaagaaggagctttgttaggtaagtgggtgggttagggcatagtctgtggcatgcccttgccggaggctaagggtgcaaaatgtgtcccttttagaatattgatggcctttcatcttt

SEQ ID NO: 645633 - DNA, 907 bp, Homo sapiens
agcggctctctctttttttccgccctagctggggctgtgttgcgaggagaggaagaaagagagacagaggattgcattcatccgttacgtcttgaaatttcctaatagcaagaccagcgaagcggttgcacccttttcaagtcttgcacaggaaaagaactgaacaaaacgaaaaagacccaagtccccttcccggcagttttgtgccttaaagctgccctcttgaaattaagtttttgcccaggagagagatgtcgttatcaggggacgaagaaatattccacgcatcacgagcgatcgtcttctgatcaacaggacggtcaaacttgttacatgatgtaccagtcgttctatgcagacatatacatggaagatgggttgatcaagcaaataggagaacaatctgagttgtgccaggacgggagtgaagaccatgcgaggcccactcccggatggtgatccccggaggaagttgacgtccacactcgtttccagatgcctgatcagggactgacgtctgctgactgatttcttccaaggtaaccaaggtcggccctgagcttgcgggaacccactatgatcattggaccacgttgttcctgagcctgggacatgcctgctcgctgcctttgaccagtggagcggaatgggccgacagcaagtccctgctgtgactactcttctgccttgtggcctcagccgagtggcataaggggcatcccaagaaggagactggaaagcgccttgtgcgaaggatcacggggtaaactttcgcttcatcgtgttacatgggctttcaaagaatcgcttccagctagacggattgccagattttatgacgtactggcgttggaactctgggaatttgggcgccattgccaagtcacgccaaaacgcgacaccctcg

SEQ ID NO: 645634 - DNA, 681 bp, Homo sapiens
ctgggtacggtggctcacgcctgtaatcccaacactttgagaggccaaggtgggcagatcacctgaagtcaggagttcaagaccagcctggccaacacagtgaaaccacgtcttaaaaaagaaaaatacaaacattagccaggcttgatggtgggtgcctgtaatcccagctgctcaggaggctgaagtgggagaatcgcttgaacttgggaggcagaggttgcagtgagcccagatcacgccattgcactccagcctgggtgacagtgcaagactctgtctcaaaaaaaaaacaaaaaacacaagataccactaagaaaatgaatatgtataattattatttgtcaattaaacaataataactttaaattccaaaaaagaacaggcaagccacagactgggagaaaatgtcctcccttgctcccattatgtgtgtgtatatgtgtctgtgtctgtctgacaaactgcgatccagaatatgtcacaggacttataactcaataatacccccaaaattaattctaaaatggtgaacagaattgaacagactatcacaaaagaagataatgaccaacttaaacacatggaaagttgcttaccatcgttactcatcgagcacagtggcaattgaaaccacaggaggctggtgacaggggcttaaccgtgtatccagacacttgg

SEQ ID NO: 645635 - DNA, 242 bp, Homo sapiens
tcctggctgggtgtgatgattggaacgagttggataaaggcttaatccccaacaacgagcacgatctgaactaatgccagtgttcaagatgcccacagaagactacgctggggaccgtgcagatttctggagaatgcgtgtccagaggtctggggtgaagaagaaccttgaggaaaagtcgggaagacctcacagctgttgtgtctgtcagcaccaagttcccagcttatgagagggttttg

SEQ ID NO: 645636 - DNA, 268 bp, Homo sapiens
agactcctgaggagctgggattacaggcatgcgctaccacacctggctaattttgtatttttagtacagatggcgcttctccatgttggtcaggctggtcttggactcccgacctcaggtgatccgcctgcctcggcctcccaaagtgctgaggttacaggcgtgagccactgtgcccggccagctctaatttctaaaagtatatttcttagctaaggtagtcagcagatcttgtgaacataaatgactgacgagggaggcagcaggc

SEQ ID NO: 645637 - DNA, 329 bp, Homo sapiens
gacatgagtatagtcactgacttaggttactgctgctatctatttatctgtctcatgtggtacgagatggggtctcactatatggcccagccgggtctcaaactccggggctcaagcaatccccatacctcagcctcttaagtgcgggaataataggcatgagccatggcaccgtggccaactcttttttatcatatctgtataaagacggggtctggctatatagacccaggcgtggagtggaggtggtcattcacaaggcatgctcatgtacacggcagactaacaactcccaggaccacaagggactcctcccgccccacgcctcc

SEQ ID NO: 645638 - DNA, 94 bp, Homo sapiens
acaggcccccaacccccaggcagcccggcaaaggacgggaggagaccagtcccccccccacccgtaccaaaaataaaggcttttgtgcttccca

SEQ ID NO: 645639 - DNA, 244 bp, Homo sapiens
  misc_feature (65)..(65): n is a, c, g, or t
tggggggggccccccccccctttgggggggcccccccccctcctttgggggggggggggggtttnccccccccctgaggggggggcccccccccccccctttttggggggggggggggcccccccgggggggggggccccccccccccccccccggggggtggggcccccccttttggggtttttttttttttttggggggccccccggggggggggggaaaaaaaatttttggggggggggga

SEQ ID NO: 645640 - DNA, 1035 bp, Homo sapiens
  misc_feature (419)..(419): n is a, c, g, or t
  misc_feature (421)..(421): n is a, c, g, or t
  misc_feature (425)..(425): n is a, c, g, or t
gggaagtgaaatcggtggtcagccgtcctcggccgcctgcaattgcagatgagaggagaagcagcttgatggcatcattatgatgcactgctgagttcaagttggcgtgatctgaagcaactctctcggggagctttcactgtgcatagcttgaatgcatgaaataaacagcactgcttgttcctgtacatccacgtgtcatcagttccatctggcttgtggttctccatgatccagagcatgtaaaggatctcactgtctgtgctagtagctgcacaggagcggagtgactctgtttctacaggcctatggagcgtaagtcccctgtacccaatctgtacgaactcgaagacctgactctgcctgttccatgccgtctaacgtgagctcaatcgttggtcttatgtaccgtgtccaanantagntccataaaagtcccacgtgatcgctttagcgcaccacacttaatacatcactgaggctattctcagcgaaagtgggtactgaccatggccagggactatggtggggaccagggtgtgtttgacctataggcacacgagataaaggccccttcccctgtgcattcagtgtctcttgagttatgcgagcggacgaaagtgcgaaattggcactttgcaacatctgccatcgagcgggttcagtggactcgtcatatatgagtgcccagcttatcgtgcgactctaggccaggagtttccttctagagaggaaaacggtactttccttcattgtccctacagcctgtggacccaaaatggtggcaccagatctgatggtggcgaggggggcaaccccccagtaagctattggcctgccttggatcagaggtttgaacgccattcgaccctcgagaccctttcagggctaaaccagggcttttcttaaggtaactccctttgttgccgcattggccaagcgggtgaagttcagcataaagctggaccaagagggattcctctgaattaaaggtcctttccactttggccacacaaaaaacaaacttaaaccctg

SEQ ID NO: 645641 - DNA, 126 bp, Homo sapiens
cctcgcagctgaatgctcgaccacgtaccggcggcagccttgtgctcctgcagccttgttgctggagcaccagccagacaagatcaaggctctcttccgcaaggggcaaggtcgctggcccagcat

SEQ ID NO: 645642 - DNA, 340 bp, Homo sapiens
ccccccggtttttttggccccccccccccccttttgggggggccccctttgtggggggggggggtttttcccccccccccccccccctggggggaaaaattacccccgggggcccaaattgggggggggggaaaggcccctttttttgccccccccccttcccccttggcctttttggggggggccaaggggggccccggaattttttttccggggggcccatttaaggggggggtttcccagggttgggttttttccccccgggggcccctttttgcccggttccccccctttttttttgagggggttttttttggggtccttttttttttggggggga

SEQ ID NO: 645643 - DNA, 388 bp, Homo sapiens
tcaatgctagctgttgtggctcagcatgctggggcccaatccacgaggcccccagttggagtattacacagttgtgttgacctgccaaaccaaaggggggactttgttgtagaagatcatgcccacccaggcgccccaactctggccctcatagctctgcaagagctcccagacaaacacattctccatctcatccagaatagacaggacggccccacccgctctctggcagcgctgtcgcgcctccttgtggcccatcagcagctccatgtggaaagaataacagtgctcccggaagggaatccacgcggagtctgcacatccctggggacagctgccatggaagcttattattcggggaggagggggcccactgataaccccacac

SEQ ID NO: 645644 - DNA, 345 bp, Homo sapiens
gggatttgggtcacggttctcggttgcggatcgctgagaacgctacttgacaatgcacatcttcaggaagactctgactgataagaccatcaccctcaaggttgagcccagcgacaccatctagaatgtcaaggcacagatccaagatcaggaaggcattcgtcctgaccagtagaagctgatctttgctggcaccctgcacctggtgctccatctcataggcggcatgcaaatcttcacgaagacactcactggcaagaccatgacccttgaggcgcagcccagtgacaccatagagaacgtcgcaatgatccacgacacggggcatatctgctgaccagcagg

SEQ ID NO: 645645 - DNA, 398 bp, Homo sapiens
ttctaccccgtggtaactcacacatgcgtgtcctgtagcccagtgctcctggtacagtgacggaaatacagtcttgccatgtggacacaacagatggggacagacagactatagctgtcgtcatcgtgatgcgtgtgagtgccttaccttgataagatatatgtgtcaggttctccagcatcacgtctctgatacaggcatctctgagcctcactaaggagactccattcctcctgggaaaagttcacagccacatcttcaaaggtcacagtgccctgccgtgatgatgacagatgaaaccacaaacactccatatgctcatccacttatccagccttgcccttcctcctcccaaggtcctaaactacaaggagaaactaggcccactggtgtcacta

SEQ ID NO: 645646 - DNA, 183 bp, Homo sapiens
agtcactgtgaagctactgccctttgtcctctaataatttgttaaaaagaagacatttataaagacgattttttgcatttctctgccttatgcttatcaacttcaaatgttcgctttttctaacctttttttgttcgctaccataattcagtattcatgtctaaatttctgtgcccatttcaa

SEQ ID NO: 645647 - DNA, 483 bp, Homo sapiens
  misc_feature (146)..(146): n is a, c, g, or t
tgttaaactccactctcagaaaaaaacacaaacaaaaagacatgccattcaggaaagggtaatcagtgattaaaatatatagattttttttggtttctactctggattattcaaaatattcttgtctagagttttttgaaacacgnaggactgttaccaggacccaaaaattgaacataaaaaattaggacatgaaaaatagcaaataatccactttttcagaataatctaaccttttttttttgagacggagtcttgctctgtctcccagactggagtgcagtggtgcgatctcgactcactgcaaactccgcctcccaggttcaccccattcttctgcttcagcctcctgagtagctgggactacaggcgcccatgaccacgcctggctaatttttttgtatttttagtagagatggggtttaactgtattagccaggatgatctcaatctcctgaccttgtgatccgcctgccttgggaa

SEQ ID NO: 645648 - DNA, 111 bp, Homo sapiens
ggtgcttctacgacggactccccctgggctggggaccgacgggggacacgccacccgggacgtcagacggtcacgacagtacgacgccaccttgttcatacggggactctg

SEQ ID NO: 645649 - DNA, 229 bp, Homo sapiens
  misc_feature (11)..(11): n is a, c, g, or t
  misc_feature (68)..(68): n is a, c, g, or t
  misc_feature (111)..(111): n is a, c, g, or t
  misc_feature (175)..(175): n is a, c, g, or t
gaaaacctgtnatcgtttcccgaagttcctcattgtgggaccccagaaaacagggactacagctattnatttcttcctgagcctgcacccagctgtaactagcagcttccntagccccagcacatttaaggagattcatttcttcaacagccctaattaccacaagggtattgantggtacatggattttttccctgttccttccaatgccagcactgatttcctattt

SEQ ID NO: 645650 - DNA, 832 bp, Homo sapiens
atgttcgcttcccccctcctggctctttattttgggtgggcgggccttctcatgggctcgccgcccgaacaaagcggtgcggcctgcaatctcgccggggcggtttaaaatatccccccgcccttggtggagttgtctccccgcactgttctctgcgagcatattacctaaacgcgcgcgactggtgtagagctgcgcgcatcacacggcgcggttgtatctacagatgcgacgccccacgggtgggcgcgctgtcgcccacacacgatttgtttgatatataagggagcacacttaacgcgccgatgaggcacccgcggatttatatgtctggccgtcccacgctgtgtgtaattgtccctcgcccggatatgtatacccggggggtgtttccatgaattgggttacgactcccgctctacgcgaacaggcactcccccaggttgagtccgttacgggcgcttttctgccccgcgtaccacgcactcgtttctcgtcggcgtgacaacccttttcgggtatcgcagcacatcatgtcttcggttggtagaaccccacacggcggttcaccacgggtgggttataactcggccattcatgttgtgggtcgcgcacaacttatgggccctagtgtattgggtgatgcgccccccgcacttgggaatgtgcccttctatcattggcccacagaacacagatggtgcggttatggaaggagcccgccgccggacaacctggcgacgtgtgtttcaaagaagatgggggttagccaactattctgatatggcaccccgcactttgttagggagcggggtgtttcaacccacagaca

SEQ ID NO: 645651 - DNA, 363 bp, Homo sapiens
  misc_feature (23)..(23): n is a, c, g, or t
  misc_feature (37)..(37): n is a, c, g, or t
  misc_feature (50)..(50): n is a, c, g, or t
ggcatgtttttggcaagtgcccnggtaccggttggtncctgtcccatgtntaagtgccttcccttcaggaactcttgtaaggcaggccctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttatagagtttcttctgagagatatgctgttagtctgatgagcttccctttgtgggtaacctgacctctctctctggctgcccttaatattttttccttcatttcaactttggtgaatttgac

SEQ ID NO: 645652 - DNA, 671 bp, Homo sapiens
  misc_feature (13)..(13): n is a, c, g, or t
  misc_feature (105)..(105): n is a, c, g, or t
  misc_feature (128)..(128): n is a, c, g, or t
  misc_feature (142)..(142): n is a, c, g, or t
  misc_feature (144)..(145): n is a, c, g, or t
  misc_feature (161)..(161): n is a, c, g, or t
  misc_feature (168)..(168): n is a, c, g, or t
  misc_feature (171)..(171): n is a, c, g, or t
  misc_feature (200)..(200): n is a, c, g, or t
  misc_feature (210)..(210): n is a, c, g, or t
  misc_feature (237)..(237): n is a, c, g, or t
  misc_feature (281)..(281): n is a, c, g, or t
  misc_feature (287)..(287): n is a, c, g, or t
  misc_feature (317)..(317): n is a, c, g, or t
  misc_feature (322)..(322): n is a, c, g, or t
  misc_feature (345)..(345): n is a, c, g, or t
  misc_feature (384)..(384): n is a, c, g, or t
  misc_feature (390)..(390): n is a, c, g, or t
  misc_feature (398)..(398): n is a, c, g, or t
  misc_feature (408)..(408): n is a, c, g, or t
  misc_feature (411)..(411): n is a, c, g, or t
  misc_feature (426)..(426): n is a, c, g, or t
  misc_feature (438)..(438): n is a, c, g, or t
  misc_feature (442)..(442): n is a, c, g, or t
  misc_feature (445)..(445): n is a, c, g, or t
  misc_feature (455)..(455): n is a, c, g, or t
  misc_feature (515)..(515): n is a, c, g, or t
  misc_feature (537)..(537): n is a, c, g, or t
  misc_feature (543)..(543): n is a, c, g, or t
  misc_feature (557)..(557): n is a, c, g, or t
  misc_feature (637)..(637): n is a, c, g, or t
agcccgcggcggntacctgcagcggaggagctctgtcttccccttcatctcacgcgagcccggcgtcccgccgcgtgcgccccggcgcagccgccagtccgcccngagcccgcccagtcgccgcgctncacgcccggggtgnannctctgccctcgctggntcagagngcnccgcagccgtcatgctttccgccatctantcagtcctgncgggactgctgttcctgccgctcctgntgaacctctgctgcccatacttcttccaggacataggctacttnttgatngtggcttccgtgggccggtagggttcgcantacgngcagcggtggccggcgcgcaccntcctgcgggcgttcctggagaattctcgccagacgccanacaagncttttctnctcttctgcnacnagactctcacctacncgcaggtggacnggcnctnaatcaagtgncccgggcgctgctcgatcacctcggcctgtgccagggagactgcgtggcgctccttatgngtaacttgctttcctacgtgtngttgtngctggggctggtgnagctggggctgtgccatggcgtgcctcaattacaacatccgcgcgaagtccctgctgcactgcttccagtgctgctggtncgaatgtgctgctggtgtcgccagaactacaaat

SEQ ID NO: 645653 - DNA, 1193 bp, Homo sapiens
  misc_feature (844)..(844): n is a, c, g, or t
ggcttcccaagcctcctcaagcctgtgagcaagatgcgcatggccactccgctgctgatgcatcgcgctgcccatgggagccctgccccgagtgggtcccatgctagaatgccaactaagtatggacatacatgatcagaggaccatgtgcatgcacctggctcctagaatgtctgacccccctgcaaggtgtacccgctcacgtgaaggcggagcttcccgtcatgaacctgcagacaccgttaagaacaccgatggcatgaccatagtactgcgaaggtctttgaggagtcttggattgcaactcgatctgcgtcggtccatgttatgaagattgaggcagtgcgacatccctcttggcagtcaaacatgccctagttgcacagtctcctaccgaagatatggttacttgtagccaaagtgctcaggaaaggaggctctatgccatcgatccctgattgtccacccgggcttcatctcaggccctaagttgtcgacgagaacgcgcgaacataatcttgccactctcagtgcctatgggacggcaatctggcttacttgcctggtagtgtcattccctcaatgggtcactggcgggtccccaaagagccaagtaagcccgtgggcaacctatagactgctagtgagttcacgtgtgaatctggaggatcctcgtcatatctggtgccttcgtgtgtggatccacatccaggatcctcgggcccagttccccacattgtgattaagcgagtcatgcatgggccggtcgttacaacgcaattcctttgtcgcgatgccacacaggactatgcgtaaccacgctctactactttagcttccccgntatcaagggcaccccctagggacccgtgccaacgcagattctttcctccagaggaccctttgttactccgttcaactcccctcgcattgaaggaacctcgcttgcggaatgccccgtggggatcatcctgttctcggttcgcacaccgccatttggggaagcagaaaggaatctcagacacccattgagggttcaggcgcacaaccaaaggcccaagagttactagcgactagtggtcagcggccgccttggtggcccgctatagtcgttagccgctcaaagctattgaagcagaatcgttcgtgtgcagcccaatgaggtgtcgcgctgactaggagttcccccaatg

SEQ ID NO: 645654 - DNA, 275 bp, Homo sapiens
  misc_feature (65)..(65): n is a, c, g, or t
  misc_feature (88)..(88): n is a, c, g, or t
  misc_feature (90)..(90): n is a, c, g, or t
  misc_feature (176)..(176): n is a, c, g, or t
  misc_feature (219)..(219): n is a, c, g, or t
  misc_feature (224)..(224): n is a, c, g, or t
  misc_feature (230)..(230): n is a, c, g, or t
  misc_feature (236)..(236): n is a, c, g, or t
ctgagcctgcgaagtccgctcccgccccgaagaagggctccaagaaggccgtgaccaaggcccanaagaaggacggcaagaagcgcangnagccgcaaggagagctactcggtgtacgtgtacaaggtgctgaagcaagtgcaccccgacaccggcatctcctccaaggccatggnatcatgaactcgttcgtgaacgacatcttcgagcgcatctcgngcgangcgtcncgcttngcgcaattacaacaaagccgctcgaccaatcacgtccgg

SEQ ID NO: 645655 - DNA, 81 bp, Homo sapiens
acctggatataatgggaaagggcctgggtgttacccatgtactgaaaatgaacttttagccatgttggtaaaaaattaaaa

SEQ ID NO: 645656 - DNA, 813 bp, Homo sapiens
  misc_feature (403)..(403): n is a, c, g, or t
  misc_feature (405)..(405): n is a, c, g, or t
  misc_feature (555)..(555): n is a, c, g, or t
  misc_feature (601)..(601): n is a, c, g, or t
ggcttccgcgtggggaggtcctccatgcgcagtcatgagtcgcttcaagtttatcgatatggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgctcagtacagttgggatgtcatcctacaagatgtggtgaatttgaaaagaataaccctgatctttacttaaaggagttgctaaatctgtgctgaaaaacaataaagggaaagtggtgggcaactaggagaatgcggacttgatttgttgaccgaactgcagtntngtcccaaaagatactcaattcaaattatttggaaaagacagttgtgaactggtcagaacaaaacacaattaccaatgtttcttcatgtgtcgaaagtcacatgctggaatttttggaccttcatgaaaggaaatagagatcggggtgtangggggagtggtgcattcatttgatggtaccaaggaagcaggcagtntcgctttgactcgaccttggactcctttataataaggatcttaattggttgctccactggccaagccggcacagctgaatccggcgaagtttcggaagtcccaattcctaggctggaaacgattcacggctcggaccacctgattcccaccctgtgccgctggcagtcccccggtacccctgcctgggtcccaactatcttcagactgccgt

SEQ ID NO: 645657 - DNA, 921 bp, Homo sapiens
agcggagtttggcgctttcctgcgcagagtctgcggaggggctcggttgcaccggggggatcgcgcctggcagaccccagaccgagcagaggcgaaccagcgcgctcgggagaggcttggacctgcacgacgcccccgttctagtcccttccgggtacctgctgcgctagaccaagtttcatttgctgtatgccatcctcgagagctgtctaggttaacgttcgcactctgtgtatataacctcgacagtcttggcgatctaacgtgctgtgcgtagctactccttctggttgaatccccaggcccttgttggggcacaaggtggcaggatgtctcagtggctacgaacttcagcagcttgactcaaaattcctggagcaggttcaccatgctttatgatgacagttttcccatggacatcagacagtacctggcacacgtggtcagaaacagcaagactgggagcacgctgccaatgatgtctcattctgccaccatccgttttcatgacctcctgtcacagctggcactgatcaatatagtcgcttctctcacggcagactaacttcttgctcaccagcactaacatacgcgacaaagcaacgcgtactcttcaggataatttccggaagacccaatccagatgtctatgactcatctacagctgtctgaacggcagcgcacaggacaaactccctggaacaacgcccagagcattacatcaggcctcagttcgcgggacatattcccagcaccaccagttgatgttcagaccacaaccgaagagacgctttgcacagaaccgtccagacacttgtgagcaggacaacggtattgtgctacgaggcctgcacactccagcccccggacactcacaaacacggacataatgactcacctgggcaactggacaaaccaaaa

SEQ ID NO: 645658 - DNA, 901 bp, Homo sapiens
  misc_feature (274)..(274): n is a, c, g, or t
  misc_feature (491)..(491): n is a, c, g, or t
  misc_feature (493)..(493): n is a, c, g, or t
  misc_feature (643)..(643): n is a, c, g, or t
  misc_feature (689)..(689): n is a, c, g, or t
ggcttccgcgtggggaggtcctccatgcgcagtcatgagtcgcttcaagtttatcgatatggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgctcctcatatttctttttaccgaagaaaaagaantgaattaagtaatttggaagaagtctttctgaaaactggcttcaggtatggttttccagtacagttgggatgtcatcctacaagatgtggtgaatttgaaaagaataaccctgatctttacttaaaggagttgctaaatctgtgctgaaaaacaataaagggaaagtggtgggcaactaggagaatgcggacttgatttgttgaccgaactgcagtntngtcccaaaagatactcaattcaaattatttggaaaagacagttgtgaactggtcagaacaaaacacaattaccaatgtttcttcatgtgtcgaaagtcacatgctggaatttttggaccttcatgaaaggaaatagagatcggggtgtangggggagtggtgcattcatttgatggtaccaaggaagcaggcagtntcgctttgactcgaccttggactcctttataataaggatcttaattggttgctccactggccaagccggcacagctgaatccggcgaagtttcggaagtcccaattcctaggctggaaacgattcacggctcggaccacctgattcccaccctgtgccgctggcagtcccccggtacccctgcctgggtcccaactatcttcagactgccgt

SEQ ID NO: 645659 - DNA, 219 bp, Homo sapiens
cgcgatcggtgcggctagtccatctatctggtgctagaaccgagcgattgaagcgtgcgaaagctgcgcgtaacgcaagaacctcgagatattctgcggacctacgagcaaagtcgacctcagacgagtggaggatattctgaaaaatgacgatcagatatcgacgctaatcaacaatgctggctacggcgtgagctcttcgtagctcacatctgatgt

SEQ ID NO: 645660 - DNA, 922 bp, Homo sapiens
  misc_feature (224)..(224): n is a, c, g, or t
  misc_feature (441)..(441): n is a, c, g, or t
  misc_feature (443)..(443): n is a, c, g, or t
  misc_feature (593)..(593): n is a, c, g, or t
ggcttccgcgtggggaggtcctccatgcgcagtcatgagtcgcttcaagtttatcgatatggtatcaacttgactgaccctatgttcagaggaatttataggggggttcaaaagcatcaagtttatgattacaggtggaaatctacaagacagtaaagatgcactgcatttggcacaaacaaatggtatgctcctcatatttctttttaccgaagaaaaagaantgaattaagtaatttggaagaagtctttctgaaaactggcttcaggtatggttttccagtacagttgggatgtcatcctacaagatgtggtgaatttgaaaagaataaccctgatctttacttaaaggagttgctaaatctgtgctgaaaaacaataaagggaaagtggtgggcaactaggagaatgcggacttgatttgttgaccgaactgcagtntngtcccaaaagatactcaattcaaattatttggaaaagacagttgtgaactggtcagaacaaaacacaattaccaatgtttcttcatgtgtcgaaagtcacatgctggaatttttggaccttcatgaaaggaaatagagatcggggtgtangggggagtggtgcattcatttgatggtaccaaggaagcagaagctgcattgattgactgtggatcttcatataggattcactggttgctcactgtgacgaacttgaaggtaaatttggaagtttagaaggtcaattccctagtggaacaacattcacgtgacttggacgcaccagattgcaccctgggttgtaggcagtccaaacaggttacccattggccggatccaccatatcatccgaaacgtggcattcccttacccaaaaagaagtgggggacagttggcggcccgggcttaaaagacacagaacatgcaccctgggcatatat

SEQ ID NO: 645661 - DNA, 118 bp, Homo sapiens
gggcaacatcacatctaattccagaacatttgatcactcctcccaaactccataggcatgactttaatgtaatggcatatacatatatagaaatacataagacagccaatcacagaac

SEQ ID NO: 645662 - DNA, 666 bp, Homo sapiens
  misc_feature (42)..(42): n is a, c, g, or t
  misc_feature (65)..(65): n is a, c, g, or t
  misc_feature (167)..(167): n is a, c, g, or t
  misc_feature (248)..(248): n is a, c, g, or t
agcaacacaaattcatggaagtatttggaggcaggcggtttngcagagcttaggacacgagggcncagtaatcagggctgtagtctttattatgcactagtgcatgtggctttgggcaaataactctgcttgtctggactccagttccttcactcccccaagtcacnaggttagccagaatgacctccagtcattctgattctgtgactcatgatcagagtcacaggaatatttttattgagttgacnaaacgagaggatgaagggctgcaaggttctgtatgcacatgtgggtgcgtgtgcaccagcgtcctcttctgcctgtcctctccttgttgagctgtatctccccttcagtatgggatggttgcctttacttttctctagtgggtggcctctcctgtgcttgacatatctgtcactatattgttttctcttccgtctctgaccttataggttggcatttcaagtctactccttcctcttgaattctacctccaggtaccaggctctggatgggattattgcaaagactgcctacgattccctccttacttacgggcccatgctgctctcatctgtccatgtttcacttagggtttgcttaaagactctctggactatgtgctgcccctactttagacattgttttgctatcttacaactg

SEQ ID NO: 645663 - DNA, 132 bp, Homo sapiens
acaggatcccgacagcacagaggaggtatagtttggcaatcctcttatgggcaggtcagcaaaaagcaagcagaaagaacaacaacaacactaaagagcaagttcaaatccaagggggagagctcctctgtg

SEQ ID NO: 645664 - DNA, 671 bp, Homo sapiens
ctttggtggtgtttggtgttgtggtcattggccccgtcccggttcccgtgtttgggttttttgcgttcgtgttgttcggggtttagtggtggtgcgccccaagcccgatgtcgcgtgtgggtgtgtggggtggggattggacccaaacccgtttcgttggtttggcccgtcccccacgcggctctgtggggagacacacgctggcctcttctccaccgcggaaagtggtggtggtatagacgccgcgtaggtttagggagttgctcttttggcctggcacgtgggtgtgcggcgcttttgggagacccccagttgtttgtttgttccccctttgggggcccccccacggggggaggggtgaggtgttggggcgagcgttttgcgggggggggggagggggggggttttgtggtgggaagtttggtgaagatggcggaagttttcacgtgaagcccaccggtcacgggtaacaccactgtgaaggcccgagcccgcctgagtaaaagttccacccacagactggagaattagactccaactttcttttaggcaccttgtgtaaaatgaaatctgacaatgtggtttaactttgtactggtaattttctgtatatttggaaaatttgggttaaaaatcaaaaccgactggactttgttacccgacctactgga

SEQ ID NO: 645665 - DNA, 390 bp, Homo sapiens
agaggatccaccaggcaccactgcaagtctgtagggctgggagccgtttgatgggcaaaggggtcccccggatccaggcagggtagagagggggatttcaggtttaggtccagaggagagtgcctccccacagtctggcagtcattagcagggtgatggtgaggctgagatgggcagggccaggctgaggagcagccccactgcggtactggacatccaggtctgggtggttacagccacttttagtacagcaggagacatcaatgtggttcgtgctgagggcgtcacccaggtgggcatgttggcacattgaggcggttgcacagcctcttaccatatagctttggtttttcggttcgtgagtgccggtggctaccagacattgattca

SEQ ID NO: 645666 - DNA, 957 bp, Homo sapiens
cctgatcgtacggttgactttgcggagcctggagggcggcttcggctccgattcgggggctccggcagaagctgaccccaggctcataatggagcaggtgaagtgcatcgcgtgcaccgagcttgctgcatgaagcgatgacggacaaaggtgttccaggaagagtatataggcgaaaaccctgggggctcccgtggacaaactccgagcagagaaagtgtatcgccacttgtgcatggaccgcttacatggatgccttggaaccacactgtgtctcgcggcttacaatctctgcggtcagtgcagtcggggaaacgtagcccaacatgttgacgcgggcgagcgccggggacacaccaacccctgtaccatttacccattaagacgtggcttgtgaaccgaacacgcgagtcacgaattggtacaaatacctgccatgcccacaggctatagcaagtcgattgacaaccggcgagctacggaccacacgggaacttgatgtccgtcagcaaacccccccaggcctgacaaacaatgaccaagaccagtcgcatgattgggacacttacgcgacgttgtgggacccctggtgccttccctgaggaattgctgtgcagccaaagtgccacctcatgaagagcattatgagggtaattcccccttagtggtgccccaaggtaagccatgatactcctggcgcggaacggcttgtactggaattccggagttgacgtatggccacaaacccaggaacttgtccactctgccggattgagtacctacattggtggaggaaaataagaaaataaacataagagacaattctgcattagctcaaaaggttctaaatttgtaggacccacaaatatagaagtgtacgttgaagcacgcgtcgtagtcgttatacaaaaaaacggggcgtcttaatacggggtggcctgtcaaagccagattcac

SEQ ID NO: 645667 - DNA, 1173 bp, Homo sapiens
gggagcgcggaccgcggacgaagatggcgaccgacatgatactatggagcacatatctggacagtatcgagaaccttccctgcgaacattcagaggaacttccagcatgatgcgagagctggaccttttgtgacggaagataagaaagcagagcatgacatcctggctgcagagatacatacaccacggtagaagacagcagatactacacaagaccagcgacgtaggagcgcactagcagaagataccagaacagcctaacacgcaagtgcaaggaataacagagacgacaaaagtagcagctaggccatgcagacctacgaagcataggaggataacacacataacagaaaggctagaaagccaggaccaggacgcgaaaatgacacgccaagatacagcacagaacagcatagagagagagcagagactacaacgacacagcaccgagaataggaacgcaagcaaaaaaaaaacaaaagaaccgaagcatcagaaaagacaaaacagaagagagaacaccgaggagacccgacaggcacggaaacaacactacacgaggagaaaaaaaacaaacaacaaagacaaccagaagacacacaaagcgagagaaaagaaagtaccaaagaaaaacaaaaccaggaacgaagaaacacaaaacatacaaagccaggaacaatgacaaagaagaaacacacaacaaaaacacaagaaacaggcacagataacaaacaagaacacccaaataaaagcaaatagaaaggaagacaaccaaaacagaacaggacacaaagaagacaaaacaccaagaacagccgagcaacaagaaacagacacacacaaaaggaacacaagaaaacacaacaacaacaccagaacaagggcaaccacagccacaaccaaaaaaaaagaagaaaaaaaataaacacacaagaaaacaagagcaacaaaacgaagaagagaagagcagagaaaaacaaaagcgagaaaaaagagaagaatgcgaacagaaaacgaagaaaaggaacagaaaaaagaaagcagagagcagtaataagaaaaaagatcgaaacaaacaacaaacgacgacggacgaaaacagacaaagtgcaagaacagacagcagagagaacgacgacgagaggcagagcgcacaggtcctgtggccaaaag

SEQ ID NO: 645668 - DNA, 296 bp, Homo sapiens
  misc_feature (34)..(34): n is a, c, g, or t
tttttttttgggggaaaggggggttttttgatcncccttattgcccaaattttaaacattaggggctaacaggaaatggtttaaccccaactgctcccaggggttacatggtttttcccacaagtacccaacaggggtgggggggggcccatgttggcccaaaaaaaaagaattcaaacaaaatgcatcccccggggccctaagttaaatgtgtttttttaggggccccggttttttttttttttttatggaaaaccttttttgttaaaaacagtccctttatttcttggccttta

SEQ ID NO: 645669 - DNA, 638 bp, Homo sapiens
  misc_feature (606)..(606): n is a, c, g, or t
aactcggccattatggtcggggcagccatcaattaagaaagcgttcaagcttatcacccactacctaaaaaatcccaaacatataacggaactcctcacacccaattggaccaatctatcaccctatagaagaactaatgttaggataagtaacatgaaaacacttttctccgcataagcctgcgtcagattaaaacactgaactggcaattaacaagccaatatctacaatcaatcaacaaggtattattaccttcactggcagcccaacacaggcatgcttatatggaaaggttaaaaaaaggtaaaggaactcggcaaatcttaccccgcctggttaccaaaaaacatcacctttagcatcaccagtattagaggcaccgtctgcccagtgacacatgtttaacgggcgtggtcccctaaccgtgcaaaggtagcataatcacttgtcctttaaaaaggacctgtatgaaagggttcacgagggttcaggtggctcttactttaacccaggaaattgacctgcccgggaagaggcggcatgacacagtaagacgagaagaccctatggagccttaatttaataatgcaaaccgtacctaacanacccacagggtctaaacttccaaacctggttt

SEQ ID NO: 645670 - DNA, 147 bp, Homo sapiens
ccttgtctcagatgacactgtgaactttttacatttgagttattgcgggaatgagttaaggcttttggaaactttgaatagacacgattgtattttattctgtgagaaggacacgaatgttcaggacacgaaggacacgaatgttca

SEQ ID NO: 645671 - DNA, 367 bp, Homo sapiens
gatgactgctggcgtacagcagatgagacatctcggattgatacctggagtcatcactaagcacctcgtcatgcggctgggacaactccggcgaaagagttgtacctgagcgataacattgagggatgatagcatcgagcctgtagtgctgtgcaattcatcacctatcttaatctcttgctacaccgaacagcagatgctcagacgacttgtcgatggagctccacgaatacctgtgctcgtcatccattcatcattgcacacgagctagccgtgtgagacgcccttggtccggctagcagcacatagacggttgactgcggacctacgagatacttagagcgacgctgctcctgatgatcttgtc

SEQ ID NO: 645672 - DNA, 334 bp, Homo sapiens
gtacagtggctcaccctgtcatcccagtactttggcagactgagagttgcaggagtatgaggccagcctggccaacatggcgaaagcccgtctctaccaaaaatacaaaattagcctggcatggtggtgcatgcctgtaatctcagctactggggaggcagaggcaagagaatcgcttgaacccaggaggcagaggttgaagtgagccgagatcgtgccattgcactccagcctgggcaacaagagcgaaactccgtctcaaaaacaaaaccaacaacaacaacaacaacaaaaaaatatgggtgaggtacaataaaactgtagaggaatttgg

SEQ ID NO: 645673 - DNA, 530 bp, Homo sapiens
  misc_feature (41)..(41): n is a, c, g, or t
  misc_feature (262)..(262): n is a, c, g, or t
  misc_feature (299)..(299): n is a, c, g, or t
  misc_feature (320)..(320): n is a, c, g, or t
  misc_feature (323)..(323): n is a, c, g, or t
  misc_feature (342)..(342): n is a, c, g, or t
  misc_feature (346)..(346): n is a, c, g, or t
ggagcgccggaggagcgtaggcaggcagcgctggcgccagnggcgacaggagccgcgcgaccggcaaaaatacacgggaggccgtcgccgaaaagagtccgcggtcctctctcgtaaacacactctcctccacctggcgcctccccctccgctctgcgctgcctgccctggctgggcgccctgaggcctgctccgactgctatgtgaccgcgaggctgcgggaggacaggggacagggaacgaagaggctctcccgcgggangcccttgaggaccaagtttcgcggccacttctgcagngcgtcccttcttagctctcgnccnagccccatttctgcagccntagngcggcccgaggttctcttctcttcctcgcgcgcccagccgcctcggttcccggcgaccatggtgacgatggaggagctgcgggagatggactgcagtgtgctcaaaaggctgatgaaccgggacgagaatggcggcggcgcgggcggcagcggcagccacggcaccctggggctgccgagcggg

SEQ ID NO: 645674 - DNA, 123 bp, Homo sapiens
ccgagttcatgccactgcactccagcctgggtgacaggctgtctcaaaaaaaaaaaagggaatattctgtacggtttccagtatttatatcggattataagggaacactgctttcaaacaagg

SEQ ID NO: 645675 - DNA, 548 bp, Homo sapiens
  misc_feature (269)..(269): n is a, c, g, or t
  misc_feature (393)..(393): n is a, c, g, or t
atatttcctggaagaattaaccgaccaactatctgctgcctttaagagactcacctaacacataagagacttatctgacacataaggactcacataaacttaaggtaaaggggtggaaaaagacatttcatgcaaatggacaccaaaagcaaaagcaagcagaagtaactattgtttttttgttttttttggtttttttgagatggagtttcactccagcctaggcgacagagcaagactccatctcaaaaaaaaaaaaaaaaaaaaancctagaagagatggataaattcctggaaagatacaaccctcctagcttaaatcaggaagaattagatactctgaacagaccaataacaagcaacaagattgaaatgctaatttaaacattaccnacaaaaaaagtccaggaccggatggattcacagcagaatgtaaccaggcattcaaagaattggtaccaatcctattgacactatttcataggattgagaaagagggaaccctccctaaatcattctacgaagccagcatcaccctaataccaaaa

SEQ ID NO: 645676 - DNA, 401 bp, Homo sapiens
aactgtctgagcctgaccttgtagaatggaggcaaaaaaactgatttaatgagcctgatccaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaagcgggagcggggcgggccgccctcacgctccgccggggcgggcgcccagccgcgccccgatataagatgaagaagaggagacacgacgtgagccgctataatcaacgcagcgcggagcggacgaagagaccgagtgggagccggaac

SEQ ID NO: 645677 - DNA, 436 bp, Homo sapiens
ccaaagttacatgctactggtctggtgtgtgggctagtacctgctatcattgtacttggctaagttagggcccctatgtcacttgaggccatgtgatcgtgaccggcctggccgtcatggtgaattaccggctttactagttgtacaatttttacgcctaatgtaccggctgatggacatgacttatgagctatagagtgtggcgatggaaaggggagatgacgagagagaacgctagaacgaatgaaggatcgatagaaccataacgagagatagaaagaaagagattgattgcaagagagtcggaccgcgaacgacagatgcggctgctcatgcttgtaatcacaactactcggcagactgaggcatgagcatcgcctgaactcagaaggtggaggttgcagcatggcgagattacgccactgtactcccctgc

SEQ ID NO: 645678 - DNA, 178 bp, Homo sapiens
  misc_feature (50)..(50): n is a, c, g, or t
catcagcagtgcaccgtaatttcgtcatagctattccttgaggaaccccntggcgcatacttatctcagttactcaggaggctgaggcaggagcatcacttcaacccaggagcagaagctgcagtcagccgaggtggcaccactgcacttcagcctgggcaagactggagactgcctc

SEQ ID NO: 645679 - DNA, 918 bp, Homo sapiens
cgtttgtgttggtgacttgtcttgaattgttcatttgtgatatattttagtatgtatttatgttatatatacagtggtaagtgttattgtgtgatatttggttttgatttttttatgtttcgtattttgttagtagtatttagtttattaatagagaataaagatctacattgttatttttttggtgttgggagtgtggtttttttgttgcttattagtctgatattgattgtcgattggtgtgtgttttatatctttcttttatctttttcgtagccgtcgttgtgcgatgcgggttattgttatgagattgtgtgggtcttgcttgtcatattctaggtgttggttcgtccccccgcttgtggggaaggggtgtctaaaaaaaaatatagagcagcgaggagcgctctcgcgtgttatgatggaaaacccctgcacagtttcgccctcggagaaaccccacattccaccgcctttgtttttgagacactctcacctatgagaagatgcaccccgcggagtccgcagtgtcacacagacctctccgcgagtctcttatatcctataggtcccgcgcggagcggagtataacacacattttacacaccacgggaaacacacctattgagcccttataggcctaatttataggtggacacacctatatatgagactccaagctttggaccacacaaaagcacggctggtataccgcgttcgcgaaatttcccgcggagatatatttttgaacccacacgggttctgccccacacggcgtccgcggagaaaggttaaaactccatgtgtaccacacaaatatatgccacactataaatgagacctatattattggcctttgattttataatatttgtatttttataaaccttttctcatataaaaattaattttaatcca

SEQ ID NO: 645680 - DNA, 159 bp, Homo sapiens
ggagtcacttaaggatccgctgatgttcggttgtcctcgtcatcatccttcacacgtgcgtcgtgtttgtgtttgcaagatcctctgacagtgatctgctttgtcccagggacgtggtagtgtattagctgacaaccaagacaaggatcagccttaagc

SEQ ID NO: 645681 - DNA, 388 bp, Homo sapiens
ctttccatggtcccatgatcattattaaacagtatggaacaccggtgacactgttcactgctattctagggcagcctctttagcttggtgggctatgtagtacagctacagacttcatcaaccttgcgaacggagtgactctaggagacctcgagcatataacagaagttctagaattatcaatcatccaaccaacatgccacgtaattttaccaaacaagagtagggtgcatggcttgaataagaggaaacagccgttcaaccaaacatatagctatatgctcttgaggagagggcagatgccaacatggaagcagtcaaaggttcctgaccttgtacatgaacagcaggctgtagcattgtaactagtggctgtgcattaagatgt

SEQ ID NO: 645682 - DNA, 252 bp, Homo sapiens
ttattcagaaagggcttctcacccaatcctaactttatgccctagatttttctcctctgagcctgtgctcaagccaaccccatgccacagaataccccctctgtgcctaatgaaaccctgctcgctcttcaatataaacagcacctccaccacgaagctctccttgatcctgacccctgtggctggagttggtggccctttccactgaacacagtgttggaacactgataagggccacctggtcagccatgg

SEQ ID NO: 645683 - DNA, 397 bp, Homo sapiens
taacaaatgggtatttgtctggctcttagtgttaaacaatttaatttcttcttttaactgaaacatcagttaagaataaccttgtaattcttttatttaaaataaggctctcggccggcacagtggctcacacctataatcccagcactttgggaggccaaggtgggcagagcgcttgaggtcaggagtttgagaccagcctggccaacatggtgaaacccctcctctactaaaaatagaaaaattagctggcgtagtggtgcgtgcctataatcccagctactcaggaggctgagtcaagagaatcgcttgaacccaagaggcagaggttgcagtgagctgagattgcgccactgcactccagcctgggtgacagagtgaaactctgtctcaaaaa

SEQ ID NO: 645684 - DNA, 345 bp, Homo sapiens
accacaacatggaaaaaccttgaaaacatatcaagtgaagaatgccagacatgaaaggccacatattatatgatttcatttatatgaaatgtccagaacaggcgaatatatatagagagaaggcagattagtggttgcttaggctgaagggttggggaggacaaaggggtgactgctaattagtatggggtttcttttttggggtgatgtaaacgttgtaaagttgattgtggtaatggtggcacaactctgaatatactaaaaaccactgaattgtatactttgaatgtttgccctgtgtggtatgtagattttatctcaaaatgttataaaaaattaaattac

SEQ ID NO: 645685 - DNA, 206 bp, Homo sapiens
cttcctgaatggttggagactccatagaagtggactaaggctgcgtgccaccactcaggcacatggaagacatctgtagtgagactggaaccagtatgtcaaacctttaccatggagaagaacgcgctcagtgaaattcgatgcatgcttaagatggcctagctccaagtagatgtacagtcacaagccatagatgtagagaacca

SEQ ID NO: 645686 - DNA, 218 bp, Homo sapiens
gatgaagttaacttcttcctggaagctggtgctattcatccacggagatccacagcgtcctgcagaagctggtgcgtccagtgcagacaccaacactggtgctgtggtgagctggtgaaacactggtgacagccaccgagtcgggagctgccagacctcacctggaccccttgcccctcatgctccctactagtccctgcggtggtggttggcacccc

SEQ ID NO: 645687 - DNA, 157 bp, Homo sapiens
aaatcccgtctccactaaaaatacaaaacatcagtcaggcatggtggcacatgcctgtaatcccagctactagggaggccgaggcaggagaatcgcttgaatccgggaggcacagggtcgcaggctgtgctgggatggcaccacagcctaggtgaca

SEQ ID NO: 645688 - DNA, 461 bp, Homo sapiens
cagacaatatgctaagctggagtgcagtggcacaatctcaaccactgcaacctccacctcccaggtttattttttttctcatgcctcagcctcccaagaagctgggactacaggcatgtgccccaaaggccagttaagttttctttttccttttttcttttttcttggttgagacggattttcgctcgtcacccacactggagtgcaatggcgcgatctcggcccactgcaacctccgactcccgggtccaagcgattctcccgcctcagcctcccgagcagccgggactagaggcacccgtcaccacgcccgctaccttgggcattcctagtagagacggagttccaccacgctggccaggctgatctcaaacccccggcctcaagtgactcacctgccttggcctcccaaagtgctggaatcacaggcccggcctatctttgcaatattggtctgcaca

SEQ ID NO: 645689 - DNA, 156 bp, Homo sapiens
aatcggctcggtaccgtcgtgtctgtttacagcaggcgcttgaggcggcgtaacgcgctgcgacagcggcgccggttgatggcggcctgcgcctgcgccaccagttggtcgtctttggcgtaaggcgaggcctggatctgcgcatccagcagctgg

SEQ ID NO: 645690 - DNA, 312 bp, Homo sapiens
  misc_feature (198)..(198): n is a, c, g, or t
ttaaagggaaaaagacacggcagaaacttaaatgtttagtgaaaggagactatgtggttaaaaaacccaagtatgcccatgtgtttcaaaaaagggacacttgaaacaagggagtgtttgtcacatttcactttcatgggaaataaaatgcagtttgcaaaaaaaacttgaaaatctggaacaagttttttcacgccngcaatcttggagtctaggttgccttgtctctccaatttttaaataagtgaaatttgggagattgtaaaatctgtaaagtttgttttgtgaaaataaaatgttcacagtagggga

SEQ ID NO: 645691 - DNA, 214 bp, Homo sapiens
gtttatctgcttctacagcgttatgcactcttatgactgatattatgctgtagagcctgtccctttcattgaaccccctgatagctttgaattttatgcacagcagctaataaaattgagggataactcttcttgaaataaccaggcaatactttgttttgtatatatttgtgattctgtgtctacctcttattttgacgtataaagcgtttag

SEQ ID NO: 645692 - DNA, 332 bp, Homo sapiens
  misc_feature (6)..(6): n is a, c, g, or t
ccctgngcacagcccagatcctagcactagctagacatataggggagacttaaccaaatctacaggatcaacttccagccagacccagccaggcacaggctgggtccagttctagacctgagcacggtttttcctacatagtagacttctagggaaggcgctccctcatactagggccaaaggaaggaggacgaagccctacctacagctaggcctagtgttaggggcatagaatactactacctactacctacctatgtactaggctactagttagacaaatccgggcatagtattaggcagtaaattaggcaccgtgttcacactagttt

SEQ ID NO: 645693 - DNA, 117 bp, Homo sapiens
gtccaaacagtgcctatcctgaattgttaaacaagaatgtacacatggaaggtggcgggcacctgtagtcccagctacttgggaggcagacacaggagaatggcgtgaacccaggag

SEQ ID NO: 645694 - DNA, 96 bp, Homo sapiens
  misc_feature (41)..(41): n is a, c, g, or t
agagcggccgcttactacgctatgctgcgagaagacgacanaagggaaaaaaaaaaaaaaaaaaaaaaaaaaaaaaaaaaaaaaaaaaaaaaaaaa

SEQ ID NO: 645695 - DNA, 146 bp, Homo sapiens
acgccgccgaggtcactgtgcgcgaactcgtcgagagtatgctcgcccccggcactctgctgaacggtggcggatcgttcaactttgtcactcaagacgacggcgtcctcgcctcctggtctccgtaaggacgccgccttcaccca

SEQ ID NO: 645696 - DNA, 1367 bp, Homo sapiens
gcccataccccgataacgttggtttaaatccttcccgtactaataaatcctatcacccttgccatcatctacttcacaatcttcttaggtcctgtaatcacaatatccagcaccaacctaatactaatatgagtaggcctggaattcagcctactagcaattatccccatactaatcaacaaaaaaaacccacgatcaactgaagcagcaacaaaatacttcgtcacacaagcaacagcctcaataattatcctcctggccatcgtactcaactataaacaactaggaacatgaatatttcaacaacaaacaaacggtcttatccttaacataacattaatagccctatccataaaactaggcctcgcccattccacttctgattaccagaagtaactcaagggatcccactgcacataggacttattcttcttacatgacaaaaaattgctcccctatcaattttaattcaaatttacccgctactcaactctactatcattttaatactagcaattacttctattttcataggggcatgaggaggacttaaccaaacacaaatacgaaaaattatagcctattcatcaattgcccacataggatgaatattagcaattcttccttacaacccatccctcactctactcaacctcataatctatattattcttacagcccctatattcatagcacttatactaaataactctataaccatcaactcaatctcacttctatgaaataaaactccagcaatactaactataatctcactgatattactatccctaggaggccttccaccactaacaggattcttaccaaaatgaattatcatcacagaacttataaaaaacaactgtctaattatagcaacactcatagcaataatagctctactaaacctattcttttatactcgcctaatttattccacttcactaacaatatttccaaccaacaataactcaaaaataataactcaccaaacaaaaactaaacccaacctaatattttccaccctagctatcataagcacaataaccctacccctagccccccaactaattacctaaaaaaaaacgggggcggacaaaagatacctcaggggccagatacgcgaaccactctggcaaggggccaaagagccgatacaagcacaccggacccgccatacaagcgcgagcgggcaacgcccgcgtgaccggtggagaaccaacgggggggacaggggacaaccaagacatagccccgacaatacaacggccagctacagaccaacgggaaccctcagattaacaaaccaacgaagaaaaagagcgacacagaacaacacaacagaaaaaccaacacacaccacacca

SEQ ID NO: 645697 - DNA, 144 bp, Homo sapiens
ccaattggaatttggggttccaaccaaagggtggtatttggaaaatgacctgccttatcttgttctataccagttttgtttgctgctgggtctttagaacagtgcctggcacacagtaagcactcaataaatctttgatgaatg

SEQ ID NO: 645698 - DNA, 412 bp, Homo sapiens
  misc_feature (239)..(239): n is a, c, g, or t
gttttaaagaagtgttatacaaagcatcgcccgccccctatagggagcccacggagtacactctcctttggaattctgtcccagctatgatccaagttctcagctctttccaactttaacaattttgttaacagcaccctgcctagaaaattttaaatatttatgtctgcaacaattgtctcaaaataataaactgtccacttcttgtcattacacaaacaaaagatctgacttttccntaatgcgccctgttagtttctctctgtctttcctgccagtgtaaatgtgaaagctttgcttgcattacgttttagaaatgcattttgcacactcgaattttgccgaagctccgtgaaaaggttagatctaagtagatgaataaagctatgcacatgttttgaaagtttaaaaa

SEQ ID NO: 645699 - DNA, 321 bp, Homo sapiens
  misc_feature (148)..(148): n is a, c, g, or t
atgccaggtgctctcctggaggcagcggtgctttcaggagcccgacggtgctggccccggcacctcggttaggaatgtccttggagaaggcggggcgcccggggccgcctcccgcaggagccgccgtgtgaggacggcctggccactntatcctgcgggctcgggagcgggtgactttggaaagtccgagaaggtgtggattcccgttgacgtccctcccgccctgaagtcagggtgatttcatagcgaagttttccgttctgctggaatgttccttttaaagaattctccttggggtggaataaatgtcacccgggatga

SEQ ID NO: 645700 - DNA, 1428 bp, Homo sapiens
tgggacagagccctgtggaggccgggccgagctcgggggtcacgccgtggtcccggtggcctatggtatgtgcagcctgtcgtgacaggtgaacgaagcttctgcgaggatgctgcagctgcccgggggtctgtgacactcgatggcctcaagggcctgagtttgttgagctggctgctgggctggcggtatgacgacggccggagggaggctcttggacggactgagccggagagcatgaacgcccgacgaacggaatcctggtgagcggaccccggggtgcaacaattcaaacgaggggaggagtcgaagaaccggagggggagaggctcacggatgcacttgggaacgagagaaacccagagagcaagcaaacacagttctgtacccatgagtctttgacagccacgatgacagaaccgagaagcacaggtgcaggcgtataacttcgaagagaatccagaaacggcaacaattatattgccccagtgggcaaaaatctattaaacccatgtggccgagtgaactccgaaaattttccaatacgggaaaataacaccataaatgatcaatttgcaacacggacagacacaaacacggaatggtttcaggggcatacacagaagcaaaggcagcaacccaacgcttgggaacagatttggtacaacctatcgtattgtcaaggggcccacaaatttggcatgacaaagaaaacagtagtgaaaagcgaaacaaggcaagcgatttgaacagcgacacaagcgcgacgagcacaaccagacaatgaaaagcgtatcaccattcccgacgctgcactgctggaaactggcgactattgagatcaatgcgtcacaaaagcgactgaagacaaaccaggccgcacgcgacaaatttacacgagcagtgttcagacaaaacgaagggcaccaattacatttagacaggaaagcaaacacccaggtcgtaaatcggcagctcactatcaccatctcggagccgcaccacgagggaagagagatattaacacgacggggggaccaccgaacacacccccttcaagaccacatcaccataggtcatacacaacacagcgacataaacactagatcgaacactctaggtacgaagatacaaccccagtttgcaacgcgatactaggccaccacgataaaatagcctgcagcaaaccctcaaagaatataaaacgggggcagccccacaagcgactagacggcacacacgaggagggaaaaaccgcggctacacaacaaaaaggaacgaacttagtaacaaaacaacagaagtacacaaaaaccaccaagcccaacccaagactatgcaggccaaacacaagagggcacgagacatatccacgaacaacagagtagaacacaagccaggaacaaacaactcgagcactatacgtat

SEQ ID NO: 645701 - DNA, 177 bp, Homo sapiens
tcgtataagagtacaaaacatggcatagaaggacaccatcatcatacacagtacaaatgctgtaaggttcaaacttacagttgtacacgggctaggcaacctctgttcttcccagaacagccatattaagatgaaagccactaagagtgaactcattaattacattaacacgtgggg

SEQ ID NO: 645702 - DNA, 556 bp, Homo sapiens
atggcgcgatcttggctcactgcaacctccacctcctgggttcaagtgattctccttcctcagcctccagagtagctgggattacaggtgcccatctctacgcccagctaactttttgtatttttagtagagatggggtttcactatgttggtcaggctggtcttgaactcctgaccttgtgatctgccgacctgggcctcccagagtgctgggattacaggcgtaagccaccgtgcccggtccccggcaataatttttaagagtacagagttgttggccccaaaagtttgagaactgctacactaaaatagtgattcaaatccagtctggatagttttttattgttgttgttttgtttttgagagggagtcttgttctgtcacccagcctggagtgcagtggcacgatctcagctcactgcaacctccatctgccagcttcaagtgattattgtgccgcagcctcccgagtgttgggactacaggtgcgcgccatcacgcctggctaatttgtgtatttttagagacggggtttcaccatgttggccacgctggt

SEQ ID NO: 645703 - DNA, 1052 bp, Homo sapiens
ccggtcggtgaacaaggcccgcgaaaggccaaacgggtaacctccgggaaggcccgtcgccttccactccaaggggggcgcctcggggggagaacacgtgtccaagcagccgcaagggtccacagaggattggcgtcctgccggcaaatggacccccagaagggagaaaccaaggatgtaaggtgggcgacgcctgggcacgcgtggaagtggaaacacctcccctccccgggccccatcctgggctgcccgagttatcccctttccaggcgccggttgagctcatctggcttcgctacttttgcgcgtatagggatgcggggaattgttttccaatttgacatgctgaacgcgttccgatcttgaaggccacgaatggctttttataaacgttgggcaagcgaagccatacgcattatcagctcagtctcaagctctttgctcgggaatatcgcgcattcacctcagatcacagtggttccacaggatcagggccgtgccctgtcgtagcatgtcgccagcctgcgtttggccccttcaaagcagtgtgccagtggcagcctgttcagttgggtcatattaggtcaccaggccagtgctcaggagggctcctttgcaaggtcggcagttcttcgggatgtcaggttcacctggccatgtatgcgcgcgcggagcggccttaccgtcgcacctgaggtagcagcagcggcgtaggaggcagtggtaccgagagtggagtctccaaccgagggactcgagagccaagcatgaacgagcctcgtgtgctgagtatacagcaggatccaaggaatgcacaccggcagaagaggaggaggatatatcggctgaggaggccggagaggaggcctaaggcaggagcccccagtcagcctcaggattctcagttcccttagaccgtcttaactcaagctgcccctttcctctcccatcagaatgtggtgttatgctgccatctatcttgttgttttgttttttcttctgggggggggatctagaatcagtgataaccgcacatagtaggcgctcaatta

SEQ ID NO: 645704 - DNA, 476 bp, Homo sapiens
aaaagccatttctatacaccagtgatggccaaagcaggaacgaaatcaagaatgcaataccattcacaatagctacaaaaagaacaaatatctaggaatacagctaactgcggaggtgaaagatttctacagtgagaattacaaaacactgctgaaagaaatcagagataacataaaaacatggagaaacattccatgcccagggataggaagaatcaataccattaaaatggctctactgcccaaagcaatgtacagattcaatggtattcctatcaaactaccaatgtcatttttcacagaattagaaagatatgattctgaaattcatatggaacaaaaggagtgcaaatagccaaagcgatcctaaacaaaaagaagaaagccagaggcgtcacactatctgacttcaaactgtattataaagccacagtaactaaaacaacatggttctagtacaaaaacagacatatgga

SEQ ID NO: 645705 - DNA, 153 bp, Homo sapiens
tgctgatacgatcgagctcggtaccagaaaagaaaagaataattagaaatctgaaagatgaaatcgaaacaaggcgagaaaacaaacacttcaacagctcatatttaaatagcgacgagcaaaatcgtagatgctacctaccttgcccttccg

SEQ ID NO: 645706 - DNA, 105 bp, Homo sapiens
tcaatcctccctgtacgaaaggacaagagaataaggctacttcacaaagcgccttcccccgtaaatgatatcatctcgtctcttcatctcgtctcttctcttgta

SEQ ID NO: 645707 - DNA, 254 bp, Homo sapiens
tcctgggggataactggaagctgcacagggtgaagttcctggtggcccctgctaatctttaagcgggaaaaggagctggcccggaagctggagtatgatggcctgtacataacggagcagcctgaggaccactgacgtgcaggggcagtgggaccgactggtgctcaacacgccgctcctttccctagcaactactgggacaagtttgtcacgcgcaaggtcctggacaaacatggggacatctacgggcggga

SEQ ID NO: 645708 - DNA, 218 bp, Homo sapiens
cacacgcagtcaatcgtatccataatccttctaatagctatcctcgttcaacaatatactctccggacaatgaaccataaccaatactaccaatcaagtactcatcattaataagtcataagtggctatagacaatagaaactagagaatagaccccactttcacgttctgaggtcccagtaggcttgcgccaagggtaccccgtcttgacagtccgg

SEQ ID NO: 645709 - DNA, 168 bp, Homo sapiens
attcaactgtacttaatgccacttcactgtacacttcaaacattattaaaatggtaaaatgtatgttacatgtactttaccacaataaaaaaaaacatttttaaaaggaagttgtacagtgttgaccctcttaaaaaggaggagggcagtattttgggatttttaata

SEQ ID NO: 645710 - DNA, 121 bp, Homo sapiens
agaagccagtgcaaagcatgtgtccgcctgcgctcggtgctcctgtcctgaaggcgcggccactgtcccgctcaggtgcctgctcggtgcatggccacagcgcatgggctgggcctgggca

SEQ ID NO: 645711 - DNA, 157 bp, Homo sapiens
aagacagcatttccagcagcgatgtcagcatttccagcagagatgtcagcatttccagcagcgaagtcagcatttccagcagcgaagtcagcatttccagcagcgaagtcagcattctcagcagcgatgtcagcatttccagctgcgatatcagcat

SEQ ID NO: 645712 - DNA, 167 bp, Homo sapiens
cacgctcgactgtcacccgtctggaatccacgttacaacaattccaaatattagttgggcatagtggcaagcacctgtagtctcagccacgtgggagagttagagatgggacggaagtgacagatcgaagtaggtattcagacggtagccgagcccgcaattcagta

SEQ ID NO: 645713 - DNA, 311 bp, Homo sapiens
gctctggagttattcattcctcctggtgggttcgtggtctcgctggcttcaggagagaagctgcagacctctgcggtcggtgttaccagcagataaatgctatgcggacccaaatgagtgagcagcagcaagatttattgcaaagagcacaagaacaaagcttccacagcgtggaaggagaccagagcgggttgctgctgctggctcaggcagcctgcattttttttctttttttttttttttttttttgggcccggggggagaaccccccttttacggggacccgggtccaaattggaacccggggcaaa

SEQ ID NO: 645714 - DNA, 415 bp, Homo sapiens
  misc_feature (357)..(357): n is a, c, g, or t
  misc_feature (389)..(389): n is a, c, g, or t
  misc_feature (397)..(397): n is a, c, g, or t
cttctgtaaattatgaggagagacaagagaccagacctccttctaatcactgatctttgtgatagattaactgcctccttttttgtacctgtattagtctgttttcacccattataaagaattgcccaagactgggtaatttatagagagaagaggtttggttgactcacagttccacatggctggggaggcctcaggaaacttataatcatggtagaagagaagcaggcacatcttacatggtggcagacgagagagagagagagagagagagtgtatgaaggggaaagagccccttataaaaccatcagatcttcatgaggaactcacttcacttattcacaaggaacatcattngggggaaacttgcccccatggttcccattcanttccccantagttttcctcccttggt

SEQ ID NO: 645715 - DNA, 811 bp, Homo sapiens
caaaagttgatgagcaagctcctccctaactcatcctgtgaggctagcatcaccctgataccaaaacctggcagagataaaacaaaaaaagaaaacctcaggtcactatgcttggtggacattgatacaaaagtcctcaacaaaatactggcaaaataaatccagcggcacatcaaaaagcttacccacccccatcaagtaggcttatatccctgggctgcaaggtcggttcaacatatgcaaatcaataaatgtcattcatcacataagcagagctaaagacaaaaagcacagtgattatctcaatagatgcagaaaaggcatttgataaaattcatacgcttcgtgtttaaaagtcatagcgaaactaggtatggaaggaacatacttcaaaatgagagtcttctatgacaagacccacaggcaacatcatactgaatgagcagaaagctggaagcattccccttagaaattggcacaaaaggaaggatgccctctctcaccaatcctattcaacatagtattggaagtactggccaggtcaaataggccagagaacagaaataaagggcatccaaagtaggaagacgaggcacagtcagactatccctgtttgcagatgacatgatccacatttctagaaaaccacatagtctcagccaaaacagcttcttaagctgcataaacaactttcagcagagtctcagaatacaacatgaagtgtgcaaaaatcgctagggattcctatacatcaacagcagtcaatccaagagccaaattgaggaacatactcccattcaccaatggccac

SEQ ID NO: 645716 - DNA, 168 bp, Homo sapiens
caggctgttcgcgactcttgaactcaagtgattttcccaccttggactcccaaattgctgggattacaagcgtgaggacccggtttaaagctgtggtttttaaaaaatcatggttttagggactgcccaactttctgcctggtggtggcccttggcccatgattgacc

SEQ ID NO: 645717 - DNA, 190 bp, Homo sapiens
ttacccttttgggttttttttgcagatatgagagatagccccgatgggcccaaggttttgccccggggggggttttttgtaaaaagtgggaaaaattgtcttgggtagggaaaaatgaaattttttagcccccggaattgaacgggattcctgttttggaaatttaataaatttctgggtttccttttta

SEQ ID NO: 645718 - DNA, 462 bp, Homo sapiens
  misc_feature (113)..(113): n is a, c, g, or t
  misc_feature (340)..(340): n is a, c, g, or t
tccccgcgtggagaccccagacaaacctgagctgaggacggtctgccgaatgacagcccagtgctcttgggacagtagatgtcacaaaacacaaaagctgactgggaacactntagattaaaggcgggggggggggggcaaatgccacgcagcagggggcgtgctgtttacaggacaccactgggacagtccatgagggctgagcctgctacagacgaggatcggcagcccagcacctgctggtttcaggaaatgctcgctgtcgcattcaggggagagggcagtacctgccacgcacggactgaaacacggctccagcaggaaagcctgtgtgagtgcntttgcatggaaacaggaaaaagcagggacaacattcacatcggggcaactgggaaaacccttcgcaccattcttactgcttttctgtaaattcggctaaaataaagacgagggataaaagga

SEQ ID NO: 645719 - DNA, 409 bp, Homo sapiens
tctcctagagatgatctatcattatactcaacagtatcaaagactgtaacttcctgtcagtaagtcatggcttaaccagtaataagctgatacctttgctccagtgactcgtgtttcattgcttcacctataaacactgtgtccaaggactgagatgaggcaataaatgagaataaatgtcaaatgcctggcacagtaaactttaatatccagtccaactcacttcctctttgtatcgctcactggattgtatcagtgcttgaagatttccctagcctgtgaccaagtgccttctatgcttacattctctctaggcctgcattcatccactggtggctgtcgagcacttgacatgtggatagtccaaatggagatgtattattatggtgacataccagatttcaccggc

SEQ ID NO: 645720 - DNA, 991 bp, Homo sapiens
gcgcgatggctcatgcctgtaatcccaacacttgggaggccaaggtgggcggatcacgaggtcaggagttcgagactagcctggccaacatggtaaaaccccatctctactaaaaatacaaaaattagctgggcgtggtggcgtgcacctgtaatcccagctacttaggagactgaggcaggagaatcacttgaacctgtgaggcagaggctgcagtgagccgagaacatgccagctgcactccagcggtgggcgacagggcaagaccccggtctcaaaccccaaaaaacaagagaagttagccaggcgtggtggcaggcgcctatagtcccagctacttgggagactgagacaggagaatcacttgaacctgtgaggcagaggctgcaatgagccgagaacatgccactgcactccagcgtgggcgatagggtgagactcgcggtctcaagaggcccgaaaaaactaaaaattaggcaggcgtggtggcaggcgcctgtagtcccaggctacttgggagactgagacaggagaattgttgaatgcggagaggcagaggctgcaggtgagccaagatgggcgctgtgaactccaggctgggcgagagaaatgagacttcctcttataaaaaacgaattggaagacctaagtgaatggaaggttttctgttccggattgggatacttaatatgtcacaatggctaagctactcagctggaataatagaatcccacacagtgcttatcaaatctcgccgactgtgtggtgccgaaatagcagcggccacaacatctgggacggttagaaccgaatgccgacaatcttgaagacagcacggggaagacatttcttaaatacacacacggccgggggggaacccgatcccacagtaggccggcacactggggacaccagggcaggaaaccacaaaaaaagaggcggacgcaccgacgaggaagacaaagacgcgacgcgccacaaggagacacgg

SEQ ID NO: 645721 - DNA, 245 bp, Homo sapiens
ctggctctgaacttaggatagcagtaatggctggaggtatagacatgcaggtcacctgtatagaggtggtggttgagtcatagagggaaaatgcccactgaagaagacaaagaggagtggagggtccaggtggaaacctgcattaggaggatgaaggagggaagagggagttttaaaaggatagaaaaaatcccagctgataaatagaaatggaagcaggaccaatgcctaagttcagagccagg

SEQ ID NO: 645722 - DNA, 482 bp, Homo sapiens
aagagaactcctgtcgctggacaggttcacttgctatctggccccaaccccgtaaggcctctgttcgttctgcgcctcctcgtaccttgcctaggttgaccccgaggcctcgtctcttcatgaggtcgcgcttgtccagcctcatctctctctagatgcgagtgctcgctcaagctaatcattgccaggtaattaactgtcggaaatcgttgctctcggacatttagcatccataccctcggaactccctaactgattgcagctcagctctcaagcgctatagattcaggggtgcatcccaatccggttgccaacactctgcttcatgcttgtcactcaacttcatctgtagagccagactgctatactgcgtcctcatatatgctcaatttccgtctcactactccagactgcatatatttcactttgtgcaatctcgcgtagtcctctcgattcctgctcatcactaccatgtcctcctc

SEQ ID NO: 645723 - DNA, 170 bp, Homo sapiens
gagggggttcccccccaaaaagggggggggtccgcccatttttggggaaacccccccttttgggcccttttggggggggggggggccccctttttttttttaaaaccggggggtgtttttcccccttttttttttttttttgggggggttaagccccccccgggttggga

SEQ ID NO: 645724 - DNA, 132 bp, Homo sapiens
tactatcggactggttaagacgacagaagggcaatccagaagatttggccagaaaagaaaactgactgacatctatttgtgtgggagacacagtatctttatttcctgttcatccacgagccagtgctggtt

SEQ ID NO: 645725 - DNA, 427 bp, Homo sapiens
  misc_feature (373)..(373): n is a, c, g, or t
  misc_feature (406)..(406): n is a, c, g, or t
gcctttagccacttcgttttggccaacttctcccacttgaaatgggtgtattcagccaatgcctgtacctccgttgtatctaagaagtaactaactagcctttgattttacaggctcataggtggaagggacttgccttgtttcagatgagactttggagtatggacttttgagttaatgctgaaatgagttaagactttgggggactgttgggaaggcatgattgatttttaaatgagaggacatgagatttggggaggggccaggggagagaatgatatggtttgggctgtgtccccatccaaatatcaccttaaattgtaggctcccttaattgtggggaggggacctggtggggagataatttgaatcntagggggcattttctcccttactgttctgggtnggtagtgataagtctcacgag

SEQ ID NO: 645726 - DNA, 489 bp, Homo sapiens
ccaccacgcccagcctgtaggtcttattgtgggctatcctcatttggctattctgggactttgtgattctatactcaaatttgtaggattatttttctacctctatgaagaatgcttattgcatactttgatagggattgcaattgaatcctgcagattgcttagggtagcactggactgtctctctaacaataactctcgagtctttcaatcatgtaaacacttgaactatcttgtctcgttgtgttgctgtcgttcctctgttagatttctgttacttcaaggtgtttagtgttaattgtagagatctttcacttcgttgaattcgtagatactttgatttaatttgcagctattgtaaatgggattactattcttgatttttcaggttgttccctgatggcatacagaaatgatactgattttttaatgttgatcttgtaccagcaactctactgattaatcagtgtgaatacgtttttgagtgaa

SEQ ID NO: 645727 - DNA, 243 bp, Homo sapiens
ctggctgggatggccccagagcatgtcgctcagcctgttctttgatcattcacctcctagaattgatgctcctttctcccatgcattgagctcccatctagcttcagcagggcagaacccttctccaggtgtgtgtaactaatgtcttgagtatctgggagtagttgaagaacagataatgcctaccaaacatcaagccttggtattcttggagcaagcagaaagccagaaccacaaatatcg

SEQ ID NO: 645728 - DNA, 787 bp, Homo sapiens
tttgctcccacgccgcgagtttttatttacactctctccatctcttatttttatatttttttctttctttcgtccagcgtattatctgcacatctcgctatcgtgtgagagcacacgcagctctctctcttctctctgcgtcgcggggtctcaactatatattcatctcgtctctctctactcaagagagacatcatcacgtacacttctgcttttttattttcctcccccccaccatatataaattattactcttgtgtgtagaaagatatttatttatatatatacaaatctcatctcgtctctatattaatcatcatcacgtcgctcttatacacacacaccactctctctttttatattcactctctcgcgtgtgagtgagactctctctctctgtgtgtgtgtgtatacagcacacacatctctcttctctcttgtttcgaatatatatatctcatgtctctcttctctttctactcgagagagagagacacacacacattatattgtgctcacaccacccttatatatatctctctcctctctcacaatatgtttctctccaccacacacacacgcgtggggggtcgtctctctctccccaccccaccaccaacacactaattacacctctctctcttctccacgacgacagacacacacctctctctcttttttatacacacacaccttccacccctcttttctctctcttcttctactcctccctcccccccccctctactccgcgcggtgtgtttttttttattaaataatataaata

SEQ ID NO: 645729 - DNA, 195 bp, Homo sapiens
atcggttatgtagatactgtggagatcacatacccagttagtacttaccacaatctgtaagtgctttttccaaagtctctcttcacattgactgaattcactcaaattttcctgaaggttagtaagctttagactctctcccctggagcctctctggtaatgctactagcctaacacacagtattacatttccgg

SEQ ID NO: 645730 - DNA, 523 bp, Homo sapiens
  misc_feature (506)..(506): n is a, c, g, or t
gacttcagacaggactttccaagggtctagactagatgggcatcgggaaagacgacatgccggattcatttcccattcggggcggagcacagggaggcggcggtgggtatggagcctttatgagcgccaagcctgtgccctctcccagccctgatcctaaacagccttgttactagagtctcccttatgtctctagctgggccctaacttcgtaggcaacaatgaggagttgaaaaagccccttccgggtgggtgcggtggctcacgcgtgtaatcccagcaatatgggaggctgaggctggcggatcacctgaggtcaggagttcgagaccaggctgaccaacatggagaaaccccatctgtactaaaaatacaaaattagctgggcgtggtggcacatgcctgttatcccagctcctcgggaggctgacaggcaggagaatcgcttgaactcgggaggcggaggttgcggcgagccgagattgcaccattgcactccagcctgngcaacaagagcgaaact

SEQ ID NO: 645731 - DNA, 220 bp, Homo sapiens
gatctagcaggatctattagctgtctggacctttcatataatggaatcatacaattgcactttatgaagcagtactggcttcttccacataagaatagatagtattttcaggttcatctatgtcgtgacatgtatcagcactttgttacttttttttaccttttcacgagacagagtctcgcactgttgcccaggctcaagtgcagtggcccgatctcgg

SEQ ID NO: 645732 - DNA, 121 bp, Homo sapiens
gattaggactgtagggttcttacggaccctttgttagttcccgatactccagccatattcccagctcccattattcgaatcatttcccatagcccagctcctcatagtcattcctcctcgg

SEQ ID NO: 645733 - DNA, 454 bp, Homo sapiens
attggatgcggtggggttttgtttagattttagttgagagaaggtgagttcaaagcaatttgcagttgttgtaatgtcaagattagtgtgcaagtgtgaatccaattcagtatagcttttaaattttaaagcatttggtgaattatgggtgagtttttttgtgttgccaatagcaaagtggttttccattaatggagaattcatgcctttcaagcattttaaatatggcaatatttataaatgtatggtttggaggaatggtttaaattgtctttcgtaattttctttgttttgaagatagattgtttcaacaagtaatttgtagtaatgagtgtgttgagttcaattttggagcgcagtaggtatgttaaagatgaagtatttggtgtcattgaagccaacacagaagttggtggtgtgttttttgttcagtgataaataaaatagttacaga

SEQ ID NO: 645734 - DNA, 886 bp, Homo sapiens
ggccactgcactctatcctgggcaacagagcgaaactctgtctcaaaaaaaaaaaaaaaaaaaagctacccttttttttctccctgatggtttattttctcatgataacgggttatgggaggaaagctgatgacgggcagtgaccattagttgaccattaaatgccggccagggcactcagcaatggctttttctcctgggccctcttagatctatgggaagctggaactcccaagcctggctgggagagacttctctaaccctggctggcgggggtctaactggtagccttctttaaaccctggctggcgggggtctaactggtagccttctttaaccctggctggcgggggtctaactggtagccagggcggtttgcctgggccttgaaggtgaagttggcctccgggtgggggcctctcgggcctggtattctggggagcgaaagttacaaccatgatgagggtggagtagcaaactcatctgactttggaaacttaaattcttcggggagtttctcagcttctcaagtctccttcatgagaatagatcctgaaaacaaatccagatccccggtagagggtgatgatttctccctatggatgccgggggtctgattcttaggccagcttcgtaccgcagctcagtgaccaaccgcgggatggtgggtcactatcatcctatgggttctgggaccccttgagttaaggactccactcatcatcctgtaaccatcccagttttctgcaacccgtgcacttagcttttgaagacctgcagatgctgtgaagcctatgctgcttgtgcgcgaagtccgtctcggtagagggactgtgtgcccctgcgagggggcgggattccgccggtcggctggcgggccccactg

SEQ ID NO: 645735 - DNA, 243 bp, Homo sapiens
gtaccgcaaatcaagatatcaagcccgagctttcgccctgtcgagcaccaccgtcacgtcactgaccatccactgagctcacctgctgacatctccgtgggatgtataatcaggctatcacacccctggccttcgtataacatcctttgtgatgatttctaccatttctcgaacctgtcttgggtcggcgctggcatggatgcaaaggaggccagtgtcctcgtagctgtggtggtatcagga

SEQ ID NO: 645736 - DNA, 737 bp, Homo sapiens
tcggggcctgctggagcctgggcctgtggcatgctgcctgtctcctgcctcggggcctgcggggtgctgccctgctgagcgctacccactgtgctgtctgcgccacctcgctgtgtgcgaccccgcgtgcaaggcccccgtgctggagctggctccctgtgtgcgccccgaactagcccccaactttgggcgaagtttgcctgcgcctctccccgcccccacgcggcgctgccgtgggccgcggactggcagctggccccggggatgcgccttcccggggtacccctggcgcgccctgcgctgctgctgctgctgccgctgctcgcgccgctgctgggaacgggtgcgccggcctgagcttgcgggtccgcgtgcggcttgcctggacggccagtgtgaccgaggagagcctgcagggcggacagcgacgcggacagcatcagactcgagctgcgcaaaggcccgacggaccctcgtctccttcaccgccgacttcaagaagtcacgggtttaaaacggaaaagataaaaattcctagaaccagcaggagggaggtgtcagaaggcccggcaggtgtacaggcatcctgttacagagagccaaagctgagcaacccagatgagccagttgggaaggtcccaaaacccatccaggccggtaccatcactccatgcccctatctacaagtgattgtgaagtgtctatccggggacactgatcctgggtgagctggaaaa

SEQ ID NO: 645737 - DNA, 742 bp, Homo sapiens
taagaacgaaagctgcattgaaatacaggccgagggatcaaatgtggtggaaacagatcctagcccttattgcattgttgctccagacacagtgatccactgcgaagtggtgagcctatcaaacgagaggatgaggaagagtccttgaatgaacgtagggtatgatagacatatgtgtagcgctgcatggaagcagctagctacagataaatggagatggtggaactgcccctgagacatcctgccctctttaagtgcaataggtgtgaagcctcctagagtgaatcctgcttaactggacctcctggaacaggaaagaccctgatatgctctgagctgtagcaaatgagactggagccttactatacttcttgatcaattggtcctgagatcatgagcaaattggctggtgagtctgagagcaaccttcgtaaagcctaatgaggaggctgagaagaatgctcctgccatcatcttcatagatgagctagatgccatctgctcccaaaagagataaaactacataggcgatggtggagctgtgcgcattgtatacaccagtatgttgaccctacatggatggcctaaagctgagggcacatgtgatcgtcactggcagcaaccaacaagaaccaacagccattgacccagctctacggcgacacggccgctttgaccgggcaggtagatatcggacaacctgaagctacggacgcaaagaaatcatcagatccataccaag

SEQ ID NO: 645738 - DNA, 263 bp, Homo sapiens
  misc_feature (213)..(213): n is a, c, g, or t
  misc_feature (244)..(244): n is a, c, g, or t
  misc_feature (247)..(247): n is a, c, g, or t
ggacaggccggttagggcgggcaaggggccccaacccctgcaacaacggaaacagttgccaacaactgggctggggtgcaggtcatcacaggacggctcctgggcaactgggccctcctgggtggggtggtgccaaaacagccttttaaaaacaaattgcgccataactgggggcaacgggggtgggcgaggccttaacttcgggctgccctntccggaagtgccttgcccaaataggcgcttnatnaatatttgttgagtga

SEQ ID NO: 645739 - DNA, 409 bp, Homo sapiens
ctacgtttgtcatttttacaaaaaagaagcaaagtctacctcccccagaaaaaagtacctgaaccaattagtcacttagccccttcccagcctctccgtgctcaccagacttgcctcacctcagcagcacacgtgtgcatatatctgtgtgttctgggcataaaaaccagccactttactgccttttttttgaaggaacattttttccttttttaccaaaattcgttgatttcaataaaggtaattttttgaaaccaattcccccttagccaaaaggattcggttatttaccaaagttaagtctggcttgctttcttctatttctgtacatgttgtttgtgtatatgtgtattttttaaaaattaaaaagtgtggaaaatgcacacatacacacccagcatttagcaaa

SEQ ID NO: 645740 - DNA, 134 bp, Homo sapiens
ctctgagaggccatatatgatctctgacacctcgtgctcgctgccgtggcggccaacatggacagcccagggccccgctggtccatcctgctctgcatgcgctcctgcaactcgcgctgcatgaggatctcagg

SEQ ID NO: 645741 - DNA, 97 bp, Homo sapiens
  misc_feature (58)..(58): n is a, c, g, or t
ggcacgaggtccggcctgagcgcctccctcctggagcggcgtccagcagcccgctggncctgctgggggctcccccacgccccccaggacagtgtcc

SEQ ID NO: 645742 - DNA, 1187 bp, Homo sapiens
  misc_feature (994)..(994): n is a, c, g, or t
  misc_feature (1032)..(1032): n is a, c, g, or t
  misc_feature (1055)..(1055): n is a, c, g, or t
  misc_feature (1058)..(1058): n is a, c, g, or t
aggtcctgttcccttcccttgtttactggtcctgtcctgttcccctggtgaccgtcatgttctcctgtggctttttatccttccccttcctgtgtccccgtgtgctctaattcccacgcgttgccgggactttttaggcttttcgtgctgccggtgtctggttcttaacctatgttggctcatcacggatctacctgggcgtattgcaccagtttagcggctctatttttcgctatacctaattagcaccatagttcggtaccactgtaacgtctggccgtgtactcggttcctgtaagttcccccgtggattctcaccgcacagatgggatgatcctcttcagtaggtatgtacttcatgctcatagtaggggtcaagctcagtatgtttccctgctttttatggggactagccatatgcctatcatcagcttgtccccgtgcccttgttgtctccaagtaagtttgccagcataggttgttagcaaaagtgctacaatctgtgtcgttatatacggacggattagtgcctcatgccctgccgcgctacccgtcaccaccgtgtcacccagatcagtgtcaccaaggccacaggagtcttattggccaggacggtgtaataatgtcccgccgtatactgccatgttgacggtgagcctagatgcttggggtcttatcggtgcttccgaagcctcctgccaactctggagttctactgacatctagatgctctcacggcatcgcacactgaagtcatggtggtcctgctggtgactcggtgcttgctgttttggaagaaccacctgtcatcagaaacatgcacagcaagcggttgttctcagttcccaagggtaagcctccacatacagatatgggtgccacagggcagccgggactccctgtctcacctacattaacccatgcatactgtatgccataaactcactttggtatatccgcgtcacatgcagagaggaactctgcgacgtcaaantgttgcttcttaaagtttcattattggcaactagaggnttgtttttaatgcatggaaactnaanagattcctcggggagttcctgaaggaaactaaacagattcctcggggagttcctgaaggaaccaggtgggcaaacctttgcttatatacatgcggcctcccctggaagagaaataacccacttgtacta

SEQ ID NO: 645743 - DNA, 720 bp, Homo sapiens
cacggagggagacaggatgcccacggtgactgccgctccgtccgtgcacacacagcggtgctcttctccccttagccacccactgcccaacccaacggtcaaagacacagaaaccaggtccccttgcagatggctctcccatcttcctgcaagtcatctgctcacacacagttggcagcacatagcgtttccttctttcagaaacattcctcttctgcggggcttcagaaagcctggcaagggccactagccagagcctcttggttaaatgcccccagcgtgctgtggccgaagctaaccagcttgaccctttcgcggaagccccacaagaaccgctggacggacactcttgagctttcctcccaaaactgccgatccaaccagatgcccttgtggacacgccgttgccgtgttcagccgcctctccctaaagtcatgattctcactcgagagcccctcgcttttctactgactgtgctttgcaagaagagtaaacactctcggatgccgctgtcctgggggagcccagcgggagcctgtgaactgttgatacgagctggccagtcctgggccccagctcactttgtccagctaacttgccaggtggcttacacgtgtgtattaaaatacatttgcattccaaagctggtcccctctgtgtatcactctaactgagaaatcctgcctagatgtgtaaggggatgtgtcctagcatttaca

SEQ ID NO: 645744 - DNA, 484 bp, Homo sapiens
tttgaggtattggataaagttataaagttttagattagaaataattatttagtatgattatggtattttaagattagagttttagaatttattaagaaatagtttatttggaatggagaatatttatttgtaatataggttttgttattttatttattttaaattattttgaattttttttaaatggttgttggatttaggtggtaataggggttgtgggttataaatttgaagttttgagaattttgggtttggagagttatgaagagggaaggaaaagagggtaagttttgaatttaattaatgatttgatggattgtttgattaagatatagaagtgaagtttgtgtttgtgtattttttatagattggagtttttggtgttgaatagagttagttgttaaaaaattgggggtttggtgaagaaatttgattgttgtgtgtatttaatgtgtgattttaaaaataaatagtaataataata

SEQ ID NO: 645745 - DNA, 150 bp, Homo sapiens
ggtggtccacaatggggcatggactgcggtctagaagagggctgtacctctctcaggtctgggctctagcagtgtgggcttccgacagagcacgtgaccgtgagggggaagcagccgttgtatctgctcaatcgaagggcttccgagtcc

SEQ ID NO: 645746 - DNA, 214 bp, Homo sapiens
tcctcccatgtgtggcggaactgggagggctaccaaccagctaacactgctattcagctcacactggggtttgacctcagtggccgctgcagctgctctgctctaaggctgaattcctgcagccagtagcgtggtgggggggcagctgcagcaacaggcacggcacatgggaggggcatggccttgctgggcaggacccaggtgtgcactagtc

SEQ ID NO: 645747 - DNA, 327 bp, Homo sapiens
gaaatctttacctcagtttcttcatcagcacaatgtggttgctgggcctctctcagggtatcattttcgataggcctaatgtaaaattatgatgaatcactcattggtaggaaaataatgatataagtttcaaatatgtatgattttacctatacttggtaatgctttgttttatagagcctgttaagctgctattgatagtcggagcttatatactgtgacttctgaagactatacatgaattccacaatcagtgctttgttgatacaaaatccttaaaagggaggcactttaaagaatatgtatttttcacttttcttaatatgt

SEQ ID NO: 645748 - DNA, 1150 bp, Homo sapiens
agcacagagcctcgcctttgcctgatcctgccggccgtccacacccaggcgccatgctcaccattggatgatgatatcagcctgcgctacgtcgtctgacaactgtgctcctggtcatgtgcaatggcctggcgttctgctggtgcgactgatgcctcccctgtgtgccgtcttccctctccatctgttgggtgcgccccaaggcaccatgtggctgttgatatgtgtagtgtgcaatggcgtcatgaagggattccttatgttgggctgactgatgtgcccaagaagcaagaggaggcatccatcacgcactgaaggtaccccatcgatgcactgtgcgatcgtccacacatacttggggagccgatcgatgtgaatgaacaagtctagggaccgaatcgacctttactaacaaattgatggcttgccgtggttgggactacaccggagggtagatcaggcccgatgtcgtgcctgaaccggaaagggctctcaccttggagagcccctcaaagggccctacatccgcgctggaagcaaacgattagacgccccaggaaatccatgagttttaagaatgaaacatgttcaaagcaaatcaccaatgcgcaagtagtaacaggtttgggcctcatactccatgggcttggtgtctattacccctaagtaactggcccttctttggcctccgtttcgcccaccttggacacctctggtgcgactgtggacctcgctgggttgaactgtggggtccaacccgagcgactttggtggccccaaatcatacacggaagggcgtgtacttgcccacttctccgaccgagtgacctagtcccctaggctagtccttgtgaagccttgggctttggtggccgagtagtaacccctggaactatggacactaagcccttccaattggcaatgggaactcccattcaactcgtaaaaacagtctgagggatatacagtggctttccacccccaaccaaacgagggtcatgaacgctcgtgtggaaaaaaattcgacttgcccgattgacacaattttaaagggcggcacaatatagacatgtgatgtcaaaaaggtacagaccccctaggacagcttttgagagcacaagcacgattgtgggaccacatgtgcagtggc

SEQ ID NO: 645749 - DNA, 320 bp, Homo sapiens
agaatattaggacaaatggatttctggtttacacaggtgaaactggaacgcagtcccaagtgtcaatggacagaacacagatacctgaatccagttccacctttcctgatttatcctcttccacttatcttacttccccttcaagttgaaccaacgattaataagtgcaaggtaaggaggactgggttgacgctgctcagtcaggcttccttttcagactataagctagtaagacagaaacaggtaccatgcaaagagcaaagccattagctggtgattggcaaatggcgccagaaggaactcatggagcgaggctatag

SEQ ID NO: 645750 - DNA, 979 bp, Homo sapiens
agcggaagtagaggttgctgtgagccgagatcatgccactgcactccagcctgggtgacagaatgagactccatctccaaaaaaaaaaaaaaaaaaaagaaaattgtggtcacttatgctagtggtgtactattctcagcccattgaaaaagagttgagattcagctcattttctcaacaacattggattggacctggaggctcattatggtacgtgaaataacccaggcacagaaagacaaacttcgcattgtttcctcacctttacctgtgttgcggaccctaaacaattcaaaaccaaatttaacactcatgtggacgattaacagaagttagaacagcgacgtggttttacccaagaaggcctagggaacaggggttggctgcggcgagtgcgctatacaagtgggctttcccaaaaaaaaatttatttttcacacacactgcactgtgacattaaagaacccctagtatatttggcccatagcccgaacaaatgtggcctgaaccctaatagctcccacatttacacataattttataatctgcgttaccccttttttaagacactttaacgctaacacagaaggctattaaacctgggggcacccttgtttttattaaaccaccccataggcggatttaaaaatctgccttgtggggagcgcacaccatgtgggaaattaacccccattcctttccccattggaacttgctaccatttattttaccacacatttttggcatgttgcccccgtgtttatttcgacagaagaccatttcctgcgggtggataacccccccaattaagaattacgcatttatttttcttaccccccacagagaaatctttttacagcaaattttttttaacaaacaaattctggaaagtataggcaagctgagttcacatgagacacaatttgggggaaccttcccccaaatttttctctcccagttgggcgcccttttcccgcca

SEQ ID NO: 645751 - DNA, 651 bp, Homo sapiens
agcggaggaggcggtgacaatgggagcagcgcgtggcggcgccgtggaggcagctgacaatctgtttgcggcttcgcttcatggccgctctcccgcccctcctgggatctgtggggagctggggagcccgcagcggcccggagccggagctggcgagccgagcggagacctgtgcgccgcgcctctgaggcgcagcatgtgaagctggagacggcatccagtggggggcgagcctctcagccggccgggatggctagcacggccgagctcttcgaggaaccctttcgtggacaggatgaactatcttgaagcgtctagtagtggacgaaccccagtgaggagtgctctacgaggtggacctgaagacttttgctcctaccaagattgattccgaaggaagtttgtaaactcagtattcaggaacatcgcagatagatggactgaacatggccttcagcatgaatgtagagaaactagagcaacaactgtcagatagaagccaaggaatttgccaagaaggtacaagagctgctagaagaagcaatcaggttgccttccaacgatttccaggaactagatgagcacattagctaatgtagcagctaagagtctgtcaccttggagtaccagtagcagggggtaaacacaccc

SEQ ID NO: 645752 - DNA, 592 bp, Homo sapiens
  misc_feature (286)..(286): n is a, c, g, or t
ttttctagaaaaggcacattgggtatcattcattacatttttgagttattttgggtttgctcttttggaaacaagtctgtgctgtaatggcccaaggcttgtatgtgtggctggcacaatcaccaggttcattgggcagttccttccaaatacaaccccagggccctaagtgcaatttcctccacacctttgttaagctgtggacctatacatgcttcaccaggacgacacccttgtgcctaaaattttctttggtagaaacggattctctatgtgcccaggtggntctcaggctccggggctcagatggtcctccttgcctcagcttccaaatgcacaggccaagttgtaccttggtcccttgccatacatgcccaacaagaggttctatacctttataatgaatggactttcataacatgggtaatgtgggagggcaagtctcttataagcgggacatttgtaaattttcctccttgaaaggtttttccagtgcgagttaccattgaactaattactacaataacgggatggctctggggtgctcaattcttgaacaactaaaaacaacgacaatacaaatcaatcacaa

SEQ ID NO: 645753 - DNA, 113 bp, Homo sapiens
agacggatcccccaggataacagcatacccggagtcactgctctccttattcatcatgctattcatctattttaaacttgccggcgacgactttatgtctatttatgaacgaa

SEQ ID NO: 645754 - DNA, 295 bp, Homo sapiens
ggttgtggagagccccaagttgagtaacaataatgaacaattattgtatgaacaattgttagagacagctaatcacaaacaatcctgcgggcacaatgacctcattccagcacgtatcacccttcagcgaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 645755 - DNA, 326 bp, Homo sapiens
gttaaatcatgattttgcagaccctttggttttggacagtttcatttttttggatttgggatagattacataggagtatggagtatgctgtaaataaaaatccaaggtagtgttttgttttagtagttttaagaaattaaagcaaccaaatttaagttttcttgtattgaaaataccctatgatggtaggtccgcccttcataaaagtaggttaattgtgtttttaaattgttataacttcccccctttttgaaatctgccctacaaaatttgtttgggttaaaggtaaaaaccggtgacaatttgttctttgatgtgattgtatt

SEQ ID NO: 645756 - DNA, 200 bp, Homo sapiens
  misc_feature (59)..(59): n is a, c, g, or t
  misc_feature (75)..(75): n is a, c, g, or t
  misc_feature (121)..(121): n is a, c, g, or t
  misc_feature (123)..(124): n is a, c, g, or t
  misc_feature (131)..(131): n is a, c, g, or t
  misc_feature (195)..(195): n is a, c, g, or t
atttcttttagtttatagatctgtgcaacatttttgtactgtatgtcttcaaacctggnagtattaatacccttncttactgacatatgtacttctagttttagaaacttttatatttatntnncttattntcatatttcccttatttattacacagtgtagtgtataatactgtagtttgtattaatacactantatat

SEQ ID NO: 645757 - DNA, 233 bp, Homo sapiens
tcaccacttttattcaacatagtactggaaattctaacaagagcaattaggtaagagaaagaaacaacacccaaattgggaaggaagaagttaaattctctttatttgcagataatatgattttatatttagaaaaaatctaaagatcccaccaaaaacgaactgtaactaagaaactgattttatttatacaaccaacatacaaaaatcagtagcacaaaaaaccaactgtg

SEQ ID NO: 645758 - DNA, 182 bp, Homo sapiens
ccttaagtagttgtcatgccatacagactttttaatattaaaaagtctgtatagcatgacaactactattaaggggaagatatgattctcttgtctactaatgtgatgcgtgtgatacctatagtgcacttacagcagagcttaggtaattgctttttagagattccatgattaggatttat

SEQ ID NO: 645759 - DNA, 104 bp, Homo sapiens
aattcaagcttctaacgatgtacggggacatgagcctttgttgctatcaatccaagaacttatttgtacatttttttttcaataaaacttttccaacgaaaaaa

SEQ ID NO: 645760 - DNA, 163 bp, Homo sapiens
tgctctagaggatctcagatcactgccatttttacacacttgatttttaaaaatacaaccaaccaaccaccacaacttcttatacatttggaactcggtcagaggtgcacctctgaccgagttcccacctctgaccgagtttctcttctccttcctcctcctc

SEQ ID NO: 645761 - DNA, 1156 bp, Homo sapiens
tcgaccagccgggagccagcgcgagctctggcacggtggacacccggtccgaggccggcaagccgggtggtgccctgagctcggccaagcatgggcaagcactcagtgacggccctgaggatccggaaggccaggggccgtttacaacaagctaatacggacaggcattccagccccacgggaattttcgaggtaactgtctcaatgagagagcgtctagtgccacgtggttcccttccaagcccaggaaagtcagtgtccagtccaacttcctccaagactcccactccgtacgtaaacacctgaggaccccttccacaaagcccaagcaagagcagtgaaggtggagaaacggctgcgcgttgagtacccaaggttcgggaacgttagggcagaagccaaagcaaaagatagtgaagattaagcaggcttcggaagtgaactacaagaaatacgaagagacacaaggactctgaacgctgaggggactgatgcatagggcccaaatgtcgctggaacactcagtctccccaggtgacacggaacctactgatacgagctcttgagggaggaaggaacaagaacttttcagaaaagagcttaccggatctagcaggcacagacaaccgtggtaccgtgaagggaagaaacgtgattctaatctttgaaccacgtccctaaattccagaacggcgtgcagcaaaggtccacgcactggtcgaacagtcacgcttgcaccaaccataccaatatactccaggcagtccaagccatcgcgacaggcccaagctggcaaatcaggttggtacagatgaccgttgcatgagtatacagaccaaccgattacatgtgaaactgccaataacggggacccataagggcctccacaacagaatgcccatgtatagcacacaggcttacatatgtgggaaggcccgagaattggcataaagcggacgcatttggggcagcagaattacagcggtgagcaaacacgcataaaggggcccgtagatctttccagacatggtaaaccgccgtgaaagagagttaaaaaggggtattaaccatgaggggggaagtacgcacaagacaagggaataaaaagacttgacacctggtatccctagaggtaattgtcattagaacgagtcaa

SEQ ID NO: 645762 - DNA, 346 bp, Homo sapiens
tgatctagaggatcccgacagcatcctaaccaggaggtgaagatactggggggaggaggaggctggctgatgatccctaggttagaccaggaggtgaagatactcaggtagaaggctggctgatcccaggattagaccaggaggtgaagatactggaggagaaggctggctgatgatcccaggtttagaccaggaggtgaagatactagaggaggaggctggctgctcccaggctagaccaggaggtgaagactactggaggaggacgctggctgctgatcccagggattagaccaggaggtgaacgatactggttagggactgctgtcgggtaccgagtctcgaa

SEQ ID NO: 645763 - DNA, 171 bp, Homo sapiens
ggagttaagatagcgggcatatagtgagacctgtcttatttaaaaaaaaaaaaaaaagaaaaaaagaagaagaaaaagagtggagaaagggagagtaattgagaaaataagaatgggaggagggagacataggaaaaagtgagggaaatgaagttagagaaaggcttaggg

SEQ ID NO: 645764 - DNA, 674 bp, Homo sapiens
  misc_feature (23)..(23): n is a, c, g, or t
  misc_feature (75)..(75): n is a, c, g, or t
  misc_feature (86)..(86): n is a, c, g, or t
  misc_feature (115)..(115): n is a, c, g, or t
  misc_feature (151)..(151): n is a, c, g, or t
  misc_feature (158)..(158): n is a, c, g, or t
  misc_feature (196)..(196): n is a, c, g, or t
  misc_feature (290)..(290): n is a, c, g, or t
  misc_feature (304)..(304): n is a, c, g, or t
  misc_feature (335)..(335): n is a, c, g, or t
  misc_feature (497)..(497): n is a, c, g, or t
  misc_feature (582)..(582): n is a, c, g, or t
  misc_feature (657)..(657): n is a, c, g, or t
taaaggagggaaaaagtgatganggaaaaaaaaataaaagaataaatgtagtttaggtaaaataaaatgtaaaanattaaaataanaaataaagaaatgatatgagaaaatatanatgtaatggtaaaataaaaagtatttttggttaaangaaaaangatataaaaaatggtgataaagaagatggaggaaaaantataaaaaaaaaaaaaagaaaggaaaaaggaataagggaagagggaaatggataataaaaagataaaattatgtgtgaagggtatggggataanaaagatgggaaganaaatgaaaaggagaaggtagatgtgtgtaanaatgagtggtaaaatgtatagttaataaagaaaaagggaaaagaagataagtagaatgtgaaaaaaaggattgatgaggaaatagagaaaataataaaggaagatgaagaaagaaaggaataaagtggaggataaatagagaagtggaaggtaaaagatganaaatgggatgtaggtggataaaaaaatgaggtggaaataatttagggagatggtgggggaatggtgattattggaataggaagangaaagattggaattatggtaaagaaaaaaaaggaaggaaaaggtggaaagaagagaaaaataggataggaggtanatgaggtgtatgtatgg

SEQ ID NO: 645765 - DNA, 889 bp, Homo sapiens
cttgggcgagtacggtcctcgtgcggagagggcccctgtcctctgtgaaggcccgcccgggaattggcggtggtgctgcagccatttccggtttcggaggaggtggtgtgtgggtgcggagtcgggacttggaggcagtctgcgaacgtgtggcaccggctacagagctgtgctcttgcgtcctgtgtgctgccaggaagtatgcggtcgggagcccggaggcttgctgttgccgccggacggtgcgggggagatggctgcgtggcgaacggggaagtacggaacgggtacgtgaggagcaagcgctgcagtcgcatgcgtgtccgcctgctggtcagatccatcatgttatcacaaaagtgggaggactatggtaaacatgatcggtttcattgaatgctttatgaagaaacagccaatgctggtgtgctgtgctcatgtatgtgggttatggcgtactcaccctctttggatatctatcgtaggattctgtgaggtattgtgagaggttgaaatggtgtcaccatgcatgagataggagatgaagacagggagtttgtgtcattgtatcacgattttgaagaacttttatacaatgaatctgtacatgacggataaggagacagaatgaaagtcggccaatctgtagtgtggctggagcgaggttggaaatcatggggatgacagtctgatgattggtaacgtggtccttccatgtatacctgtggagatataactaacgggtgttattaaagattgggtatctaaagagtatttggattgcaggggatactggattttgttagaagcagcgcaaattcgttgacgaagtatggggtgattgggacacttgggaggaattggaacttgaaacataaaaagaggggta

SEQ ID NO: 645766 - DNA, 255 bp, Homo sapiens
ctgtaacaatactgaccagccggcattgtagctggtcaagcattgaagggattacagaaagaagtacactcacgagcggacacccagcaaagttggaagagtcgagcgaaacccaggctgtatgagagggggtaggttactgactcctaggacggacgtaagacttaggaaagatggtctcctgtcgtcagatgctgtacgtaagcatctactggtggtcaatcgatcttaatttctacattgagctgaatagtt

SEQ ID NO: 645767 - DNA, 345 bp, Homo sapiens
ccaatcctatggtggattatgagaatcaaaagcagagctcatatagccagcaaccatatcataaccaggaacagcagcaaaacatggaatcatcaggaagccaaggtggacagagcacctttcctataaccagccagcactatggtcaacaaagattcatatataccaggcagtcatggctatgactcacacatcaatggctcatatagatgagacagtcaaatttatagactcagcatgctttgattcctataagtcacaaaccatgcagtccatatcattcacaacagggaaaactacagccaccacacacaagatgaccgtcgtgatgtgagtaggtatgga

SEQ ID NO: 645768 - DNA, 676 bp, Homo sapiens
  misc_feature (41)..(41): n is a, c, g, or t
  misc_feature (51)..(51): n is a, c, g, or t
  misc_feature (70)..(70): n is a, c, g, or t
gaactgatggggctctacaggtcggtgggggtgagacaggnagacgagaangagggggcagccgctcagnaggcagggggcatcgtgcccggctcaggcccatcgacgcagacaccattgacatttacgcccgcgctgtgttccctgcggcgtttgcggccgtcaatgtcatctactgggcggcatacgccatgtgagcacaggactcaggccaccctcgcttgtcctggcgcccggcggcagctgcccagaaacttcctgggagaaagagccctcgggctgccttcccctctgcgtgtttcgaagtgggatgacagtcggccacggaaaacaagaggaagcctcggcctccctgagctctgaccccagcctcacccgaaaggccagcctggggctctccggcaggcagcccgagacctgcacagatgaaggagcagaggttctgaccgagaggctgagccaggccggggtctgggcccttcagggagccgcggatttttatgttcagaaagtgatcctggtttctaggtctttgctctgcaggatcgggatcagagcgtgggaggaggtgggggtggacgtccatccggtgaacagtgaaggcgtttgtgaggtctttctggtcccagcatgaaataaagccttggcctgggggccgcttcattctcaaaaaaaa

SEQ ID NO: 645769 - DNA, 830 bp, Homo sapiens
tccctctaaatatttggataatttctgggatggatgcagtgatgttttggtcccttccgtatttataaatgaaacacctttttttagtgtttctaaacctaaaatctacttggttggaattcagtggttggaacactgttggattttttatttgaagcatgtggttgatggaaaatttcatggaggaagtttcaatcaggttgtgatcagttggattctgtaatgagcacagcacctaatatttggaggagctctgtttggaggaccaatgcttagggtggatttggttcgtaaacaatatcccaatagatttgtctgacttgaggtctggttgggttgggttggtttggtttggtttggtttggttcccaatagaattaagaattctattgttgaaaacactgcacaattttttatgggacaaagcctagaaaagagaattgtggttggaatcatattctaaatcatcgtatgatagaagagggaaagtgttgctgccataattctccttcactggtgtgggacctaatcagtgaactgtttctctgtcccacaatttaggccttcagtaataggtcttagttggttctgtctaaacacaaaaaaacaaagaataataaaacaaggaagagaaaagaaaaaataaggagaggggagcatgaagtactattggggaggacaatatattcttctgagatatatcgaggcgggtgaatgcgtgttgaagtatagaggcgtaaaagaatggtgagaggagatgaggatggagagatcaatggtggggatgagagaaatggatgagggaaaaaattgaagtgaagaaattaggg

SEQ ID NO: 645770 - DNA, 660 bp, Homo sapiens
aggatattgaccagagtatgaaatctgaaacatctggtagctttgaagatgctctgctggctatagaaaagtgcatgaggaacaaatctgcatattatgctgaaaagctctataaatcgatgaagggcttgggcaccgatgataacaccctcatcagagtgatgggttctcgagcagaaattgacatgatggatatacgatcacacttcaagagactctatggcaagtctctgtactcgatcatcaagggtgacacatctggagactacaggaaagtactgctagacctctgtggaggacatgattaacacagaaatcccagaaggacaggaggattctgaacactttgaatgcttgtaacttcattgatctacactgctatgatcattatctcagaatgctgattgtcaattaaaacgcctacagatgcctgctagaatatagactgtctgtatcattagtcacctataattaggcattacgatgctttaaagctgcacttgcatttcaaagcttatacgatctaactggagatcttaaggccgaattaaatatgcataccatgtttttaaaggtatactttatacttggagtttccggacatggaaccttgcaaatagttcaatattgtctattaaggggatttttattggcctgcct

SEQ ID NO: 645771 - DNA, 116 bp, Homo sapiens
ttatcttccgtgcccattaaacaaggaaaatataaaggtattagataaatttattggcttacgtattcacattccagaaccacatgctattaatcagaggctaccatcgctgtagt

SEQ ID NO: 645772 - DNA, 497 bp, Homo sapiens
  misc_feature (170)..(170): n is a, c, g, or t
  misc_feature (189)..(189): n is a, c, g, or t
  misc_feature (192)..(192): n is a, c, g, or t
  misc_feature (214)..(214): n is a, c, g, or t
  misc_feature (430)..(430): n is a, c, g, or t
aagctgacttgtatgatatagtatagccacgcagtgtctcttatggttactatttgcatgaatatctttctccattcttttactttctaaagggttctctggaagaaaacatatagttggatttttttttttaaatccagtctgacagcaactctaaagaatgccttttnctggccgggtgcggtggcncanacctgtaatcccagcactttgngaagtcaaggcaggtaggatcacttgaggccaggagtctgagaccagcctggccaatacggtgaaaccccatctctactaaaaatacaaaacattagctgggtgtaggtgaagtgcgcctgtaatcccagctactaggaaggctgagccgggagagtagcttgaacccgggtaactcggctggaattttcactacgagacgaggtctcactgtgtnagccaggatggtctcgatctcctgaccccgtgatccacccgcttcagcctcccaaagtgtcgggata

SEQ ID NO: 645773 - DNA, 100 bp, Homo sapiens
tgttagatatgggagtagtgtgattgaggtggagtgctggagattgtaatgggttttgagacatttcatattagtaatgctagcgtggagtggaggactg

SEQ ID NO: 645774 - DNA, 167 bp, Homo sapiens
  misc_feature (33)..(34): n is a, c, g, or t
ttagaaagtgtaacggcgcgattcccggggggnnaatatcgcacgcgttcccgctctatctcatgtacctcttcgcaggcatcctaatgctacgacgaaatctaggctatatacaactacgcaaaagggccccccaacgtgtaggcctaggctataacctcgctgac

SEQ ID NO: 645775 - DNA, 718 bp, Homo sapiens
  misc_feature (701)..(701): n is a, c, g, or t
gtcaaggattccaaagatctttgagcatcacccatatcttccccccattgtattcaccgttttccttgtaaattatttaacctatttataatagttgcttaaaagtccctgtccattaattcaaataactgagtcatctgtggttggtttctattaactatgtttttctttattgtgagtaatattcctctgcttcttcccatttttcataacagtttacatttcagtcactgagtataaaaaaagcagtggagacttcggtataatattgatttgtggtttactcactgcagagcataaggcttttattcttggtgagctagggcgaggggctgatcattagattcctccttgagtcagggtgagcttgggctgggctgcacctttggttagattcatgttccctgttattaggccaactcctggacttttgccctgccctgcctttgtgatcttctcagtatttgaatgggtagatggctaggtgcagcttcagatatttttgcttgaccttggtatttcactctggtaggactccagaatccaagcacaatgagaatccacctaattatgtgatttatctctactctgcaggcaattcctccactgctgctttcttggaaacatgcagaaaatgtgggtgaggggggataacttaggctgagatattctttttcattcagattctaagcctcttcggnacactgttatgtagatc

SEQ ID NO: 645776 - DNA, 122 bp, Homo sapiens
ggggcatgggtactaccaggatctggagcttctagtagggaccatggcagttctggaagggccattcccaggggggcgacccatgatacacactctgaaatccacactcccaacttctttct

SEQ ID NO: 645777 - DNA, 262 bp, Homo sapiens
atggtgacgggggtacacactgtgccatctacgaggggtatgccctcccccatgcaatcctgcgtctggacctggctggccgggacatgacataactacctcatgaagatcctcaccgagcgcggctactgtttcaccaccacggacgagcgggaaatcgtgcgtaacattcacggagaagctgtgtaacgtggccctggacttcgagcaagagatggccacggatgcttccagtgtcctccctggagaagagctaagagct

SEQ ID NO: 645778 - DNA, 641 bp, Homo sapiens
  misc_feature (1)..(1): n is a, c, g, or t
ngaggagaacgcctgttcaccgaagttccacggtgtttgggatcacaaaggagtatggtgcgcagcccgtggtttaccacaaggggagctcagtgattctagtccagagacagaacagttgcgggtctcttctgaaggagtcatggatgtcattcagtgtcctgtgactggtctggcactcgacgttggttggctaagatggctcggcgtctaaaagctacgtcacttatgcaggaacatggacgtaacgatatcgagggggtccaaagatcatggaaggtcagattagctcgctggtcagcacgctaacaagatcggtagattgcagctccacagaaggcatcagctgttgatgtcagtgcagtgccagatggaataagctgttggagcctggatgagcagagcatgcatgacaatccgttagatattcgacgtaggagttgagtcaggcgtacattatatcatcatgatgggctgttgaactcggagcattgtgctctggcatcgtgagcccatggagtaagacagttggcatagcggtcaccgtagtaatcgtagtcagtgtgcagtctaagggaaagcctcattgaggctaaaggcaacagttttagggcgaactatacggtagagtgccaaggctc

SEQ ID NO: 645779 - DNA, 634 bp, Homo sapiens
  misc_feature (38)..(38): n is a, c, g, or t
  misc_feature (172)..(172): n is a, c, g, or t
  misc_feature (186)..(186): n is a, c, g, or t
  misc_feature (193)..(193): n is a, c, g, or t
  misc_feature (214)..(214): n is a, c, g, or t
  misc_feature (219)..(219): n is a, c, g, or t
  misc_feature (224)..(224): n is a, c, g, or t
  misc_feature (229)..(229): n is a, c, g, or t
  misc_feature (265)..(265): n is a, c, g, or t
  misc_feature (321)..(321): n is a, c, g, or t
  misc_feature (365)..(365): n is a, c, g, or t
  misc_feature (384)..(384): n is a, c, g, or t
  misc_feature (427)..(427): n is a, c, g, or t
  misc_feature (440)..(440): n is a, c, g, or t
  misc_feature (447)..(447): n is a, c, g, or t
  misc_feature (452)..(452): n is a, c, g, or t
  misc_feature (463)..(463): n is a, c, g, or t
  misc_feature (472)..(472): n is a, c, g, or t
  misc_feature (525)..(525): n is a, c, g, or t
  misc_feature (550)..(550): n is a, c, g, or t
  misc_feature (560)..(560): n is a, c, g, or t
  misc_feature (627)..(627): n is a, c, g, or t
tttttggtataatttttattccaaaataacaggagtanaataataatatttatagagaaggaaaataatgaaaatctataagagttttggcagccgccctgcatattttttttttttttagctcccctaaagactgtggcaggaaaaaaggaacactggctccgagtttctntgagaaaacaagtnaagaaanaaaaaagaaagcccaaacccncaaanaaggncaggnaaccccattgcccacccccccaacaaggtaaaaaangagttcctttagtaacagtgcagaattcatctttatctcccacctgcctcaacggnggaagtctaaagtcatgattttttttagagcattgaaactgtgngtctatagacaaataaacncatatgagatgacaattgaatttttaaaagtgcaggtagaganaggagcgatcatnttgaacnaaaanctttctatgtnttttgattnctattcaacttgctattttttagcaaaaagcgaagtttcaatagtgttcatcncaaatcttattgctttaaccgtggnaaactttcantaaaaataaaaagatgaagcagttaatccagttatttatttgacatggctttcattgggaaaggggngggctgg

SEQ ID NO: 645780 - DNA, 215 bp, Homo sapiens
taagtaatatatataaaataatatctttttacacaaatcactcaaaaactgtaagacatattaagagtagacatcattgagtggaaggatttggatgttattaatcatcataaaatcttccatttcttgagcagggcaaaatcagttttcctcaaaaccatttactccacaaaaagaaaggatgaaattttttcgtcgacgcggccgcgaattta

SEQ ID NO: 645781 - DNA, 131 bp, Homo sapiens
tactcacgattgcactctcttcatctgaaaatagccagcagctctattatgtattgtacctccgaatgatcaactttaccgatggtattcacatatcacgtactgaggaatctccccttcatggtcctctg

SEQ ID NO: 645782 - DNA, 134 bp, Homo sapiens
  misc_feature (36)..(36): n is a, c, g, or t
  misc_feature (54)..(54): n is a, c, g, or t
ttagaggttcccccgcggtactgtcttacgaagatnctgtatagggtctgacanctgcccggtgctggaaggttaaggaaggtgcttagcaagtacttcgaaggccttgactgagggccccagttaaacgcgcg

SEQ ID NO: 645783 - DNA, 144 bp, Homo sapiens
acatctctcagctccgccctctcctcctgttcgcacacgacacctgcgtgtggcgcactcgacccctcctttctgcctggcacgggcgcctacgaccggcacggcttcgtgatgtctggactcttcgtgcgtgtgcacgggtcc

SEQ ID NO: 645784 - DNA, 545 bp, Homo sapiens
gctgtacaagaaggacgtgagctgacttcgcaagtggcgtatgtgtagctgaagattggggaacacaccccctcagacctcgccatacatggcaaatgccaatgtaactggcccgttatgccagtatctgccagcagaatggcattgtgcccatcgtggagcctgagatcctccctgatggggaccatgacttgaagcgctgccagtatgtgaccgagaaggtgctaggctagctgtactacaaggctctgagtgaccaccacatctacctggaagtgcaccttgctgaagcccaacatggtcaccccaggccatgctatgcactcagaagttaactcatgaggagatatgccatggcgaccgtaacagcgctgcgccgcacagtgaccccacgctgtcactgggatacacctatacctgtactggaggccagagtgaggaggaggcgtacatcaaactcaatgacataaacaagtgcacccctgctgaaagcctgggtcctgaacttctcctacggacgagcctgcatgcctctgacctgaagt

SEQ ID NO: 645785 - DNA, 134 bp, Homo sapiens
  misc_feature (28)..(28): n is a, c, g, or t
  misc_feature (31)..(31): n is a, c, g, or t
ttggcctcccatcttctaatggggttgnagncccctcattccctctgaggagccttgggcatccgagccttttatttataacttattttgtattggaacttttaaacaacactgaagaaaaaaaaacttttccg

SEQ ID NO: 645786 - DNA, 347 bp, Homo sapiens
ctggctaatttttgtattttttggtagagacggagtttcatcatgttggccaggctggtcttgaactcctgacctcaggtgatcctcctgcctcggcctcccaaagtgctaggattacagttgtgagccaccccacccaaccactgtgctaaattctttatagtcagtacctcattcagtccggacaacaaccttaggaaataggcattcttttctctctctctctctctttttttttttttaaaaagactgagtctcactctgtcgcccaggctggagcgcaggggcgctatctctcctcacggaaattctccggcctccggggttccaagtagattctccgtgcc

SEQ ID NO: 645787 - DNA, 205 bp, Homo sapiens
acatccagatcgtcacaccggaggtgcatgagggacacccgttgaactacatttccggtggttcggccacctctgacattgagttgtcccgggttgacggagtgcatgggcctacgtcggctttatgtcatcgtcgtcgacgaccggtaaaacacgaccagaactagtgccccggttgagggaccggggcactgctgtgcctgag

SEQ ID NO: 645788 - DNA, 269 bp, Homo sapiens
gacaggagccatggggccagggccccagaatagctttacgaaaaaaaataattaatgccaccctcctccgcggcaggtatctatctcttaccacaaataaagtatttaatgcatccttggagtcatgaaatatagagaacccaataagacactacaatttccagaaaaataaaatcatgaaggcattgagtaaatatactgaataaaggtggaatgagaacaacgcgtaagggggcggacctgaagtctcggatctgacggagaaatca

SEQ ID NO: 645789 - DNA, 762 bp, Homo sapiens
  misc_feature (15)..(15): n is a, c, g, or t
  misc_feature (21)..(22): n is a, c, g, or t
  misc_feature (76)..(76): n is a, c, g, or t
  misc_feature (118)..(118): n is a, c, g, or t
  misc_feature (120)..(120): n is a, c, g, or t
  misc_feature (133)..(133): n is a, c, g, or t
  misc_feature (147)..(147): n is a, c, g, or t
  misc_feature (176)..(176): n is a, c, g, or t
  misc_feature (178)..(179): n is a, c, g, or t
  misc_feature (205)..(206): n is a, c, g, or t
  misc_feature (218)..(218): n is a, c, g, or t
  misc_feature (227)..(227): n is a, c, g, or t
  misc_feature (266)..(266): n is a, c, g, or t
  misc_feature (306)..(306): n is a, c, g, or t
  misc_feature (329)..(329): n is a, c, g, or t
  misc_feature (399)..(399): n is a, c, g, or t
  misc_feature (527)..(527): n is a, c, g, or t
  misc_feature (573)..(573): n is a, c, g, or t
  misc_feature (623)..(623): n is a, c, g, or t
  misc_feature (632)..(632): n is a, c, g, or t
  misc_feature (661)..(661): n is a, c, g, or t
  misc_feature (667)..(667): n is a, c, g, or t
  misc_feature (700)..(700): n is a, c, g, or t
  misc_feature (714)..(714): n is a, c, g, or t
tggccgccggcaaanaggatnnccaggcaggtgaagaacgtccccagcagtgcactggtcatcctgtttgcctgtnaggtggccgccggcatctggggctttgtcaacaaggaccagntngccaaggatgtgnagcagttctatgancaggccctacagcaggccgtggtggatgntnncgccaacaacgccaaggctgtggtgnngaccttccacgngacgcttgnctgctgtggctccagcacactgactgctttgaccacctnagtgctcaagaacaatttgtgtccctcgggcagcaacatnatcagcaacctcttcaaggaggnctgccaccagaagatcgatgacctcttctccgggaagctgtacctcatcggcattgctgccatcgtggtngctgtgatcatgatcttcgggatgatctctgagcatggtgctgtgctgtggcatccggaacagcgtcgcgtgtactgaggccccgcagctctgtgctcacgagggacctctgcatgtgcccccctaangtgaccccggaacacttcccgagcgggggccactcacgcgccctgntgtaatatacactgttttccgggtatttacgtctgcatacacggtagccnttttatacntttgtgaggggtttgtgtttttttgttcntggaancttgtccgtggtataccgtgttctcaaggggcntgaccggtcaccantgataggggtgggcggtggtattgaaggtgggaggacgggggccttgg

SEQ ID NO: 645790 - DNA, 347 bp, Homo sapiens
gatttttattgccctagtatactaaagtgttagtgaactcattttttggttctaatcttattttagtgatttccttaggattttttcttattattattatactttaagtttcagggtacatgtcgacgacgtgcaggtttgttacatatgtatacatgagacatgctggtgtactgtacctattaactcatcatttagcattaggtatatctcccaatgctatctctcaaagagaaaccagcatcaaagtgaacaggcaacctacagaatgggaaaaaatttttgcaacctactcatctgacaaagggctagtatacagaatccacaatgaactcaaacaaatttac

SEQ ID NO: 645791 - DNA, 1034 bp, Homo sapiens
gctgaaaggtctggaggagaaggcgccggttcggggtgtggaggaggggcgtcgtggaagacgagaagagtggcccgttccctctcctctctccctttccctcgttatacggagaagtggtttctgcggggcccggtgagcctcggagtacctgaacctcgatctccggggctgcgcgtgtccttggtggtggactgacgcgccccctcccggggacgggctggtctggccgcggacgtcccctgccgggagctgtgattggctggaaacggtacccgaaccccgcaggtgaagacccgatccctgggcggacccttgggtatcgcgactcacagtatcttgtcagatcggcacgcggtaccctgaccttgagtgagtctactgtccgcttgcgtcgcgggcgcatggacgacacgtgcaggaccagtacgggcaggcagccgtctgtctagaaggaaaggggaagttgacgctcctgtgcctcgcaggcgtctggcgcagtgggagcgcataccgggcaggccccgatctgcgctcggccaggtcacggcctgaggacggagcggggaagcgcaggccgagagcgagaacctgaagattgttgacggcgggtccagagaggtgcgcacgtgaaggggccaagagggacgaacgttccccacaagacgcttgagagagaaccaagacgccatgccgaggataagcgaatcaccgcaggaaactgagtgcccttgcccttggaagcagacatgtgaggaggtggaaccatgagcagaatagaaatggggcagagacatggtcatagacacacagaccaataacaacaaaaaaccaagcaaacaaacaaattggacacgagggggaaatgaacaaacgtgaacggatactggaacgaaaagcaaaagacacgaacaattcaatacacacagaaaacggccaacacccagagacagcgaagcaacaaaaagagacagcaacggaacagaaacaagaaaaaaggaagcgcgaaaggcacaaagacaaacggcaacaag

SEQ ID NO: 645792 - DNA, 1780 bp, Homo sapiens
ggttaattctcacccccaggcttgggtctgtcatcggtgcgtgcgtgtgattccaactagacttcatactcaggcttccagtacatatcaacgttggctgcgttcggctgtagactgctgggtgtgcgttcaactcgcgttggtgggtcgcgcatacagaaggttgctcaggaagtcccacgtgttctcgatccgattcatcgcgccacgagaatgaagggtcccgagacagcacggtgcaagttacctgatgatacttgacagctgaccatatcaccctggcgtcaatatagggcagggcagatttattctgcaagcgaaatgtgttaccacataggagagtgagttcggcgcgagatcgcttcttgcgctgaccaactacacatgagagggtccctcgttcgtgcttgatccgtcgcttgtaatgtgcatcacatatgacataatctcgtagtatccgttgaacgagatgcctttgtgttgtccaggcggttggaatgcgagtcttctccgtgaacgtggactcggagtgcgcattgttgtagaacgggtctggtagggggtatcgaagtcttggaacaacgggctggggactgcgcctgcttggagcccgtgtagatggcacttcgctctggtcctcggcgcatacttaatgtggtaggggctgcccaactcctcgtttcctctgggtatgtttttgtccactggtctctgttccgtcgtacttacccgtacgtgtcctcggttcgtgtcttcctgtgaggttcttccgccgcgctttggctgacttccgctctattcgtcggcaaggcccgtttcattctcagaggacattggcagcgggaggatttctctcgtccatataaggcgcgcgtccgccatcagtgtgacgtgaaacagacgatgggacaggccgtgggcctttggggcctggtgtctgcaatgccgtcatcgtgggaattcccaactgggacattgcgggacgaatataaccgacgagagtgaccattaggagtctaacagcgtgagggtgcacctgtgcctccctgccgggcatctactaccaagctcagcagatacttctagttgtttcatcccctgtgctctgggtctgtgaaggtgtcgtcgctcgccgcgcttctctgctgcggtatccgtccgtgaccgtcgccttatcgtcgaggcctgcgtctctctcgctctcgcgcgcgcttctcgtcacgcccctctgtgggtgtggtgctcccccgcggcggcgggaacgtgtgcgtcggactctcgccgcgccgtttgtggttctgcgctgcctcacggtcttcgcgctgcgtctgcgcttcttcgtcggctttcgggccgaagttgtccatcgtcatagccgctctggcgctctcgcagagactccttcttgcgcgtcgtcgtgggtctgggatcagtaggctagatctggcgaccgcgtcacgcgctcctctcgctctgctcttgttgtcggttctctttgtttgttttcttgcttttcgtgttctggtgtgcgtgtgtcgtcgacaccggtccgtgggctcaggcgcgcttctccttgcatttgcttgtgcgtctgctctgtgttgggcttcggtgtggtcagcggcgcgtctcgcttgcgtgtcttgctgcgggggacgctcgtccgggcgttgtctggctcgcttagtggcgttttgtcttctgctgtccgtgctcgctagggccggcggtcgtgctctgtgtcttggctgtttgttcgcgcgtcgggtttctcctcgcg

SEQ ID NO: 645793 - DNA, 809 bp, Homo sapiens
  misc_feature (566)..(566): n is a, c, g, or t
tggacccccgtctgccggctggtgcactggtgctgctgggccctgccctggtgttcgcgttgggccccgtgcccgccccggagatgcgtgagaggttgtgcgggcaccacttcgtacgcgcgctagtgcgcgtgtgcgggggcccccgcatggtccaccgaagttccaggaggtcctgcggccggaggtcggaccgtgagttgctacagtgggtggaggagacgatatctgctccatgggctggtggccgacagtaatctcacgctggaagctggtctgcagcccctgccccagaactctcacctatcaccggacatcaccggtggcagcttgccgaccaaccctgcgacggctgactggctgcgctcagtggcttgtaccgcaatgaaagaccgtagctgacccgtcatgatccctacgtgcatgtcgtcctttggtgttgcacgccattacgaagttggccttgagggcccgggaggggtcctggtactggtgacgctcactgagtgtccatcgacatgtgaccatagaagctctcgcagtctagccaggcctttgtattaccntcctggagatgggctgctcaactatctagcccgcagaccaatgaccacctggcagccttgtgagagtcgagctgcagtagataaatcagaccctaagcccatggctgtggcaggatcccccgggtttcaccagatgtctggacagctgtacagcctaaatgtcgctcatgtccagaggagccccagaaagctgcggtccctgcatgtgtaacgaccccttcttgctgtctcttagtaaataaa

SEQ ID NO: 645794 - DNA, 381 bp, Homo sapiens
  misc_feature (2)..(2): n is a, c, g, or t
  misc_feature (11)..(11): n is a, c, g, or t
  misc_feature (152)..(152): n is a, c, g, or t
  misc_feature (310)..(310): n is a, c, g, or t
  misc_feature (366)..(366): n is a, c, g, or t
tngcctggtcncccccttttcctgcctggccacgtggcgagttcctggccacggataagtgtcagcgcggtggctgcctcgcccgtggtgttgcctgcccggatttctccaggcagacactctttccattacccaggttctcactatctttngtaaatacctccgtggaggcagtttactgtattgttaaaaaaaaatgttttgcatgtctgtatctagtgttacactgtaatccacatcaaagctgagctggtgtccttccatcttcaagccctcaggggactccgagcaatgcctggaatgtgcttgnaaataagtatttgtttgagtgaatttgcgagcgcaccaaagactcgtgcagttagnaaacacgttttaccc

SEQ ID NO: 645795 - DNA, 708 bp, Homo sapiens
  misc_feature (270)..(270): n is a, c, g, or t
  misc_feature (276)..(276): n is a, c, g, or t
  misc_feature (297)..(297): n is a, c, g, or t
  misc_feature (300)..(300): n is a, c, g, or t
  misc_feature (314)..(314): n is a, c, g, or t
  misc_feature (316)..(316): n is a, c, g, or t
  misc_feature (324)..(324): n is a, c, g, or t
  misc_feature (338)..(338): n is a, c, g, or t
  misc_feature (344)..(344): n is a, c, g, or t
  misc_feature (373)..(373): n is a, c, g, or t
  misc_feature (402)..(402): n is a, c, g, or t
tagatctgggagaggaacccgagaagccagcaccgtccttggtggggactgctccctagactccaggagccatatcccagacctttgccagctacagtgatgggatttgcattttagggtgatttgggggcaaaaataactgctgatggtagctggcttttgaaatcctatggggtctctgaatgaaaacattctccagctgctctctttgctccatatggtgctgttctctatgtgttgcagtaattcttttttttttttggagacggngtctcncactgtggcccaggctggagngcngtggcgcgatctgngntcactgangctccgcctcccgngttcangcaattctccgtgcctcagcctcccgagntagctgggattacaggtgcctgccaccanacccagctaagtgtttggtattttagtagagatggggtttcaccatgtgggccaggcagatctcaaactcctgacctcgtgatgcacccacctcgtgctcccaaagtgctgggattacatgcgtgagccactgcgccctgccggttggtagtaatttttaggcaccaaatctccctcatcttctagtggccattctcctctcgtgtcaggtaaatgtcacactggtgcccagaagggatgaccaggaaccttaaagagtggctgaaaagatggcagagttatcataataaaatggctaaactggcg

SEQ ID NO: 645796 - DNA, 419 bp, Homo sapiens
cgctcacgcccacaaaggacttctttatttgccattcctattatgtacaaagccatattttctatctctactttaaaacaatagagtcttgctctgttatccatcaggctgatattgcagtgctataaacacagctcactgcatcctcaacactcccggtctcaagtaattcttccatctcactcttctaattagcttggactacgggcacacttcaccgttcccggctaattttccgttctaggtagagttggggtcttgcggtgtatgcccaggcttgtatagacctcttgtcctccagcaaccctcctgccttagcctccccaagtgctacgattataggcttgatccactgtgttcagcccactcagatctagacaggagatcagcagttaatttcgtcttttgtcattctcagt

SEQ ID NO: 645797 - DNA, 211 bp, Homo sapiens
ccaggtctcccgaggccgagcatgtactatgtagccattagcaaaccaggtagtaggagcacatagttcaatgcacaacaggcaacaaggatccggctgttagggtgaacacaagcaaattatcaaataacttatagtatgattccaagtttggcaaaaaacaggagtcaggagaggcataagaaaagggagagactgtgcaggagatagg

SEQ ID NO: 645798 - DNA, 194 bp, Homo sapiens
ttcctgtctgcctccgcttctgcaaaatggctgcttcctgcttctgcctcctgcttctgcaaaatggctgcttcctgcttctgccgcttcctgccttgtcttcctgcttctggctgcttcctgcttctgccgcttcctgcttctgcctctctctctctctctttctctctttctttcacagggtcttgaagaag

SEQ ID NO: 645799 - DNA, 294 bp, Homo sapiens
actaagcctttccgttcccggagaataaaaaaaattcctttttgaaatgaattcctcctttgggggaaaaaaagcctgccttttagccccccaagatgaaattatggaaaacaaaagggggtccttcccatgggcggtccctgtccccccccgccagtcctccccccccaaactgtttttgattgggttttagctttttggtgtttttttttttccttttaacccttggatttgggggcttttttgtgattttgagaaggaaacttttgggggtttaataaagtttttttccca

SEQ ID NO: 645800 - DNA, 250 bp, Homo sapiens
gcagccacgtggtctcacgttttcatgttgacagccagtcagagtcaagagctcagctgtatcgacagatcgtcatgcatcatctgcaggcagactgaggagactactccagctgggaggtagtctccagagagagctggacgcatgttgcagaggcaaggcccatcactcacgtctcctacgtcttgggagagctcattggacaaccccaggagcatctagtccttcgatgttgcccaacgcaagggtg

SEQ ID NO: 645801 - DNA, 332 bp, Homo sapiens
ctctgatttccctttagtccttcataaatgccatgatcccaagtaggaacaacctgtcattacctttaaacatactaaagagtctagagaggaaggctgaattttctttcaaacttctcggagtaccacatggtcataattagaaaataaaatactgccttggctatttggcaattaacataactgggttgcaacgctggaggattttctttctttctttctgctcaaattggcaaacaaggtaattgctcgaaatggtgtcagattaaaaacacattttcaaagtttagaccatctaaaattatctcctgaagtgttttagaagacagttg

SEQ ID NO: 645802 - DNA, 429 bp, Homo sapiens
ctcctggctagaatagacagcgaaacaggagcaaatcttatacaggcggcttcctcttcttcagcaggcatcatttgtaacgctgttcgaaatggcatacaaacaagatgcatctgagcgagaaggctctggaagttctggcactggggaacaataggaagatcaaataggaggaaagacagtaataatagtcgtaattgtgacctgataaggacaacatatgaagcttaggagtgaagcgacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaa

SEQ ID NO: 645803 - DNA, 437 bp, Homo sapiens
  misc_feature (284)..(284): n is a, c, g, or t
  misc_feature (344)..(344): n is a, c, g, or t
  misc_feature (351)..(351): n is a, c, g, or t
gatttgtgtctcatatgtactcccaattcctcccagtttcaagcagttacattgtgtctgcgtttagcacatagccgttcatctcctctgtctcagtcctgcgtggagatagggtgctccgctagccgctcttcccaatgcctctccagtggtttggttttccgaagcttgtttgttgccagtgccttcaggagggaatttttgggaatactgttctctgaggactggatgctgcctttatacttgaaagtaattttgtctggatataaaattcttggctcacntatctttccttgtgtgtcttaaatacgttaatcctttttttttctgttggagtttgatanttaattntctttccgttataagtcacctagtcttttgcttggatggctaaaaaatttatctttaaatagtgtttttattgggctgataagccg

SEQ ID NO: 645804 - DNA, 157 bp, Homo sapiens
gccggggggctcggccactctctccggtttctggcctcttctcccttcactcccgtccaggctgggtttgagagcggggctgttctgcagcacctcagggcggggaggagagatacctgctgcttccattgctttgcccttccaggagtcgacgcca

SEQ ID NO: 645805 - DNA, 791 bp, Homo sapiens
tgcggtggctcacgcctgtaatcccagcacttgggaggccaaagcgggcggatcacgaggtcaggagatcgagaccatcctggctaacacggtgaaaccctgtctctactaaaaatatttttttaaaaattagccaggtgtcggggcgggcacctgtagtcccagctacttggaaggccgaggcaggagaatggcatgaacccaggaggcggagcttgcagtgagccaagatggcaccactgcactccagcctgggcaacagagcaagactccatctcaaaaaaaaaaaaaaaaggtttgaacaattagaatttaccctaatactttagataataggatgggaactaatcgtggtcctttttctaaaatgtggcgtcttgtggttcaaaaatggtcattttaaggtcattggagaaggacccagagttaatatagggggttctttaaaaaacgtggttttgtggggccgaggtgattttatacacacttgtgggagattggcccatttttacgcttggaattacattggagccatggaaaattcagttcaggggagaaccagacttttccaaaagtgaggattttccgaaagttcgcggaactttgtggacttcaaagggtgaagacttccagatgaggggtacaccgggttccactattacagtggcagtgggtggtaggggggttaagggcggcgaagaatatgagctaggggtggcggaagcgaggacagtttgtcctaaaaaaccggtgtaaattggggactaagttaattaaggtcgccggaatgt

SEQ ID NO: 645806 - DNA, 1347 bp, Homo sapiens
  misc_feature (619)..(619): n is a, c, g, or t
  misc_feature (971)..(971): n is a, c, g, or t
gggtgtatcaatcttacccgctcggactactagcactatccggtgagggatgttagtgtctcatacctactggctacggacgaatcagatcacctatccgcgtgatggcgcattgatgggcgtagctctagataccccgtcatggaccagactttccctgttacagcgaaggattaggggctccctttgtgcactcacgtacgtctctctacctggcgtagacgtgaggagcccgctgtcgtgctacggccatacaagctcgtctcatggtagagaagagtatactaaggcactactacactagagtaacctggagcctatgatgatacatcgagagtggctttaagatagcgaaactacgatcccggggcggcaagtgatgtgagctaaaccagcattagcagtaaaactcgtgcactggatatgacttagctagttactgttggtaagtacaagctacataacgcaccttgggaagcacctaattttcatttaggggtttccttgctcacttctagcatattagtttctatctcgccattcgaggatccaatgtttgattctaagtgaggtctttacaaaccgcattaattcctaggtggcaatctctgataaacanttgttgcttggtgttaccatttcatggggttcctggtgcgactctaagggcgctcgatgcaatcgacttggtcgctgtctgattaggacccaggattgcctctggaaaggggccacgcatttgtcctacgggtattgaagaaaggtctactttcagcgcatactttctccttcacatatccttcatacggtatcgcccaaagagggtcatcacctatagagaacattcattgacccttacgagcgatggaacaccccaggaagactcctttttgcttccaccctatgcatatcgtgtcttgtcttagacctttcccgctccgtgctgtatcgtttccgtacttgactccccntcgccccacgaatttcgccaggccgttcattgctggaatgcaaagaacaacgccccaagatgaacattgcattcggcgttaaattaccctacttccgctattttctcactttgaggcagcgctaacggtacgcgtcagaccacaatttacgcggtgtgaggctccgcttccgcagagcgtagatttttccggcatcgtaaggggagcgcccccacgttaatagatcgtcgggttaaccgcaagtttttacataaggtatcaagtccgttggggtgcgccctaatggatggcgtagtatcgtaatatcctatggacccggggcacggtggtcgctagtggattttagcgatgaggatgcgtgaagctgtgtgaaaac

SEQ ID NO: 645807 - DNA, 235 bp, Homo sapiens
aattcggttattagattactctccttagtcctagctagcttttcgtgtaaatgcatgacattctcatcagcctgtgcagtattcaggaactgggtcgtaacatcgaggtccctggaaacagtgtcttgtcccaaacttagactcatgtacctgcaatactgtcctcagtgagcctgacgttggttagcttccggagtggatgacgcttatccttatgctgtcgggctagtcgggg

SEQ ID NO: 645808 - DNA, 410 bp, Homo sapiens
gggagcgcagttcgtgggacacgtcgcgcagcaactggcgctggctgccgatcaggctttgcaggcgtgcgcccatgcggttgaagtcgttggccagcacgccgaactcgtcgcgccgattggccagttgcgccaggctgttctgttgataagtggtttgccccagatcatgcaccgcgccgcgcaaacggctgagtgggcgggtgatggacaaggtcaccagcaggctgaacagggtcagcaccaccagggtaatcgccaatgcactgagcggccacagcaggctgctgcggtgccaggcgtccagctccgggtgaggaatacggtagatcaataggtaggtgccgccggtttcggcgctggtgtactcggcggtcaggcggcgccagggcagggactcaggtggtgtg

SEQ ID NO: 645809 - DNA, 185 bp, Homo sapiens
cagagaaatccggagcgtaacaaaagcaagacttaatagggcgtttagatcagatattgcagacccgaaacgaagtgatctatccatgagcaggttgaaaccggtgtaagagccggcggaggacacgaacccgctgacgtcgaaaagtctctgggatgacttgtgaataggggtgaaaggaagta

SEQ ID NO: 645810 - DNA, 151 bp, Homo sapiens
agaggatccccgcgagtgatgcgggaaacaagcagggcacacggaatagaacaaaaggctcccccacttgtgccctgatcactgtcatcgtggatgtcagaccaagatagccttctcacaggagatctcggatgcatccgtcgttgctcga

SEQ ID NO: 645811 - DNA, 386 bp, Homo sapiens
  misc_feature (4)..(4): n is a, c, g, or t
cgcncccccaaagataccaatatgtaatcctgaaagtctacgaataagttatatgacatggcaaaaaagatcctacagatgtaactaaattaagatcttggcaagaccaatataatcatatggatttttacaagagggaggcaagattgtcagataattgggatgtggctacagaaacggaggtagttgtgatgggaggtcatgagcaaaggaatgcaaacaagctggaaagggcaagttaacagatacaccctcaaagcttccagaaggaactcaaacatctgcaaacattattggaactgattttagatttctcatctctagaactgtaaattaaaagtttgtattgttttaattcagtatgtttgtggaaatgcgctatagca

SEQ ID NO: 645812 - DNA, 213 bp, Homo sapiens
cctctcgaggatccccggctcatagcggggcgccttgtgtggcccatggcggggcgcgtggtgcggcgctttgggtggctcattgcgcggctcatggggtggctcgtcggggggctctttgggtggctcatcgggtggctctttgcgtggctcatcgcgtggcccttcgtgtcaattcctttaagtttcagctttggccctttgcgcaacgag

SEQ ID NO: 645813 - DNA, 701 bp, Homo sapiens
gcatcagcacaccccggcactcctctgcggcagctgcgcctcgcaaggcgcagtgccgagcgcacgccggagtggctgtatgctgcccggcgcggcgccgcctgcgcgggctgtgggctgcgggctgtgcccccgctgctggccagtctgcacggtgcgggctctgcggcgcccgggtgctctgcaacgctgcggcgggctggcatgggataactgctggcatggtgcgccgagatcgcctccgcgaggatgagggagtggcgggtccaggtggggctgtggccgtgcccctgcttgctgcggtacctgcaacatacacacccctccaaggttctcccctgcccttcattcatggaacgtcttcaggcaagtttatcacttaccaagggactgcggtatcttctaccaagactctgtgggtgtggtttggaagtccacgagataagttgtgcttaaaccacggtttaccaaaatccaagctacagatggtacaacgactagggaacgggtctgacccttgaggtaacaatcgggtgatttgcccttgatatctttagggctttgcgttcagtgacaaacgagaccacatcaagtattccatattatgaacaggaccagcactcgtgaaagggctattgcggccattcttgggctcaagaaacggagatcaacttctttctcatgactatggaaatatgtgc

SEQ ID NO: 645814 - DNA, 333 bp, Homo sapiens
tcacccccaaataaaaggtttcccctttaaatttttttaggttttggccggggggggggggttttcctttttttcccccccttttggggggccgggggggggggttcccccggggggggggttttttgcccccgggggcccccttggttgccccccttttttttttaaaaaaaaaattttgccgggggggggggggggccccttttttccccccttttggggggggttgggggggattttctcctttcccccgggggggggggggttggggggcccccttttgccccttttcccccccgggggggggggggggggcacctcctttttccccca

SEQ ID NO: 645815 - DNA, 133 bp, Homo sapiens
  misc_feature (17)..(17): n is a, c, g, or t
gatcccttccagcctgngtgacagaaaaagcaaatattcagcgagtgctgggagatcatgtaagggaaatatctcaaaatccaggaaaagaaaaatattttgaagatgtgcaagtaaaatgttaacgagatga

SEQ ID NO: 645816 - DNA, 603 bp, Homo sapiens
gccatgtagcccccttcccacccaaagggcctcccctggtaactagtccgtagggagacctgtgccccaactgctgtggcccctccgtgatcatccttctccagggagcaagcaaagacccaggaatggaaagcgagtttcctaacaggatgtaaggtcccccttcagttcccccaggcctcaaagcaagtagctttccaccttttgccagaatacaaaggaaagatggtgttgggagccctttggagaaccccagtttccccggccccccgcatctattgagtttgcaaagtcccaacccctttggttttggggccagcaagattctttaaaaaaaggttttttttttcgggccccctgccaatcatgtgggtgaacccgtggaacaacgggaaacctgtgctagtttttcaaattgcccccctattacccggccccaaaagaaacccagtgggccggaggtggttttgaccccctggtttcttctccccccaggagaaaagtttaggagaaacccgccttttctgttttttaaaaaatacagcttccccccggccagttaacaaggaaagcctgggcccaaaaaagggttttcccccttta

SEQ ID NO: 645817 - DNA, 155 bp, Homo sapiens
  misc_feature (44)..(44): n is a, c, g, or t
  misc_feature (60)..(60): n is a, c, g, or t
tccattggcattgcttagtagcgtatacatggcttcataacctntggagcacagattgtntgtggttccatagatcttccacttgctccataaacccgatccctgatagagcataatattcttttcttgtctgttgccgtagttaaaaaaaaaaa

SEQ ID NO: 645818 - DNA, 378 bp, Homo sapiens
  misc_feature (372)..(372): n is a, c, g, or t
  misc_feature (376)..(376): n is a, c, g, or t
  misc_feature (378)..(378): n is a, c, g, or t
cctgcacttactccacctgacagacacctttgttgcattcattatgaggcagccactgctctgagttccaatattaactcatttaatccttatcacaaccctatgaaggagatgttattatcccaatttacagatggggaaactgaggcacagataggttaggtaacttaggatcacatgagttgaacccaagtcatctggctctaaagtccatgctcttcatcacttgcctggcttcatcactataacatgtcccgtttgaagacagaaggaccgagagtcctctcttccaccctgcaccagcatttctgctccaagaaaggacagtgctgtccggggtcaactgacatctgctcagaagacccctgtgcntganan

SEQ ID NO: 645819 - DNA, 137 bp, Homo sapiens
  misc_feature (125)..(125): n is a, c, g, or t
gcgcttagtgacttctgatctgggcctgagcttcggcacttggagcagtgaatccagtctcaataatactatgagttcatgagcacattcttcttagaagtcagctctgtcttcccagatttttnatcttcatcttg

SEQ ID NO: 645820 - DNA, 971 bp, Homo sapiens
ggaggcggtagaggggagtgcccggaggcgcaggccgggccggtccaaccctgtcctagaggcgaagccggggcccccgaccatcgtagagcggcctgtcgacgacctcggctcagacatccccgacggccgtgttcggccagaatggagttttctggccaagaccaagagggaggggtgaagcgccagcacgctatgcagaccaagcggtcccaggcacccgccgtggagtggcgcctgcaggggcgttcctacaatcgatcggtggaagaccacacagagcccgctctcagcggctcacgagggggagagtgcacgcggcagaaggaggcgtagaagcatggagcggcagctggccctgcccgcgcacggagcaggccgccacccaggagtccacattcccaggagctgtgcggagggggctgctggaggagtcgggatggtgagggggagccaggccagggcgagggcgccggagcgctggggagtgccgaggtctgtcccacggacccgccacgccgtggccaccacagagaagaagacggagcagacagcggcggcgggagaaggcctgtgcacaggactgcgggttacagcaggccgcgtatgcgcgccgcccggctccggcaccaggagctgttccggctgcgccggatcaaggcccaggtggccgaggccggcggagcggcgcggcggcggaggcgacggcaggcgcggcgggatgctgaggcgacacaagcccccgaaggctggcgacggctcaagtaccaggcacctgacatcacggcagcagagctcggagctgccagactcgccatcaggactcgaagcccgagggcaacatccttcgagaccggcttcaagagcttccagaggaggaatatgatcgagcctcgagagagcgccaagttcaaacgcaagtacaagggaagctcgtggagaacgcggcagacatacgccctgcatgtagc

SEQ ID NO: 645821 - DNA, 726 bp, Homo sapiens
  misc_feature (299)..(299): n is a, c, g, or t
  misc_feature (301)..(301): n is a, c, g, or t
  misc_feature (306)..(306): n is a, c, g, or t
  misc_feature (308)..(310): n is a, c, g, or t
  misc_feature (316)..(316): n is a, c, g, or t
  misc_feature (318)..(318): n is a, c, g, or t
  misc_feature (324)..(324): n is a, c, g, or t
  misc_feature (329)..(329): n is a, c, g, or t
  misc_feature (335)..(335): n is a, c, g, or t
  misc_feature (357)..(357): n is a, c, g, or t
  misc_feature (369)..(369): n is a, c, g, or t
  misc_feature (375)..(376): n is a, c, g, or t
  misc_feature (381)..(381): n is a, c, g, or t
  misc_feature (386)..(386): n is a, c, g, or t
  misc_feature (390)..(390): n is a, c, g, or t
  misc_feature (425)..(425): n is a, c, g, or t
  misc_feature (432)..(432): n is a, c, g, or t
  misc_feature (437)..(437): n is a, c, g, or t
  misc_feature (491)..(491): n is a, c, g, or t
  misc_feature (512)..(513): n is a, c, g, or t
  misc_feature (579)..(579): n is a, c, g, or t
  misc_feature (593)..(593): n is a, c, g, or t
  misc_feature (612)..(612): n is a, c, g, or t
  misc_feature (618)..(618): n is a, c, g, or t
  misc_feature (641)..(641): n is a, c, g, or t
  misc_feature (715)..(715): n is a, c, g, or t
ttgacccttcagttgatgttcttaaggcaacagcactccctttgttgaaacaatttgggattgatggtgaatcatttgaactgaagattgtgcgacggggaatgcctcccggaggaggaggcgaagtggttttctcatgtcctgtgaggaaggtcttgaagcccattcaactcacagatccaggaaaaatcaaacgtattagaggaatggcgtactctgtacgtgtgtcacctcagatggcgaaccggattgtggattctgcaaggagcatcctcaacaagttcatacctgatatctananttccncnnntccccngnaaagtntcaantcgggnaagttccccgggctttgggttngtcactcggttngctggnnacccnccatnggcncctttcctcatgctgaactggcctccaacccccangggccangggancagcaagtaccttccagaggaccttggcaggaactgtgcccggctgctgctggnagtaaatctcacaggggtggnntgcgtagattcgaccaaccaaagcctggcgctactactcatgacccttggacagcaggatgtttcnaagtcctgctaggncctctctctccctacacgnctaganttttttgcggaatttgaagagcntttttccagattatgtttaaaattgaaaccaagccatgtggtgaagaactcaagggtggggataaagtgtgatnaccttgtgtgg

SEQ ID NO: 645822 - DNA, 132 bp, Homo sapiens
ggtttggatgaaagtcgtagggtgattctatttctgctgtgatttatcagctgaaagctcagctggggttgtgcaaggctagggaccctattccttgtgtaatacaaggtctgaccagtgtcctggctccca

SEQ ID NO: 645823 - DNA, 870 bp, Homo sapiens
  misc_feature (24)..(24): n is a, c, g, or t
  misc_feature (52)..(52): n is a, c, g, or t
  misc_feature (96)..(96): n is a, c, g, or t
  misc_feature (116)..(116): n is a, c, g, or t
  misc_feature (124)..(124): n is a, c, g, or t
  misc_feature (132)..(132): n is a, c, g, or t
  misc_feature (140)..(140): n is a, c, g, or t
  misc_feature (150)..(150): n is a, c, g, or t
  misc_feature (152)..(152): n is a, c, g, or t
  misc_feature (156)..(156): n is a, c, g, or t
  misc_feature (184)..(184): n is a, c, g, or t
  misc_feature (207)..(207): n is a, c, g, or t
  misc_feature (263)..(263): n is a, c, g, or t
  misc_feature (289)..(289): n is a, c, g, or t
  misc_feature (294)..(294): n is a, c, g, or t
  misc_feature (320)..(321): n is a, c, g, or t
  misc_feature (356)..(356): n is a, c, g, or t
  misc_feature (361)..(361): n is a, c, g, or t
  misc_feature (364)..(364): n is a, c, g, or t
  misc_feature (383)..(383): n is a, c, g, or t
  misc_feature (414)..(414): n is a, c, g, or t
  misc_feature (429)..(429): n is a, c, g, or t
  misc_feature (439)..(439): n is a, c, g, or t
  misc_feature (443)..(443): n is a, c, g, or t
  misc_feature (460)..(460): n is a, c, g, or t
  misc_feature (468)..(468): n is a, c, g, or t
  misc_feature (555)..(555): n is a, c, g, or t
  misc_feature (560)..(560): n is a, c, g, or t
  misc_feature (637)..(637): n is a, c, g, or t
  misc_feature (642)..(642): n is a, c, g, or t
  misc_feature (665)..(665): n is a, c, g, or t
  misc_feature (670)..(671): n is a, c, g, or t
  misc_feature (682)..(682): n is a, c, g, or t
  misc_feature (684)..(684): n is a, c, g, or t
  misc_feature (688)..(688): n is a, c, g, or t
  misc_feature (699)..(700): n is a, c, g, or t
  misc_feature (705)..(705): n is a, c, g, or t
  misc_feature (707)..(707): n is a, c, g, or t
  misc_feature (738)..(738): n is a, c, g, or t
  misc_feature (752)..(752): n is a, c, g, or t
  misc_feature (759)..(759): n is a, c, g, or t
  misc_feature (761)..(761): n is a, c, g, or t
  misc_feature (763)..(763): n is a, c, g, or t
  misc_feature (770)..(770): n is a, c, g, or t
  misc_feature (772)..(772): n is a, c, g, or t
  misc_feature (798)..(799): n is a, c, g, or t
  misc_feature (804)..(804): n is a, c, g, or t
  misc_feature (832)..(832): n is a, c, g, or t
ttgggctccgggaaaccgttcggnctggggctttcggccacagggcggatanactcacacagtgggtaattcagtgtctagtattctagtgccgcncactttcccctattgcccantgcataancttagttnaactttcnatttcctttnantatntcattaaaaaaaacatcggctccaaatntaaaccactctacatccttttanaaaatttaggaaggtttaactgtgctaaacttggccggactaaacaggtgcagaantactcaaaccctaaattctccaaaantctanaacttaaataccgctttaaaaaaatnnaaaaactacactttgaaatctataaaataaaaaanaaaangcnaaaactaaagaataataanttcctatggggtactaaattttccctaaaanaaattttatccaacnaagtactaantctncccttaatgctgaaacntgaaaaancttctgggcgggggaacatcacggtctcaactcaggaattaaaagacaatcgtttaataaatatggaggtagaggccagaaacctanataanaaggacttcctgggaaaatcagatccatttctggagttcttccgccagggtgatgggaaatggcacctggtgtacanatctnaggtcatcaagaacaacctgaancctanntggaagcgggntncagnccttggtcatnnggtcngnggtgggaacccagcacacctatcctggggcnaggggccgaggagnacatggncngngtacatntncgcagtggtatggtcataccagcggnnttcancttcatgtagtcccgttttagtggtatncagctacccgtaaagtactaaaaaaaaaaacgataaaa

SEQ ID NO: 645824 - DNA, 610 bp, Homo sapiens
aaagtatttgctgaatggggaccttttgagttgaatttattttattcatttttattttgtttaactgtctggtgctttctgtcacctcttctaatcttttaatgtatttgtttgcaacttttgggcgtaacgactatttttctactgacgctactctctttccttctgcacagctttctagcggctcaactttgccctttttaactgaacatgctgaacgttatactgtggctatgcaacagctctcacctacgcgagtcttactttgagttagtgccataacagaccactgtatgtttacttctcaccatttgagttgcccatcttgtttcacactagtcacattcttgtcttcaagtgcctttagctcttaacacgttcactttcttacacgtgctatttactgacagtcattctattaaactatgcctaacacatacttacaatcggcatgtcttgcactctgatgtacttttatcacggttgcgctgcatgacacttctcatacgacttacagaacgtcgcggacacaacgcaacaaccccaccccccaaacccccccccccccaccccccccccccccccccccccccacccaccccccccccca

SEQ ID NO: 645825 - DNA, 391 bp, Homo sapiens
  misc_feature (38)..(38): n is a, c, g, or t
  misc_feature (66)..(66): n is a, c, g, or t
  misc_feature (68)..(68): n is a, c, g, or t
  misc_feature (91)..(91): n is a, c, g, or t
  misc_feature (93)..(94): n is a, c, g, or t
  misc_feature (98)..(98): n is a, c, g, or t
  misc_feature (114)..(114): n is a, c, g, or t
  misc_feature (132)..(134): n is a, c, g, or t
  misc_feature (143)..(143): n is a, c, g, or t
  misc_feature (145)..(145): n is a, c, g, or t
  misc_feature (181)..(181): n is a, c, g, or t
  misc_feature (187)..(188): n is a, c, g, or t
  misc_feature (193)..(193): n is a, c, g, or t
  misc_feature (207)..(207): n is a, c, g, or t
  misc_feature (232)..(232): n is a, c, g, or t
  misc_feature (260)..(260): n is a, c, g, or t
  misc_feature (268)..(270): n is a, c, g, or t
  misc_feature (281)..(281): n is a, c, g, or t
  misc_feature (285)..(285): n is a, c, g, or t
  misc_feature (289)..(290): n is a, c, g, or t
  misc_feature (295)..(296): n is a, c, g, or t
  misc_feature (300)..(300): n is a, c, g, or t
  misc_feature (302)..(302): n is a, c, g, or t
ttcccttcctgcaaaacaacgatgttcactccttccanattatccaaattgaagatctaccaaaananaaacaaaaacaaaagcccacagngnnatantaagggacaaaaatcncattctaatggggggggnnngtgcatttngnagtcttcgctgtgctgtcttaccatccttcagctgnctttcnnaaaanaaactccctaagcncatcaaaatatacattttccatttnctttttttaattatttatttttttttgngggggggnnnctttagggggntggnggtnntttgnntggntntttttggtgtcttgttcagcatttgggggtcaggaaggctatttgcagcacatgtgattaggggctactgatcttcagggtttagcttt

SEQ ID NO: 645826 - DNA, 290 bp, Homo sapiens
ccaggggggcattcctgtccacactatcacataaatttttagctgatactgtgctcacctgtgaaactggggaatgtatgatgatgactgggcagatcctgaaatgcaaccacacttgaccttctagaagctgaagttgggcactgaagtggtcctatcctgaagcgaaatccagggatttggtggcacacaccctgaagggtggttcacaaggtcctgaaacctaaggcaaaaggcctgccggggcatgaacagaacagaccgctttaaggggagccatgtaagtggca

SEQ ID NO: 645827 - DNA, 345 bp, Homo sapiens
ctgccactctcaaccgatgagagttccagttttccagccggctgcgatggttcacgcctgcggtccaagcactttgggaagccgaggcgggtgggttgctcaagctcaggagttggagactggcctgggcaacatggcaaaaccccgtctatagaagaagtgcaaaaattaagtgggcgtggtggcgcacacctatcatcccagctactcgggaggctgaggagggaggatcccttgagctccggaggtgaaggctgcagtgagctgtgattgaactgctgcgctccagcctgggtaacagactcaaaaacaaacaaacaaacaaacaaacaaaaaactctagtt

SEQ ID NO: 645828 - DNA, 118 bp, Homo sapiens
  misc_feature (61)..(61): n is a, c, g, or t
  misc_feature (67)..(67): n is a, c, g, or t
ccggacgagagtctgagctgtatagcagacatgtctgctgtctagggtcatgactgtgtgnctctanagttgcactcctcacagggctcaggtgatacccactgaagctggcaggaac

SEQ ID NO: 645829 - DNA, 364 bp, Homo sapiens
ctaattttttttgtatttttagtagagacagagtttcaccacgttggtcaggctggtctcgaactcccgacctcaggtgatctgcccacctcagcctcctaaagtgctgggattacaagctttgagccaccgtacccggcccgccttcaagtgttatattatgtgttggttcttcgttttttctgagatgaggtcttgctctgtcgccctggctggagtgcagtgccgtcatcttgggctcactgtaacctctgcctcttggattcaagcaattcttgtgcctcggcctcccaaatagctgggatcacaggtgcccgccaccacacctggctaattttgtatcttgtagaggacaggttttcac

SEQ ID NO: 645830 - DNA, 439 bp, Homo sapiens
  misc_feature (261)..(261): n is a, c, g, or t
ctgatgtgaagtgtatgtgttgtgtgtgtaggtgcctgtgtgtgtgtggaccatgcatgtgtgtctgtgtggaaactgtgagtgcatgtattgtagctgcactgtggttgtgtctggtgtgtctgtgtggaccctgtggtgtgtgtgtctgtggtgtgcaggtgctggaaggcaggctctgcaggtgcagctggagcttcaaagtgtgagcattgggccaggaggcacacgcgctggctgatccaggggagagaagtcgtntctgaggtttctggaaatgacagccattgggaagcaccacagcggcactcatccatgaactcaaccatccgatcacccatcagttcatgcagtcattggatacaggtttttgctattcatttatctacttacttttgtagagatgtggtctcactatgctgcccagactggcctcaaa

SEQ ID NO: 645831 - DNA, 487 bp, Homo sapiens
  misc_feature (230)..(230): n is a, c, g, or t
gctaaactgcaaatattaccctagaattaacctcttgtcctgtgtcaaaagtcttgttttgcatctggattgttaaactgtcagcttctctctgacagtctcgaactgtcaagacagtctcagttcacagccaaggtgatctgttaaccctccccatttccagggccaaatctcagttcttaagcacgtcgtttcttagcacggctttattttcatgctctttatttctntattttgtgcagccttacccctttaaagtccactgtgagtcctaccctgcagggcctcttaacacagtagagttcatgtgctactgatttggtgcctgccttcaaacacatgtgcaagttttgtggggttaaagatagcacttggtggcacaccacattggaagtgctgttcacccggtcatttgaaacggtgtttgaccacttggtgcgcaaatggcctatcggattaaaggatagccaaacccaaaaaaaaaaaa

SEQ ID NO: 645832 - DNA, 375 bp, Homo sapiens
agtacagatgcaggaaagtacagtgagggatagagaggaagccaggatgcgcaagatggagaggatgtaaggaggacggtgctgtgtactcagacaacggcaccctgggggacgccaagcttacctctctttgcaggaatagtatatgttagaaacacctggctgggtgcggtggctcacacctgtaatcccagcactttgggagcccgaggtgggcgaatcacctgaggtcaggagtttgagaccagcctggccaacatggtgaaaccccatctctactaaaaatacaaaaattggccgggcgcggtggctcacgcctgttctcccagcactttgggaggccgaggcgggtggatcatgaggtcagtatagata

SEQ ID NO: 645833 - DNA, 413 bp, Homo sapiens
  misc_feature (195)..(195): n is a, c, g, or t
  misc_feature (199)..(199): n is a, c, g, or t
  misc_feature (204)..(204): n is a, c, g, or t
  misc_feature (221)..(222): n is a, c, g, or t
  misc_feature (236)..(237): n is a, c, g, or t
  misc_feature (242)..(242): n is a, c, g, or t
  misc_feature (266)..(266): n is a, c, g, or t
  misc_feature (268)..(269): n is a, c, g, or t
  misc_feature (292)..(292): n is a, c, g, or t
  misc_feature (295)..(295): n is a, c, g, or t
  misc_feature (303)..(303): n is a, c, g, or t
  misc_feature (306)..(306): n is a, c, g, or t
  misc_feature (317)..(317): n is a, c, g, or t
  misc_feature (326)..(326): n is a, c, g, or t
  misc_feature (363)..(363): n is a, c, g, or t
  misc_feature (394)..(394): n is a, c, g, or t
cccagtggcagcctcctgggcagttacgagctggctggcggggacctggcaggtttattgggggccctgtttgacatgggcctaaaggagggagtgaggctgttgaggggtccagaaacccgagccaagctgcccagcacaagggtgaaggaagccagtgggtacgggagccagtcagtggagcaggaggcaaanaagntgggncccccccctgagccccnnggagggttttgccnngggcncccccagcctcaggtgcattgacntnntgcctgcccccagcccccttccnggnccccctgnacngggtccccccntatttcaanttttttttaaccccccccccccccccctcagttgggncaaataaaggattttcatgggaagggggggncccctccttccccccttta

SEQ ID NO: 645834 - DNA, 450 bp, Homo sapiens
tcggtctccgtttgctcggtctggaggagcgtgctgttactgggccctgtcctgtcctttcctcatcggacactgatgttactgtcactttagttatgctaaagtggtaggttgtcagcctccagaagacagcagagccttctagggtcgccttaagaataggtttagctgaggctgggtgtggtggctcatgcctgtaatcccagcactttgggaggctgatgtgggcggatagttgagcccaggagttcgagaccagcctgggtgacatggcaagtacactatgtctctacaaaaagtacaaagattagatgggtgtggtgtttacgcgtctgtagtcccaggtatttgggaagctgaggtgggaggatctcgagcctgcgagatcaaggctgcagtgaatcatgatcgtgcgctactgcactccagcctgggccacagagcaagcca

SEQ ID NO: 645835 - DNA, 138 bp, Homo sapiens
gtcacattaggcatatctttttccactattggtggaacatgatgttgtccagctccaacccctaaaataatttcctatggcagtaagagaaggaaggtagggatgcaggctccctatctgcacagcgaggggcattgg

SEQ ID NO: 645836 - DNA, 162 bp, Homo sapiens
cccggtgttttaacaaaaacacgcaaacagacatatgaaacacgacaaaaacacacaaaacaaaaaaccacaacctccatacaacccacgcgcacccacaccaaacctcacacacgtctacatcaacgaccaaacatcgctatcgaaggtgaaagacaggac

SEQ ID NO: 645837 - DNA, 367 bp, Homo sapiens
ccccgtttttaaaaaaaccccccccccccccgggggggttttttaaagggggccaaaaaagggatttttgccccccccaaagggggggcgcctgggggttttggggaatggggacccccttgtttaaacccccttccggttttttttggggggaaaacccctttccccgcccgggggggttttaaaaaaaggggggtggggtttttccgggaaaaaatcccccggaattcccccgtttaggggttttaacccttttccgccctgggggaaaattttttttgggggttaaaccccctttttttttgcggggaaaaggggtctgttttttttttccccgaaaaagggggaaagggggtccgggccccca

SEQ ID NO: 645838 - DNA, 659 bp, Homo sapiens
  misc_feature (353)..(354): n is a, c, g, or t
ctggggtgggtgccctgtgtcctgtgggcgagctcgagcagccaaccccggtgcgcgtcggggccatggactggcctgagtgcagctgcgtggagcacttcctgtgagcaaatgtgaacctggtcaccgaagtgctgtggtggcgctggaggccaagacctgtgggtggagaagctggtatcttggctgcagtgagccgtcactctgctaagcctgtatcttgctgttcgtgctacgtgagcgtctctgctgtgcaatctcatctggattttgtgtacccctgcatatgcctcaatcaaatgctatctgatgatgcccaatgcaatggactgactgacacttgtgttggctcnnacctacttggtgtgtgttgtactgaccctgttttggtgcttgtgcctgatgttctttcatgctgcatctaactaccttggtccttgtgatatccctttcccctactactgttgtgtgcaatggtggctagccttccttgtttgttccttgcattggcttacccagtggccctagtgaactgtgggtcatctcatgcttggtatcagcgctgtctgtgctgtcctgcttgttcctaatggcaccacgttggcctgtagacatgaatcatgaactgacctcagcgggcgagccctggactgcggcgg

SEQ ID NO: 645839 - DNA, 412 bp, Homo sapiens
catataaaatacatgatttgcaaattattttctcccattctgtgggctgtcttttcgctttattgatggtgttctttgaagcacagaagtttttaattttgatgatgctaatttatctatttttgtctcacttatacttttggtgtcttatctaagaaactgtcatctaatccaagatcatgaagaattattcctatgttttcttctaagagttttgtagttttcgcttttacatttaggtctatgactcagtttgaattaattgtatacatgatgtgacagagaggtccagcttcatctctggcatgtagatatccagttgtccaagcataatttgttgaaaaaactctgctttcccctattcaattgtcttggcatttttataaaaaataaaccgcatatctatgtattt

SEQ ID NO: 645840 - DNA, 580 bp, Homo sapiens
  misc_feature (526)..(527): n is a, c, g, or t
  misc_feature (532)..(532): n is a, c, g, or t
  misc_feature (550)..(552): n is a, c, g, or t
  misc_feature (555)..(555): n is a, c, g, or t
taagttcgcttttgaattaactttccccaccataatcttcctacgaaaaaagttaatccctaaacaaaaacagcctgttgtactcacctgtttccgggaacctctcaactcactggcttgcctaaggctccttgtcccccataacagtgttcaaaaaacagcccctcggaatatgttcaacatttgctctcctgtcatggtaatgcctctcctgccaatggtggaactcttccccgtggtaaagcataatattaaactccgggtaccttcccctactaaaaaaccctatgcccctaaactgtaacccccctccagcacaaaataactgggacaaactcttaaattccacctatccggaattgtacaaatctctctgtaactacctttgtaactgtcctgtggtttctcccaccattcctttgtttttggaagaacataattggattaatgccctgaaaaaaaggttccaaaaattccctttttgttcctcccatttaaaaaataaacccttttaatttatccgagnntgtcnctggaactcaatcaactnnntcnccttggtggtcatgagtacacaaga

SEQ ID NO: 645841 - DNA, 238 bp, Homo sapiens
ccgaccagcaggtccacgtcaacaaattcaccaatgtgcaaacgcggcccagcctgccaggcctgttcgccgccttcctggccataccgctcgccaatcagcgtgagcttctctgccaactgatattcgaaccccgtgccccaggtcaggcgatgttgttgatcaccgtcgttgtaggcgtggctccagccggcgttcaggttcaggcgcaatgcatccaggggttgccatgtcaggg

SEQ ID NO: 645842 - DNA, 881 bp, Homo sapiens
gactggctgctctgaacaagccatctttgcattgttcctcatccgtcctccttgctcgccgtcagccgcctccgacgtgcgccttcctccgccgccgcggacatcctggcagctttatcgccagaggtccctgtaactctcgctttctttttaatcccctgcatcggatcaccggcgtgccccaccatgtctagacgcagcccgtagaacaccatgctccagatgatcacctaccagaggacttaaaggagaagaaggaagttgtggaaagaggcggaaacatggataggagacgcccctgtctaacggcgaagtggctaatgatggaagcactggggacgcaggaggctgacaatgaggtagacgcaagaagaggacagcaaggttcgtggggatggcactgaggaggatggaccgaagaccggtgactggtgaggaagcaggatggcatgcatgaaggactgaaggcaagctgcagttcagccttacggggcgaaggccggggcccaggcttgcaactgattgcatggaggggactgaaaccgattggtcgacttaacccacatgaaaggtcacgaaaggcaacccgagcgcagggcattgacgtacgaccgcgtccgagcatcgacagggtcacatacgagggtttcaaatcagccgtttaaaacagtatcaaaaacatccagggggcccaggtcgctgttgggcaccccattaaatttgcatacgccgctgtctcaaacttatgtgccccccacggtctgcccttcagagaacaactcctagacaaacgcgcgtgtgaagactcacaatcccgcgcattaccatgcggggaccaatctacgacaacagcataggcggggccccccgacggacccgcc

SEQ ID NO: 645843 - DNA, 1041 bp, Homo sapiens
attctaccttcacacacaaaaagttaaaaaaaaaaaaaaaaagactatggaactaaaaacagtcaacgggttgtacgtataagggtaaatccaggagtgcaggggtttactaatatatccgggtttggaaacctctggttcgaaaacaaaaggtttggagcaatcaaccaaaatgggttccttttcttttccggtagatgttctggacagattggcaggggcattcgggctcacggggctagtatgtaaaaagggtgtggtttacacgagggcaaagagaaaacattggctattcagacagtggccaaatagaataattatagccacaaattacgtgtacaggggtgcctgggcacaagcaaacctgtgagaaacggtgttaaaaaaaaaaaaaaaaagtggtgttacaaaattttaaacaaaaaacttttgtggcgaaatttagggccctgtgttggaccattactggggaatggtaaacaggggacttatatattggaacccaaaagggggctgtcaaatattgggggggtcttacagagaataagaggttcaaaacatcttgaagtgttaagggggccacaaattgtgggacaacagcgggggaaacatatggcgttaagtgtatttacagtggccaaatataatggcgttagaaggtgtgtccatcaattaaagagcttaaaagtcgtggtgttttaaccctcgaagggggacttatatttgaaacccatttatcgttgttttgtaagtgaaaaatcaggtgtggtggacaaaaaatttggggagagatttttaagtaacacacaatggggaccacacctggggggaaacaaaagaaaaaaacagaaacaagaagaaaagaagaaccaaaaagaagaaggacgcaaacaagaaaaaaaagagaacacaagaaagaaaagaagaaggcagagacaggcagaagcacacacggagcgacgaaagcgaaccagagaaggaggacgaagcgcagcacgcccagcacaccagaaacggcacagacaagagacagatcacgag

SEQ ID NO: 645844 - DNA, 380 bp, Homo sapiens
  misc_feature (247)..(247): n is a, c, g, or t
gtccggtggggcctttccaaagtgggccccgttttttgggggcctgggggcctgtttttttccatggttttggggggggaaccaaaggccccccataaccttaaggggggctgttagaaaaccgggttttcctttccccccgtttttcaaggggcccttccgtggttaaaaaccccggccgggggaggggtgtgggcccccccccttcctttggggtttggggtgggggaaagcaaaaagggccttnggggccccaagatttttgttccggccccggggtttttgggggccccccgctttcccgttatacccaggggggtggggtttccgggtttgttccttttgaaaaatgggaggtttgcctttgggccctggccgga

SEQ ID NO: 645845 - DNA, 368 bp, Homo sapiens
tgccacacagactatgatggcataacagacaggcgaaatggggtatgtgagtaaaagccctttataaatcaaaataccacataccggctgggtgctgtcgtcacgcctggaatcccggcactttgggaggctgaggcaggcagatcacttgagatcaggagttcgggaccggcctggcaaacatggtgaaatcctgtctctgctagaagtacaaagattatctgggtgtggtggcgggtgcgtgtggttccggctgctcgggaggctgaggcaggagaatcgcttgggccagcggggcggaggttgcagtgggctgagatctcaccactgcactccagcctgggcaatagagactccgtctcaaaaaa

SEQ ID NO: 645846 - DNA, 179 bp, Homo sapiens
taaccaaagcatgttagcacttggtctccagcatgctgtcaccattccaaccataagttggcaccaatgctactgtgtcgtggttgtagccgattttcttaatgttagtgctgacttccttcccaatttcctcatatctcttctggctgtatggtgagcccagctgatatcccacgtcg

SEQ ID NO: 645847 - DNA, 979 bp, Homo sapiens
gcctggacaacaagagcgaaactctgtctaaaaaaaaaaaacacacacacacacaacacaatgttttcacgcctgtaaacctagcacattgggaagccaaggtgggaggattgcttgaggccaggagttcaaggctgcagtgagctatgattgcacactgtactctagcctgggagacagagttgagacactgtctctaaaaaaaaaaaaaaaaaaaagtttttggaccctttaaaattactttgtgtttggaatttccataaacttcttcatttcaacaagagcaggtaaaaaaggggttgctgtgctcctttgtacaagcctactttaatttagactattacgtgaggattttttaaagacgcctgaaatcactgtgtgggaatacttgtgggtactaacagttaattttcatttgtgttctattgtctcccccagcttattaattttccttacccgtggaaaaaactgccctgggctcttgagaactcgtgccgcgtgaatagaaaaaattctcccttgtgctccttattttttaaacacaccaacactttttctagaacaacactaacgctgggttaacacaggctttcacgactttttaacaaccttccgggcaacaagctttttaaaacattccccccaagagggaaaattggtcccccttcattggaaattgtgtcgattggacaccatttcaactggccaacctactttcgtggtgggaaatttccccataatttaccctggcttcaccccagaagtcgaacattttgcattcggccaaaaaagcagccaaagaactcctccattcaacattttcgagaggaacccgctcgttatcatgtgtcactcggacaatcaaacgcacctctttttttatgggtgccacaaaacacagacaacacagccaaatgcaacaaaaggagaagtaacacaacacaacaagacaccacacaacgacagacaacaagaccgc

SEQ ID NO: 645848 - DNA, 226 bp, Homo sapiens
actcggcactttcttagaatagacaatttgcaaaatgtccatcccaggttcatccttgtagcctaatgtttccgtcaccgttgccactagttaacgtgggtgaactttatctgggaaacgggtaacatccgcgaccacaactagaccatcatttgacgtaatgccatcagcactcaccaaaacttggccaaccaacagcctttccgtaactgagtttgatttctcc

SEQ ID NO: 645849 - DNA, 80 bp, Homo sapiens
tctttctcttgagtcattttatttttatcatggactagtgcgtgctccgtgtccaccccaataaaagggtctttcctaaa

SEQ ID NO: 645850 - DNA, 332 bp, Homo sapiens
gacaggtgatcacgaggtcagagctcgagaccggcctggccatcatggtgaaaccccgtctctactaaaaatacaaaaattagctgggtgtggtggcacgtgcctgtagtcccagctactcggtaggctcagtcaagagaatcgcttgaaccagggaatcaggttgcagtgagctgagatcccaccactgcactccagcctggtgatagagcaagactccgtctaaaaaaaaaaaaccaggagtgagaaaaataagagtcattgaaccttacatttttttaaacaaacgaatatcactttgctgtcctttccaatatagcatttccccaatt

SEQ ID NO: 645851 - DNA, 410 bp, Homo sapiens
gattgactaagacctgtgttccgcgtcatcaagacgatgtatcacgttatgcggtcactgtatcaccattctcagattgcggaagagctgcagctgccccgctttggctcacaaagtttggtcacttaatggtccacagtgtaaatccgctattcatcatgggggctccataagttgcagcacaagttatagggttccagtgatggtattatccgtacccaatgatgtcttccactaggcattcaggtagacagcattgagcagctcaagaccaaaatctgaggtcatactgtctaatatccgcatgatcctgctgttagtgttcttgaacactctcatattgttgagatccaagttggcttcacaggtgttgcgtaagactgtagctcaccatctgtacagcatcagac

SEQ ID NO: 645852 - DNA, 311 bp, Homo sapiens
cagacttctgtcaccagaaaagatactgggttcactggtttgctaaagatttctcatccattaagcagaccacccacttcaacgttccttgtcccaagtatctaagtaagataatttctactctcaggtgacagagccaaaatgtctaataatattaaaagtccacctaccaggtgagctcttctacttcataaaggcacaaacaaccatttcatgagcatgagctcactcccaatgaattaattttggtctaaaaacaaatcccacacgggctccagagtcacctctccactccttctcagctcacctgc

SEQ ID NO: 645853 - DNA, 271 bp, Homo sapiens
caaatatatattctttaatgtattcagtcagtacacaatcctttataaaagtagtatatatatttttctgtcaataccttcattacatttataagtacaagatttacacagcaccccatcaaaaaaaaaaaaaaataaaaacccttaacaaatatctacttatactgcatacctataaaacttccaagggggtgctctgtaaagggggggccctagtaaagggcccattaacgggtgcagcaatatacatataaatgtaatgtaagagata

SEQ ID NO: 645854 - DNA, 291 bp, Homo sapiens
gtaaaacacaattgaaagaatgtggtcgccgctgacgacggttctcacattttgtttatagctccagttaaggttctgatccaacatctcgatgcatactagggttaactcctttgtcatgcgccccattctcttctcattcatatatgttttccgcgaatttagttactgacctctccgcaaactcagcccgagtctcagcctccttcagacttgtcggaaaggaccttgatctcttcctcatatctgtcttccttctgcgagtacttctcagcctgagcctccagtgac

SEQ ID NO: 645855 - DNA, 439 bp, Homo sapiens
  misc_feature (386)..(386): n is a, c, g, or t
ctgctccgcccctctctggtgggcaggggcgggggtcacaaggtgcttagtcggggagcttctgagccaggagaaggaaattcacagggttaatcactcagttaaggtggggcaggaagtaatcacaatggtggaatgtcatcagttaaggcggggcagggccttttcacttcttttgtgattcttcagttacttcaggccatctgagcgtatacgtgcaagtcacaggggatgtgatggcttggcttgggctcagaggcctgacagaaatcggcttttaatgaagctgacttttaaccatagagttctaaaaaaattctttccaatctctcactatcatattttagctggaacagttgatatttcaaaagtcacacaaatatcanaccagaaaggattcattctctgagccaggaattgaacccagattgccacagag

SEQ ID NO: 645856 - DNA, 120 bp, Homo sapiens
tgctcttccagccgctgaagtatccatactccctttcaaagtctctctccactgtttgggcacaatctgttatcttgggctgcccaatcttaaacggaatccagctcatggttgtatcga

SEQ ID NO: 645857 - DNA, 507 bp, Homo sapiens
  misc_feature (375)..(375): n is a, c, g, or t
ggggtctctcaggtaagccaggctgggtctcaaactcttgacctggaggtgatccaccggccttggcccccaaaaggctggggattacagggcgtgagccaccacacccagcctagctgccatttataaaggggcccagggtgcgccagacccagtgctcaccagctgggcatagtagtcctctgaacaggcctgcgaggtaggtatggatcatgccggtgttaaaggtgatgccacgataacagctaaggctgtagagcagttcggtggtaaccacggtgctaaatactgggctggtgtctccgtttcatcaaagccacacccaagaataggagggggttcttactatttccattttacagaggacaaaagtgnagcagggagataggtggcttacagtcacatagcaggagggcagagtgggcactataacccagtctctgacccttaacctctctaagcttttcacctgcgccttatcatgcagaaatagaggttcacaaagat

SEQ ID NO: 645858 - DNA, 139 bp, Homo sapiens
cgctctcaggctcagggaggaggcatttctccaagtctgagagtcatggcatgctgccccagccaggttgcaacctgctcaatgggacacaggaaatagggcccgtgggtatgactgagaactgcaactaggaaagatt

SEQ ID NO: 645859 - DNA, 199 bp, Homo sapiens
aggatcccctgctcttccgaccctatttcactcagaaatatattgtacattttctctccataattccatccacctgtctgaacaagtgaaaataattattgtgccacattttctactgtcttgacaaagattactcctgatttgcttccccaccccaaataagctaaagagagctaaaggggcccacgcaagatcagga

SEQ ID NO: 645860 - DNA, 442 bp, Homo sapiens
  misc_feature (85)..(85): n is a, c, g, or t
  misc_feature (155)..(155): n is a, c, g, or t
  misc_feature (184)..(184): n is a, c, g, or t
  misc_feature (187)..(187): n is a, c, g, or t
  misc_feature (442)..(442): n is a, c, g, or t
gcgtctgttctagtgtttgagccgtcgtgcttcaccggtctacctcgctagcatgtcgggccgcggaagactggcggcaaggccngccaaggccaagtcgcgctcgtcgcgcacaggcctccagttcccagtggccgtgtacaccggctgctgcngaagggccactacgccgagcgcgttggcnagnagccagtcgtacctggcggcagtgctggagtacctcaccgctgagatcctggagctggcgggcaatgcggccggaacaacaagaagacgcgaatcatcccccgccacctgcaagctggccaatccgcaacgacgaggagctcaacaagctgctgggcggcgttgacgatcgccagggaggcgtcctgcccaacatccaggccgtgctgctgcccaagaagaccagcgccaccgtggggccgaatgcccttcgggn

SEQ ID NO: 645861 - DNA, 1083 bp, Homo sapiens
  misc_feature (278)..(278): n is a, c, g, or t
agcgggaggatttgcctgcaggcaaggctagtggcctgtttgactgcgttgctgtcgtgagatccgagacgacggagaaggtccctcttatttaccgaccattgaaagctcctcgccccgtcctccgttagctaattaaggaacatttttcatgggacagtagccatcctagagacattgccatgtattgttccgagttgactctttccgatctatctactgagtcccttcgggagctgagttatggtcgacgagctgccgttgaattacttgtggtnccagtacagttggtggcggaaccgaggttgcagcacagcgcagccagtcgctggctaagatggcctcccgtcgctgccttggctagcgatctgcaccagggctggtgttgcactacccaacgattgccgtacagtttaccacttacagaagccctaggtgattctgcggatctcgagcccagaaattggctaggtgggaagcatgccaagcgtaccctggcgaacaattgtttgcgagatctggtgagtaatccgacacttgactgaggccaagttctgtctgtccaaccgcagacattaagctactggcgaaggccatattccgccattaatcagctctggatacacatgttggggtggcgcctcacaagagttcgggcaacatcgcgaacatgacgacctgaagcatacggattttgaccttcgttctcagctgaccaggatcgaggtaccgtgtactcttgcaggcgatacttgactggtagcaccgagtgtgaaccttggcagtccacgccttgcaattccctggatcgatccccccaacattagggaacgaaagactggcctcttccttgcggaactttgtgccgttatcccttaaacgggacgcgacaagaaaagctttgggaaaacgctccatgggttggaacccgttggggcgttatttccttaaggaacacattcaagaatttacactgcctcttggccggtaggtacaatgggccaccgacacttgttcctagccatgaaatggagcaacagttacttctgcaggaaccattccctgaggcaagcctaaacgatg

SEQ ID NO: 645862 - DNA, 138 bp, Homo sapiens
acggattgagtagatctgacatgcacagtctgctcaacttgactcccggttcaaactggcagttcaaaaactagtacagaaagttggattttttggcaattttggcctgtgcttcaggttccaaatcctttatttgat

SEQ ID NO: 645863 - DNA, 621 bp, Homo sapiens
tctcccccaccccccccgtgggggggccccgcgccccaactctccggcccccaaggttttttttagccctccccaaaaccaaggggcgggttttttttccccccaaagtggggcttcccggcaattttttttcaacaaaaaaaccgggttcttggttgacgggcttttttcccccctcgtctgaaaaattgttctcctgtttaaccccccccccccccttggcctccgggggtaccagagtgcgggccccataacagggtgtgggaaaaggtttttcattaatttgccccccccctttgggtggggggggccccgcacgccctttttccccccccctcttcctttgggggggggagattttcctcattaggggcaagcggccctttttttatgttgggctgggaaaagtttgttcaccccccttttttaaaattatttccaacaaaattttcccagggtttttgttttggttaggttgttttcaaacagggcctgttaacttttgtttggccccggttggggggggggaccaaagccaaccgaaaatcccctttggggggccccccggttagcgggttgccttttccccttaaaccgtttttctttgggaaaaattcagga

SEQ ID NO: 645864 - DNA, 649 bp, Homo sapiens
agcgactgtgtatagtgagacttgtgctacttaggagaagcaggttaccttattgaaaatgaggttgagttgcttccgtttctgatgcattgatttttgaagatattgttttcccccttcccctcttggtcagaatcaatctctttgcgtgaaagtaagaaccgcaggagtcgagttcaggttctggtcctgctacagattctatggtaattttaagtttgtccattcctcatcggagtcctacgacatctcgcctcctcctgctatggctggaggtatctgtgtcctttaaatatcgtggatgcaggacctggtcctcgacatgtgtggtagagccatggacctttgcgcttcccttactcgtccttgagggtttagaaccatgacaccaatcactatccagcgtacccggccctagcttacggtgcgggtgatgcggtcgaccctgcagaatagacttgcacttttcattcaggaaccaagatgacgcagctcagtactggtgagggtcactccctcccagaagccccggtctggacgagccattgcctgacctcttcggtgctgaccttcgccaaaagtgatgccttactggttttgtactaactgtgttcattttacataagtgtcgtgcctgcctggggttgtt

SEQ ID NO: 645865 - DNA, 308 bp, Homo sapiens
cctccacagctctccaatgccttcagacaaatgttttttggtatgccatcagcgttcttgttctctttaagaagattggtcctctgcaagctctctaagaaacagaagcccctttctattgtgtttgaatcattatatattttggggtctctttgttaccgcaagccaccctaccctaaataatacatattctatcagcattttaatatatttttaggagaaagtggcctgcaataactatgcttctaggatgttgcaccaaaggtcttacattgattaaaataaaacatatgaatgaagtaactcta

SEQ ID NO: 645866 - DNA, 670 bp, Homo sapiens
  misc_feature (267)..(267): n is a, c, g, or t
cgtaccaccaattgtcagcccgtgggaatttccccagggagcgcgcgtgacaaaaaacgcgggtccctcgggaaaaataggccaaagttgtgtggaagacccgggtatacaggggacgatatccagccggctcacaagggtcctaaacaaccgaggcgcttgcgaagctttaggcgccccccccttgggcgttcgctaaataagccgcctcctggggagctttctctcccccggcccaaccaccacatgtttcttggcgacccaccncctgcctgggccccttatagtttcacctgccgatgcccctctctgtccccagagggacatcccaacctgtgggtcatcccccgagactcccgctatcccgtgtgtgaggccagttgacaatcgtgtgttcttgtaggtgtagcttcgccgccctttttctcccgggcgcagttatgcgtgtatgctggcgccccgatacaattccccgcaagctgcgcctccttaataaaaagagtcttggaatcccgccaagattccttctattcgagtccccttacatcacactcttctcccaccaccggaaaagttgtcttttaaccccccaagtactgcgcggtgtagtaatcgaccccccaatagaacagacttccattcttccgccccccaacaaagaacaaacaaa

SEQ ID NO: 645867 - DNA, 344 bp, Homo sapiens
atcttcggaaaaatccaaaattaccagagaaccctcgtcctcagcccggcgcagctcaattcggccgtcgggcagttcaacaatttccagaaaggacgttggcataaaagtctgttctccacgaaaggccggcattatatcagtcatcagcgcggcctcgctcaggatctgaacagctttctttacggcttgatgaatggtgcctgacttaactcagcactcgttcagcccatcccgaaaacgaatggccaacttcttcaactcctgtcgccagctttccagctcttcacggcttaatggcgcaggcccctcttcttccaggctcacggccaggatcagctgcg

SEQ ID NO: 645868 - DNA, 107 bp, Homo sapiens
acatagaatgagagaaaatcagcatctcaggaggtggcattaggatgactgtgttaccccattaccttttagaagccaacatgtaggccccattaccatgctggact

SEQ ID NO: 645869 - DNA, 947 bp, Homo sapiens
ggagagtgtcggcacagcacgcctacgatgcgcatctgataactgtataatcgtgtgagcatattgtccagacgatcggctgtacggaagggcaccagtgcgacaggaccgaggtgtaaagatggagccgttcgccagggcgggagcgttcgtgccacggtcatgtacccgtcatactcgggtagcgttctatgcgcagacaacggaagactgtgctcgttccaggaaagatggaatactcctacctgcgtgtctgagttgccgtagggacagagatatctgctaatgtacgtatgtgcctgatcacgaccctcttcgagagtggtgacacgagcatagagtagcatgaacagtggacatcattccccaaaacctcaggaacgtagccgtgattattggtagacacaaggacattggcatgaccaaaagtctgactctcgagtacaataactttgggagaacgattagccaagtctaggtacataaagcattcaatgtgaggctcgttcagggctggtagctagacatctcgctatgattgggccagtataggtggttggcgttgtattctgcctacttggtggcagagaaaagtggtttgtgatcacaaagacaaagatgatgaactagttatgcttgggagtcgtctgcgtggagtgttccttcgccggtgcgtgctgagtcatggtgagcccatggcaggggtaccaaagtgatcctccactcttaaagaagatcagacccagagtacctaagaagagaggcggggccaaacaacgtagtggcaagaagcgctatccccaggtcacacaggctatcccatcacccggatctggagaacggcaccgccccgcacggcgaactcggaggcacgcggcccacgccgaaaccgcgcgcacacacacgccccaaaactcgccacgcaccccccaccacacctgggccac

SEQ ID NO: 645870 - DNA, 436 bp, Homo sapiens
  misc_feature (411)..(411): n is a, c, g, or t
ttggagaccagcctgggcaacacagcgagatcctgtctctataaaaataaattaaggtatttttaaaaatttaaacgatcccttcttagccaggcacggtggctcacatatgtaatttcagcactctgggaggccaaggcaggtggatcacgaggtcaggagttcaagaccagtatttggccaacatggggaaaccctgtctctactaaaaatacaaaaaaaagctagctgggtgtggtgtcaggtgcctgtaatcccagctactccggagatccagccaggagaattgcttgaacccaagaggtggaggttgcagtgagccgggattacgcccctgcactccagcctgggcgacagagtgagactctgtctccaaaacaaaacaaaaacaaaacaaaaaaccgaaaaaancccaacagtttcagagatgaaaaaa

SEQ ID NO: 645871 - DNA, 162 bp, Homo sapiens
acggatgcgctggtgacagctgatgaaggtagaagtaggtgccccaggagatctatgcagatattggggggttggagaattccattgcatggacattctggactctgtggagcttcctctcacccatcctgagatattatgaagagatgggtataaagcctc

SEQ ID NO: 645872 - DNA, 133 bp, Homo sapiens
tggtacctcacatcggctacggtcagatcggctaacgcgacccccccgggatacagcagttattaacctttagcaataaacgataagtttaactaagctatactaaccccaggggttggtcaatttctgggga

SEQ ID NO: 645873 - DNA, 226 bp, Homo sapiens
ggggtccgcatgctgtactcgtgaccattgtgtggcagttatctcctcactgtttccctcctgctctgccatgctaagacatgcttgctcccccttcgccttccaccatgattgtaagtttcctgaggcctcccagtcatccttcctgttaagcctgcggaactgtgggtcaattaaacctcttttcttcataaattacccagtctcaagtaattctttacagcag

SEQ ID NO: 645874 - DNA, 168 bp, Homo sapiens
ttccttgggacatattcccaagagcaaggtcaaagcataaagcatcttgtagtctcttgtcttttttagtttttgagacagagtctcattctgtagcccaggctggaagtgcaagggcacagatcttcagcttactgcaaacctccactatcctagggttcaaagcga

SEQ ID NO: 645875 - DNA, 185 bp, Homo sapiens
tcggcctggtagcctcacatgctcttcatggtgcatcccgagtaccggcccacgcgccctgccaaccagtttgtgcccaggctctccggtttcaagatccatccgatggcctaccagctgcagctccgagccgccaggctcttcccgatcccagtctcgatgcttcgctgattccctcccccacc

SEQ ID NO: 645876 - DNA, 909 bp, Homo sapiens
  misc_feature (418)..(418): n is a, c, g, or t
  misc_feature (822)..(822): n is a, c, g, or t
agcgggggaacgctgctcggtgagcggcagccatgacgtattgctgcttcctcgaccgggcggcggcgcggcggcggtccggctgctggcccagtctgctgccctgctgtgcggtgacggtgtgtgtggagctggcgctggcctcgcagagcgtgcttggtgtcgccggacgctcacaccgtagtggagaggcgctcgagccaggacggctggagtcgagaagtctaccttgcgtcccatcgagggtgcggaccgattcgtagtgatcctcacgcatgtgaccgggaagcggaacgatccctatgaacgaggaggcggagagacataaagcgccagaagacgcttgggattgtcgttcgagtctagggtttcatagtactctcgcttcccccccatgacatgcacggctgcatgtagnccactggagccaagtcgcctctgagcaaatggaaacgtcactatcgacccagaaattatgtacattcccaaatgccatgcatgtctagccacgtaccgagcctacgtaggctttccacccatgaggcgagagaaccattccatccaaaggattatggaacccgaaaagaaaatgattggatcaatcaaaactgggcttagacaaaggtggatcatgacgtataaaggtggcaaacagacgtaacgcgcccgttaacagatatccctcccagaggagaaaacctccacgagtcagtagaaagtggcaaaaacccaaacgaatcacagagtgggctctttgggtaagtgaggcacacacaatcgcggccttaaggaagaccctcaggagcgcctatgtcaaaaggnaaaaaattgcctttttttaagcgacaaacttaagcggggcttgccgtgaaaatgagggaggaccctttttccatttaatccctgcca

SEQ ID NO: 645877 - DNA, 424 bp, Homo sapiens
tagtatcagtcgtaccatcacgcccacaggacttaatagcatctgaattttttttattttatttttggtaaagtgggggttacagtatgtgggccaggcgggtcttgaattcctccgggcttcaagggatccacccaccagcggcctcccaaagtgcggggataacaggcgtgagccattgtgcctggcaaatttttggtatttttggtaaagacaaggttccaccatgttgcccaggctgggtctcaaattcctgaccttgagtgatccatttgcttgggcctggtaaatgtgctggggattacgggtgtaaaccactgcccccagctgtttctaaaattctggctgaaagaattatgtacgcaaatactacaatgtttacagccaaattgtttgtcccctactcagtccttgggggcgtgag

SEQ ID NO: 645878 - DNA, 156 bp, Homo sapiens
cccggccccttccgcttggcggaaaggagtttggccggggtttaaacccccccagaggccagaggcggcgcgccacaggaaacccggacccccacggccccggagccccgggcccccggattccccgcgcccccagccggggtttccccggggccg

SEQ ID NO: 645879 - DNA, 819 bp, Homo sapiens
  misc_feature (201)..(201): n is a, c, g, or t
  misc_feature (456)..(456): n is a, c, g, or t
  misc_feature (465)..(465): n is a, c, g, or t
  misc_feature (481)..(481): n is a, c, g, or t
  misc_feature (499)..(499): n is a, c, g, or t
  misc_feature (504)..(504): n is a, c, g, or t
  misc_feature (522)..(522): n is a, c, g, or t
  misc_feature (532)..(532): n is a, c, g, or t
  misc_feature (579)..(579): n is a, c, g, or t
  misc_feature (582)..(582): n is a, c, g, or t
  misc_feature (592)..(592): n is a, c, g, or t
  misc_feature (614)..(614): n is a, c, g, or t
  misc_feature (621)..(621): n is a, c, g, or t
  misc_feature (624)..(625): n is a, c, g, or t
  misc_feature (628)..(628): n is a, c, g, or t
  misc_feature (632)..(632): n is a, c, g, or t
  misc_feature (635)..(635): n is a, c, g, or t
  misc_feature (638)..(639): n is a, c, g, or t
  misc_feature (648)..(648): n is a, c, g, or t
  misc_feature (658)..(658): n is a, c, g, or t
  misc_feature (662)..(662): n is a, c, g, or t
  misc_feature (677)..(677): n is a, c, g, or t
  misc_feature (681)..(681): n is a, c, g, or t
  misc_feature (683)..(683): n is a, c, g, or t
  misc_feature (686)..(686): n is a, c, g, or t
  misc_feature (703)..(704): n is a, c, g, or t
  misc_feature (724)..(724): n is a, c, g, or t
  misc_feature (729)..(729): n is a, c, g, or t
  misc_feature (735)..(735): n is a, c, g, or t
  misc_feature (784)..(784): n is a, c, g, or t
gtgctgaatctcgtcagttcaccatccgccctcggcttccgcggggcgctgggccgccagcctcggcaccgtcctttcctttctccctcgcgttaggcaggtgacagcagggacatgtctcgggagatgcaggatgtaaacctcgctgaggtgaagcctttggtggaaaaaggggaaaccatcaccggcctcctgcaaaantttaatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggaaatcacccaccactttcccctctcccacctggacccccctcgccaacaggaccgcccactccttccccccaggaacatttacccctccatngatcaactngctaaaatacttcctngattccttcaacaatttnggctnaaaaacattattagcatnggaacaagancaagcacctacatcctaactccatttcctctaaacaaccctaaaatngtngaaggccttntccttatcaacctgaacccttntgcgggnggnnggntggnctnggnngcctccaanatctcaagangganccaaactctcccggncatngnggngtcccacctttttgggnnggaagaaatacacagtaacntggangtgggncacacctacccccagcacattttgaataacatgaaccccccgcaacctncaccttttcatcaatacctacaacaaccggcgcga

SEQ ID NO: 645880 - DNA, 324 bp, Homo sapiens
cgggagtgggtggatgtgttttgggcagtcacacaccgaggtagtcataatgataggcagaagactgggagggggtggatgtgttttgggctgtcacacaccgaggtagtcataatgataggcagaagactgggagggggtggatggaagtgagctttgaaagtatgattatttttgtattgttgaaacaaatccagaacatgaaataggttttgtttcatataattaggcagctgcactcagataatccttatgatggagatataaaagctgaaagaagggatgatgagggaaagaaaggtcgacgcggccgcgaatttagta

SEQ ID NO: 645881 - DNA, 172 bp, Homo sapiens
  misc_feature (129)..(129): n is a, c, g, or t
accacgatatgtactacgcctggcgagtacctaactaagtataaaaaatatggaatatttcaaatgaattatggtatatgctcaatttctctgttatatacgggagcctcatttcttttctcatctatntcttgggttactttccagttctaataattatagcttgccttct

SEQ ID NO: 645882 - DNA, 702 bp, Homo sapiens
ctttttccccccccgggaggtgtaagtttccttctttcctcacaaccaaatttgtggcgggcaaaaagaacaatctttcttttccctccatggtcatcgccatcaatagacctgtggtggtgcaccctcattcttgggggaacctcataaaataagttttgagaataataagcactggtttgcggctctttcgcaggtgttctccgttgcacattcataaaagatgaacttcagctatcttctctagaagatccatcatatgattgtgagaggcgggtctcccccaaaaatcccgcgcatgtattctttcgtttagaatctgaaaccctctttcttttcaggcttgatgactcttataaggtatttgttatgcctctcttctgggttgttcgttttgccttatcaagaagcacaaattctttctccatggcaacagaaactgcttctatttcgctggctgctgcttctttctctttccttagcatacatgtcacagctctgtttagtctctggctcttaatacgttgagcatcttcttcctcctgttgtgctaatctaaagaaggaatcaattcggagctgtgtcttttattcagtaaattcacttttaagaaaatattctttggccgcgcatggtggcacacacatgtactcccagctctgtgggaggccgaggcggaaaaataaagaggtcagctcgtgc

SEQ ID NO: 645883 - DNA, 109 bp, Homo sapiens
cagatatgtatgtggatactgcgcaaggatcccggatccgaccttctaagtagctggtgatagtgctggagctccaggtgacatgggccagcaggcgctgagtcaccag

SEQ ID NO: 645884 - DNA, 889 bp, Homo sapiens
tggccgatcaacttttattttttatttattttgagcacagagtttcgctcttgttgcccaggctggagtgcaatggtctcaaaaaaacaaacgaaaaagcaaaaaactgcacatatttaatatgtacaatttcatgaacttggatatatgcaaacaattatgaagtgataatcaaagtcaagataatggttatatccaaaactacacaagattttctgtgttcatttgtttttatttttccttttgttttttgatgatcttggctgtggtactggtagtaagaacatttaaagtgagatccacgctcttagtaagttttgaagtgcacaatatacaatactgcattaactgtaggcattttggtgtgcaacagatctctagaactttttcatcgagcattatcaaaacttgacaccctctgaagaactgccgttttccctaagccgcaggcagccattcatgtatatcggatcctgccatgtaaatccttttttagactagtgcagtgtatttgagcataatagtccgctggttaaataccattgtggtgaccaaagggcaggacttaatatttgaaagggtgattaatttatgctaggtattaatttaaatatatattcttagttggctatatatgcactgggcatctggtgtctatgcttcgcgctggaccccatctactgccacgaacatcatgtgcgcccaagatattgataactgggtgtacgtcattataaccgttatatactcactacagacttgcctcacattctacaaggtgaatatgggtagcggacctcttacatttctgacgccaattggggtaatacccaatcgtagttactgttctgggctaattgcggcaaatatcccgtggtctggcgtgttg

SEQ ID NO: 645885 - DNA, 1634 bp, Homo sapiens
gcttgtttctgttgttttttttgctttctgtggacgagagcagaaccagacggaacccttgttttcttttgctctgctgcatgttatgtttgtttctctgtatctcgtcttgtggcgtgcacggttttacctctgttgttccccccttcttttccgtgtgattcttcttctcccttgatttctgcttttgtctccacagttcctcatctttttcgcttttggtttccttccgtttttgcctctttgggggtgtttttgtctgcggtggcaccccccgccctgttgtcggcccccttacaattccccccggggatatagtccccccaaggccccgttttgtgtcccatagggcattttcttggggtattccttgtggcatcacctggggttatataattatgcctaagccctctgtgtcgcacgccccttgtaacatagtgccccacttgagtgtgatgggtgatagtacacaacacatcaggggtgtctttttggagttggttgtacttttggtttgatagggggtggtctcccggagacttatttgttccttttgggggccaaagagggcccacccttgttttgtgtgtgttgtgtcccccagagggtttttcctgtgcccaccagaagttcctccccaggagtctcctgttggtttatccgaattgtgaggctctaccccacccccaaagtgtggtggtgggacccccacgagaggtaccagtaacccacagtgttttgtgttgtctctcacgatgcacggagaccaacttgtttgtccccaaaaacgccctgttttttcccccacacacaaggacacacagtgtcttggagacccactggtgtggcccacactaagggagcttgtacacacacacgcagtgttccctcggtaatctctcacagaccccgcgcgtagttccttgtgttggttgctatcacacacatccgcggcgtgagaaacatgttggttataatagagtctttgggagactttctctccccggtcgccacacactctgggtgggtcacactctctacagcgccacacactctcccctcggtgtgtcccacgccacagctgtcgtcttggcacagagggcacgccgctcacacacgcggggagtgtccctcggtcctctcacctctcgcgagggtgtctctcttgagagctccacatagtccacacacaccctcgcacagagagtgtttgttccccctctcttcttcttgagttcccagcgccgcggcgctcaaacacacagagaggtgttctctggcttgtcttggtgttgaccacttgtcttcctctctctgggggcttctatacctctctcccaccacactgttccccaagagataggaaaaaggccacccctggattacatcttttgtgaaatcccactcccttgtgtgggccagccatctcctgaggcttctccccagaacccgagcctcttgtcgtcttggcccctctttgcaatcttggaacacccccggtgggtttttcttggcatagagagcccccctgcccttttcatagatctttatttgattaaattccctcttcaccttctgtgtatttaaaaaataattattttctggtgggaaataaaacaaaaaaaaaaataaac

SEQ ID NO: 645886 - DNA, 1353 bp, Homo sapiens
gattcatttaactaaagtaacaaatgtggtttttttttacacccacttaaccactctactgtgtgtgcgtgtgtactgtatgtgacgcacgatgggtcttaccagaactcattgttgacactaccctgaagacaagtcttgagacatacctacaatactaatgctgattgtctcttcctttttgaacacttttctgagttttattcccccaaacacctcagcttaaatactttaccccactatgactatatatgactgatcctgaccttgacaacagtatttaaacgaacaacaacttatttggacactcagctcaagaatattccaattgaatgggccactaacattctagacatttatacgtatgatatgtgtcacatgtaatatacaacagttgaggtcattcatacacgcgcacgcacagcaagacacagtacggctggctatcttctagccagatagcaacatcggattcacaaggcacaaaacagccatgcgtggtagccagtggccggcactctataccagccaacacaccttaccccagaggcggcttccaagggccacccaggggcgagcatcgtccatcatgagcaaacaacaaaatggtgacacacaatgaccacatttgcctgcctgacacctaaacaaacacataacattgaaaaacaccctacaactccacaaaccccccccagtataacagaccacccaactaaagcacagagtaggaacacaaacacggacgaaacacaacaggcggaaagccagcatgtacacaacgtaggaacgacaccaccagaaatacacttgcaccacacaacaagggatagaacatcaaggcaacaagaggaaacaactaacacgcgatcaacgtccaccctcacgagaagtggaggcatgctacacggaaaacaaagggaaaacgggagtacatgacgacaaccgcacctgctctacaccgccccctcacaaaagcacgaagcatccgactaaaacagcgcaacaactgccatggtgcacaacacaataaagaccgcacaaccatgaccctcgagaccggaaacatacgccctaacctccaaaccatgtacccacgtgcaaagacactacagccagcacacaaagcacaacacccacaattagtagcaacagggatgacacacaccatggaacaggcaaccccacaagtgccaggcagaagagacaaaacggaacacaaccagaacaaccactgcagcgcaaacggccgcagaagcagaccaagaaacagcgcaagaattacacaacaatggaactaaacacgaatcgcgcgtaacactagtgcccgagacccacagcaccgcgtgagag

SEQ ID NO: 645887 - DNA, 1279 bp, Homo sapiens
agcggaaggttgggggccatgtagcagttgagcccaagcggatactgctgtcgtgtaagagaaggaaagaaaaaactttgtactttatgtacgagagtcatcaagggtccaactttgagagctataagatttgtaacaatttacacttgctacaaatggtctttcggaacacttaagagtagttaagattgttgattgagagacattggaacgttagacatgttcgacgacaaaataaaacgtctgtggtcgagtagtccggaatacgtcggaaggatgactcatgggaatggagaccggttttctccaagattcatgctacttgactgtgagtgtggtgtgcctaatgccattgaatccgccgtatgggcacgaaaccaggacctgtgaactagcgtgacatatcttatggtgattcgattttttctggcgaatcgatcgacttgttatccggggcattgttgtggtacttacggggaggatggttccgagtggcagcttcatagaaagggacattcagacaatagtccgataagaactggggcagtaaccatccactaacgtggcaaagcttcgttcgaacaggacacgaccctcgttctagaagatgctcgggcggggaactccagagaatgtgatcggcccctgagcaataacctaggcgaactgatgattaaccgtcgcccccaggcgcgccatcgctaaacgaggacgcccccggttacaataacaccactgacctcaaatcgcaagacaaagaccctcactcacgtagacgaagatcttatatatgggagaaattgcagaacagaattatgaggaagggagaacagcgcgaacgtagaaatgggccacaacttacagaatacatcgctccgtgatgcacttggcagtcagaaagaatgaactagtatgttgcgcatagtattcggttggttggttgggagcgccaatttactctatatagtcgcaatgcgcagagagatattgtgacatcaggcggaataaactccttaacgcaaagagtaccggagaaatcagttacgcgtgaaacgcagggagaaccatggcccccgggacagacccaaatacaaccctgcgcccgcatgtggcggaataaattcaacccgcgaccgatggagaaacgcgctggtgagacggcgaaggggcacacccggggaaaaatggcaccggcgcgcccttacaaactgtcacgtcatagcagagtgacatctggcgcggagaccatcgggcgcgagaggtcgcggcactaacatga

SEQ ID NO: 645888 - DNA, 194 bp, Homo sapiens
tgcgaatatgtcccaccctgtttctgcatcaggtctcgccccaaaaacgaaattctgcatttggtctttcttattaatagctttcatcaggttggaagcgtgcagatcaccggaagcttcacctgcaatgatataatattttaagtgttttgtattttagattttgaaagtctgatcaatagataaatctaaag

SEQ ID NO: 645889 - DNA, 1047 bp, Homo sapiens
ggaataggccagcactgaggacgaggacaaggagtggccagtggtgtctgcgccctctgtcaagggagtgtcgtttgaccagggcctgtaatctgctgcagtagaggcctgactcgcaattgagcgtaacggcgcaagtagctgactccgtcatccatcctgcgtggactgtccgcgttgtcatacgtggcccatatcccaggtgcgaggtacgcatccgtctgccaggtagcatgggggccctctgcggcttgagatatgcgtcgtgacggactcacgacacagttcctggccctagcgccggtgtagggtagcttccgagtgcagtccctgtgtggtgtttcgtcctcactaagagatgcctctcgcgtcgaggggacctgttctctggtttccggaagccgcgatcgtagtcgcgcgctcttggtgcgaaccctggctagttccgtaggtccactttggacacctgggcgttggaactgggtgccgtggggttgcctagggcagctctagggaatccaggctccaaggttgaccccttggtcccggggtccccctgcccttagtgcactcttgtctgtctgcggctaggggtcgcctgtgctgcgtgcacccctgttggaaaccacccgtgggtgctctcaccggtgctacactttgtgtggcctattgtccataggcactggggctacgctttggtgggacagaagcgctgtgtgcgacactccgaggcgatgcctcggcaggggtggttggcccaacgttggacgcccgcaacagagctattgggcgaaatattcacccccgtcgaggcaggaagacccgccgaaccaaatgaagcacagaatgcgcggagattctttctccaattttttccgccaagagcgttagaggccccacaataagagagagaggccgatgtgcacccgagacagcgcacagaaccggtatcctggccattggtcaagtagtaaggggccttcttaggctgggcatggtgcacgcgatgtgtgtggaaacccaagccaatgactcccttggattcgg

SEQ ID NO: 645890 - DNA, 164 bp, Homo sapiens
cttgagtattattcagctagccatgatgaaacaaatgagtctgccgactatctgccagcttcatggctagctgaataatctcaaagctagctgaataatctcaaagctagctgaataatctcaaggctagctgaataatctcaaagctagctgaataatctcaa

SEQ ID NO: 645891 - DNA, 176 bp, Homo sapiens
tcatggaataagaaactataagatattgcaaataatcaatactatgacatttttatactgatttgtccatgcagatgatcatacatcatccaaaaacagcaggccatctttttatgcacacaagtcatgcgtgacaatatacttctctgctggataccttggataccgagctcgaa

SEQ ID NO: 645892 - DNA, 771 bp, Homo sapiens
gaggaggaactctaagtctgggtcttgacacttttagtgtcagttaagtctcaagtcgttcaactctctggtatccagtctgccaggtttgcgcatgatcgctccggagcggagcgggttgtgttgcgcaggtcgatacgtcgaggatcgtgctgagttaacctggaatcaccacggcagccactctccctctccccgacgcggggagttacaagaagattcttgccggggtgctgcagccatgcccatgacgtattgcctaaggcggatttgaagtctctttctctccctatcagaatcttattctatggctaaggatcttctaggataggcagaagtcacgtaaacaccagaagcacctgaagaccatcaaggtgagtctgagcagggctgtttttaaggaaccaactgggaacctggcttgagcgctcacatacccctaattcatacaacagatttgtcttacaggacgctacaacactggctcatgtcttgcgctgggtactagaaccttatcgacctcattacaccataaccaacggaccatgataatcacacccaacggaagcaccagcggcacgttaacgtcaacgacacgtgggggcagacttcaacagcgtttcagcacggctgcactaggtggggcaaatgacagaaaaccagcgaaaccaggcaagcggccgcaccagccacagtgggaccgtgaactcgggcagcatgcgtagatgccccactagaggcacatcagaatgggacaactccagtccctgg

SEQ ID NO: 645893 - DNA, 144 bp, Homo sapiens
accggcccatttggagcagtggaagaacggaactatgatttggcttccttatgcctccgaaatatttattaactgcagaggaaagcctgtattattataggagaaaggcgaacagaataaacgcacagcagataaatttcaggg

SEQ ID NO: 645894 - DNA, 210 bp, Homo sapiens
tgctgggattacaggcttgagccaccatgcccagcctcctgtcatacttttctctgtgttcccatttttctagcagacactttatttttatagtgagtaaaatctgctatttgaaacttggcagtgaggtatccagactgtcttataaaatcctgtttaagccattgatgtatttgaggatggcgaggtccatgctatcctttgtgccct

SEQ ID NO: 645895 - DNA, 150 bp, Homo sapiens
tagcgatgcgtcaccaatgcccagctatttttataatttttcgtactcgctgggctcttggcctcgtgccaggtggcgagggctgacggaagcggggatcttggcctcagtgccggggtatcctcttagacgtcgaccctgcagagcatg

SEQ ID NO: 645896 - DNA, 263 bp, Homo sapiens
cccgcgagtttagttgtgaccttcgcggtaggtgccggtttggggccggctgtgaattgttatcttggtgctgcagaggacagcagaaagaggagattgggtcagaaaactaccctgaccgaaccagagcacagcggactagtgggacaggggtccctgactcagagcttaactggctgtgtctgcgtggtttttgacttttgctgggaaaggggctgaggtgggcacttaaatcagggcatagatgagaaacttgaagcttt

SEQ ID NO: 645897 - DNA, 419 bp, Homo sapiens
gtaaatgaatccaatgtggaagaaaccctttttcctcccccttcaaagacagatcaaaggtggtccagcccatcctccagcaaaatcatgtcccaaagtcaagtatcgaaaggggttgatttttaaccaagggggggtgatgatgatgacccttttatgacccctagttttttaaaaaaaaaaagaagataattttttttagggccctgagaaccctgcaagatcccggaaaaatgaaaatgttcccagctaagggtttcccgtttaagattttaaggattgtttcctgggcaaaaccccataagtaaaaaatttttggttcccagacaaccaaaagcattgattccccctgtttttttaaccggggggtgggagtaaaagctttgtttcaatatcccttttgggtaaagttttaaata

SEQ ID NO: 645898 - DNA, 207 bp, Homo sapiens
  misc_feature (17)..(17): n is a, c, g, or t
actctagaggagcgtantatacacccacaaataacatttcagtaattcagtagcaaaagaataccacagcagagctcaatcttggctcttctcttgggatctagaccccttgttcaaacttccttgaggtactgtggtccctgggtgaggctttggtcctctctctctctgagataactactgaaactggtgtgccccaccaagggc

SEQ ID NO: 645899 - DNA, 449 bp, Homo sapiens
ccctctgcgggtatcgtcctcttctggtttaggaacaatctgtcctttccgtaagactcatctcaatgtggcaggaagagctcatgtatgggttaatccgaccatgagctcctggtaggtccggcggccgcttcttaggtgctttgtccacttggatatgctcaatggaccagagaatctacaatctaaaacccttaagttcagcattactctctgcgtttttaagcatgtccagcaaaaattcagcactctttttgggccaccgaccttgtgtcccagccccattgcttggcctgcgcacacctgccaactccaccattgtaaccgtcggaatggtacacactgtttctgtaaagtgacatctttcagatacttcgtggcttttcgtatatgcatacccttgatggcctgagcagtttcacgagtgttcttaaagtgaacacgaaggc

SEQ ID NO: 645900 - DNA, 953 bp, Homo sapiens
gtacccatgttgtcttttagcgctgcgtgtgtcttgtgccatgtccgctatactgggctgagtggtgaccggtctgggtgtcccctgccaggtttcctggctcgaggatttctcttgcgccgattggcacatcggggccaaaccggtggaagttcacctcctattttggggtctcccgccccccttggtgtgaattttggcgcccttctgcggttaaccgacagtgtccaagcgccctgtgtaaaaacgctctggtcttaaaaagaagccgtcttccggtttcaccgccaaaaatacggggccggcctttttctttaacgcggccaaaaggcaataaatggggcccactccttccaaacaaagaagtctgatgaagtgggaaatcctaatattgcccggagagagcgtctcccccgggacatacaggggaaaccgctctaccacgaaagttccgtgcgcagcaccactataggcacttgggagtgcgcgacaaaaacgtctcttgcctcaaaaaagcgggcgtgcggaccataaagccccccgacagtccacagggcgacatagataaccccccacacgagatgggcggtcccaccgggagaaaccagagtggttgaccgccgcgtaccccacttaagccgcgcgcattcaggagccaaaactgggcgaggtatctgcaaactatggggctttttatttcccccagtcccgggcgagtgctcccactaagtgccccagaaacaaggttgatgacccacgctatgtttataaaatggggagatacacaattcgtttacaggagaaggatcactcaacctgcatgttccccaagctctaacccggtcatccccagacgatacaactttcatagcgtggcccacgctcccccaaggtttaaagcagaaaaaagctctcccccattttaaaagggttggggatcccaaaaacaaaac

SEQ ID NO: 645901 - DNA, 113 bp, Homo sapiens
ttgtatacagctcgatcaatagcacaaactgaaaaattaaagtaataagccataaccatcatgaacaaggatgactctaaaaataaccaaaacaggccgggcacggtggcttc

SEQ ID NO: 645902 - DNA, 803 bp, Homo sapiens
  misc_feature (81)..(81): n is a, c, g, or t
  misc_feature (83)..(83): n is a, c, g, or t
  misc_feature (86)..(86): n is a, c, g, or t
  misc_feature (89)..(89): n is a, c, g, or t
  misc_feature (104)..(104): n is a, c, g, or t
  misc_feature (124)..(124): n is a, c, g, or t
  misc_feature (206)..(206): n is a, c, g, or t
  misc_feature (216)..(216): n is a, c, g, or t
  misc_feature (236)..(237): n is a, c, g, or t
  misc_feature (239)..(239): n is a, c, g, or t
  misc_feature (241)..(241): n is a, c, g, or t
  misc_feature (260)..(260): n is a, c, g, or t
  misc_feature (266)..(266): n is a, c, g, or t
  misc_feature (273)..(273): n is a, c, g, or t
  misc_feature (486)..(486): n is a, c, g, or t
  misc_feature (490)..(491): n is a, c, g, or t
  misc_feature (535)..(536): n is a, c, g, or t
  misc_feature (543)..(543): n is a, c, g, or t
  misc_feature (552)..(552): n is a, c, g, or t
  misc_feature (559)..(559): n is a, c, g, or t
  misc_feature (570)..(570): n is a, c, g, or t
  misc_feature (572)..(572): n is a, c, g, or t
  misc_feature (575)..(576): n is a, c, g, or t
  misc_feature (578)..(579): n is a, c, g, or t
  misc_feature (583)..(583): n is a, c, g, or t
  misc_feature (593)..(593): n is a, c, g, or t
  misc_feature (628)..(628): n is a, c, g, or t
  misc_feature (635)..(635): n is a, c, g, or t
  misc_feature (639)..(639): n is a, c, g, or t
  misc_feature (656)..(656): n is a, c, g, or t
  misc_feature (664)..(664): n is a, c, g, or t
  misc_feature (673)..(673): n is a, c, g, or t
  misc_feature (681)..(681): n is a, c, g, or t
  misc_feature (683)..(683): n is a, c, g, or t
  misc_feature (690)..(690): n is a, c, g, or t
  misc_feature (692)..(693): n is a, c, g, or t
  misc_feature (698)..(698): n is a, c, g, or t
  misc_feature (706)..(706): n is a, c, g, or t
  misc_feature (718)..(718): n is a, c, g, or t
  misc_feature (721)..(721): n is a, c, g, or t
  misc_feature (723)..(723): n is a, c, g, or t
  misc_feature (727)..(728): n is a, c, g, or t
  misc_feature (741)..(741): n is a, c, g, or t
  misc_feature (748)..(748): n is a, c, g, or t
  misc_feature (751)..(753): n is a, c, g, or t
  misc_feature (759)..(759): n is a, c, g, or t
  misc_feature (764)..(764): n is a, c, g, or t
cctaggcaacacatgactttctgcaaggcactgataatagctatgaggaataaatattgcagatggattaaatcaaaaaangnatnggngagccaaattaatcntgaaaaggagggagaagcanaaatgaagaaaaaagaaccacagaagtaaaatcagcagcattgaaaagaaaatcatctgctgtttgaataaagacccaaganctttcattgntggatccccaaagccagtgnngngngggagcagcaagtcccaanatcaanaaatcanaaggaactaatactttaactaattagtagtaatgaaaatttactagacatcaatgacaaatttacaaggcaaatttatttccaaagtacattcatatatatcacaggtaaaatgaggttttcacgaacaccgttttaaacatagggtttatttgcaggagctatttttgtggcttagggaacaaatggttcattgaaacagaactttgctggnctgnnttcaaaaattctattatataaaagattctgtagaacagatgggnncaaaagnccctgaacncaaacangaatatcaggnantgnnannggcntttgggatangattatggtttatgctttgaaagattagtatgcanggaactnaggnaagagcataaaagaggnagtgggantatactttntggttaananggtttananntttcnaaatactnacatcctactgnagntngggnncaagattatcctnggttatnggnnnaaaacntgctnccagaaaagagggttcaacgcacaaaaactcaagtgggt

SEQ ID NO: 645903 - DNA, 248 bp, Homo sapiens
gctgtcagagttcccgctttacgaggccacatcctcatggatctagttgggtttgttaacctctgagccatgaagggaactcctttcacctcacctctgaagcttcactagctacgcttccattctgatgacctgtgttctagataacggactgccctgtggattaattcccaataacttctgcctaataactaacccctgccacccatggcagtcatggaggagaaactgggattggccccctcgtt

SEQ ID NO: 645904 - DNA, 150 bp, Homo sapiens
ttactgcaccacgctgcatcgcggtcgatgtagaaatgcccgctgttgccggcaccactgtcgtacagcacacgctcgccggtactcgcggccatcgccagatccggcagctcggtgcagtggatcaccaccatctccagcgtggccggg

SEQ ID NO: 645905 - DNA, 258 bp, Homo sapiens
cagaggactgattgatgacagtaagctcaaaggacatgcgagatgaggtcctggaacatgaactgatggtggctgaccgaggccagaagcgagagattcgagagctggacacaggaactgtataagtggcaggtgctagtggaccgcatcataggtctgagctctccggagttcgacaaccagagactggcagtgctgcgtgcaccggatagatgcgggacctgatgcgctcgcgttagatcaccctgatccagagaa

SEQ ID NO: 645906 - DNA, 145 bp, Homo sapiens
gcttatgccgaagagtatggtatgtggcgaaatagaaggctgaataacctgacaagaaccacactgatgtgagagttttgattccatgctcaggaattttcaacttttcccagtgtgcaaactgtaaaccaatgacacagtcctg

SEQ ID NO: 645907 - DNA, 628 bp, Homo sapiens
  misc_feature (492)..(492): n is a, c, g, or t
  misc_feature (524)..(524): n is a, c, g, or t
ctgcaaaagatgaaatgtttttaatgtggcttgatatcaggatgatgctggcctcataaaatgagttgggaggattccctctttttctatcaactggaatagtttcagaaggaatggtaccagctcctccttgtacctctggtagaattcggccgtgaatccatctggtcctggacttttttggttgatttttttatatatataggatgctgtttgtaaatggactgaggggagaggtgcgaagtttaagaaatcttgttcaacaaatagatacataaattttggaagcactggattacagtaaagggtctctgaaataatcttccttcaagagcaaagaaagttgtctcgtctacttaattaaattctccagaataactcctggtgctttccaaatatatgtgtagtcccagctacttggaaggctgaggcaagaggatcacttgagacgttcaagggtgtagtgcaccatgatttgccctgtgtgaatangcatgagatccaggctgagcaaaaaagtgagnactcatctgtaaacaaaaagaaaaaatgctcctgtcgatttcaatgtcaatttatcggtagaaatcttaaaaattaatcctcctaaaaataatgctgttaaggg

SEQ ID NO: 645908 - DNA, 348 bp, Homo sapiens
  misc_feature (292)..(292): n is a, c, g, or t
  misc_feature (304)..(304): n is a, c, g, or t
  misc_feature (330)..(330): n is a, c, g, or t
tgagacaagtctcgctctgtcgcccaggctggagtgcagtggtgcaatctctgctcactgcaatctctgcctcccgggttcaagcaattctcctgcctcagcctcctgagtagctgagattacaggcacacaacaccacgcccagctaatttttgtatttttagtagagacagggtttcaccatgttggtcatgctggtctcaaactcctgaccccgtgatccacctgcctcggcctcccaaagtgctgggattacaggcatgagccactgcggccagccctgttccttctntctacccatctnacactcctctcaaatttggggggagnccagatagttaataggca

SEQ ID NO: 645909 - DNA, 169 bp, Homo sapiens
cttctgctgtcactctaagatccccgcgtcgcttctagtgtgcgcgtgcgcgctctggtacctgtacccctacgtttactcaccggattaccgactccgcgactatgttctatatgcaatatatatacgtatactaattgtgtactcgtaggagataaaatcactgtaa

SEQ ID NO: 645910 - DNA, 253 bp, Homo sapiens
tgttggccgatcacagtgagtgacagccaaaggcacccagtgtctaccccaaatgaggacttgtgggggttgacgggtggaccccagaggccagtgtttgctcctcttccagcatcaggcgagagcaagaacagtcagagcctcctgggcaacgtatttgactgtccacatcctggtcctgggtcagttactctaggattggcttgacttcactcttgcaggtgctgttgtcccaggatggggccaaacattg

SEQ ID NO: 645911 - DNA, 118 bp, Homo sapiens
accggcgtgctcgaagaaggtggtgtagaggtcgcggtcggtaagtagtatagtgatgacagcacgcaaggactggaagagaccggagccgcaggaccgcagagataaggcaaggcca

SEQ ID NO: 645912 - DNA, 150 bp, Homo sapiens
aagcagtatacagactcatctttctctgattttcatcatttgatcctgcttatggcatgcctatttaaattaattaattaattatagagacagggtttcagcatgtgggccaggctggtcttgaactcctaacctcaggtgatccacccg

SEQ ID NO: 645913 - DNA, 685 bp, Homo sapiens
ggcctcttcttactctcttctccaacctctctcactgtccctcaaccactttctcctttccactcttcaatctctcccttctcttaatttcaattcctttcattttctgggagagacaaaggagacacgttttatccatggacccaaaactccggcgccggtcacggactgggaaggcagccttcccttggtgtttaatcattgcagggacgcctctctgattatatacccacatttcaagggtgtcagaccacgcagggacacctgccttggtccttcactcttagcggcaagtcccgcttttctggggaaggggcaagtacctcaaccccttctctccttgtctctaccccttctctggtttcctggggcaggggcaagtaccccaaccccttctccttcacccttagccacaagttccgctttcctggggcaggggcaagtacccctcaaccccttctccttcaccttagcagccaagtcccgctttcctagggggcaagaacccccccaatcgcttatttccgcaccccaacctcttatctctgtgccccaatcccttatttccgcaccatgactcttatctctgtgccccaatcccttatttccgtgcccaaacccttctctgcttttctggagggcaaggaccccctaccccgttctccgtgtctctactcttgttggg

SEQ ID NO: 645914 - DNA, 274 bp, Homo sapiens
aaaggcagatttagttaacaattcatctcttaacttaccagatctcttaaaatctaacaaagtgtttttaccttattctaagaatcaacaaccaaaaaaggaacttggatacttgtcactcccccgttttcatccatttctctgaggggaaaacagccctgggccagtggggaagcaaaagagggtgcctgtttggagtccgattggagcgctgttggggacagcacaggggctcccctccccaggaggtctgcttagggtagggagggagtgc

SEQ ID NO: 645915 - DNA, 288 bp, Homo sapiens
  misc_feature (273)..(273): n is a, c, g, or t
agagcacggggcctaagggagacacgctgcatctatcgagacacaaacgggctggggatgggggcgggggcctggagggccagctgacatgttaactgtgatgcataggactcgctcttctgatgtcgagtgagagcagaaggtagagatctccgccccgcgggggcttatctgtactggtagttcatgctgtggtctgcgtttctgccatagccgccttgtgaggactggtaggagctgggagggccactgtagttctggccggaccccggngagttgtagttcgac

SEQ ID NO: 645916 - DNA, 1068 bp, Homo sapiens
ggacgcgtgggtcgagccacgcgtcgaggacgcgtgggtaatggaaatgctcccaagaagcggagagaagtcgatgacggttaacaagcaagaaagtggtataggctggatggagtacccatcagcatcggcaggtcgtctcacgctgcaggtgctggcctatgtcaccaagagacatgacttgagccatatccatggtgagaaacacgatcaaaaggcacgagacaaaatctagttcattgaagccagtagactatcacgctacaaccgaaacaggcacgaaaaaacacattaaatactaatagttggcgtagaataccatttgtgcagcgcgattaacatgtgaggatgcaagagatgaacatactagaggggacacgagcagtatccgtggtaggtagtaccatatggtgacttaaggaaggaaaaagagagaagagatacatattactagtgagcaaacgttaaacagtgaaaagtcaaacgggagtaatacgcaactgagtagaaaatgttcaaactggcaagacgaaaaacggtgtaacgtatgtggcagacaagatgcatacgacacagcacgactaggggacatattacaacacactggagcaaagtacgtacaccacgtgcacggaaagctagcctatcatggcacgcggagctcaaggacaagataagacgaagaaccaaaagatcgaggggataacgccagagcagcagaaccactcaacacggacaaaaaaatcaagtaaggaagagaaagcaacaaagacgtgcaactaaacgagggcgacaaccgaggacatgaaaacaaaaacatacgagacgcacaaacgcatggaacacaaatgaacgaaaacggagagcacacacaaatgcaacgacaacaaaagaagaaacacaacataacaagacaaaaacgaggacacagaaagacaaaagaagaagaaagaaaaaaaaacaactgaaaggaccaaacatatggacacaggacaacaaaccaagaaacgagacaaaaggaatccaacagtgaacaccagacgaacatgccaccccaacaaacaacgg

SEQ ID NO: 645917 - DNA, 289 bp, Homo sapiens
  misc_feature (165)..(165): n is a, c, g, or t
  misc_feature (196)..(197): n is a, c, g, or t
  misc_feature (241)..(241): n is a, c, g, or t
ttagaggatccccggaagcacacgcaacaggttcgtgtcacctgtgcagaagatgtgtagttgatcatctaggcataatggcctaagatgaactttgggaccaacttctaagtcacacagcgtcagtatcagatttattggcacaacagcttattcttttcactnctatgtctgaggaaaaagccctcccagaatnncgtaatgaatttctccagtggtaacccctcttctggtttacaanacagaaaagtttctcgtaggctggtgctggagatgcatttgtgttaac

SEQ ID NO: 645918 - DNA, 1294 bp, Homo sapiens
gcttgtttacggacggtgacgagcctaccgcgcacgagaacagtgcctctcggcaaaaggactctccttcatcgccgtctcctagaatgaggacgagagatggagaacagctagaaagagacgcactggatgcatgagccccaaatgtcctatcttcatggatgttgaaatagtgccctacgcgtagtgctataagaattcatgcgacggtctcgttgtagtcacgaatgccaacgaaagcgggtaagattgtagatgctgattggacatgcatcacactgattgcatcctgaccagtgccttaccagtgcaggagaatagcgataggacgttaccatgataggcactgttcccgttcgagagtgaggtacatgccagtcaactgattaaggcagctcatgtgagtttcactggaactgccagtgggggaaaaacccgatcgtcgagataaaacgagcaatatagggtccatgaacagcaggcaagcatagaatagcccaaagcaagcgacaaaacctttctcctaaactgccctcttgtgagcaccttgggcgatatataagcacatctgcgcacaagaccacacttgcttcggaacatgtggagtaagtcaccgcgagggcgttccccacagaaaagagacgtccatgggtgcgaaccagggcgaggggcgccatttaattgcgagaatcaaccatgggggaaggctatacactcccgccgaggggcacagggaaactaattctgccgttcggcaagtttaccctttgggttccatcgacgttggcatcctaaaatacaaatatggggcccaccccccgggagcacggcagaagcgatccaggtgacacgcagtgtactgcacagaactacaactatacgccttcttcacgtaagtgtgcggtggcagacatcccgtcgggaacagggtccctgggctaacatggggaagggacatgtttctataccaccgccaaaaggcaagaagggaaagcgcaccacttcaaacaatggttaggctgttccgtatgtagcaaagcaagtgaactatcccttattacagcgatacacctcgacctgtgggtgcgacgcgggtaggcgtaaagacttacagcactgtcccacgttttaagattctgataacccaactcgggatgaaacactagtgggctggaaagctttccaagtcggcagtgccgacgccatgtcacaggttatgacaagtaatttcacgaagcgtgtgtacggttgcctcttgggtatgcgttggacacaccaagtgggttggatcgac

SEQ ID NO: 645919 - DNA, 208 bp, Homo sapiens
  misc_feature (35)..(35): n is a, c, g, or t
attttgaggattgggggagccttgccttccaaacnaaaagtcctaatagtagaagaaccccccataaacctggagtggctatatggatgcccccccccctaccccccattggaaaaacccggatacataaaatttaggcaaaaaaggaaggaatcgaaccccccaaagctggtttcaagccaaccccatggcctccatgactttttca

SEQ ID NO: 645920 - DNA, 366 bp, Homo sapiens
  misc_feature (23)..(23): n is a, c, g, or t
  misc_feature (25)..(26): n is a, c, g, or t
caggggctttacagagacctttngnntgttggcaaatttattttccaatggatcactattgagaatattgtatcctatagaaattactatgagtctgccgggcgcggaggttcacgcctgtaatcccagcactttgggaggccaaggcgggcggatcacgaggtcaggagatcgacaccatcctggctaacacagagaaaccccatctctactaaaaatacaaaaatcagccgggtctcatggcaggcacctgtaatcccatctactgaggcaggagaattgcttgacccaggaggcagaggttgcagtgagccaagatcacgccattgcactccagcctgggggacagagcaagactctatctcc

SEQ ID NO: 645921 - DNA, 896 bp, Homo sapiens
cctctgtgccgatcagcggaagaccaaagaggatgagaagagactgacaagacccatccgagctctggatgagcggggatattgccttgttgaaaacttatgcgtcagagcacttactctaggcagatcaagcaagtcgaagatgacattcagcaacgttctcaagacaaattaatgagctcactggtattaaagaatctcgacactggccctggccccaccagcactctgggactttggctgcagatacagcagcacactccagagtgaacagcctttacaggttgccaagagtgtacaagaggataatcaatgctgccattcgtgaggacccaagaattacacttagtcaagctgtaaacagtcagctttgccacagcttttgctgtgtggcaccttacgtgattcaggtggtcatcctactgacattgacacgaagggatgacgagtgggcgtggatacgaaagtaaatatcaaattacatcgattccgattagcctcctaagattgaccgcaacaagttaccatgatgcgagagtggaagagaaaccgtgatgtcaacatacagcagatgttgagaggctgtaaggaacagacttgagaaatctgcgagtgaagtaggttgaaacctgcgattacttcatccagagaagggtaagtgaacctagcgcacttgagcctacgcaagggcgtgactgcttcataagagtccacaccggatacaagagccaaagatagaactcttggcaacgccaggagccagcattgcctaaacaccgggacctgaatgccgatgacctagccataacgaaggttatatggcaatgtgagacccattgtaccaaaaaaataacaatgcaagaatgaaaggaggctccaaatggcttccagcgaac

SEQ ID NO: 645922 - DNA, 292 bp, Homo sapiens
tttttttttattccgggggacccccttttgggggccgtaaaaggggggttttcccgttttttttaaaggggggggaggggggtttgggaaattttttccacggccggtaaaccccccgcccaccccaagccccttttaaaacccccccgggttttgtttggaggggccaaggtttttttttttcccccaccggaatttttttttttttttggttcccccggaaaaggtttccccaaaatttggtgggggggggttttttttttttaaattttaaaaaaaaatttggggggga

SEQ ID NO: 645923 - DNA, 920 bp, Homo sapiens
gacagccagccgggcccggtggcggagaggaagtgcggtccgcgccaagcccgtccccgcgacgccggtccccgcggctcgggtgacagcgtcgggccgcggacgcagcgcgggcaggcgcggcagagcgagcgcaggggaggctccgggaaggcggcgggggaaaaatggctgatgactgggctcctctcggtcgtcggaagagcggtgccccggagggcgccgggaggagggacccgggcggccggcttcctggccccagcaagggagagcgcgagatggggcggggcattaagaggacacgaaccgagcggcttccggggccacctgccgggggcacatggcgggccccggcgacccagcagggggccccaacagagtggcgggggggctcctgacgcgccctgggggcacacacgcccactggggagattggtgtccagggggccaaacgccccgtagcttagattgggcttaccgcgcgagccatggcccgtgggtgaacagggtgtgaccacaggaagctgggaggagcatccggccaatgtgggaagaaggagcccgcaggaaccgggctcaacaaatggattcgctggcatctaaaggggccccggacacaggcgatgggggggaaaaggccaaaaagggcccgtggaggaggtgaccccgcgcggtgtggaacacttcgacgacgacagatcaacacggcacgaagagcttcgggaagatccagcgggaccccagccagggggaaaggggcccgtttttgattacccaagagagcagcggcaagtggcgccggcggcatgccgaaaaagccgccgcggcgagggtgcccacggggcggcacggacgtgcgggacaacgtccaccacaccccggggggccaccccgggccccccaagcgctttgggcaaacc

SEQ ID NO: 645924 - DNA, 119 bp, Homo sapiens
tgacgatcttccccatacctcagatgttaaaactgaggcacattgttacgttgctataactgcagaggccagacctgggagcatgtgccctaaatatcaggcttgccctctaagactca

SEQ ID NO: 645925 - DNA, 754 bp, Homo sapiens
gggggcttatgccggtgatcccagcactttgggaggctgaggtgggagtgttgcttgaggccaggagctcgagaccagtctgggcaacatagtgagaccttgtctctacaattaaaaagaaataaatatttaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaaaaaaataaaaaaaaaaaaaaaaaaaaaaaaaaaaaaaaaaaaaatttgttttaccttttatacaaaattgatttaaccctgacaaaacttttttataggggggagaaatcaatttctttttccaaaaatgcccttttggggggacttgccaaaataggagggccctttttaaaaaaggggctccggaaaaaaccttggggataccaaatgttaatcctttgtgaaaaattcctttttacccggggggatatatgcaaaatgggccccacatgtttcgtttattaaaaaatgtcctttatccaaaaggactatacaatttaaacgctttaaatttttgaaaaattcgcgaaaaattttttttaaaggatccttttttataacaaagtggcgattagtgtaatatttttttaatataataataattcccccttttggttaggaggttttcccgttggaaaacgatgccccctttaaaagctgggcctcccaaggtgtaaggggtgacctt

SEQ ID NO: 645926 - DNA, 116 bp, Homo sapiens
gtgtactggacagatgttgctggacggacaatcagccgtgctggtctggaactgggagcagacctgagacgatcgtgaattcaggtctgataagccctgaaggacttgccatagac

SEQ ID NO: 645927 - DNA, 355 bp, Homo sapiens
attcaattttcatagcacagtttttttaatctgttatataatgttttatcatttcaacatgtaatcagtatacaacatgattagtgccgggcgcggtggctcacacctgtgatcccagcactttgggaggccgaggcgggcggatcacgaggtcaggagatcgagaccatcctggctaacacagtgaagccccgtctctactaaaaatacagaaaaattagccaggcttggtggtgggcgcctgtggtcccagctactcgggaggctgaggcaggaaaatcgcttgaacctgggaggcggaggtggcggtgagccgagatcgcgccatttcactccagcctgggaggaaaaaaaa

SEQ ID NO: 645928 - DNA, 329 bp, Homo sapiens
ggagagaatactaaacacaggaattaggaaccaagaagctaagccaggagctcagagtcaaggttggaagtccaggacaggtccgaccagtgctgatggtggacaagcccagaaatggaagattgtactttactatacctactggaatgtacttaaattatatactctatatacgatgttagcacacttatttaatgggatcctatgattacctggcacaacagcacaatgatgctagcaactttggctttgaactgctacaaaatgtactatcttgtagtaatatacagtacaaaacacactagaaatcaagtgctcctacaacgaaa

SEQ ID NO: 645929 - DNA, 683 bp, Homo sapiens
  misc_feature (31)..(31): n is a, c, g, or t
  misc_feature (68)..(68): n is a, c, g, or t
  misc_feature (97)..(97): n is a, c, g, or t
  misc_feature (107)..(107): n is a, c, g, or t
  misc_feature (124)..(125): n is a, c, g, or t
  misc_feature (155)..(155): n is a, c, g, or t
  misc_feature (157)..(157): n is a, c, g, or t
  misc_feature (169)..(170): n is a, c, g, or t
  misc_feature (180)..(180): n is a, c, g, or t
  misc_feature (183)..(183): n is a, c, g, or t
  misc_feature (190)..(190): n is a, c, g, or t
  misc_feature (201)..(201): n is a, c, g, or t
  misc_feature (238)..(238): n is a, c, g, or t
  misc_feature (273)..(274): n is a, c, g, or t
  misc_feature (278)..(278): n is a, c, g, or t
  misc_feature (295)..(296): n is a, c, g, or t
  misc_feature (304)..(304): n is a, c, g, or t
  misc_feature (315)..(315): n is a, c, g, or t
  misc_feature (334)..(334): n is a, c, g, or t
  misc_feature (338)..(339): n is a, c, g, or t
  misc_feature (369)..(369): n is a, c, g, or t
  misc_feature (383)..(384): n is a, c, g, or t
  misc_feature (386)..(386): n is a, c, g, or t
  misc_feature (459)..(460): n is a, c, g, or t
  misc_feature (466)..(466): n is a, c, g, or t
  misc_feature (506)..(506): n is a, c, g, or t
  misc_feature (511)..(511): n is a, c, g, or t
tccgccatttcgtggacgccgggtgagtganagagttggttggtgtgggccggaggaaagcgggaagnactcatcggagcgtgtggatttgagccgncgcatttttnaaccctagatctcgaanntgcatcgtgattcctgtccattggactgtnangtttatgtaggnnatcttggaancantggcaanaagacggaatnggaacgggcttttggctactatggaccactccgaagntgtgtgggttgctagaaacccacccggcttgcttnngtgngaatttgaagatccccnnagatgcangctgatgcagntccgagagctagatggaangaannactatgtggctgccgtgtaagagtggaacngtcgaatggtgaannangaagtagaaatcgtggtccactccctcttggggtcgtcgccctcgagatgattatcgtaggaggagtcctccnnctcgtngcagatctccaagaaggagaagcttctctcgcagccggancaggnccctttctagagataggagaagagagagatcgctgtctcgggagagaaatcacaaagccgttcccgatccttctctaggtctcgtagtcgatctaggtcagatgaaggaatagaagacagtttgcagagaagtggtgtcaggaaattacttcatttgacaggagtatttcgc

SEQ ID NO: 645930 - DNA, 330 bp, Homo sapiens
  misc_feature (53)..(54): n is a, c, g, or t
  misc_feature (103)..(103): n is a, c, g, or t
  misc_feature (175)..(175): n is a, c, g, or t
  misc_feature (230)..(230): n is a, c, g, or t
tagcgaactgataccttcaggcagcagcagcaagctgtatctcccaactgtcnntggttcagttcaatattggttgagtaaatagcatttccactatatcttngtggcccccgtggcaagcccagtataaggcagtgcttccagctttgtctaagccattaacacccactctgtngtccaaacactctctcaaccagctcaagttgcctctttttgctgcttcatgcaanggattgtcaatggattctgcctgctcagccacatagttgcttggaattagtccagtcctgcctttggaggtgcctctccaccaattgtatcgcatcagaa

SEQ ID NO: 645931 - DNA, 297 bp, Homo sapiens
  misc_feature (70)..(70): n is a, c, g, or t
  misc_feature (142)..(142): n is a, c, g, or t
  misc_feature (197)..(197): n is a, c, g, or t
ataactgacgctgatatataccatgttttatatgttaattaaaaacataacagattaaatatatatcttngtggcccccgtggcaagcccagtataaggcagtgcttccagctttgtctaagccattaacacccactctgtngtccaaacactctctcaaccagctcaagttgcctctttttgctgcttcatgcaanggattgtcaatggattctgcctgctcagccacatagttgcttggaattagtccagtcctgcctttggaggtgcctctccaccaattgtatcgcatcagaa

SEQ ID NO: 645932 - DNA, 773 bp, Homo sapiens
  misc_feature (362)..(362): n is a, c, g, or t
tccagttagtcctgatttcagggtcacccaaaaaacccctgccaaacagaagtcttaaaagctgcaaaaattcccgggcgctgagcattacttcgggatgtttcaacagagttcaggagtgcctcctcctcattctgtggtgcccaagcctttacatagcctcttccgaagagttttcgtgcatctcagccccgcctcattcaaatctccagggaaaggctcagctcacagtgtgccctcttgaggaaccgtgtgtgccatgtggcgacatactctcagggctaggaggagacagtgggtgaacggcaggagacccaagatctgtggtgcagaaccccaaatgtgtgcccccagaaaccccncgcggagaagaacggcggcgagaagacgccggggcagaccgggttaccgccggggggacaaacccgcccgaaaaaatttgcaagaccgcaaaaacaaagaagaaccaggacaaaagggggggaggaatctcagggggggggaaaaaaccccacctgggggacccccccccacaaagatttatgcacggccttttgttccattttttatgagaacctataacaattatcctagcggggctctgagaagcaggggaacaagtgtttctcctacaaagggctgggcccaaaaatgtcccgcaaagaaatcttttgaaaaaggggcgccttagaaacatagatcgcctgggaaaacaaggttgtgtaactgttaggtagactcaagggaatgcgccccaaaaatcccccttttcg

SEQ ID NO: 645933 - DNA, 193 bp, Homo sapiens
  misc_feature (90)..(90): n is a, c, g, or t
gtttaatggcagagctattttcttctcaaactgttcaaaatgatgaacgaagatgcagctcagaaaagcgacagtggagagaagttcaantggcagtagtcagacgaagaaaaagacccaagaaggtaaattgctggaattaggcatgtctgtatggtctgtatgtatgtacatagatgcgtctgtgtgtgtg

SEQ ID NO: 645934 - DNA, 168 bp, Homo sapiens
gattgcaaaaaaacaggattagaaacccccttaaaaaaaacccccatttaaagttttttttcctcctcaaggaaccactaggccccctttttaaaaacccctttaaagcctaattactccaataaaagtaactaaaggtttggagtctggttaaataaattttgagta

SEQ ID NO: 645935 - DNA, 250 bp, Homo sapiens
tacactcactagggcggaaaacctttagggcgttcttctgctcttataattgaatcctgagcttcatcttccgcttttgctgcctgatgcagctcctacttccttgatatgctgctaaggaggcacagtggctttcttccttagcctttaattggagagccatcatcctcaagctttcatcgtctctctccaaagcacaggtttactccatcagtagccatccaatgtcatagtccacacgacatgccag

SEQ ID NO: 645936 - DNA, 945 bp, Homo sapiens
gccgtttgttgccaagggtgatgcaggtactgaatgcctgatgccatgtgttgtgaagctgagctcaggcgattacaatgacgattcagctgtcgcatgcatcacgacacaccgacggctgtgaggtgggagcaacacccaggataagaatcaggaacctgcgtcccctgtatgacattcctatactatggttgagaaggccccgaggatatttctctcagtataaaagaagcttacttgggcgtaaagacacggctcaatagtggactggtggacctacaattagaccgagctcgagcccagcgccactaggaggacatgttgccttgcctcttttctcaagtaggcgtacctgctgccactgtcaacccattggcagtggatataaacatagctgaggctctttgtcggcaaaggtctgagactcatcatgatgtgctcaagatacctgggcaggattgattgagcctaagaggattctactctatcgaacttatcagcatgacactgcttttgcatgcaatgagagtccaagaggctcattagggaactggcggaaacgggagttgcactaggccagtaaggagaggatgccctattccgagctgtggtgtgcacgagtattactccctgggggggtacccaataaatagcagaaacggcaagtgtccatgtcctttgttctttcgagtgggagcaggtccgttacttgacctgctggggtcggaagtatcgatcgtctcagtaggtctcctcagtactacgacaaccccgtattttggcgaaaggggagattgagccctttgagtctacctttctgtggatcgggaacggccattatgcatgcccccaggagggagccccgaaaacctcccggggtttggtgcacgaagggagaaccccttcaaccgacggacgctacacttacccccaacgcaactggac

SEQ ID NO: 645937 - DNA, 101 bp, Homo sapiens
ggctataccgtgactggcagtacaaggtcagcggcgacgtgctggcggcttcgctgcagtacaagttctgatccaggcgattgcctgaagcagtgcgaagg

SEQ ID NO: 645938 - DNA, 750 bp, Homo sapiens
actcaaagaatactaataaatgtgtactcaggtatatgtacagaaatgctgtaacattataattttaaacaatttaaaacagactgagtttccaaagtcagggtccaggaaggaaaggggggctatatatatactgcgggaaatatcctaccaggcagtcgaagaaggatgatggatacacacacacacacacacacacacacacacacacaccacacccccacacgcgtgtgcgctctccctaaatcacagcaaatcgcaccgtgccccaccgccccacaccactcctcgtgccccaccacacgtgcagcgccgccccacccgcgcacgccgcgcctctcgcccactctccccgcaccctgagatcgcggagtgccaccggtctctctatcgtcgcttccacccattctcctccccctccctccgcccctcccaccctgctggcccaccgccctctccccgccccgggcctcccctcgctgcccgcctcccccccccctccctctccctccccccctcctccccccccccccccgccccctcccgcctcctccccccccgctccccccctcccccccacccgccccacccatctcaccaccatgcccttcttccccgccacccctctccgcctccgtccctccccccccgccacccgacccttcctcacctccccaccccctcatctccccctccgccacctacccctcctccccccccctcccctccgcccccctcgccctcccacct

SEQ ID NO: 645939 - DNA, 943 bp, Homo sapiens
gtgtctatagtcaatgtagtctgtccttcactacctaccatatgtactagccgccactagctgctgcatagcatgcatagctgccgactgctagctgcaacgaatcgtcagcagaccccacagacctatagcgacgtacgtcgcatacctccatcggacagacaatttaatgaagtaagcagtcagaagccatgtgctaacagtgccagcggattcacaaactcgagacaagggatgaaacaatgagaaatacgcaacccaacagtccttacaggtgataccacttagtccagggagcttcaacttgcagtgcttggtcgattgacccttcgcaagcctgacacccacaaatttcatagtgactctaacacgagtcatcacaggacgtatcgcattactccgctccgcctcacttgcacgacgcaacacactcactatccgacatactcacatggcctgcgcctgagcacgctacatgcctatagaccccccattgatgagccaaactgacagccattaagactctgcctcggcactgacaacgaagaaatcccaaacgactggcacccaaacaccgcacctggacggactcgctctcacaccacgacaaagcactggaaacatgccattaccatcgacacacacacaacacaacaggacaaccaccactaagaggacctccacacgaggatccataccaccaccaacatgacgatacaccttccaaggagcatgcgcaccacgttaacggtatacttaaaaggaacaacacgaaaacggggccaacacccaaggacaacagaacaaatggaatacaaagtgacaagaacaagaacaccacactcagctacttccgtaaacgccaactacgccacaggaccaatatacagcacccggaaacacacccagcacagtacacagtaaccaaacacaagcagatggg

SEQ ID NO: 645940 - DNA, 118 bp, Homo sapiens
accacaggcatgaaaatatgtattactcagaggtggcttaatacatgatatcgctttcttgtggttgtttttttactgaaataactcatgtttgtgtagaagagtgctgtggttaaga

SEQ ID NO: 645941 - DNA, 195 bp, Homo sapiens
  misc_feature (7)..(7): n is a, c, g, or t
  misc_feature (10)..(10): n is a, c, g, or t
  misc_feature (74)..(74): n is a, c, g, or t
  misc_feature (113)..(113): n is a, c, g, or t
agtgctnccncctgctcgggcgctgcggccggcgttcgccactgaccagtgagctggacatcttcgtggggaanacgacccttatcgacgaggacgtgtatcgcctctggtcngatggttactcggtgaccgacgcggtggccctgcggtgcgctcagggaatcctggagcagactggcgccacggcagcggtgc

SEQ ID NO: 645942 - DNA, 595 bp, Homo sapiens
  misc_feature (13)..(13): n is a, c, g, or t
  misc_feature (27)..(27): n is a, c, g, or t
  misc_feature (59)..(59): n is a, c, g, or t
  misc_feature (100)..(100): n is a, c, g, or t
attctgctcgatncggttacttcatgncagagaagctggcattcatcccagcagctgcnacgaatggattcctgggcgaagcatggagactccagtgtgnctgtgtggacagtgcctatgaagtcatcaagctcaaaggctacaccaactgggccatcggcctgagcgtggctgacctcatcgagtccatgctgaaaaacctctcccggattcaccccgtgtctaccatggtgaagggaatgtacggcattgagaatgaagtcttcctcagtctcccgtgcatcctcaatgctcgggggctgaccagcgtcatcaatcagaagctgaaggacgatgaggtcgctcagctcaggaagagtgcggacaccctgtgggacatccagaaagacctcaaagacctgtgactgccagtctctaggctgtagaacacaaacctccaatgtgaccatgaacctttagtcttcagccatgtatgtaggtcacagtttgcttcttccctgacatgtgatatgagctcacagatcaaagcccaggcttgtttgatgtttgcactaggagctcctgatcaaataaagttagcaattgcagcataaaa

SEQ ID NO: 645943 - DNA, 722 bp, Homo sapiens
  misc_feature (173)..(173): n is a, c, g, or t
  misc_feature (515)..(515): n is a, c, g, or t
  misc_feature (524)..(526): n is a, c, g, or t
  misc_feature (530)..(531): n is a, c, g, or t
  misc_feature (540)..(540): n is a, c, g, or t
  misc_feature (545)..(545): n is a, c, g, or t
  misc_feature (563)..(563): n is a, c, g, or t
  misc_feature (569)..(569): n is a, c, g, or t
  misc_feature (571)..(571): n is a, c, g, or t
  misc_feature (573)..(573): n is a, c, g, or t
  misc_feature (583)..(583): n is a, c, g, or t
  misc_feature (585)..(585): n is a, c, g, or t
  misc_feature (602)..(602): n is a, c, g, or t
  misc_feature (616)..(616): n is a, c, g, or t
  misc_feature (622)..(622): n is a, c, g, or t
  misc_feature (625)..(625): n is a, c, g, or t
  misc_feature (628)..(628): n is a, c, g, or t
  misc_feature (721)..(721): n is a, c, g, or t
tgagccgcagcctggactcggcgcggagttcctggagcggctggaagcgcggggcggccgggagggggcagtcctcgccggcgagttcagcgacatccaggcctgctcggccgcctggaaggctgacggcgtgtgctccaccgtggccggcagtcggccagagaacgtgaggnagaaccgctacaaagacgtgctgccttatgatcagacgcgagttatcctctccctgctccaggaagagggacacagcgactacattaatggcaacttcatccggggcatggatggaagcctggcctacattgccacgcaaggacccttgcctcacaccctgctagacttctggagactggtctgggagtttggggtcaaggtgatcctgatggcctgtcgagagatagagaatgggcggaaaaggtgtgagcggtactgggcccaggagcaggagccactgcagactgggcttttctgcatcactctgataaatgagaagtggctgaatgaggacttcttgntcaggaccnnnaagnnaaattacanaaggngtacccttctttttacangcaaangnanatgtcctggnanaaccgtggggtcccagnagtcctgacacatnctcgcnatngtngaggaagccgtcgcctcagggatttggccctgaaccctctgtgtcactgcagtgcgggttgtgggcgaacaggcgtcctgtgcaccgtggatna

SEQ ID NO: 645944 - DNA, 257 bp, Homo sapiens
ccctgtctctactgaaactacgaaaattagccgggcgtggtggcgggcgcctgtaatcccagctactcgggagtctgaggcaggagaattgcttgaacccgggaggcagaggttgctgtgagccgagatttgccactgtactccagcctgacgacagaacgagactccatctaaaaaaaaaagagtgtgcatgtgtgtgtgtaagagagagatatcctgtgcatttaaaataattctggaatctcctataaatgtaa

SEQ ID NO: 645945 - DNA, 442 bp, Homo sapiens
agcagttacgatgctgggcatcatcatttggtacaacgtgtcaaccaacgattcccagaacttggttttctttaataatcctccaacatgccacattgagtcaactactggaggtgatgagctggcagttttcatcagtacagttggtcgtggtcttaactcacgatcaactccgatatgcttggcagagagagcttacagatccaatctagactacagctgatgtgtcacctcgacctggagccatagttctgcaagcgaacatttacctgtgtaaatcatttaccattttggacatgtgcttgaagacaatattggactctaattacagaaacacattcttcccctattggattgatgggtatgtcatgggcttagttagcaaagagaaggaacggctgttgctaaaggataaaatgcctggcacctttttattaagatt

SEQ ID NO: 645946 - DNA, 142 bp, Homo sapiens
ttcagaatctgtcgaactattcaggctgcttttagaggcattaaagttagacaaaaattgaaaaatgtatctagagtgaaaagatggcagccacttgttaaccaaatctgcactctgcttgttacagcaagtttaactcagt

SEQ ID NO: 645947 - DNA, 306 bp, Homo sapiens
attttcagtagagatgtggtttcatcacattggtcaggatggtctcgaactcccgacctcaggtgatctacccgcctcgacctcccaaagtgctgggataacatgtgcgagccactgctcccggcctacatttttattaaaaacctgaatttgaagatacattccaatcttacataaagttcatgttgggtttttacattacctaattagaaaaaaccttttttaaccaattttctgtgccatgttatgttaaatactattaaatatcttgtgtgaccaaccgtcgacgcggccgcgaatttacta

SEQ ID NO: 645948 - DNA, 326 bp, Homo sapiens
aaatgccccctagcgggaatgtctgggcagtcacccccatcctgcgcgctttttgcaaagggctgctggcaggtgacagacgacacggttccgcaacagcagtcccgagccctgagattctgaatgtcagcaggtggctggagagtatcaccagagccactcaggaaccagccatgcggaatggctgggtttcttattgaacatgaaatgcttcctctttggcctggactgttttgctaaaattgttagtgggttttggggcaggccagtgtatgggaaacttttttgttgttgagggggggcgatggagtctccctctgttgccc

SEQ ID NO: 645949 - DNA, 495 bp, Homo sapiens
ggcggggcgcggtggtcacgcctgtaatcccagctctcagggaggctaagaggcgggaggatagcttgagcccaggagttcgagacctgcctgggaatatagcgagaccccgttctccagaaaaggaaaaaggacaaccacacaacaacaaaacaaaaaaaaaaaaaattgtgtggccggccgcgtgcggaccaagagaaagggtttcataaaaaccactttcgcgttgtggggcgcgccgcggcgcccaaaggtggggtgtactgggaaccccggggccaaacaggcgcggcgtccaagagagaaccccgggcgcacaaagcctggggggcggggttctcctccaaccaaataaaaaaaacccgccgggggggcaacccggggggcgctctgagacacaacctccaaggtgggggtgtcccaggggccaactagcggggctcatcccacagggggtcccacggagggcaaaataaaattagccagcggggggag

SEQ ID NO: 645950 - DNA, 134 bp, Homo sapiens
actctagctcggtacccatgggaagatatttcctttttcacgttacgcctgaaagcacgccaaatgttcacttatagacactacaaaaagagtgtttcaaacctgctctgtgaaagggaatgttcaacactgtg

SEQ ID NO: 645951 - DNA, 283 bp, Homo sapiens
aacaagttttttttattatcatgtttacatagcactgaggacacaaaacaacgctggaagctcagctgtctgattcatacgctgtattgctgactctcacttctcccttcccctctctactctacctctctgcaaaagaaggctttccttccagagctggcagctgcccctgcttcttgacaggatgagcaagacagcggtggtttaagcaaggtcttcgctgtgctccggagagatgtggatattctgggggaacatgcctatgttataacatttattgaat

SEQ ID NO: 645952 - DNA, 816 bp, Homo sapiens
gtccctgcccctagtcacctagctgtgagggtgcctgagtgctgaatggctccacccctacccccagccctgctatctgacctgtggctctggagcccctgcccctgcctgcataccccgagcaccccaccctccaggcctccacataaaggagaggagagggctgtctgcagcagcatgcacatcagccaccataacgccagggatggggccagccgcagaatgggctcagagaaagccccaggtgcacatcagacagagagccctgcctttcagttgccaaaagcctgcactcagaggcgaatgccggcaaggcacacaagggcatctgagcacgcccctgtgggacattggagacgcctgccccatgggacgtgggagaagccatggccatggactaggtgtttgaggcaccggacgcagacatctctccgtgtgctaatcctcccacctcacacaccaccactcacagacatcaaagccaagtccacgctggccagcagatcttcacactactccaacactcacattacttaatcttgggtgctatataacctttcctcgccctgaccgtctgcgtcctctagcccaataacaccggtcccttgagtgtttgccgaaccaacaccaacaccaacccagcaacaccgtcggaggcccaacacaatacatccggggacactgcgaccacaagctcaagtcatattgcactacgtgcatccatgcgccaccatacagcaggaattccatggtacgccccagactatctcttggtcccacaccgtgtgtgaccaacatcagcggcacccacccata

SEQ ID NO: 645953 - DNA, 309 bp, Homo sapiens
tgaacaccaatgctggtagcaacatttattaataatagcccaaatgaccatcaacaggtgaggagataaacaaaatgtggtatatacatgcaacggaatattagccttaaaaaggaaggaaatactggcgcatgccaccacttggatgaagatgaaaacattatgctaagtgaaacaagtcagttacaaagggcaaatattgtataattccacttacatgagtacttagcgtagtcaaattcacagacaccgaaagtagaacagcggtcccacgggctggtggaaggagaaactggggacctattgttt

SEQ ID NO: 645954 - DNA, 588 bp, Homo sapiens
tgggagtcaagatggaggagtacgcgcgagagccttgccccatggcgaatctgtggatgactgtggtggggcctttacgatgggtaccatgggtggctggtatcgttctcaagcaatcgaaaggttttcgcaatgtctccagtgggacgtaaagccacagagctacgagggagttcgacagctatgaaaaccagggctccacagttaggaggtagcttggcagtttggggagggctggtttcccagtgattgactgtaggtatgcgttcaagtcagaggaaagaggaagatccctggaactcctagtcacaaggtggtgccttaacggggagccatactggcagcaaggaaagtggaccatgtggccatggtggggtcagccgcaattgggtggcatggctcctagctttgattgaaggagctggtatctgtcgacaaaagtttgccgtctgtcgcagttgtcccaagtggtcctcaggttgcagaagagccctcccagtggccttcaactgcagtgtaccttcctcacctttggggactatcgaccaatatcagtaggacttcgtttcctaggatttctgttaacag

SEQ ID NO: 645955 - DNA, 319 bp, Homo sapiens
cggcggtgatctgagaggacccgtgcagatgacattctttaacaataaataatttatctcacatcttaagtcaagtctctcctaagttgggggagaagggggaagaaaatgtagtaggcttagtggggactagcaacagaacgtgaaatcctattcggtgacgtgcagtataaagagatgatggatcacgtggcagagttacaaggcaagcactagtttaaatctgaattagactagggccatggacctgatatacctgttaaggacactacggtgtatacgatggtagagacaatatacacataagggggtatcctaa

SEQ ID NO: 645956 - DNA, 1424 bp, Homo sapiens
  misc_feature (616)..(616): n is a, c, g, or t
  misc_feature (644)..(644): n is a, c, g, or t
  misc_feature (728)..(728): n is a, c, g, or t
  misc_feature (855)..(855): n is a, c, g, or t
  misc_feature (1044)..(1044): n is a, c, g, or t
  misc_feature (1089)..(1089): n is a, c, g, or t
gcgtgctctgtgtcctcctgcgctgtcgtctctgcggtgctagtccgacgccagtgtggtggctccaagttcgggtttcctttgttccccagggctcttctctcggtggtgcttttataggaatatttttgtatgtcccaggtgccccccgggggtttgcgaccccgcttggttcccccccattgtttggtcttctttccccgtggggaaaacctttctgaaccactttgggtgtattcccacccccgaatggtggccccggcttgtaccacccctcctttggagagggttttgttgtaattgcccaccccgctgttgccgcggtgtccccacacccacgggaaatttggttttggggaaggtgcccaagcgcaacatgttgcccgcttgtggagtttgagacttccccctgtccgcctgcccccgttgtggggtgttgggaccgcttcccctttatagggggggccccttggctgttttgagcagaggttacccccgccggcgcatcccatttgtttaggtttatgaactgttgagaaaccccgttttgccccccaaagccccccacgtcttttcccaagaatgtgttctcaaatagtgttttcgccccacgtgngttgttacaaaaatagtttttttcgccncgcagatacacacaataggcgcccgcatgtgacccacccacgattctccatatatagatatatacttgcgcctgcgcattggangaaaactatttttaataggatatctccttgtgaaagatgttttcctcatacaacactagtgtatatttctctttatataaagagatcgcgatccccccgcgggatattctctacctctatatatatntagagatatatagagataggaagccccgcgtgaagactctgtctcttttttcctcgccaaaataggtgaaatatgccacgccacaatatttatatacaccacgttactcgcccaccccacgatatttgttgttatatcaccatctcatatttgagaaatattacgccacgtgatagcctttaatatganaagatatttgtgtccaaggttatataaatatgacgccacgtttanagataattaacacccatatttatagccatagctgtggacatttagtctttataggatatttatatcccacaaattgcgtttagtgccacccatagccagtggtcttgtgatattttgataataatagtggtgtccataataataaccattaatgattataataccataataagaatgaggtggtattcaccattattcctaataatagggataatgctgtttattgtccagaaaaagtaaaatccgttcttctttccaattaatggcccctttattttgggacccggcttttattttccccgatattatttctatttaatactcttttctctcca

SEQ ID NO: 645957 - DNA, 768 bp, Homo sapiens
  misc_feature (93)..(93): n is a, c, g, or t
  misc_feature (162)..(162): n is a, c, g, or t
  misc_feature (209)..(209): n is a, c, g, or t
  misc_feature (258)..(258): n is a, c, g, or t
  misc_feature (283)..(283): n is a, c, g, or t
  misc_feature (311)..(311): n is a, c, g, or t
  misc_feature (363)..(363): n is a, c, g, or t
  misc_feature (381)..(381): n is a, c, g, or t
  misc_feature (383)..(383): n is a, c, g, or t
  misc_feature (412)..(412): n is a, c, g, or t
  misc_feature (444)..(445): n is a, c, g, or t
  misc_feature (468)..(468): n is a, c, g, or t
  misc_feature (476)..(476): n is a, c, g, or t
  misc_feature (512)..(512): n is a, c, g, or t
  misc_feature (514)..(514): n is a, c, g, or t
ggaggccccgccccctgagcctgggtagcggcgcgagggcgggagaaccgtcgcgaggaaaggcgaactagtgttgggatggccaccaactgngggagcctcttgcaggataaacagcagctagaggagctggcacggcaggccgtgaccgggcctggctgngggagtattgctgaggacctcacaggagcccacttcctcggaggtgntgagctatgcccattcacgctcttcccctcatgtccccagtgccctgtngagcaagctatgctgtgcagatggncttcaactgctagtggatgctgtcagcnagaagctgcttcctgagcaaactctttccagcaccatcaaacaggatgattnaccgtcgtctctttgacntnccacaagcaagtcctaaaagagggcatgnccagatgtgtcctgggctgaatcgtcagactnnatgtccagcgcagggaagatggntccccagnccttgaaacagatgaaatcaacaccatctctgcagntnggggggctggctccggaacccagtgtgacgaatgtttcagtgtctgggtagacaagaagtggaagatctcttaatatcagaggatggcctggaatgcaggctggagttaggtcaccatgtctgtgtctgttgtcaaaaaaaaaaaaaaaatttgggggggcggaagtttaacctgtggggggcaggaagaatgaaggtcacgacggcgaggggttcacaaagcgggcggtgaacggtgggttgtctagtaaagg

SEQ ID NO: 645958 - DNA, 833 bp, Homo sapiens
  misc_feature (15)..(15): n is a, c, g, or t
  misc_feature (61)..(61): n is a, c, g, or t
  misc_feature (63)..(63): n is a, c, g, or t
  misc_feature (65)..(65): n is a, c, g, or t
  misc_feature (68)..(68): n is a, c, g, or t
  misc_feature (83)..(83): n is a, c, g, or t
  misc_feature (110)..(110): n is a, c, g, or t
  misc_feature (116)..(116): n is a, c, g, or t
  misc_feature (119)..(119): n is a, c, g, or t
  misc_feature (153)..(153): n is a, c, g, or t
  misc_feature (163)..(163): n is a, c, g, or t
  misc_feature (180)..(180): n is a, c, g, or t
  misc_feature (183)..(183): n is a, c, g, or t
  misc_feature (190)..(190): n is a, c, g, or t
  misc_feature (194)..(194): n is a, c, g, or t
  misc_feature (239)..(239): n is a, c, g, or t
  misc_feature (243)..(243): n is a, c, g, or t
  misc_feature (320)..(320): n is a, c, g, or t
  misc_feature (328)..(328): n is a, c, g, or t
  misc_feature (332)..(332): n is a, c, g, or t
  misc_feature (378)..(378): n is a, c, g, or t
  misc_feature (394)..(394): n is a, c, g, or t
  misc_feature (396)..(396): n is a, c, g, or t
  misc_feature (423)..(423): n is a, c, g, or t
  misc_feature (447)..(447): n is a, c, g, or t
  misc_feature (449)..(449): n is a, c, g, or t
  misc_feature (511)..(511): n is a, c, g, or t
  misc_feature (519)..(519): n is a, c, g, or t
  misc_feature (540)..(540): n is a, c, g, or t
  misc_feature (661)..(661): n is a, c, g, or t
  misc_feature (681)..(681): n is a, c, g, or t
  misc_feature (709)..(709): n is a, c, g, or t
  misc_feature (806)..(806): n is a, c, g, or t
cccctcttgccttcntcctccacggtgggtgccagcaggctctcccctttccagtgacctncntntcnctcctcccagaaccncacttggctttaacctccagtgactgnacaganccnacccagggtctaaagctagggaaggcagctgaanctcacctttnttctcccttcttccacntcntcatctnattntcatttcttgtttaaataaaatacagaaaagcaagcgcagtggtntacntgggagaatggattcaccccggggctgggggcaggggtgggagtattgggggcggggcaggcagaggaacctcagcnaggtgtantggnatcacagcaggccaagccacaggggcccggctcaagctgtcctctntctctctctctccctntnggaggctggcctggcagtgagcctgcngtccagaggaggctggcggagaancntctatgcctgcctctcaggcaccatgttacagggtccccggggtgggggcagcagccagggnagaaaagnagaagctagcctctataaaantacctctttccctttgcttctagaggaagccctctttggttttaaggcagatgtggagtttcctggaagcagggtaaaggaagggaggagaaattaggattgagatagatgagatagatgntttttttttttttttgcttntgtttttccttcagtataaaaccactgnagaaaataacttctcttagaaaaaaaaatacagaagaaaaaaaccaaaggggttatttttctttggcttcaagccccctcccatgtacgtgcagggnaggggggtgggcatgaggtgaggagga

SEQ ID NO: 645959 - DNA, 625 bp, Homo sapiens
agtatatcaactgtctctgatggatgatagagcttggggtcggtgtgagagacatggtatcctgacgggatgatagaactgggtcgtatggagagccgtgggtccccgtgtgtgatgatagacgctggatagtgtgtgagagcgtggatcgccgagtgagatgatagagctgggtcgtgtggagagcctgggtccctgagaggatgatagagctgggtcgtgtggagagcgtggatccctgatgggatgatagaactgggtcgtgtggagagcctgggtcgctgagaggatactagggccaggtcatgtggagagcgtggatccccaaatgggatgatacgagctgggtcgtgtggagacgcctggatcccagaatgggatgatagagctgggtcatgtggagagcctgagtcccttagaggatgatagagctggggtcatgtggagagcctgggtccctgagagggatgatagagctgggtcgtaatgaagaggctgtatccccgatgggattgatagagctgggtcatgtaggagagcctgggatcctgagaggataaaagaactgagacgtgtggagagactggatccctacgggatactagaactggtcgtgtgagagctg

SEQ ID NO: 645960 - DNA, 233 bp, Homo sapiens
ctctagggaatggtataggggaagatgggaagtaagagtcacatatcagaggggcctccacttatactaccctgcagacgagggtatatgaagtataaaggggtgggagccccgaggtgagcgggaacggtgctgctttatttgaaatgtttacttacctcattctgtgccccagtagggggtccagcctcatctgtctggcttggccctgtgtacctcctgtcccctgctcc

SEQ ID NO: 645961 - DNA, 188 bp, Homo sapiens
tgatgttatccccaacacctgacaacaggatgaaagccctgtctactgcaattccttttacccagtgtatcatgtctacctatcaacagaaaattacaaagcatacttaaaaggcagaaaatgcagtttgaagagactgaacaagcattagaaccagagtcagtcgtggcaggagtgttgggcgataa

SEQ ID NO: 645962 - DNA, 300 bp, Homo sapiens
  misc_feature (148)..(148): n is a, c, g, or t
  misc_feature (178)..(178): n is a, c, g, or t
  misc_feature (265)..(265): n is a, c, g, or t
ctccggtcctagctggcctccgtgcttccaccagcgactggatcttacgggtcaacggaacagggtacctaccgggcatgggtcgtgtgctgcttcctggaaccgagcgtttgtgagcatccaggaaaagatggcagaagaccctctnacctacaaatcccggctgatggtggtggtnaagatggacagttccatccagccggggccttccgggctgtccttaagtacctgtacacgggggagctagatgaggacgagcgtgacntcatgcgacattgcctacattggtgaagtggtcga

SEQ ID NO: 645963 - DNA, 111 bp, Homo sapiens
tactgcttgcagcgtggagaatgcgtgggagattgtaatgggctatggagacagtgtcgtataaccttatgctacggtgagtggtaagaaccctctcttcatagggaggtg

SEQ ID NO: 645964 - DNA, 890 bp, Homo sapiens
  misc_feature (132)..(132): n is a, c, g, or t
cacaggcgggtgaccccccgctgctgcctaggacccctgggccactggctctacagccggtggaaccccctgccccccatatatccggccggaccccaaactgcgcccccacctaagagccgcctcaacctntgctggggaggggcgacaaagtgccccccttcaggggacaacacggggggtgcacttcaccaagcgcctggcccgctgggggggtcatcccaagaaaaccccgcgcccacgggtattcccccgccccaagacccgccccaagtgccgggccacaacgggttcgccacgccccacccccaagaaaaacacgggggcgcccccacccccacagaggtcctcaacctcctagacgcccccctcgaccacccacccggcgcgtcgggaaacccccctcaccggagccgcccgtgttggcgcccaccaacacgctcgtgggtgtgtccacacaggcacccccccgcgagcctgccgcgggcccctcgtagaccacccggggacaacccgctgtggagaggaggaacgcccacagaccgagactgcttaacccccaccgcgcgagtaccaccacgccgcgctagagcgccacgtcagtccgtgaacccccgcgcagcgggagacaccccacggaaagagggggtgtcccgccggttggagggggggcccagcaccccccgcgagaggtgtggccccgccacacccccggctcggcgaaaaaagtagtgtgtaaaagaacggtgggcgtggtgatcaccgagggccccccccccccccgcgtcccccccggggccccccccccccccaaaaagagggggggggggggccccggggccccccgaaacccgcggggggcccgggccccccccccgggggggttggta

SEQ ID NO: 645965 - DNA, 1016 bp, Homo sapiens
  misc_feature (657)..(658): n is a, c, g, or t
gatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggccattaacggggttgaaggattggttccccctttaagggaagcaaggaaccggtggttcttcaggttgccttgaagtcaaggccaaagaaaccagaatctcaggttggttacacttccttctcggtgtgaaggaccttacactgtgttccgttggcttctttcattccttcttctcaaaacacacttgtgcatgtagtcgtgcgtgtggaattttctcactctaagtttccccaaatcgaatgtctctacgagggtcactctcggggaatcacgagggaactccttagaattctccaattcgtgttgtgtgagttggccccacgtcaacgctcacccttacacgccttcgctattcgtttttcaattctttcttggccagttctagggcagctaacacgctcccagcatcattctagataactacgggcaggtggaagcaccnnctctttcttctctaagactcggatctatggctcacattgctccgcttgcccttgacattttttgtaaacttctgtgacccgtttgctgtagcttacactttcagattaacagtaggagaagcgaatgtgctgaggtggtttgcctccctttggctctaccttgagcctcatccccaacagcccagcgaggggagagagacacgacgaattcttttctatagaaacgaagtgggggcggggaatggggaggggatttagtcgcaatctagaggcctaaaccccactaaatgaccctcagtgtttccttccatgcattcttactggcgtgtcctctggcttggcaaacaggattggggaa

SEQ ID NO: 645966 - DNA, 350 bp, Homo sapiens
caggcatgagcacggcgtactttgtgtgtgtatgtgtgtgtgtatgtgtgtgtgatggagtttagctcttgccctgctggagtacaatggcaccatcttggctcactgcaacttcgcctcccaggttcaagcgattctcctgcctcagcctcccgagtagctgggattacaggcatgcgccaccacgcccagctaattttttctatttttattagagacgagtttcactatgttgttcaggctggtctcgaactcctgacctcaggtgatccatccgcctcggcttcgcaaagtgctggattacaggtgtgagcccgcgcgtccggctgtcactttaaagagtattataa

SEQ ID NO: 645967 - DNA, 168 bp, Homo sapiens
agagtcagtgttcagatagaggtgtatcctgtggcagtgcagtgggggtgggcagatgaggacatctctagcagggctgtgtcggtggagtagtggaggtaatggccttgttggattcggctgaagagagaccaggaggccagattctggagataatgagcaggaact

SEQ ID NO: 645968 - DNA, 494 bp, Homo sapiens
tggtgtctgtatggatacaaatgaactctctgcacctggacgggtatgggctcatggcacgagaacacagtgcatcatcagacaagagaatggcacatctgcatactggcgtttaaggatcacaatttatacaaaacctatggctgtagccaggtgcagtggttcatgcctgtcatcctacgtacttgggaggctgaggcacgagaatcgcttgaacccgggaggtggaagttgcagtgagcccagattgtgccattgcacaccagcctgggcaatagggaagatagacacggaggcctcactgtgttgcccaggctagtctcaaactcctggactcacgcgatcctcctaccttggcctcccaaagtgctgggattacaggcagaagccaacacgtctggcctgatgtgtctttcgggtactgaatggtagttaactgagtgtgttatctatgtaaatattccttgaggcaatatgctcatgattggtataca

SEQ ID NO: 645969 - DNA, 137 bp, Homo sapiens
  misc_feature (6)..(6): n is a, c, g, or t
cgcggntctgagccaaaaggacaaagctagaggcatcacactacctgacttcaagatatactgcaaagctgtagtggctgaattagcatggtactagcataaaaccaggcagtagaccaattgaaccggatagcttg

SEQ ID NO: 645970 - DNA, 115 bp, Homo sapiens
cacgaaatcccaggtcgggctgtcccggcatcttcaggccggccttgtcgaacaggtcggtgcggtacatcaccatcgagctctcgccgtagaacggcgcggcgtagagcttgcc

SEQ ID NO: 645971 - DNA, 363 bp, Homo sapiens
  misc_feature (335)..(335): n is a, c, g, or t
gtcagtctgataggaagagtttcaatcagcagatatggtttggtgttccgggctggtctgttgggaggaagagaactggctgaactaactgaattgagtggcctcgaagtggtctgggacatctagatgccttaatttgtcttggataggggacggggggggcttgaatgttgcaaaaaaaaagttacccaagggatgtcagtttttatccctctgctatggttggatttccaaaatcataatttgcagaaggaaggccagcatttatgatgcaatatgtaattatatatagggtggcacactagggcggggtccttcccccctacaagttttgngccctttcagagattagaaactgggtta

SEQ ID NO: 645972 - DNA, 343 bp, Homo sapiens
  misc_feature (1)..(1): n is a, c, g, or t
ncaggtcggctttctccatttccacgagcagacattcggtgaggtcccgggcacagttggggtcacagagattgatggtgctctttcaccctttcagacacatactcttttacttcagccacattttttatgacttttctgtggcttccaggcaagtagtgtagaaatctgggaaaattattgtaacgctaagccaggaatgtgctgagtaggtggaagttctcattaaaaaatactcagcttagaatttctcattgtagtcacaatgcttgcggaagaggatgtcgtatatgacgttacagggcgcacagcctatgagaaaggtggggtcgaaagtctggcc

SEQ ID NO: 645973 - DNA, 360 bp, Homo sapiens
cgatgtgctgtaggcgttgtggtgggttagagagatgtggtattgaggaacgttgggaaatttggaatgagtctttgaactggattcgtgatggggtcatggatgagcagcatacgtgaaggtgttacatgagacgaggcatggaatgtgtgtactgagggaaacggggtcaggggccggcactagctggagcaggagcaggaaggggactctaggttgaacgggggcaagacactgtgtgttttgtggtctttagtacacatctaatacttatagatctgttagtctaggattactctttatatagatttgccaccactttagtttgtagaattgactatgtggtggcatcgataagca

SEQ ID NO: 645974 - DNA, 304 bp, Homo sapiens
ggctcctgcccagctaatttttgtatttttagtagagatggggtttcaccatgttggctaggctggtctcgaactcctgaccttaggtgatccgctgcctcagcctcccaaagtgctggattacaggtgtgagccacagcgactcttctagttttttctaactgtattatttgtctatatataagttttgactgtcaaatctatccatcttttcctttgagattacttatgttgctttcatactctgaaagcccttcctcatccacagattagaaaaatattcacttcaagcttttgtcgacgc

SEQ ID NO: 645975 - DNA, 297 bp, Homo sapiens
cccccccagggttttcaaaaaataaaaaatttgggcccctttgaaagggggttttgggggggccttcctttaaaaagccctcttttaaaaaaaaggggaaggttttttgttaaaaccacccttttggtgggggttttgtaataaaacaattccaaaatgggggggggttggaaacccggaacccccaatgggggaaaaaaaaaaatggttcctgtttttaattggggtttgggggggggcagattcccattttttttttaaaaaaagggttttaaaaaaaaaactttttgggtccca

SEQ ID NO: 645976 - DNA, 123 bp, Homo sapiens
ggctcggtacccgcaatttacattgacgcgtcatgccttacgtgggaggcacagttccagggaaagctgccatgtggagaagttgtctagccttccgttccagaaaattcagcgacagcgagg

SEQ ID NO: 645977 - DNA, 340 bp, Homo sapiens
  misc_feature (124)..(124): n is a, c, g, or t
  misc_feature (126)..(126): n is a, c, g, or t
gtttttttttttggggccccttggaccaaacccccccttttttttttaaaggggttttccccccaagtggggggggggggggggtaaacaaaaggggaaccccctttccccagggggggggggnantttttttttttaagcccccggggttaaggggccccccccgggtttttttttttttttttacccccaagggggggggttttccaaaaattttttgggggggggcccccctttataagggggggcaaacttggggtcccggggggggatttttttttttttttcccccccccccccccgggggggggggtttttaaaaggttttttccctttccca

SEQ ID NO: 645978 - DNA, 602 bp, Homo sapiens
tcagctgtcgcctcggattacgggatgggactgctgctaagtggggttctgcctgttccacttggctgctgggtctgcaaggcccggcccagctcatcctcagcctgccgtccccgccgccgtgctcggtgagcctgcgctggtgcggtcggctgtgcgcctacgtgcggcggttactgcaatgcccagtgcggcctggcgtggactggagggagggagcccgccaggtgtctgcgcgctggcgtgtctggccggatgacccaacacctgctgacccccgagccctgatccctagccctgacccctggctccgaacccgagtcctgaaccctgaactctgaatccgcctcgagtttgccacctggcctctcctcatcccaccggtgctgcccgtgggcccctggcctgcgctgtttgctgcttgctgcctggtcgagcagggttttaccttttagtgggatctgtcgtgttgacttgccttctatggccaggttgcaggtatttggttttaccatcagccaaggcccagcctgcccaagacatctttctctgtgtatacccactcttgcttgagtatccatgcacttcacttactcacaggc

SEQ ID NO: 645979 - DNA, 693 bp, Homo sapiens
agcgggacgcgggtgggtgtaccctcacagccccgtcatccggagtcataaggcacccgcgcgttagccccagcgccaggcacgcgagcggcgcggagggaggaaagctccgccgcgggccggacaaaagcccgccgcccacggcttgcccgccgtcggaccgagacgcccgccgcggtcagtcgctgtccgctggcggatggggtggccgtcgcaggatgctcgccgtgcccgttcatgaattagcggctgttgtcggtgctgctgcccaaccgctattcccattcccgtgctgcgctgtccggtcctctcccggcggggtcgtatcggcgtgtacatggttgtccgtttccctagcctgctagttctccttgtttttccaagcagttgtttggctttccgaagctcactttctgtctttaagaggtttaaagaaactaccagaccattttccaatgaatgtcttggtaccaccagacccgtagttcctattgattcatcagatttgcattggatattcgtatgtctgggtttacacctaaacagttgatttcaagcctctagctagtatgtatactgtccatcacatgttacttttgtatgcaatatgcctttatcaactggaagttactgttttgtgatgaaggaacctgtacagataacgccaatattttgttttcctgggtgaaaaat

SEQ ID NO: 645980 - DNA, 113 bp, Homo sapiens
ctccccagccacatggaactgcaagtcccatcaaacctctctcttttgtagatctgcgcagatatcaagtatgtctttatcagcagcgttaaaacggactaatagcaacatag

SEQ ID NO: 645981 - DNA, 437 bp, Homo sapiens
tgctacgaacatgtcgggtgccttatatcatgcggcgtacctttggtggcaataaactctactgggctgtattctctgaatatgtaacaacctatggttacggaatggattatgctcctgttgaatttatacctcgaagggacaagaagccgctctgcacaagacatagactcctaaatatggtcttctgaatactgtgatggagccatatatataaaagagaagttaagatacctacctagtcccaattagtatcagtatgataagatcttggcagaaactctttatgtgtatgagctactaggggtacctaaaccacaagaattaacacctgggtgctgaagccagaagatctctctgaaacttggcagctcatgtgtactaggaatctgtgtactacatcttggagctggagctgctgactcataaaggtccaa

SEQ ID NO: 645982 - DNA, 649 bp, Homo sapiens
aaaaaacaaaaaaaaaaaaataaaaaaaaaaaaaaaaaaaaaaaaaaaaaaaaggaaaaaaaaaaaaaaaaaagaaaaaaaaaaaaaaaaaacccaaaaaaaaaaaaaaaaaaaaaaaaaaaacctggtggcccctttggcccaaccgatttttaacttgggccagtttttgccgggggcccgaattggggcttattgggccaattcccccttatggggggccgtttaaaattaaggggccggggtttaaaaacggtgggactgggaaaacccgggggttccccaatttaatgcctttgggaaaaatccccttttcgcccggtgggggaaatccaaaagggccccaaccggtgggcttttccaaaagggggccaccccgaagggccaagggaatttggacggggtaaaatttgggaaaaaatcgggttaaaatttgggtaaaacggcttattttttacccaagggcccaaatgggaaaatcccttttattaaaggaaatccccggaaatgggttgggggttttccccttttgggaacaagggccccttttaaaagacggggcctccaagttaagggggaaaaacctttttttggggcatggggcccttggggcctttcccctcaggttttgggcccggggccccggcct

SEQ ID NO: 645983 - DNA, 183 bp, Homo sapiens
ggtgtaatgtggccaaaaaataaaatggtttgtgtgtgtattgggaggaaaggtgtgcaaagctgtggttgagtggtgaattgtgaatggacagatgatgtcagtactgtgaacgccgaatgtgggaggccatttcataacatttcttgtatatcaaaccacctgtggacacgcttcttttgc

SEQ ID NO: 645984 - DNA, 724 bp, Homo sapiens
ggctttgaggaactggagcctgaggagctgcgtgctggagcacgagccgtatcccgagcccgaagatgagccgcccactggtgcgtgcgctccctcggtagactccgttcccctgagggcactgaggtttcagggagctcctcgagcacgtccacagagagagcgacgagtagtgcacgtctcgcgagcagctgtatcagtcgcgtggtgaagcctgacgttgactgtgggccctgatctgagcgggagcccgcgtatgccttgggacacgctgtaatcgaaacgtctacgactgtcagtgattcatggtacggggctagcgactgaggacacctcccctggtagctagaagtagagcgatcgttatacgtaagctgactgacctatgagctcactcactcctgagaccaggtagcatgagaccctagcgatgggacctactttgttttggtttcacccccacttttacttggttaaaattttgcgaacttcggacttcgggcaagtaacgggcacaaggttcccattgaaacgttcggtcccgggctttcgaacactcgttatttggctttgtcgaccgttttcgttgcgaccataaattgactagcgagacagccaagacattattcggtgcggtaccgttactacctggaccctggttactagctgggagcaacgacaatagcacagttgctccaccttggtagcattttctgtggacatg

SEQ ID NO: 645985 - DNA, 1378 bp, Homo sapiens
ggagggtgcgtgcgggccgtggcagccgatctaaggagcaggggcgccgccgctagggacccgcacactccacctcccggggccgcagcatcggccatctcgttctactgccaccagtgaccgccaagcggatatatgcctgatggctggtgcagatccagcttcggacctcatcaacatgactgcaaactagtacctgacggccgatgcgttcgtggttcacaggttgaatcgcgtccagtcagcagtccttgacataagtaagcagaatcatggtatcgcttgagagacatgtccgcccctgactgatggcgaggcaagctcggccagattgtgaccatgcgcagaccacgctggggcccgtctatccctaggctggtcggcaccgaggtatcgcgtcaaaccagttgtagccttgccgaagcggccagaaggttgcccacgtgctctcgctgagcgtggcactgatttacgcattcaatcagtcgcgacgacacagaacgtagcaggtcggccttgggtcacgctgcgcagtccgtccggtgcgtgcacctgtggcggctacttctcgggcgtgccgaccggaggaagcgcgacctgttccctgcattcgctccgcagcatcgggttgctctcccgcggccggatgaaagttgggacggcgtggcacgaattctgtccaagtgccgaccactccaggtgtctaagcatactaattaggcagtcacctccgataagctgctaacagggtcgatctggaagcggcagcgtgcacagtgcccgaacggatgattcgatcgtgggacccagcagcaacggtgcccctggggggcgttctgactcgccgtcatcaaccccattcggcacctattcccagtgaaacccaggcgtcttaacaggcagttgtcaatgatacagttcggagccaaccggagttctcccattgtcgggcctcacgcaacgggagcgcgccttgtggttggtgtcgacccacagaaggcccgccccacctatgggatacacgactggagattcaacagcacccgaagaaaggagggaggcttctcgcggacattcgcagagcgcgcgccgcaaacactgtgaacccagactggggtgccccaacggggaaccgaccaaaaggggggggacgggccccacaagtggggcgacggaagaagagcaccaacttatgactgtagaggacaacaaaatgtcacccagagagagaagagataaacgacggaccaacaacagaagaaagcgctgtaccacagaggcaagttgatactgacttcgcacacacaagcagcagaagccgcacaaagcaacagacaagatcggacagaccaaagaagagtagtaaaacacaacgaga

SEQ ID NO: 645986 - DNA, 343 bp, Homo sapiens
  misc_feature (51)..(51): n is a, c, g, or t
  misc_feature (159)..(160): n is a, c, g, or t
ccctttttagaggaaaagcaagaagaaacattgccctgaaaggtgattttnctagtcatttcccaattagtacagaaatgttactgcctctgggtgcagtggttcacgcctgtaatcccagcactgtgggcggatcacttgagccccaggagtttgagnnccaatcctgggcaagatggcgagaccccatctctacaaaaaaatttaaaaattacctgggcatggtggcacacacctttattctcagctactcaggtggctgaggtgggaggatcccttgagcccaggtggtcaaggctgtggtgagctatgatcatgccactgcactccagcctgggtagca

SEQ ID NO: 645987 - DNA, 238 bp, Homo sapiens
ctgctctgatcagagtctacaacattgaatatcacttgacacaatggtgccaagcgtatctcacatcctgctattgattccctctgagtagctagttctcggtttgcagtaacattcaacaaaaatgtagagtagtctccagagcacgggaaacttggttccattgttctatcgtcctatgcttcgagccattggtcttcagtgtcatccttatcagactcttacatattcttagggt

SEQ ID NO: 645988 - DNA, 350 bp, Homo sapiens
gcggctgcctttcctttaactacattctcactctttctcagactccacctcagagaggaaggcacacagtgagcgaatcacttaatcaacaaaaccactctggtattataaattgagaaactgaattacaaataacagcatgtacaacaatttcagatacctgtccagatgtagagtatccacctagaaaaatgttctgttttctatttatccatcttatcctccagttctttaactgaattattacttgttaaatcacgcttcaggtaattcgtaaaacagacttcagggaaaaaagtacaatgtgtatattctttccattctctgttcccacagaaagctgcgataat

SEQ ID NO: 645989 - DNA, 725 bp, Homo sapiens
cggacgcgtgggtcgacccacgcgtcgctaagaattaggtactacagccatggagctggctgggtaaaatctaattggatatttcagtttcattcacctaccctgtttaggtgtttggtttggtttggtgagttttttttcactatttttgggacaagcaaggatcacacttgccgccctccctggttccttaatcccttttgctaaaagggggggaaaatccggatggataatcagggatgggctcgtggctgctcagcgtgtgtattatggcagcacctaaatccgtgattataggctttcatttctccgcaaagcctttatttgggcagttacgccaaagtgtgtttccccagaaaagtatagtaatattagctcctctttacttccctattctttcctcccctttttcccgtctggaccccaaacgtgtaattggcgccacacacatggacgtgggaccaagaaagcttttggtgttctggaccctggtaatatagacagtctggctaaatattcggacacgaagggtagcaagtagttgggggtaaataacgtcgagattatccggactaatacaaatcaatattaaagccggaaacaaaaatggaccttgttcccgggtgggtccgtggacgtcttcacgaaaaagggtgcccactagctgagggtgcaccaattcccacgagggcttcaaggtacccaccgtgtattccacaacctgg

SEQ ID NO: 645990 - DNA, 551 bp, Homo sapiens
  misc_feature (23)..(23): n is a, c, g, or t
  misc_feature (35)..(35): n is a, c, g, or t
  misc_feature (182)..(182): n is a, c, g, or t
  misc_feature (205)..(205): n is a, c, g, or t
aaagagagatgtgaccatgtcanagatgctggaanagcatttgataaaattcagttgccattgcaaataaaatagggataggagaaaactttttaaacatcataaaaagtatttgaaactaacagtgaacattatattaaacagtgaaacacaggttacattctcattaaagtcaagagcangacaggcttatttgttatgtgtntaccagatcctgtcagcataatgtcatcagtgtaatggacaggcattgtgcttgtgggatgtaaagatgtttgaggtcccttgagtctatattatgatagaaaacaagagagctaacattgccctgatgcatgggcagtaaacttaatactcttgttcctacttggtaaattcaaatgtattctgattttactaatgtatggaaatgaagaaaaaacattctctaggtcaatacttccatatcaggtgcctggggctgtgtaaatttgcttcaacagagatatgatatctggaattgcaattgttttttggcatcaccacctgattaaatttgtgatctgctgtca

SEQ ID NO: 645991 - DNA, 649 bp, Homo sapiens
  misc_feature (401)..(401): n is a, c, g, or t
  misc_feature (605)..(605): n is a, c, g, or t
ctcagtggctcacgcctgtaatcccagtactttgggaggccgaggcaggtggatcacctgaggtcaggagtttgagaccagactggccaacatggcaaaacccctctactaaaaatataaaacttaggctgggcacagtggcttacgcctgtaatcccagcattctggtaggctgaggtgggcagatcacctgaggtcaggagttcgagaccagcctggccaacatggcaaaacccctctactaaaaatacaaaaattaggccaggcatggtggcttatgcctgtaatcctagcaccttgggaggccgaggcagatcacctgaggtcaggagttcaagaccagcctgctcaacatgatggtgggtgcctgtaatcccagctactcaggaggctgaggtggnagaatcgcttgagcctgggaggcagaggttgcagtgagccaagatcacgccactgcactccagcctgggcgacagagtgagactccatcccagaaaaaacaaaaatagccggtatggtggcaggtgcctgcaatccactactcggaaggtgggccagcagactgcttgacctggaagcgaaggtgagggagccggatcatgcantgactcaggcgacgtgacagagcagactcatctcaaaaatcacc

SEQ ID NO: 645992 - DNA, 1267 bp, Homo sapiens
  misc_feature (519)..(519): n is a, c, g, or t
  misc_feature (530)..(530): n is a, c, g, or t
  misc_feature (1267)..(1267): n is a, c, g, or t
tgtaactttaagctgttaggtccagagaggaacagctcttaggacagctaggagaaaagcctgtagagagagtaaaagaatttaacacccatagtaggcctaaaagcagccacctaattgaagaaagcgttcaagctcaacagccgcactacctaagaagaaatcccgaaagcatataactgaactcctcagcacccagagtgggcaccaagtctagtcaccctatagaagaacgtaatgttagtataagttaacatgaaaacattctcctccgcaataagccgtgcgtcagattaagatacactgaactggacgagattaacgagccccaagtatctacgagatcaagccaactaagtcatgtgattacgcgctcactgtcaacccaagacaggcagtgctcataaggaaaggttagaaaaaagtaaacaggaactcggcaaatcttaccccggctgtttagcaaaaacatcacgctctagcatcacgcagtattagaggcaccgccttgccccagtngaccacatgtnacaaactaacaacagagccaaaataagaggaaaagaaagatagaatacaaagcctgggcaagaagcacaagatcgaggcggggggcagaaaagagaagtccgaagagggcaggtggggcaataaggagggcttcggggagccaacaattttcggtggaaaacacaggttgggcaaagaattggccgggggagcgacccggtagagaggaaggcccgagacaaaattcgagagaaaagcgcaggggtaccgcggtagagcttctttgcgtctctctataaaaacaaacaaacgggataaacagagcacaaaaacggcagcactggccagaaaaacaaggggccccgggaagttagcaacgacggagaggaaaaccagagggaggaagccatgaaggctggaagaaaagtcccccgggactagtgaccgcggcacacacgggtggagacagaacagaccacggggggacaaaaagcaaaacaccaaaagaaggaacaagaaacccaccaaacgaacgacaccaaccgacaaaacagatgagccacgaccagcaaatcgaaagaggcaaaaacacaggcaaacaagagagtcaatagcaaaaagtaaaacacaagagagaacccccaaagatttgggaaacccaccccagagaaaagagacaaacaaagacgcgataaaaaagaatccaacgacacgaaaaaagaagaagaaaacgaccatattctaaccatgtattcan

SEQ ID NO: 645993 - DNA, 882 bp, Homo sapiens
ccacgcgtcggtgcgtcgaccctgctgcacagcccaaggccttcgtggggctcagaccagcctgaaatgcgatcaccccgtaggaaataaagcaggcatctctggacctcaaaaaaaaaaaaaaaaaaaaaaaaaaaaaaaacaaaaaaaaaaaaaaaaaaaaaaaaaaaaaaaaaaaaaaaaaaaacaaaaaaaaaaaaaaaaaagagaggggggggcgcgcgcaccagcaagtatcccccgcgggggcgggagaccgagactcgacccgcgcagccagccacgtgtgtttgttgtgataaaacagagaggggcgcccatacagttaggagcggcgctattatacatattactaaaggagagagcacagaggcagcgcaccgcgacagtaacaacacaatagaggaaagaggcgagagggcagtacacagacagggcagacagaaaggacgtgaacatcgatgatgaagggagaaagcagggcagactcatagatctcccgtgatcgcggcggacgcgagagcggagacacccacacgatcgcggagcgccaccaaaagcactcgcaaccccacaaccaaggctatagttacaccagcccaccaccacgcaaggggacaaacaaaagaaataatgaactgagctagagagagcggaggcgtgagagcgagagcgggccgagtgacacaaacagagagcgcgggcacggctctgcttctgtcgtgcgcggcgtctggcgtgtgacagggagagcaggagcgtggcgagacgaatagagcaggcacggagaggtagatcgtggatcgagccgaatcggcagtaaatctatcattgaccagccagcgcacggcagctgctgacgcatgaggaacaaagaggggt

SEQ ID NO: 645994 - DNA, 147 bp, Homo sapiens
gatttcggcacgagctctctgggaacaatctaatgtctaaaccgccaaaaaagcgcccatttcttagctgctgaaatcagtgctctctcactcctacagagacgcaggtatcgaccatccccggcagtaggttagatgtgggtgatt

SEQ ID NO: 645995 - DNA, 253 bp, Homo sapiens
gggggggtttttttttttcccccccttttttggtttgggagccccgttttccccccattttggggggttttttcccccccgggccccccggggtcccccccggtttcggggttggttttaaacccccccccggggggttgggggtttttttttgggcccttaaaattccccccccccataaaaagcccggtttttcttttttttgggtttgagagattccccaaaaatttaaaaccccttttccttgggggga

SEQ ID NO: 645996 - DNA, 236 bp, Homo sapiens
tctctagcacggatcccccacacttcgatcgcggagaaattagtaagactcactatcgacagtgctactcgcatgaatcagtattcgtggaagacttgaagcatccaggacaggtagaagaaggtggtttcatagggaaggaaatggttctactaactggagtcactagtggccactatggatagctgtcctgcaatggttcaacacctctctctccaatggttcacttgcatact

SEQ ID NO: 645997 - DNA, 296 bp, Homo sapiens
  misc_feature (8)..(8): n is a, c, g, or t
  misc_feature (258)..(258): n is a, c, g, or t
  misc_feature (262)..(262): n is a, c, g, or t
ccttaacncctacaaaacaggaaaaggtacttgctggaagcatgtgattcctggttttgggcttgtttcccatttatattttagagagcaatactaggattaaaaacttttttattgttgttattattattttttgagacggagtctagctctgtcgctcaggctggagtgcagtggcgcgatctctgctcactgcaacctccgcctcccgggttcacgccattctcctacctcagcctccccagtagctgggactgntagngtgtgccaccacgccgagccctatgcaacattaa

SEQ ID NO: 645998 - DNA, 241 bp, Homo sapiens
caccccagttctctcgtaaggagcatggcccagtcctctcccacgtccacacaggagcagatgatcgcatgctttcgtgtacattatgtaatgcaaaatatattaatcttcgccttactacttatttattttgttttatattgactgctgagccttcgatgccccccctggactgattgctggaggatatctccttcacacgtctgaggcctggtcccaggaactggcaatctaacaggat

SEQ ID NO: 645999 - DNA, 336 bp, Homo sapiens
cccgttacagtaatccacgtggtgaagggcatgtccccgttaactaaggaaggactgcggtaacttcccctgcagggctgtaggttgcctgcaggcgctccaggcccccaccctgttgattccgatttttaggtttcattttcctttggtcccttttggcccctactttaaaagcttgcccaaagggatcccctccattttagtgggcagaggacatataatataatgccaatatttgcttttttttaaaacagtacaaaaataaaaatttaaagtggttgctgtggaggacaggggtcagtggtggaagtgagcccgaaatagactttgaagtaa

SEQ ID NO: 646000 - DNA, 164 bp, Homo sapiens
ctggccgatgtatgtttgctggtgtattactgtgaaacctttacaccttctttgctgtcactgtcttaaggacttctgattccctaacagtcagacttggttagggagagcagagtgatccgcagaggaggtgctggctgtgctaccttccaaaacagttcttt

SEQ ID NO: 646001 - DNA, 145 bp, Homo sapiens
catatctaacacattactctcatcttacttcacggagctgctgctctgctcctcttctgacttatcattcttcatctctactgctatgtgagcactgtacctatattcaatattaaatccaggattttccagagagcagaatcca

SEQ ID NO: 646002 - DNA, 669 bp, Homo sapiens
  misc_feature (112)..(112): n is a, c, g, or t
agcggtctcgtgtatcccttgaatgtactggattacatcttgcacaggaaaagtgtgaaagacgaggctccaagctcgacctgcttgggcgcgtgttcagggtcttcccaangtggcctttgtgtggcacgcagtctctctgatgaactgagaccacatggaatgccctctgactgcctatagtaacgagtgcggctcgaggtgttgaaacagggtgtccacttggaaaattttccccagaggaaaacaattttgtggaaaaggccccagttgcaaaattgaagcccccgctttaggaggtggtgaattaccaggagccttggaggaattgttaaagggggttggggctccaccttgccccgggttttgggaaaggaatgtcgcccaatagggctttgtcagataacttttgatatgataagatggagatggaagatgatatggaacgggtccatgggaggagatgagaagacgctaagggaggaaactttgaagggaaacttcagtggaaggttacagtcgtggcgacattcttatgaggggaaccgctcctcaaccatgaatcatcatgaatgaagtttggccttatgccctgaaatctggagaggtaatattcataaaatcccgtgcttctaaatccgcattttccgggttgtacctttactgtga

SEQ ID NO: 646003 - DNA, 266 bp, Homo sapiens
  misc_feature (35)..(35): n is a, c, g, or t
  misc_feature (70)..(70): n is a, c, g, or t
  misc_feature (122)..(122): n is a, c, g, or t
  misc_feature (124)..(124): n is a, c, g, or t
  misc_feature (137)..(137): n is a, c, g, or t
  misc_feature (147)..(148): n is a, c, g, or t
  misc_feature (158)..(158): n is a, c, g, or t
  misc_feature (170)..(170): n is a, c, g, or t
  misc_feature (177)..(177): n is a, c, g, or t
  misc_feature (189)..(189): n is a, c, g, or t
  misc_feature (229)..(229): n is a, c, g, or t
  misc_feature (257)..(257): n is a, c, g, or t
ttattaaaatagtgtttgcatcttgtgtatccttnaagtctaattcagccacagcagtggcaaaaggaanaagtttatcatggtgcagcagcagtcgtacaaggggcaaaagagcatcattntnatctcgacatatntcactcaaanntgtaagcagnctgaggcagatnggttgancatctggtgatnttagcagcaaagttttcaaaggaccatagtacttgaaggnagcacgtagtcttctgtataaatatttntaatcaagg

SEQ ID NO: 646004 - DNA, 167 bp, Homo sapiens
tgattcttaaaggaaaattttattacttggaaaaattttagcaggccaggtttttaaagtccaatattttttaagaaatttccaaaaagttagtattaaaagttgacttgtaacattgctccttgcctttgctttgagggcgacccgggcgcaaatttaattttttt

SEQ ID NO: 646005 - DNA, 129 bp, Homo sapiens
cggatgaatcgagctcgtgtaccacttaatatgagtagcttacacaagtagcctttatagtaaagatactctttacggactccacttatgactccctagagcctcatgtggggagtctctagagtcgac

SEQ ID NO: 646006 - DNA, 128 bp, Homo sapiens
accactatataagctggaaaggaccttaatgctcatcaggatcagtgcctccctgggcctagattgcccctgtacatgtaggttagcctgaccttgagatacataagccctataagtaccatacgcaa

SEQ ID NO: 646007 - DNA, 133 bp, Homo sapiens
agttggtatgatctggaacactactctgtgtggtgtttcagcacgaaagtcgagatattgcatgatcagggaacgaacactcaagctatgtcgcctttacggaaactaacgctgatcggtgatgccgaaagat

SEQ ID NO: 646008 - DNA, 358 bp, Homo sapiens
agttagttttttaacccttggtcccttccctcacccccaggagtccccagggtttactgggggcatctttatgtccatgaatacccaatgtttagctctcccatataggggggattttttaagggactaacgggtggaattaggcccaccctattgcttagcctgccatgattattcaaatccaaagttgacataaatagggctttaaggccctgaaccaggcttgtttaaggagtccctccttcagccttatgaaatgttcccttgtaattttttaaaaataataggaagtatgaataaaaatctggaccctttttgtgttttttcctaaaaacgttaataaaataatttagaagta

SEQ ID NO: 646009 - DNA, 136 bp, Homo sapiens
cagattacattaggggagaaaaggcactgtttcgagcatctgctgagtgatataactggtgttttcgaagtgaggttcacacattaacatgcctcacaattccctgaaatggtccttagaagtgcaggcaccaaga

SEQ ID NO: 646010 - DNA, 148 bp, Homo sapiens
tgcgccgctttttttctctcctacgtacatttttattaaagaacaaaaaggtgtacatttgtccataagtcgacatctccataaaaaaacactatcatacaatacatacctttgctttcgcagaatagctacatacatacacacatca

SEQ ID NO: 646011 - DNA, 333 bp, Homo sapiens
ttcctctcctcccacctccaggtggccaggtgcggtggctcacacctgtaatcccagcactttgggaggccgaggcgggcggatcacatgagcctgggaggtcgaggctgcagaggtggcaggatcacacgatcctgggaggtcgaggctgcagaggtgggaggagaggaatcctctcctcccacctccagagagatacagtcatgggggtcaggtgtggtatctggaatactgtgggaggctggattgaagtctgggccaggaacaatggtaattgtgggagactcaacaagaagtgagtacagctgaaggagccagggggtaccgagctcg

SEQ ID NO: 646012 - DNA, 705 bp, Homo sapiens
tcccagctacttgtgaggctgaggtgggaggatggtttgggccccggaggtagaggttgcagtgagctgagattgtgccactgtattccatcctgggcaacagagccagaccctgcctcaaaaaaaaaaaaaaaaaaaaaaagggcttggcagggggtcacgcttgtaatcccagatttggggaggtggggcgggcaaaacactttgacggtcagacgtttggagaccagcctgggccaacagtggttgaaaccccgttctttttaccaaaattaaaatataaaaatttatccaggcgttgggggcagtgtgccatatagccccagctactcaggaagctaaagcacgagaatttatgtgcactccgggaggtgaaggttgcagtgagccaagatcacaccactccactccagttttggacaacagtagttgagaacacctgttgttcaaaaaaaatacaaacaacggaaaaagaacggcaagagaaaaacgtgtgctttttgggccccaggtgcaggtgggctctcaccccttataatcttaccctctggggggaggcgctcagggccaggaaggatctggcctgggagcgcccacagagtttcaaaaacaggcgcgggccactctttgcaggaacccccactctacaaaaaaaggaaaaattaaccggacgcgggatgtggcctgtatcccgcaaccgggccg

SEQ ID NO: 646013 - DNA, 158 bp, Homo sapiens
tcgagctcggacccctccatatgtgtgcccaggctagagtgtagcggtccaatcagagctctctgcagccttgaattccagggttcaagccatcttccctcctcagcgtccccagctactcaggaggctgaggcaggagaatggtgtgaacccgggag

SEQ ID NO: 646014 - DNA, 810 bp, Homo sapiens
agcgggcgcgtgcggcggctgggcaccggcatttgggccggtggccgtgagaagcacgctgtgatggctgcaacgagtgaaggcgaagagctgatgtggactctgtgctccccgtccgcaaggggatcggttatcgtccagaagagcgtggatattctttcgcccagtttatggcagagcaagttaacgaggaattgctgatggtcgaagccagtgagcaaagtgtaaaccgtaagaaagtgtcgacaggagatgcaaaagagaggtggtcctggtagtgtcgaagtgggaaaattagtggcatagagggttacacacccagagcgaaaatacgcattggactgtccggaaacggtctttgtattgagttgtcggtactctgtattaaggaaatgccccattgggacgccgttatcaagttgtcaagtcgtaccaagcaacattggaaaaagaaaccaggacatcgatatcgtgccaatgccgttcaaacttcacaggtgtgccgtataccgtcgtccaggatgaagttcagggattagtgtggaactaatggtactggaacgtcaagatgctttaaaacatgtgagcaggaaaacaaaagccaaacctcggacagtacgatgatcctcctgactggcaggagatccgacttagctccgagggatctgacgttcacgaaaactcacctcgacgacacgactgctagcaaagatgacccaccaagccctcaacgaaacctcacatatgtagaccagactcctacggcgcgcacaggggccagcgggaccaaccacggcaccgacacgacga

SEQ ID NO: 646015 - DNA, 251 bp, Homo sapiens
  misc_feature (35)..(35): n is a, c, g, or t
  misc_feature (76)..(76): n is a, c, g, or t
  misc_feature (111)..(111): n is a, c, g, or t
  misc_feature (137)..(137): n is a, c, g, or t
  misc_feature (187)..(187): n is a, c, g, or t
  misc_feature (216)..(216): n is a, c, g, or t
ttaaaatcagattatttgggtttttttatgccatngagttgtttgagttcctgatatattctgattattaaacccntgtcaaatgaatagtttacaaataatttttctcantctgtaggtagtctcttcatattgtngattgtttcctttgctgtgcagaagctttttagattgatgtaatcccatnatgtccatttatctttggctgtgtattcnctttaggtcttactccgtaagtctctgcccagatg

SEQ ID NO: 646016 - DNA, 379 bp, Homo sapiens
ccagagtcaaacagtgcccctcttcccagctcctgctagcatcaccaacaactggtgtgtctagtttgtttgtttgtttgagatggagtctcactgtgttacccaggctggagtgtaatggtgcgatcttggctcactgcgacctctgcctcccaggttcaagtgattatcctgcctcagtctcccaagtagctgggattacaagcacccgccaccacacccagctaatttttgtatttttagtagagacgcagtttcaccatgttgtccaggctggactcgaactcctgacctcaggtgatccacccatcttggcctccaaaagtgctgggattacaggcgtgagccaccatgcccagccctggtgttgtgtctactt

SEQ ID NO: 646017 - DNA, 710 bp, Homo sapiens
tgagcggaggcgcagaaaagggggcggcgagactcggcttgttgtgttgctgcctgagtgccggagacggtcctgctgctgccagcagtcctgcgcagctgtcctgacgatgtcagtcccacctagtctgagccgcctgcgtcccctgcgacaacaacaacaacaactgcttaggaaaatgagcagtcatctgctccccgccggccggcctcaaacagtttcctggcgtggagctacccatgaacatggcatgcaatggcaatgatcatggcaatgggaaaactggtgggctgagaacacgtaccatcctcatcctccatccacaatggagacatggagaacgatacttttggatgcacaacattgaatcacggacagacgtagttccagatgcacgttctcactgtgacagcccttcgccacaagacagatgggccagatcatgtcctcgactgtggaaatgcacaccagccgggaccactagctctcagtcacgaagaagacgtcgtagaatgacgagaaggacagtctcaggctttgacagacaagtgccggactggcgaatcacgactggtccacggtagacccggaaccgcgtgccaccccaaggtagtttccacttcagcacaaccctacaccgctctgctgtctcgcagcactgaggaaaacgtgcacgcactgacgaaggggggtattacctccgccacact

SEQ ID NO: 646018 - DNA, 308 bp, Homo sapiens
  misc_feature (38)..(38): n is a, c, g, or t
gaagcaacgagtaactccgagatactgagatgaccaantccaaagcaactaaccacccgatgctttgaccaaacgtacgtcaaaaaattgtcgatttaatgacagtttagcacctgctataatctctccttctctgtcttccaaatctctcccaatatagtcaaagaagatgttaatctgctcagaaagagctcttactacgattcttgtagcaagggtcaaagaaacttacaaattcctcaaagtgcaagatttgtacgcttatcttcttcagtcagctcatgagggggagctttactatcattttc

SEQ ID NO: 646019 - DNA, 144 bp, Homo sapiens
tgtgtgcactatatcatgtatacacttaattgtatgtttaaggccagtggaatctatagctaattactcatttgggtcttgaaactgaacatgcaacattttattttatgttaaagaattaatgtgtattctacacaataccca

SEQ ID NO: 646020 - DNA, 375 bp, Homo sapiens
  misc_feature (83)..(83): n is a, c, g, or t
  misc_feature (291)..(291): n is a, c, g, or t
agcttttcccaagatcacagatcaagacttctctacaatcatgagactcttatcttaagaatctgtgcagctgctaacacttncagcatgtggagaaaacatggggtattataaagatttggttgtagggaattaacaaaaaaaaaccacttagttaagcaagtaaaccctttatctaatgcattctttaatctatttgatttttggtggtttgatttatggggaccctgagtaaggagcatataccacatcttggtgttatcccaatagtcataagagtctccctggtgnactgtacttactcaaatgtttcaagagtttgcatgcagccatctctaaaatgtcaaatggtgtctctttaactggaatggcaag

SEQ ID NO: 646021 - DNA, 1231 bp, Homo sapiens
accggctttttggggggccaggactttctttccgcaaaagatttatcgtggggggcccccctacctgggagtttttgggagtgtgcccccagagatgcccctcgagggtgtaatatacaacactttggaaagaaagtggaaagcgcgggcctccccttgggtagtttcctcctttgttccaagttctcgcccctctcttggtgggtgaagtgggtagagtccctccccgttcccgtccgtgaagcaccctatttcggggggggccccccacatggggggattgaccccccacggggttccgtcctttctgatggtaaacggaatctccacggttccattcggttatatcccccccgcgggaaggggatcccttttcctacgtgcgcccccctattctcggggggggtgcctcccttgtttgggagacacccctgggatgttaatttgaggggaaatgggagtaaaacatgggatttgaccgccttacaggggcctttcttggggggttcttcgcgcctgtcaccacacattcttgggggaatccccacggggggggccctccactggtcaccccctctccacgagacccacggaggattttcttgggaaatagccctgtgctgctactgcgaggatagacacatggtggtttcacacaacgggggtgtatactgcgcctcacacagaacccccccaccgtgttttcaacgtcaatggtctcccacacacttcaaacagggtctatgataataccacgccaaagatcggaggaaaataaatgtttctgtctggcgttcccccctccgctgagcctcgccctgggctctccgccctgcttctacacgcggagccacggtccaccacgggttcacaccactggggaaattttagcccgcccacctgcgggggaatgtctacacaacacccactgcctgggttatctcttctggcggccgtgctaagttgttggggggaatgtgttgtgggacacacgctgtggtggtgtgtgtgtgtgctgtgtgtgttctgtgaacctcctgtccccactggtaacgtcccaccccgtgtccccaagagtcccctaattccctccaccacaataaccagaaaacacactcccacgggaccttctggggaaaggctgaggacataatacctgctgtcactccagaggacattttttttagccaataaaattgagtgtcaactatttataaaaaaaataaaaaaa

SEQ ID NO: 646022 - DNA, 575 bp, Homo sapiens
  misc_feature (556)..(556): n is a, c, g, or t
ggccagcaaggctgctctcaggagaggccttcctcccctgtggagggcgagacatcctcatggggactcaattcagaacataacaggaaaaagcgagtgactccaaagacagccacaggtgtggagtctggaaatcaaaatcacagatactccactcctctttgtgtcttccagccccataatgtcaccccattatagtccaagacccttcctgtaccaggaggcccccccataggcctgcaaggtgtgtattaaactgatggtgacgttgtgactgcttgtccagatgggcccctgagtgaaatggggcactactgatagttccctggtggtcctgggaacactggggtatatggtcaccctaactgttgtgctggattgatagatagggttggtcacttgcccgaggccgatggctggtacatggcagagctgagatattcactgtgttctggctgtttccaccgtaccatgttgttcccagccctctgttttctttccaccccacttcccatgacttgcttcccctttgagacgtggtgctagtaaatcttanattcccttggcctgtactg

SEQ ID NO: 646023 - DNA, 227 bp, Homo sapiens
  misc_feature (147)..(147): n is a, c, g, or t
  misc_feature (180)..(180): n is a, c, g, or t
  misc_feature (226)..(226): n is a, c, g, or t
ggtgactctagaggatttcgcccaggtagattgcccaggtgatttttctttttttttctcagtagtgacagggtttctccatgtgggctaggcaggtctcgaattcctgacctcaggtgatccactggcctcatgtgctggggattnacaggtgtgagccactggcgcccggccttcttntttatttttggtataataatttcgtgtgtataaactctaccggggng

SEQ ID NO: 646024 - DNA, 919 bp, Homo sapiens
ccagtagccccgtgctgctgtgaataggagccggtggtgatgcggcttccggcccggagcctcagtactctgctatctcttcggcagaagtccaggttacaggcccctcctgttgtcgctgcaacttccctcacccacagcagtacctgaggtggttctggagagactgcagatgtagtccaaactgctgctaccaagcttcctgaactggggctggggtcatacaccccagtgggactgatccagaatctactgcaatctatgcattgttgatctgggcctaccttggtggggggccatagctgcactgtacagtctttgcccgctgcctgattcttcctctcatcgtgccgggccagcgacaggcagccacgctccacaatcacttgccagagatccacgaagctcacccagtcgaatcaacagaggccaagttagcacgagaccacatcgagtacttacacggctccctcgggagatggcgctctcaccacgaaacaacatggtattcaactctataaactctcattctccctgtgactcaggccccaatctacatctccttcttcattgctctgagagacattggccacccttcctgtgcccagctgcaagacaggtggctctggtggttcccgatctccccggcatccgatcccatcgtacatatacacctgcagacctggctccaagtgcgctgcctgaagctcagtggcgagcacaggcttcacacgtctgcctacccacgatgaactgggtccgaatcacccccaggtaacctggccatagcaccatatcccggcgcgcgcacaacaccgccctcccgaagctccctggccacacccggccggaccaccgagcccccaacccccgcctacacactcgcaccccgcagcccacgccacgcgaagcaaccccc

SEQ ID NO: 646025 - DNA, 252 bp, Homo sapiens
taactgcatctgcagtattgcatgtaagggataagtgcttattttaagagctgtggagttcttaatatttcataccatgcactttcttccttatccctttcccattggttatttcatgtgattgagaaatttttccattcgagcctttttataattgtaggactttttcctgtgggcttcacttaatggatagtacacttcactcagaggcatttgcatcttctaattatttcttaaaagcttctatagtga

SEQ ID NO: 646026 - DNA, 112 bp, Homo sapiens
aagagaggcggaccccccagctacggaaatagctcatgagaaggatcttagactctgccgagtttatcaaattcacggtcattagaccatttccaggactggtgattaataa

SEQ ID NO: 646027 - DNA, 119 bp, Homo sapiens
tgcacttactcatcccgtgacggtcctcacagccctaactcctccctgaccagtcctcctcccctaactcctccctgatcagtcctccagccctcactcctccctgaccagtcctcctg

SEQ ID NO: 646028 - DNA, 584 bp, Homo sapiens
  misc_feature (59)..(59): n is a, c, g, or t
  misc_feature (61)..(61): n is a, c, g, or t
cctgaccggcaaggtatgctgttactggttacagagtaaccccactcccaaaaatggancnggacaacaaaaactaaaactgcaggtccagatcaaacagaaatgactattgaaggcttgcagcccacagtggagtatgtgcttagtgtctatgctcagaatccaagcggagagagtcagcatctgcttcagactacagtaaccactattcctgcaccgactgacctgaagatcactcaggtcacaccctctatgcttgagcgcccagtggacaccatccaatgttcagctctacctggattatcgagctgcggctgacccccaaggagaagaccggacctatgaaagcaatcaaccttgctcctgacagcatcatccgtggttgtactcaggatttatggtggccaccaaatacgaagtgagtgtttatgctcctaaggacacttggaccagcagaccagctcagggagtagtcaccactctggagaatctcagcacaccaagaagggctacgtcgtgacagactgctaccatgagactcaccatcaccatgtagctggagaaccaagactgagacgatcatc

SEQ ID NO: 646029 - DNA, 421 bp, Homo sapiens
tcaccatgcatggctaaagctgagtaaacccgaagagaaggggaagaagcggatgaattttggtgaaggatgggggctggaggcatccggggtcctgtgagatacagtgtagctattttagacagttagtcacagagggactctaaggagggaaatacttgattcttctacaaagtccacattaaactaccgggtgaaggctgggcacgatgtgctaatcgcctgttatcccagtcatttttgggatggccaaggagggtatatcgcttgatgtcagtgaatttgagaccacgcctggtcaacatggcaaaaccccgtctctactacaactacaaaaattagctgagtgtggtggtgcacgcctgtaatcccatctaattgggaggctgaggcaggagaatcacttcaacctgggacgtga

SEQ ID NO: 646030 - DNA, 159 bp, Homo sapiens
cccccccccccctttccccccctagggttttttattggccccaataaaacccaggggggggggtttttttaaggggggggcccagggggggttttgggcactgaaggggtttgaacaggttttgggatttttttaaaataaatttttttttgcccccca

SEQ ID NO: 646031 - DNA, 293 bp, Homo sapiens
ttcttcccctccccactttatgtgtatcttccaagaatacttcctaacaatccttaacatggtccatcacagggtctacgaaacaaaataacaagagagacatagacggagagaaaacaggagcaggaggagaaggaagagcaggaagacgaggaggcggaggaggaagaagatggaaaattatctagatcacgcttgtccaacccactgtaatcaggccacatagtggcccaggatgggttggaatgcaaaccaacacacatttgtaaactttcttaaaacattatgagatt

SEQ ID NO: 646032 - DNA, 366 bp, Homo sapiens
tcaggacacagtgctggctacaggtgtgagcactgcacctactgtattacacccatactctcgctgcaaggtgtgttcctgtccctgctgcacttttactgggcactctgaagctgctgggcttggtgttctgctttcacactctagcgtggatatagggagttcagcggtgccaggaagaggagaataggtgcttagactagttttgatcttacttcagtaccagagagtgtacaggtagctactgctgtcctgtgtgtctgatttctttgagcggtggtaggcgtagtctccttgaaccagcgcacattcgaggttctatacgtgattatgtgcattgggggagggaacatggggtctgaccct

SEQ ID NO: 646033 - DNA, 446 bp, Homo sapiens
  misc_feature (50)..(50): n is a, c, g, or t
  misc_feature (413)..(413): n is a, c, g, or t
agccatggcaagtaagtggcctttggaaagttaccaaggtaagacatacntgatacgttcaagaaacaattccaaggttcaataaggccagaagttaaagggcaatgtaagccctggaaactgaggctagaaaggtagaaggatctctttttaccacacactgtgccgggcaccatgaagaatacaaaatagctagctattatggagcctacactttaatgtgtgtacatagatacatgtccatgttggaatttaactccttgagaggtcatgaattacttagtcccggaagcatttgaatttatactggaaagctatagtagagagttgacaaaatattttaaatgtagtaagaagaatttgacaatctattgtgtggtatgctagcaagccagttctccttcctccttttntcaccatcccaccacccctcacaaaaaaaaaaa

SEQ ID NO: 646034 - DNA, 397 bp, Homo sapiens
  misc_feature (41)..(41): n is a, c, g, or t
  misc_feature (44)..(44): n is a, c, g, or t
agctgctgtggtttcagtgatggtttcccctctacattttngtngaaactttctccccagtgcaacagtactgagaatagtggtctttgggaggagatttgaatcttaagggctctactctcatgaataggattggcactctttttttcttttttcttttgatatggagtttcgctctcgttgcccaggttggagtgcaatgtcgcgatctcggctcactgcaacctttgcctcctgggttcaagtgattctcctgcctcagcctcatgagttgctgggattacaggcatgtgcaaccacgcccggctaattttgtatttttagtaaagatagggttactccatgttggtcaggctggtctcaaactcacgacatcaggttgatccgccctccctca

SEQ ID NO: 646035 - DNA, 147 bp, Homo sapiens
aaacccccttttttcccaaaacccccgggggacccctccgggggcagcccctaaaaatcagggaatttggggccccccagggaaaccgggaaaatccccaggggttttttaaagaaaacgatttccccaggggggtttttttttcca

SEQ ID NO: 646036 - DNA, 115 bp, Homo sapiens
tagcagtgcgtcatcggctcctttggttcatgagtgaagtatgcacctttatgtctggcaaaatagcgcccccctagcaatatcaaccattaaccttccctctacacttatcatc

SEQ ID NO: 646037 - DNA, 609 bp, Homo sapiens
cggagtatcctgaggtattggatctcaccagaatccgtgatgcacgtttagccagccaatcggggaggatcactccagtgcccaggtcgcaggaagctctgtcttgtgcagtcactcatcggtccatgctctcagcctcgtctgtaggggcaggagttgcctgaagcatatccttgaagacaagaatgcaccctaacaagcagcgtagtaatatatcgacgaagaatggaaaaagatgtcccaatgctgccccaaagccagcagaagaaagatggggtgtccttcttgtgctgaacatgtccgtaggaatgccctgggcacttccatgctcaaatgaagaagaccaacccagggcctgtgggtgaaacacttcctgttgccagactgagctcatatgctaagacagagctggggtctcagacatccagaaagtagtcgccagtgaagccagccgaaatactcagatgaaggacagctggcagtgatggggagcaggaacccatactgtgaagatcagacatggagagtgtgaccctgacagtgaagcctgatacgccatagcacagtgatcaagaagatcccctaaaaaacatgctggtgtctaacacg

SEQ ID NO: 646038 - DNA, 113 bp, Homo sapiens
tccagtaaggtggcccatgctgggattcaggctctttgagctttcttccatagtggttagggctggagcaggactccactgtggcgggaggtattggggcacacattatggag

SEQ ID NO: 646039 - DNA, 188 bp, Homo sapiens
aggaagtatttagccagcctataaccccatgtatcttggaagtaactaactgttttgatcttataggctcataggcagaagagacttgccttgtatgagatgagacttgggactgtggacttttcagtttacgctggaatggaattgaatatagctgcgaacgggaatggtacgctggaatggaatgg

SEQ ID NO: 646040 - DNA, 126 bp, Homo sapiens
tcctatagaatcgagctgttaccagacgtcattcttgcattgcaccgttttccaatgagagagccacactgactagcagtggaccaccagcctcagggtgaccgggggttactggcagctgtgctt

SEQ ID NO: 646041 - DNA, 351 bp, Homo sapiens
taagacgggtaccattctgtcgcccaggccagagtgcagtagcgtgatcttggctcactgcaacctccgcctcccaagttcaagcaattctcttgcctcagcctcccgagtagctgggatgacaggcatgcaccaccgcgcccggctaacttctttgtatttttagtagagacagggtttcatcatgttggccaggatggtctcaaactcctgtcctcaggtgatccgtccgccttggcctcccaaagtgctgggattacaggcatgagccaccacgcccggctatgcccttttccatcttaggaacgttatgctatcacttatctttcttctcttttatatgtaacaatt

SEQ ID NO: 646042 - DNA, 116 bp, Homo sapiens
gtccggtcccctaatgccggcgctcttctcccgggcgggtccgggcgcggggatctgcttggggctgctgcgcggcggctccggcgacgtgggcgggatggactgccatgcggccg

SEQ ID NO: 646043 - DNA, 944 bp, Homo sapiens
ccatctcacttctaggaggtactagtatatcgcgtcacagcctcatatcctcccctactatgcctagaaggaataatactatcgctgttcattatagctactctcataaccctcaacacccactccctcttagccaatatgtgcctatggccatactagtcttggccgactgcgaagcagcggtgggccgtagccgcgtactagatctcagagtcgtccagacggacatatggcctagacgtacggtacataacctaaacctactccaatgctaagagtaagtcgtccgcaagcaagttatattgacgtaccacgtgacgatgacttgtccagaaagaacacataatttgaatcaacagaaccacccacgagctaattattaggatcatcccccctactattttttaaccaaagtcaagcaacgaacgctatttagcggttccccagacctttgtcctccgacccgctaacaggcgcgcctcataatactaactatcctgactcactacccctcacaatcatggcaagccagcgccacttatccaggtgaaacacttatcaggaaaaaaaatctactctctatactaatctcgctacaaatctccttaatgaataacatgtcacaggacacagaaggtaatcatatttatatcttcttgcgaaagcacaattatcgcccacctgggtatcatcaccgatgaggaacacagcagaagctgacgagcacataaaacatatcgaaagctagtgaggtccttcctagccacgaagaagcgcatcaaagacctaggtcattaacatataatatactctatgcagagtaaactggcacataagtgtacacagaagagactcgggacaaggccagcaggaacacggagggaaaagggagagcgaaacgaagaggaaggaaagaaaggaaaaaacacgaccccccctcgaga

SEQ ID NO: 646044 - DNA, 230 bp, Homo sapiens
atcaacaaccattgtaacatgagtctaatttacaggttttctatctattactactagttatctctgggttaagaatacattcacttcaccatctagtactaaaccccaacacaaaaatgattaggattaatagaccactttcaatttcaaaatgctccaccactggtatatctagccatatgcatatatttgctatgtcttatttctcctttaccttacaaacatgctga

SEQ ID NO: 646045 - DNA, 219 bp, Homo sapiens
catttgaaaactgagttgcttatcttttattgttgagttgtgagaattctttatatattttgatactagacccttatcagatatataatttgcgaacattctctcccactctgtgggtggggctgttattatttggttgtgtcctctgatgcacaaaagttgtggggggtattttttgttgttgatggtcgctggtgtttgaaacaacaactcactctg

SEQ ID NO: 646046 - DNA, 200 bp, Homo sapiens
gaggtggagcacgagcgcacgcttttaggacccgtaaagattggtgatctactgtcctggcgccgggcgaccgccagagcgaaactctgcgcagcgaggtccgtagcggctcctgcacgtgctaatccggtcgtccgcacctggtgtctaggcggcgacaacgcactacctcgcaacccatctacgtactctgcgcttct

SEQ ID NO: 646047 - DNA, 416 bp, Homo sapiens
ggattcccccgattcgattttgcgctctcgcgatgaaggcggcagctgttaccatcccagggcgctcaacatcccggtgtccgatttggatgagtgctctgcagtactgagccagctgccttccaggctttatattctgctgagacagccaacgctggacgatgagcatctcgttttcttctgtcacatgggcaatgcggggccctccaggccacgcagcttggcccggtagctcttgcgatcacgtgcggctcgcaactacgctggagcctattgagaatggttggagaaagagagttatgcaggaggcgagcttactgattgccaccccctggcccctttctggccaccttaactaagggtgtgaaccgcctgacttgttgaattgggcaactccttatagtgttgtgcgcaca

SEQ ID NO: 646048 - DNA, 488 bp, Homo sapiens
  misc_feature (25)..(25): n is a, c, g, or t
  misc_feature (32)..(32): n is a, c, g, or t
  misc_feature (50)..(50): n is a, c, g, or t
  misc_feature (59)..(59): n is a, c, g, or t
  misc_feature (79)..(79): n is a, c, g, or t
  misc_feature (97)..(97): n is a, c, g, or t
  misc_feature (111)..(111): n is a, c, g, or t
  misc_feature (138)..(138): n is a, c, g, or t
  misc_feature (158)..(158): n is a, c, g, or t
  misc_feature (183)..(183): n is a, c, g, or t
  misc_feature (231)..(231): n is a, c, g, or t
  misc_feature (250)..(250): n is a, c, g, or t
  misc_feature (253)..(253): n is a, c, g, or t
  misc_feature (259)..(259): n is a, c, g, or t
  misc_feature (263)..(263): n is a, c, g, or t
  misc_feature (266)..(266): n is a, c, g, or t
  misc_feature (271)..(271): n is a, c, g, or t
  misc_feature (279)..(279): n is a, c, g, or t
  misc_feature (303)..(303): n is a, c, g, or t
  misc_feature (309)..(309): n is a, c, g, or t
  misc_feature (311)..(311): n is a, c, g, or t
  misc_feature (348)..(348): n is a, c, g, or t
  misc_feature (367)..(367): n is a, c, g, or t
  misc_feature (370)..(370): n is a, c, g, or t
  misc_feature (386)..(386): n is a, c, g, or t
  misc_feature (446)..(446): n is a, c, g, or t
tgaaaattgtattttgtaggtcacnggacttntcacggattcttgtcttntaatagacnctcatacaaagggctcgatntgtacggagtttatgtgngacccacacatgtntgttatttaatatatgtttcacaaaanaagagaggaggccttttgcncatattttcattgttcgccccgttngttatttgtgacagagttattgattgaattcttagtcacttattgctntttacttggtatttttagnganaaaaanaganagnaactnagttctanggtttgtgttgcacattttgtgtncccatncnactatgggtgttgtgaagttatatttctgaaaaaagnactttttatatttcaaaanagnttcaccacatttttgngttgggcaaaatttgttaccacaaagggaggaaaaaatttccagtgggtttgcttgttgnagttctagggttacttccatatttattgaaagcccaggaatg

SEQ ID NO: 646049 - DNA, 409 bp, Homo sapiens
  misc_feature (166)..(167): n is a, c, g, or t
  misc_feature (188)..(188): n is a, c, g, or t
ccacgacgtcgggttgatgctggtggcaaggtgcacaacacacggggttaaaccccttccaaaaggcctttaaaaaaggcccccaagaaaggggggaaagcccccccaatttgccagtcccggcaaaccctgtccttgtcagcaggaactttgggcagggttattnncccgatctgccatgtattccnagaaaggccatgtacaacgacggaaagtactcaagcgcgcgtaaaagttccccaaagggggttttttggcagaacaaaaagggcacaacaccaccaagcaaaacggggcacggcacaacgggtttttccttccgaccaaaagcgttggttttaaccaaagagaacccaagtttttggggtggggttgaacaaaaggaacggggcggttaccccgggggtgg

SEQ ID NO: 646050 - DNA, 259 bp, Homo sapiens
gcgagacacccagaaccaagtgagacgcccctgattctaaaacggcgggacccacagcaagtcggaaaggttaccggaacacctggaactgtgacccggcacaaggcggcaaataacctccaaagcagcccggaacaaacacctcaccgcacaaaaacacccgcgacactatgtgcggggcgagacaacggacaaaactgcacatcggacctacgtgccggcccgctcgtggcacagggacatccggcgcccaagacgc

SEQ ID NO: 646051 - DNA, 146 bp, Homo sapiens
actttagtcctctcaaatgtgtattatctcccagatcacaagacttcttggggatatgaaatcattctacatttcctcctgctttatgtactttatattttcatattccgattgcatgaatcttcagaattgctttttccccttct

SEQ ID NO: 646052 - DNA, 395 bp, Homo sapiens
  misc_feature (19)..(19): n is a, c, g, or t
tgttatatttgattgggcnaaattataatcgtgtctcttagccttggttccctttgtggtaaaatatgaaacaagtataatatcctaccttatagaattttgttaaggattaaatgcaatccatggcccagacgcggtgactcatgccctgtaatcccagcactttgggaggctgaggcaggaagatcacttgagaccagcctggccaacatggtgaaattccatctctactaaaaatacaaaaatgagccaggcatggtggtgagcacctgtaatctcagctactcgggaggctgaggcacaagaatggcttgagcctgggaggtggaggttgcagtgagccaagatcgcacgactgcactccaacctaggcaacagagtgagattcagtctca

SEQ ID NO: 646053 - DNA, 841 bp, Homo sapiens
gagacgttcttcgccgagagtcgtcggggtttcctgcttcactaggtgctgtggacggaacccggcgctcgttccgccatgcccggtcgcggacagggctggagtagtctgcagcactcgtccagtcaccttcttgtttgactccgcgtctccttcgggaagcgtgcgccctagagagagcctctccagcgcgattcgcgtccctggcggcgcgacgcctagtcccgtcgggagtcgactttgtcccgggctggggttaatccgtcgcatcttaggttctgaccctgtggcagtgaaacagatcgcgggagttccaaaccttcggggaggcatgcggtgcctatgcaaaaaattttactctcagtcaatggggaaccttcgggtaagtggcaccgggtgaagtccaacaactctgggcaaggaatccaaatgcttgggggaggtcttcataacgggcttacgcttaacgtctcttgaccacgttgatcacggtgtatcgtgtacatagcatttctgagagctcgacttatcgtgacctggtggggcctgtctgagactgattgagcgttttctgacgcaaatggtagacgtctgtgctaatcaaaccacatggtcgtaccatttggaccgaggaccggatggcggggaacaatgggagaattggttcccgttgggatgggaagaacaattactttggacaccttggaacatgggaccccttggaaccacagaggggagcccccgaagggcgagaaatggggttatgggggccaccggaaagggtctcccggtttgccctgtatttcaccgcgttgaggtaaattccgagatgaaccttact

SEQ ID NO: 646054 - DNA, 311 bp, Homo sapiens
tattgaggtacgtagggtagacatacgcattcacttcagaaatgtgaattgaggcggcatgtgttcacgcttggatcccagcatttgggagctgagcgggcagtcacttgaggtcaggagttcaacacaacctggccaacatagcaaaaccccgtctctactttaaatacaaaaaaattagccgggtgtggtggtgcacgcctgtaatcccagctactcgggaggctgaggcaggagaattgcatgaacccaggaggcggaggttgcagcgagccaagacctcaccactgctctccagcctgggtgacaga

SEQ ID NO: 646055 - DNA, 224 bp, Homo sapiens
caggcccgaacaatcccgcaacctcatggttcctagtcggattcgttaactgcgccacgacgggaactcctattcttctagttctttatgtatttatatatacacacatgcattcataaagctattttcaagcagttaattttgggggggaggggggctgagcttgtggcagatagaagctcccaggccaggtatccaccattgttcggggcctggggtaccga

SEQ ID NO: 646056 - DNA, 351 bp, Homo sapiens
  misc_feature (331)..(331): n is a, c, g, or t
  misc_feature (351)..(351): n is a, c, g, or t
ccatatcactgatgtagaattagcaaaatgccagccactgttctacgggtttatcatgtattaattaaaatcctcacaacaatcttataatgaaaattatctccattttactatttatttactattatcttcattttactgacaagaaaccagaaccttagagatgttaagtaaattgctgaagatcacacagctaataagaatctacatccatttcactccaaaacctatggtctcaatgactatgctaatgtaataactgacttagtcttgtctttggagtctataaaatcttttctcaacctcactgttacttggattggaaatggancctaacttcggctcaccaan

SEQ ID NO: 646057 - DNA, 121 bp, Homo sapiens
gcttggtctttcactcctgacctcgtgatccccccgccttagccttggacaggttcttggatttacagactgtagccacccgtccccgcgcaaaattcactttatttcaatcaagggcggg

SEQ ID NO: 646058 - DNA, 754 bp, Homo sapiens
tatatcggcttcatccctgaaatctgtatcttagcgacagatccagaatttggcgtcctaggtgctgacacggctgtggtggatatctgtgattagtggactatgagtcctgctgaacaattgactgattagttgtaagagaaagccatgcactgtcgttgtttgtttatagattatcgggcagtaatcgtaggagaggatggaatatgtaagtgaagagcttgaataagttgacaatggtggcagttgccgtggttgcgagtttgagttagtgagaagaatatgtacactcaatgcaagagagtgtcagtgaagtgcatggcgcaagtgaggcatagtgtggaaatgacctatcaaaatttgttcattcttatagaaatatagtccctcatagaaaagtcgagtatataatacagaattccacacgcattttagatagagtctaccaatatttggggttcagacataattagatgactaagatttgagcgtaatactgggaaagaatgctacagaaattggtaattccagatttgaacaatgattatgtctgtttgaagatatttgactccaagacattgttccttaatgactggagctaggtgtaacaggtgactgggacactacggggtaaagaatgtcgtgagttaaatgcttcaactggggctcaaatgtagttaattgagtattgctacggaacatatgttcataggggacccagttgggatttttcgttaaacaatgaggctcaaca

SEQ ID NO: 646059 - DNA, 108 bp, Homo sapiens
  misc_feature (63)..(63): n is a, c, g, or t
ggttgtctccaggaagagatggcacaggatgcgtgtgtgtcatgtgtgtcatgtgtgtcatgngtgtcaggggtgtgtgtgtcgggcgggttcgcagatacttatggg

SEQ ID NO: 646060 - DNA, 343 bp, Homo sapiens
catatgtgctttgctgcctcaattaattttattctatgctgcccatttattctccttaccagaaagtgtatcaatagcattctttaagtcaccataagaggcgaactcaagcacgcccttcatttaatttaggtcgcgtgtgcatccgaaaacgttacttccccagtttgtctcatgaaatctttgagatcctgccagctgactccttgaggatgaattctcaactataacgacgagtttctgttcttacagagcggaacgatctcgtctatcatttcgaggtctgcgactactaaaacggtcagagtatcgtcctctacctcttccacctcgtgaccgagcc

SEQ ID NO: 646061 - DNA, 447 bp, Homo sapiens
gatcttgggccagctgagacagagtggccgtgtgccttgcttcgcgtctccactttcgctcatcgttccggaaagtgctgtctaagcgagggcacctggaacttctcgagactaccggacacttcgtattttgcgtgagcgaggtccttgtttcagtatgattaaactttgacatacgagttgagatgatgcacggatcctgaacgaggagttcactcatgggcgagaggcaggtgaatctgggacgtgaagtataaccgagtctccgaagcgctgagagtcgatcacccgactcctgtgagggggggacgccttggcttgtcgatttcctagtatcctagatcgtccatcaatggagtccgcgtgtcaccgtaacgtggtccgcgtatgatctcctcttccttcaggaagcgctgtgaacatcacaacattgaggggccatgtata

SEQ ID NO: 646062 - DNA, 375 bp, Homo sapiens
ttacagcggtctcgggaggcaggtctcgtaggaggcagggtctcaggagtgagtgtggggggtgagctggaaaggcacagatcagacagcactgtgggggctgggcccgagggcctcgtcttcccagtggggaaggggcttctcatggttagactgggacgagaggctgactgcgggccccccgctccccaggcaaggcccaccggtgcaggccatgtgctaagaaacaccatggtcccatctacaggacaggggttgggcccagcttgcccttgtgcacgctagggactgggcagtgcgggctacccttgggaagcacaggagggttgggctggggcccaggctttgggacccttccaatggcacctgtggctg

SEQ ID NO: 646063 - DNA, 924 bp, Homo sapiens
  misc_feature (149)..(149): n is a, c, g, or t
  misc_feature (214)..(214): n is a, c, g, or t
  misc_feature (262)..(262): n is a, c, g, or t
  misc_feature (284)..(284): n is a, c, g, or t
  misc_feature (376)..(376): n is a, c, g, or t
  misc_feature (543)..(544): n is a, c, g, or t
  misc_feature (547)..(550): n is a, c, g, or t
ggcagatgagccacccagcctggaccctgtgcagagcttctcccaggaggcagtggacacaggcagggtcctgtacctgcactcccgccctgaggcctggagcgatgccttctcgctggatgtggcctcaggcctgggtgctcccctcnagggcgtccttgtggagctggaggtgctgcccgctgccatcccactagaggcgcaaaacttcagngtccctgagggtggcagcctcaccctggcccctccactgctccgtgtntccgggccctacttccccactntcctgggcctcagcctgcaggtgctggagccaccccagcatggagccctgcagaaggaggacggacctcaagccaggaccctcagcgccttntcctggagaatggtggaagagcagctgatccgctacgtgcatgacgggagcgagacactgacagacagttttgtcctgatggctaatgcctccgagatggatcgccagagccatcctgtggcttcactgtcactgtcctgcctgtcaatgaccaaccccatcctcannacnnnncaggcctgcagatgtgggagggggcactgcgcccatccctgcggaggctctgaggagcacggacggcgactctgggtctgaggatcttggtctacaccatcgagcagccagcaacgggcgggtagtgctgcggggggcgcgggcactgagtgcgcagtttcacgcaagtccaggtgggacgggggggtccgtgctgtctcacaccgaaggacctcgggtggaaggtcggatcgctctcctgaaggggagagaaattcccggaaaatctttacggtgaagggcaaaacaggtggccttcgctgaagcgagcgacctggcggtgtgcagttcggaacaagaagcgagccagatggtctgagggattgccaactgta

SEQ ID NO: 646064 - DNA, 210 bp, Homo sapiens
tttgattttgtagaaaatagcttttgtctaggcaactaagtggtatactctgcaaataatgtaaatgaaattttacctttttgattttttgtaaattaaaaatgggtgcagataaaatgtccaaattaacaaaccagtgttttaaaagtgttactaacattttggttctaaaactgtcctttcccaaattgaataaaaaactctcacact

SEQ ID NO: 646065 - DNA, 590 bp, Homo sapiens
gctgtttgtctacttcctactgcttccccacgccggcggcgccatcatgagtggaaatcgtgcacttgcaggccgggcagttgctggaacgcaatagtcggagccaagtttgggaggtgaatcagcgatgagcagcggcatcgaccccacgggctacctaccacgggtgactagcgaccgtgtcagctggaacgcatcaacgtgtactacaatgaggccaccggcggcaaggtacgtgccccgcgccgtgctcgtggatctggagcccggacaccagtggatctccgatggccgctcggtggacccattcgggacagtatcttccggccggacaacttcgttttcggtcagtagtggtgctgggaaacaacatgggccaaggggcactacacagagaggcgcggagctggtggactcggtgctgggatgttgtgatgaaaggaggctgcacgagctgtgtacgtgcgctgcagggtttccatgctgacccactccctgtggtgagggcggactggtctctgggatgggtaccctcctcatcagcaagatccgggaggagtacccagacaggatctgaacacgttagtgtg

SEQ ID NO: 646066 - DNA, 796 bp, Homo sapiens
tggtggacaatccacacggccggcaacccctcccgcgagtgggggctccaacagggggcccccccaccgaatcacttttaatggggaggctccctcccaaatgaaatgtaaagggtgtgaaggagaggcttctctggcctcctttgtaggagccggcccacaggtgtgtgaccctggtgcacatcttgtgaagagagagttccattataagatggagagttggtggagacccccttgtgtgtccccgtgaccccctgaggagtctcctaccccccccaggatagattttacccccttagggaatttcccagaccactgtctcagaacccctggcacccacgttgtagaacatctcccagcccatgtgtggaaaaagaatgtatgttatgtacccagcggcaccaggaagatcccatggggcgtgcccaacattctcagaacgggacacccagagaagaacaccaggagaattttgtaagaaaaattctatggagtccacatcccggagagtggatttttccacaggcgtaaatttctcacgtagcgccccgtttgctgtcctcccctgagacatcgttggggctgtagcatgcaacaccaccccacatttcttttcccctcatctttcttcttgggaccttgtgggccctcacgggcttgtgggcaaggcaatgggaatgtgccccaggcacaacggttccgcgggcatcagagagaaaagagtgggttttgggaccttgttcctcccccattggcccactgtttacaaccatttaaacgattttccccagctcca

SEQ ID NO: 646067 - DNA, 324 bp, Homo sapiens
tgatctacaggatcttactaaccctaatcgcagtacgcttcacaatagcaaagtcatggaatcaacttaagtgcccatcagtgtgaacgggataaagaaagtgtggtatatctacaccatggagtattatgcagccataagaaagaatgaaatcatggttgcagctggaggccattatccgaagtgaattaacccagaaacagaaaatcaaatacttaacatctgctaaagatgggaacaatagacactagggactccaacagggaggaggaagggagaaaggcaaaggttgacaaaattctttttggggcgattagggttagt

SEQ ID NO: 646068 - DNA, 110 bp, Homo sapiens
gaacctgttctgactttagaagcacttcctgtgtatcgatgtgagggctcctgtcctcatcactatcttcacggacttgacttgtactcccaccaatcgttggcgtggca

SEQ ID NO: 646069 - DNA, 267 bp, Homo sapiens
gggcttccttccttaaaaccccccccccttttggggggggtgggggggggggttgggggcccctttccgccccccctttttttttttttttttccaaaggggccggggttggggggggccccttttgtgggggggggggccccctttttcccccccggccccccccctttttccacccccttggggtttttttaaaaacccccccccccccgggggggaaaaatttttttttcttttccccaaaaacccccttccccccccgggcca

SEQ ID NO: 646070 - DNA, 1426 bp, Homo sapiens
gggcgccggaacaccatgatgtggagacttaggatgtagtcaagtacctctagcgacggtctcaggagcagatggccgaccagtgaatcgtcgtgactgtagtaaggggctggtgacagtatgtctctcaagtcataaggggttgtccgtccatgttgatccgatgtatcatggtaccagactcatgcatagtagcggaaccaggcatcgcatgactcggtgattcactataactagtaactaccatcaagcagcatggttcatacaagatctctatgtgccaatgtgcaagtagcgaattggccctctccaattttcaaagttcttgatggtgccacaatagggcaagacacttgggttactcttcttttgaaagtcatggatcttgtccttccataaccaattattgattcaccaagcatcattcgcatcccaactttcaaatgcaggtagtcatcaacaatttcactatcccaacaacgtttgacatcctgcccaagtgggtaaaatcccagcatacaacagcagctcctacccaatatccacccaatataggaggcgcaagggcattgggaacggggaaatgtacattaaaaaagatagcgtcataattcgtcgtcagtaggagaaaattgggggatttaggaacacaaggtaaaagaggaagagtattatttgggggttagtaaattccattgggcttgtatcgcaaaggacgtttacaatatgggcccttccgaacgttaaatggtgtattgacgtagtggataaccaagggataataggtcgtcgttatataaaacaataccgagcaattacttataggacacactcgcgtatacatttcgggatcacaaccacgcgttccatcagttggtgggacctccattccaacaagaggacacggcctcggggcagttccatatccaagtagtatggacattctacgaggaactggaaggcggcaaacaacttaggttttcaacgaactagcttgtgacacacatctttatcctatagaacaaggcacattccaacacgcgtcaatggtcatacgcccagtacaggaagcgttgagcagaataccacacgctgttcctggccccagcgcgctttggcacacacacctggggtcaaccactggaggcatacaacactactggaagggtcctcacacatcgtgcaagcgcaccacctggggtactccaaacaacgggggcaaacacatataagccgacaggcgccgaacgaacgacacaacgaccagaaaagtcaacgctccacaccagcgtacacaccaactgcaggccacagcagaccaacactacacacaccacacaacaacaggcacaacgaccaagacaagaggcacaagaaagcaaacacacgacacgaacgagcaagcaaccaaaacacgagcgacagc

SEQ ID NO: 646071 - DNA, 472 bp, Homo sapiens
cgctcggtaccccttgcttgctcaggtctccctattctctgagacacaacaatattgaaattgggccatttaatcaccctacaatggcctctaaagtgctcaagtgaagggaagggtcgcaggctctcacttgaaatcaaaagccagaaatgtttaagcttactgaggaaatcatgttgaaagccgagctaggctgaaagctaggcctcttatgtcaaccagccaagttgtaaatgcaaaggaaaagttcatgaaggaaattaaaagtactactccactgaacacatgaatgataagaaaacaacacaacctctttggccgggtgtgatggctcacaggctgggcgcagtgactcacacctttgatcccagcattttgggaggccaaggtgggtggatcacctgaggtcaggagttctagatcagcctggccaacatggcaaaactctgtctctactaaaaatagaaaaatt

SEQ ID NO: 646072 - DNA, 312 bp, Homo sapiens
  misc_feature (37)..(37): n is a, c, g, or t
  misc_feature (41)..(42): n is a, c, g, or t
  misc_feature (47)..(49): n is a, c, g, or t
  misc_feature (72)..(73): n is a, c, g, or t
  misc_feature (76)..(77): n is a, c, g, or t
  misc_feature (84)..(87): n is a, c, g, or t
  misc_feature (132)..(133): n is a, c, g, or t
  misc_feature (140)..(140): n is a, c, g, or t
  misc_feature (152)..(152): n is a, c, g, or t
  misc_feature (160)..(160): n is a, c, g, or t
  misc_feature (165)..(165): n is a, c, g, or t
  misc_feature (180)..(180): n is a, c, g, or t
  misc_feature (213)..(213): n is a, c, g, or t
  misc_feature (311)..(311): n is a, c, g, or t
atggagcagcgccgcgtcaccgacttcttcgcgcgcngccnncccgnnngcccccgcatcgcgccgcccaanntgnnctgccgnnnncccagccccgccaggcccgcactccgcgccccggcctccgctacnngtggcanccgggagcgcgnccgcccgnccggngcccccggacgcganaggccaggccaccggcccgcaggagactgcggntgtcggtggacgaggtttccagccccagtacccccgaggccccagacatcccagcctgcccttctccgggccaagaagataaagaaatccactccggna

SEQ ID NO: 646073 - DNA, 109 bp, Homo sapiens
tcaacatttagctacaagcttcatatgacatccccctatgaagcttgatttcttggagttatctttacaaaaaacttctgtcaggtgattaatttcaagcatggtggat

SEQ ID NO: 646074 - DNA, 137 bp, Homo sapiens
aacgatctacaggggaggggacctggtgggagtgtggtctcacctcccttgtgtccaagccccacatttggtgtgttaacgtggggaaaagagtctgatttcacttagaaggcaggctgccagcagggcagccctgg

SEQ ID NO: 646075 - DNA, 389 bp, Homo sapiens
gcgcctctagagtcaccccacgccgaccctcccctcttctctagacttatttccatccttcccgcttttaccctccccacccctccctgggctccaggcgcggccctcctcatcctggaccggccttctcgggcccctcttccttaacgggagagtgcgaatgcagccggctgcccccccgctttccatcagtcggtcgccaccgggcaacggagcccgtcgcagggaccgaggtggggagggagaaacgtccgcaggggcacatccgctgacgacacaatcgatgagcggcacacacgcaagcaggcatggcgctacccatcggccaactgcacaccaaaagggaaccagccagggagtggggatcatagagcgagcgcgagtggaaa

SEQ ID NO: 646076 - DNA, 212 bp, Homo sapiens
ttctgcagtctggaaactctgctctggggcagtgacaccttagtgctctgtggccatacttcgtggctcgtgcctgtaatcccagtgctttgggaggctaaggcaggaggatcgcttgaggccgggagtttgagaccagtctgggcaacatagcaagacccccttctgtacaaaaaaaattagccggtcaacacctgtagtccagctgcttg

SEQ ID NO: 646077 - DNA, 464 bp, Homo sapiens
gggctgtaggaattttgcacgagagatcacacaacctctaacaagataacccccaacctgtgtgagatcgccttcagactatacacgccagatgtgacacacagtgcaacagcgccaatatcttcttctccccagtgagcataggtacaggctttggaaaggtctccctggggaacaaaggtgacactcacaaagaaatactggagggcccgaatttcaacctcaccgagaatcccgaggctcagaaccatgaaaggtttcaagaacttctccatataccttaacaagcagacaggcaggttcaggtgagcaccggcaatgggctgttcctcaacgagggcccgaagctagtggataaatttttggaggaaggtaggtggaccactcagaagactttactgtgaactctggggacaccgaagagggccagaaacagatcaacgctttcgcggaggggactcggg

SEQ ID NO: 646078 - DNA, 137 bp, Homo sapiens
aatggcctcggtccattggcttgggccgcaacgctaactaactatggtgactgctcctatgtctcaaactagcttacaacaaaaacctagtgtatgaagacgacaaaaggtaacgacttccgcaccaaacaccaaga

SEQ ID NO: 646079 - DNA, 432 bp, Homo sapiens
agacactgtccccactttcagttctaaaagcttctgggtctaaaatcttaagttgacagatgtctcaaggtgctttctgctctcactaaaactttagtcattataaaaccttgagggggatccttatcttgctagaacacctaagaaactcaagagatcaccatacgtgtacccttcagactattgctttttgcactgtaaggagcatacaaagtgcctggggatctctttaaaatgcagataccaatttagaagatttgaggtagggccaggtaatctgcattttttaaaaagctgacgccaaggctactgatcagaaaccacactttgaacagggcttcagactctaaaatttagagaaatgaagccacactgagtggttggcatagttggcttgttcctaatttcaagatgccagggggcacagagccc

SEQ ID NO: 646080 - DNA, 390 bp, Homo sapiens
  misc_feature (3)..(3): n is a, c, g, or t
  misc_feature (20)..(20): n is a, c, g, or t
  misc_feature (28)..(28): n is a, c, g, or t
  misc_feature (77)..(77): n is a, c, g, or t
  misc_feature (275)..(275): n is a, c, g, or t
  misc_feature (293)..(293): n is a, c, g, or t
ttnaaatatttgtgaagaanttggcccngtccatggtggcctcgggcccgggggcccccaagtagctgggacccacnggcacacacccacccatgcccggcctaattttttaatttattttttgtagagacagagtcctcactgcgttgcctaggctgctcttgaactccctgggctcaagtgatccacctgctttggcctcccaaagtgttgggcttataggtgtgagccactgcacctggctgtgaacttagtatgtgtatatatgtatatgnagttatatatatatatanaattatatatataaaattactcagaagccatagtatattccttttataggttaagcatttatagaaattataagggaaacattaaaaccctagcaga

SEQ ID NO: 646081 - DNA, 288 bp, Homo sapiens
tcaacagtgctgggcccactcagtgtgaacaaaagcctttgcatcttggtgccatggcatgttattaagtggaaaataattccagcatgacacagaagtgagactttatacacaaagcaagttatttaggtccagattattcatgtcatcccattcagtattgtatcaactacaggcaaagctctatggtagatgccattgggcttaaaaatacaaatgttgcatgatcctctgtaagcagtttatctccaacttaggaaagtcagatatggatcgcactggactctg

SEQ ID NO: 646082 - DNA, 205 bp, Homo sapiens
ctgagccggccagcaaattcaatgcgccacccacacgcttcacagcctctccatgctgagtcagcgcatctcgtgtcgtgtccagtatgggatggtagacgaactggcctgtagccagcaaagtttgctgctcagccgtataggcttggccttctgtctgcatggcagacagcttggcgtattgcggatcatccttgggcgcgcc

SEQ ID NO: 646083 - DNA, 155 bp, Homo sapiens
ggagggtttcaccatgttggccaagctcggtctcgaatttcctgacctcaaggtgaatattgcctcccttggcctcccaaagtgctgggattatagggtttaggccaaccacaacccgacctgcaattttatttttatttttttaattacaattt

SEQ ID NO: 646084 - DNA, 155 bp, Homo sapiens
  misc_feature (6)..(6): n is a, c, g, or t
  misc_feature (30)..(30): n is a, c, g, or t
  misc_feature (128)..(128): n is a, c, g, or t
ggcttngcccttttctgaggcccatggggncttttctgtttgaatggtcgccttcctcatcctcttcgcccatgtgaggctccatggggggtcaccggacctgttgctactgcaactccacaccattncttggtgactggggtgtgttaagcttt

SEQ ID NO: 646085 - DNA, 1064 bp, Homo sapiens
gcccggatggccagcatgcgtgtggtcatggcttcgtggtgcgtactatcctatgcatcacctgcacacatagctgccggtaattaggctgttgatactgcattagcgagtcataccagagctagtccctgagcgcacaatgacctgtgcctagttttccaaaaccgtagatagatgactacagcctgttagggctctgccctgcttgccctgagagcccagactaacgaactacccatcatacagcccgtgacggcgtctacacgtgtaaagtgctggctgtcccaactgttgtcgctgacaattggtgcgagcctgacctgtagctaccacccgtgttgatgcgctagtggctctctgaataaggagagcgttccgtgaataccctcaataagggaactgtattgcactcgcatgggtgcatggggatcatcgtgaggtgattgctgggctgtaagactctacgtgcagctcctggatccttcaggccaccgtatcaagaaccgcgaacgcagagcgagtgtccatctcgagaaggagctccattgatggacataatgccgatgctagtgggatcctatgggcacttgaggtagtgatgacagaaagtgcttacaaatgaatgggtcaagtgaccgtcatgtcacctctgcgtcatgaggaatcctgggggcagcagtgccgtcatcttccttcagggcaagggccctctgatgacgcccctgtctgggtcccccttgcctgggacgcagtctgttgagttccaagcatgctgctacttgcacgagtttgaggctgcccccctcaccgtggcgtagccgaagagggctgcagggatccccagcatggaagaagggaagtgcctacacaccaaaaggcaaaacagaccaccaactccctggagtttccgtcaacatcaacccagaagcgtatggccatccaaacgataagaacttagaccaatgggacacgaccacaagtcccagacacccaaggcgaacggttactaaaccgaagcaccgacaaccccaacacaacagcgggcacagaaaaagggaaaccgc

SEQ ID NO: 646086 - DNA, 326 bp, Homo sapiens
tcgcaatcatcggcaccttgtttcataatccaattcccgctgtaccctgaataaggtggtgatcaatgatgttaacaaaacgaatttaatgtactcccaagattattgcagataggaaaacacatccgctcacaatggatgtgccggtcagcaccattcagcgatgtttttaaacctgctgccacggagcgtgatttgcccaccttcctcccagagttggcccttagctaacctcatccattgaaagctcgctggctctgttctgggcctgcatgggcagcctgcagtccggtatggcttcctggtggggtgccgatgaatagcga

SEQ ID NO: 646087 - DNA, 178 bp, Homo sapiens
ctaagtgttgccttaggccaagacatgctcgattaccctccacctgagcaatggctcttggtgcctcctcctgtactcacagctctaaaggctctctctgtggtgacaattcccagtctccaagctgggccactgccggtgacttgctcatccatatcgcccaccagcgtttccatga

SEQ ID NO: 646088 - DNA, 104 bp, Homo sapiens
agtgcacagcctgggcaatatggtgagaccccatttataaacatttaaaaattagccatgcatggtggtatgcatgtatagtcccagctacttggctgaagtgg

SEQ ID NO: 646089 - DNA, 118 bp, Homo sapiens
gtaatgttttatctacgttattggtagtgacatgtgaacatggccaagacctccacactcccctgagaagaacagtcagtgagaattagatacatctaaatgtgtggcacatgtgaca

SEQ ID NO: 646090 - DNA, 146 bp, Homo sapiens
ccctgtcagcctgccctcatcccatccacgtccacacctgtcagccctgggcgctcgatccacccacgtccacacctgtcggccctgattcctcacccatccatgtccacagacccatgtacatccccacacctgtcatttagatt

SEQ ID NO: 646091 - DNA, 1029 bp, Homo sapiens
gggaatgcaataaatgtagcatcgtgaataaatataacttttataatccgtaaagtggtcttttctttccatttctttaattgttttctcaatttttattcattttttcctttaggacacatttcccttaattggatatctttcccttaaatttctattagttgttttcatctgcccacatgtaattgaagatttaaaaaaaaaattctgatacctgcagtattactaatactgcttaatttcttgaaatgtggaattgctgctgttaatgtcaagcaaaacgcagtatttatggcaaattgtaaagtaatttgaatttagtgctacctcaaaattaactttttaaatactatgttagattcttaacagttaaaggtctaatacatgcatgaggaatggttacttatgaaaggaaaaagaatttgtaagagttatcacctcagtttggaagaaattgaacaaaatgtaaggctgaagaaaacttacggaggtcacaaaagtgatgttttcaagaggaagagaaactgggagggagatacacagtggaaatgcaaaatgaatcaagtatagtggtagccctgagagcttagggactcaaatggaaactgtgtgaagggaaactcacttgaaaaaaaagcatgaaccagttaggccctgacacactgtgtttggccaaagttcacaaatcctgttttaaccctgtcgcttccctgtcacttctctggctttacctctcctgactaagctttttgtttccttggcagtaatttaagatctttctggtacattgcccacaagttaacaactgctaactggaactggcttaaccacttactgctactggaaactgacttagcccaccttgcataatcggagattagggaaaagtatatggcctgtagcaacaatagggccaaaagcttttgctccaaagttacgtccattcatggtccacaattgacaactgctgttagtcacatggacaatcattgagttaaacgctcaaaatcgtcagataatacacactta

SEQ ID NO: 646092 - DNA, 396 bp, Homo sapiens
  misc_feature (396)..(396): n is a, c, g, or t
gatctctctatgaggcccaggctggtcttgtactcctaacctcaagcaatccccctacctgagcctcccaaaaagctgagattacaggtatgacccaagtcccctcgcctctagcattttttttttaactattaaatgggcctcttggtctaaggcaatgctaggtatgatgccataaccatataccagatacttcatatacttttagatactgttgtttgctgagacactagagtcaggaaagtcaaagtcataccttgaataaacattaaatatattaatagtagggatggattgtgttttctctaggatataaggaacgtacaattaacttgttaccaagtagatgttgtatcacatcgacacagcattagtcttggctgctcattggtgggn

SEQ ID NO: 646093 - DNA, 523 bp, Homo sapiens
aagctgttcggtctcggaagtaagtcatcgcggcgtgacgtctgatccaccctcgaggttcctgtggaataactacccttctgaaacatggtttcacccgtatccttctctagaacgggtcgggccgctaccactgtcctggcccggaggggaactgttttctccggaagtgacaacacgctgactaggaaaaggaggaggcggggcagatggggccttcggacggcgactatggaagtgagcctgcatacatgttttggtcgtttgagaagggcggagtgtacctgcaccaccagctgctacgaagtatcaggaccgagactactctcatcgctggtgtcactccgtgttcgagcgacacaagggacacagtgaacgatccttccatgccactgtggcatcatgttagagggagtgcagcacaattaccaaaccaaatccatctttcatccaagaacagtacatccatatgggcacgtgactcaatgtgcattcatgagcgaggaaccaacactatagagcc

SEQ ID NO: 646094 - DNA, 206 bp, Homo sapiens
ttcaactacgccaatgagaagctgcagcagcattatgtggctcactacctaagggcccagcagggtgagaggatggggtgagcaggaggcaggtccttctattgggatcctcaatcccttcctgaccttccagccccaagttccaggttctgattagaagccttttgttccttctcattttatatttacattgacaaagtaatcat

SEQ ID NO: 646095 - DNA, 250 bp, Homo sapiens
caccacctcccacccctagactaggtacgaggcctgcgtgtttaatcgcgtcgaggatacaagcggcagtttagactccgcctggcaggagatgctgaactcacgccactcagcagggtcatggatggcggagcagaccaagatccagtgagctgatgctggtgcataatggagacggcagccaggtacaatgccgccatggtgccgcatgcgacagctggatgaatgaaactcaagagagccatcaaca

SEQ ID NO: 646096 - DNA, 118 bp, Homo sapiens
gtctcggtcattatgctgattcactttggagcctcagttcctttcctcttcactcctgtgtcctagtgattccgagtcattttggtcactgattgttaccgggtatcgagctcgattt

SEQ ID NO: 646097 - DNA, 106 bp, Homo sapiens
tccagccccacattgcacttagtattcgacgtcgaaagaatttacttttaaactttcccagatacctgagctctgtggttctgttgctatggaagtggggaagagg

SEQ ID NO: 646098 - DNA, 877 bp, Homo sapiens
  misc_feature (178)..(178): n is a, c, g, or t
  misc_feature (788)..(788): n is a, c, g, or t
agcgggtctgtccgttggggccgggccgggcgggagtgcaggtgacgtgagggcgcaagggccgggacagtggtggcccgcccagtccaccggcgtgtctcagcggtcgtaagattcggcgcccggcgcctatcccgcctggtgccgcctgacttgctgcctacataatatgcgtagncatgacgttctgacgactgacttgactagtcccagtccccatctggagtagttcctgagatcgtggatgggggagaactcacacgggactgctgggtcgaaggtccctgagggtgtcaggctcacagaggtggtcgtggacatagtgcgggcgtcgctaatcgttcaccgggacctgtcgacaacgggtaggtatggggaaaccaagaccaccaaaggcggacatacatcagacgcgctagttctcgcgagagatccgcgtcacgccccggctgttgacgtggggaagtatcgttgcctaggaacagtaattgtagtcgccgagttacgcttgcaagaatttggcaacaagtggatggaagcgagggactaactggccatggcccaattcacctcggtgggtatgcgccgtgggtagccgaggggagttttcccactgtgagaagtcgtgggatgctgtagcagctctcgaagcacacccaaacgcggatactaaggtgggctatagggtagcgccgctttatccagtcattgctcggtgccctgtagggatggatacctttatggcgcgaatgcttgacgggcctcactggaccttggggatcgcgatnatgagagggagccaatggccgaagggttgcatttggcgatcccatgggaccgcctggcaaatgtggatacgcaaattagctccactaag

SEQ ID NO: 646099 - DNA, 897 bp, Homo sapiens
cccgcgccgcacgccacgacggccctgctggggtgctgggccttcctgccctgcgctcctgcctgacccttcgcgcgctcgcgctcacgcacgtcctgcacgcactgcacacgcttgactgtgcgactgcgctacacgctacgaacgagcgcactcctggcgctacacaacgctagacgcaagcgactcacacggaccgcgactgcactgacacgctagctaccacgagcagaggaagcaagctacttcagctctgcgcactgcgactttaaactggccatcaccacacactaaacgcagcaaccctctagcagcagcacacgctcgcgcaaaaagcctttgccccttcccaacggcccccgcacagctctaacccacgcacactgactgcaacaccctctatcactcaactctcacttggctactaacacacactaacaggagcactttttccctgcagagaacctgactttcaaactgcttctgactgcctttagcatacacgataacggctaatatcactgacctgactgaaacatgctctttctggaaactgaggaactaacagctcaacaacttaacgtgtgataaggagaagaacctgctgcatgtcacagacaccggtgtaggaatgaccagagaagagttggttaaagaaccttggtacccatagccaaactctgggacaacgcgaagtttcttaaaccaacaatgactgaagcacaggaagatggccagtcaaacttcctgaattgacttgggccagttgagtgtcggatatcatattaccagccttccttggtagccagaataaggtaattggccccctccaaacccaaaaaggatttccaggcacaattggggaggcttgactcaataaaatttctggtcattgcg

SEQ ID NO: 646100 - DNA, 830 bp, Homo sapiens
aggagagagatcggtggtgagtcagccaatggtggactcccaggcccagcacccgccgcctccccagactgctgtcctaattctgctgagctgtccctgtgatccagggtctgcccctgaaggagtgaggagatatttgctcatgatgcctgtgaatgtgatgacccaccatctggtgtgcctctgaagtgccctgtgacatgaacttgcttcatggagtgccctgctgagtgatgggtgcccagatgatggtgctacactgccatgtgatcttgatcctggaaccccactgctatgccacgccctccctgagactgtgaccatgaaatcatctgcataggttgcccatcaccttgccactgggccactgatgcctgtgtggacatgtggcctcttgacaaacatgcctgtcaacccctaactgtgggtcatgttggtgtgtgcaatgtgcaccgcaatattgcatgtccaatggaacttggcgttgaaaccacgcggcacatcgagcataagaagaccatcggcacgaggacaatcgcgcagatggaccgcgaaccacaagacgacaacatagagcgagccacaacgaccgggcccaccaaggcgaaacacatgacgccaaaagacaacaaccgcacgccccacgcaacaacacacagaacatcccagcacaggagaaacaaacacagagcacaccaagagacagccgcgcagaggagaagcaggagcacgccagaccagctagccgacagaagcagacagacacacgcaaacaacaacgctccagaagccgaacccagagagacaacacacaacaagacaccaacccg

SEQ ID NO: 646101 - DNA, 1413 bp, Homo sapiens
  misc_feature (879)..(879): n is a, c, g, or t
  misc_feature (926)..(926): n is a, c, g, or t
cttgtaataagtaaatacacgtcgactggtgagtatacgtcacgcgtgtggtgtaattttaactactcgatagtatggttgatgataacaacaacttgccgtctcacgtgaggtgataaaattcttgttgtcgcactccataaagcatccacctggggtttgacatacccagttgtcttatatcgcccatgtgtgtgcggggaagatttgtcttccccgccctttgtagtatagcccctcattatgggtgactgctacccacggggtgtgtgcgaccttggggggagttccacacacgcttttcttttggggggtaaatactccccgccttgggttatgacaaagggggttaattcccactcccagaatgggccaatgttgccccttttcaagggctccctggcggatgtggaaacccctcgcgccctttttgtggatttctaacacaccgggggcgacacacacaccagaggcgcaatttgttggggcccaaataccccaaagagaattgtgcttgcagatgttgcgcctttcttccctcttgacaaaaccccgtgcaagagatgtgttcttctggaattctccgcaggattttataccccttccatagctttatggggaattaaccccctgggggttgttgttggcccaaataaaccactggtgccccagggatgtgagagcccccctccagggagttgggtttcttttgtggtcccgcctttctctgccccctacagccaggcgacaccccctattcactcgttctcctcgtgggctggggagcaaacttggtccaaaggtattggaaacctcggctataaactggcacaagctgagaagagccccacccacacacttggccacacacacacaggnctatatttgagaacacacggtggaaactcgttcttctcccacagatnggaattccctctctcgtggctcttctcgggaaggccaacaggagttgcgccacaggcccacttgttaatgggagttcttcacaccgagaaggcacaaacaccctcttaacacacgctaagattggtggggaacatcatcaaacgccctcgtgcgttcaagccctataccgctaactggcttgtggtgctggccacacacaggccccacagcactcacaagattctgggagatttatagagagggagaaagaatcacttgtaagatgaaactgagagcaaagaagttattcacgtaccacgcacgcaaaggcagaaccacccccacgtgcaccctccctggcctggtttgctgagtggccacgagactctgtttgctgggtatacaccggagacacaacctggtgcgagtgtggcaggtgacccttggcacacgctagaagatttatggcagagctttaccaaataaaaaaaaaactggcttttttga

SEQ ID NO: 646102 - DNA, 254 bp, Homo sapiens
cggaccagacttctgtcaccaggaatagcgaaaacaaattataacatgctaattttttaaaaaagtaagtatctggccaggcggggtggctcatgcctgtaatcccagcactctgggaggccgaggtgggcggatcatgggatcaggagatcgagaccatcctggctaacacggtgaaaccccgtctctactaaaaatacaaaaaattagccaggcgtggtggtgggtgcctgtagtcccagctacttgagggg

SEQ ID NO: 646103 - DNA, 1121 bp, Homo sapiens
tcatctacgtgtgttgctagtcggtttttagaattcgtccctactcgtggcaccgtggcaaaaacagtggtgaacaccatttgtgcggcaaccacgggcttttataaatgtctccaccgtgcctagaggcacgtgcaaaacaaatgtggtttttggaaaaacctaatagaattctaaaaagggttttacaggaaggcgttttacagatgttataactgggttctcccgcgtcaacacaaacagggggttttaatcaggccagctcacacaggaagttctgggagattccccccagttctatgccccgaccaccatcacgcatctttgggtgaaaaccgtgatgaattgactctggaaggcttcaaccaatttttccggaccactggagaggaaagagggaaattgacactctggtgtgacctttcggacacactggaccatcactcagcggtcatcttctcgaacccccaaagaaaggtggactggctgacggagaaaatgagggaatccaacttcacctgtatcctcaaagcatggagacatgcccccgaaagaccgggagtccatcatgaaggagtgccggtcgggcgccaaccgagtgcttaattctacagaagttctgggcccaggggttggaagtccctccacggtgtccctcatcattaactatgatctccctaatcaccacgagaattgtaacaaaacaccagaattgggagatccacggttcgataccgcgcccgcgaagggtttggcccacttaaactttgtaaagaatgacgaccattctcgcattcctccacgagatattcgaccacgtactattccacactcacgattgaatgagatgccgcatgaacgcttgctgatcttaatctgaagcacgcacgatcacgtgggatgagggagactgttcacacctgctgtgtaactcctgtttggaagtatttagatccagattcctacttaatggggtttatcatggactttctttcttcataaatggcctgccgtctcccttcctttgaagaggatatggggattctgctctctttttcttatttacactgtaaataatacattgttctaagtctttttcattaaaaatttaaaacctttta

SEQ ID NO: 646104 - DNA, 125 bp, Homo sapiens
  misc_feature (1)..(1): n is a, c, g, or t
ngcatactagggtgtgtggatatgatgaggtatctttaaaatgtatgtatttaacaaatacttaagtgtattaaggtcatgtagcaaggatttgataaagtttaaataatttactctctaaaaaa

SEQ ID NO: 646105 - DNA, 348 bp, Homo sapiens
ctcctgcccatgtagctgggattcaggcgcatgcaccaggctggtaattttgtattcttagtagaaacggggtttcctatgttggcaggctggtctctaactcccgacttgtgatctgccaccttggctcccgaagcgctgggattacaggcgtgagccaccgaacctggcctgcctgttttaccttttaagatgtgacttagacgccagaggaaagtctaccttcttcctgtcccttaggaatggcttaagtaacaggatgatagggttaagcgttaatacaagcagcatggctcacacatttcctacccctttactaactgcttcagtggataccatattttactt

SEQ ID NO: 646106 - DNA, 584 bp, Homo sapiens
  misc_feature (26)..(26): n is a, c, g, or t
  misc_feature (86)..(86): n is a, c, g, or t
  misc_feature (106)..(106): n is a, c, g, or t
  misc_feature (118)..(118): n is a, c, g, or t
  misc_feature (121)..(122): n is a, c, g, or t
  misc_feature (140)..(140): n is a, c, g, or t
  misc_feature (143)..(143): n is a, c, g, or t
  misc_feature (155)..(155): n is a, c, g, or t
  misc_feature (161)..(161): n is a, c, g, or t
  misc_feature (165)..(165): n is a, c, g, or t
  misc_feature (176)..(176): n is a, c, g, or t
  misc_feature (180)..(181): n is a, c, g, or t
  misc_feature (185)..(186): n is a, c, g, or t
  misc_feature (230)..(230): n is a, c, g, or t
  misc_feature (268)..(268): n is a, c, g, or t
  misc_feature (271)..(271): n is a, c, g, or t
  misc_feature (275)..(275): n is a, c, g, or t
  misc_feature (283)..(283): n is a, c, g, or t
  misc_feature (298)..(298): n is a, c, g, or t
  misc_feature (303)..(303): n is a, c, g, or t
  misc_feature (308)..(308): n is a, c, g, or t
  misc_feature (310)..(320): n is a, c, g, or t
  misc_feature (335)..(335): n is a, c, g, or t
  misc_feature (342)..(342): n is a, c, g, or t
  misc_feature (345)..(345): n is a, c, g, or t
  misc_feature (358)..(358): n is a, c, g, or t
  misc_feature (368)..(368): n is a, c, g, or t
gagctctccgtagctcagtggttgtnccaataagacatcagggattcttcagaagccagccttcagacctctcactgtgttttganaaaattattatcaatttggntttaaaaaccanggnncctgtcaaacccttcccnccntcctcatctcangcctcncgcntgccacttgcntaanncccnntggttcacaaggtcactgcccccagaagcaggcactggaaaganacaggcagctcttcattatcccaagcagaacctctgtnaanttgnccattgangggttcgatttgggnggggntgggntnnnnnnnnnnnagtttcacctttacnggagttntanttcatagtttggngttgcagttngtggggcaacttttcactgtgcttgcacctgggctggggcaggatcctgaacctctcgggggcgtagcgcggaacgtggtcggcttgttggtgaaggggtgccactggccctggatgctagggttgtcggtgtggaagggcttgcggatgcggatcacgtccaagcccgactggtcggccagcttctgcaccagcgtcgagatctcctcgaccgac

SEQ ID NO: 646107 - DNA, 725 bp, Homo sapiens
caatgtgaaggacaggtgcagcaggcccgcgccaggtggaggactccaggccacgttttcctacgcatccactccttccaggacctgtccagcagcattctggcccagagccgtgagcgtgtcgccagcgcccgcgaggccctggaccacatggtggaatatgtggcccagaacacacctgtgcacgtggtctcgtgggaccctttgcccctggaatctactgagaaagccccgcgtaggagaagaagtcagggggagagggagagggactcgatgctgtggccccgtctcttatacattgcatgctcgtgctctggagtcctcaatccggggctctatttcaacacttcattttcttagccgaactcctcccagctcttctgtgctcgtccatttggtgaagctaaaggctctcaaaacgggcaatcacccagttgagccatctctcagcctctctgagtcttggaagaagcctgttctgagcctcaccctatcagtcatgtagagatgagatgtccagaacacctaaatatcttgtcaggaaagttctcccctgcagaatttcttcgtccttgttaaatatcaggaatataggccgggtgcggtggctcacacctgttatcccagcactttgggaggctgatgcgggcggaacacctgaggtcaggtgttcgagaccagtcaggccaagatggtgaaagcccgatctctactaatggatagaa

SEQ ID NO: 646108 - DNA, 442 bp, Homo sapiens
actgcactccagcctgggcgacagagcgagattccatctaaaaaaaaaaaaataaaaaaaaaataataataataataattttttttcctccaaaaagcactttgcagagaacctcagcaaggctgaaaaaaataaaaataaaataaaaataggccgggcgcagtggctcacgcctgtaatcccagcactttggggggccaaggtgggcggatcacctgaggttgggggttcaagaccagcctggccaacctggtgaaccatcatctctgctgaaaataaaaaaattagccaggcatggtgacgggtgcctgtggtcccagcctctcgggaggctgaggcaggagaatggcttgaactcgggaggcagaggttgcagtgagccgagaccataccactgcacttcagcctgggtgacagagcgagactctctctcaaaaaaaaa

SEQ ID NO: 646109 - DNA, 412 bp, Homo sapiens
tcgaggataggtagacaggaagtgagggttgcgtgacgagagcagccgatatgagcctattgtcgtgggccaggatcaggttatgctgggtctattatgctatgtgatacattccagatgttatcctgtgccatgatataccattgtaggtttaagtgtaatagatcactctgactgtagattatgtactgtcacaactagcagaaattggtcgactatttctagttctcccacatctatttgtgagactgcgtggtagtcctcctagtatatgcgattactatacgggatggataaggagtatactagattgtctcggtaggttgggataaattgaatgattgattgtttgatcagtggatcgattgttgggtggaaatataatcggaacttctcctatattcctagcctt

SEQ ID NO: 646110 - DNA, 542 bp, Homo sapiens
ggatcttcagggacagcggttcgatacaaggtcaatatcagcaacaagttctacaactccagtgctgatatcagatacaatgcttcaaggacaacttcttatcggaaggcttattccagttacgtgaggctagcatgaggtgtgtgcattttgccaggggaacatttctattctcaaattaacccatagcagcaaatgctacgcatatgttgagtccgtatagaagcatttgcggtggacgatggaggggcccgactcgtcgtactcctgcttgctaatccacatctgctggaaggtggacacgtgaggccaggatggagccaccgatccaaaccgagtacttgcgctcttgggggtgcgatgatcttgatcttcatggtgctgggcgccaggacggagatctccttctgcatcctgtcggcaatgcccggatacatggtggtgccgaccgacagcaccgtgttggcgtacaggtctttgcggatgtcacgtcacacttcatgatggagttgacgttgttctcgtggatgccgcaagattcc

SEQ ID NO: 646111 - DNA, 150 bp, Homo sapiens
gcaggataatcggttcagcaacaaacagaaggaaactactgaagcagctgaaatttgcagaatgcctagaaaaaaggtggacatgagcaaagtaaatttggaggttataaagccttcggataacaaaagggtaacggaaatcctgggttt

SEQ ID NO: 646112 - DNA, 237 bp, Homo sapiens
cccgcacggcgtaagcgttgcaaccagtgccgggggtaaggctcgtcacctcggtttaccctaagtcgttgatcgacaaatagttttgatctgacaaggacttagaccgagccgactgtgtacttttgatgtgtacttccggggttcgctcatgacaaaagtgagcgaagcgatgaagagagcccccggggttcaccagcggccaggatcgagcatctggcattacgccgatgcggg

SEQ ID NO: 646113 - DNA, 338 bp, Homo sapiens
ttgtcttagaggaccccgtttcgtctcatcactggacacggtttacatgtactgaaactttggagggactcctgcactatcagtacatcacccattactgttctttttttgttattttgagatggagtttcacgcttgttgcccaggctggagtacaatggcacgatcttggctcactgcaacctctgcctcctgggttcaagcgattctcctgcctcagccttccaaatagctgggattacaggcatgcgccaccacacccggctaattttgtatttttaatagagatggggtttctccatgcctcaggtgatcccagcctcaaggtgatcgacttg

SEQ ID NO: 646114 - DNA, 149 bp, Homo sapiens
gagactttacatgggttctgaatgctggtaactagtaaagaaagatcaactgaaatacgacagccagtatgttgtggcaatattcgagacaacacactgtaaaaaaatctttacagtttaaaactgcttcacattgtatacataactta

SEQ ID NO: 646115 - DNA, 129 bp, Homo sapiens
ataggcaggaaacctgtacggttgtgctaaagacaaatccatgctgacctacagtaaaacattgaggtgtttgtatgtatactagtttatgcttttatttattaaaggctactgctatcaatatgaagg

SEQ ID NO: 646116 - DNA, 903 bp, Homo sapiens
ctgcagtgtgaatgtgagtatgaatgtgtgtggtagtgcgacagctgtgtgtgtacgtcgggtgcgtgtgtgcgtgtgtcgtgttagcgtgtgtgccgtgagttagagcctgagtgtcccctgcgtgggttagtgtgtgcgcccgcccggtgccctccgtcttgggagtctgggctgctgctccgctgggctctggatgcctggctgctccccacgagccgggactctccgccgcgcccgggagctgcgcaatcgggctgccaagacgccggctgccacctggctgggccctgttctcccctctcttttctacatgtcttacccgcagctgacagggttcgaaagagcatgaaacggaggagacgttacagcaacgtgtcagctgaaatgatgggcgtagacgcacgtcagcggctggaaatggttctatcaaacatgaaacgtgttaggagattttcctcaagtttcaaatgacgtgcgaatcccgttttccgcgatgccgcagcgcgcgggttttaaccgcagggtcacgcggaacgccggccgggcgatgtgcctcggtctcttgcgcccggccctccctccgggtccgcgaggaggaggaaggcccgtcggtgtgcggaggtcaagcggcgctggatcccaccaaggcgaagagggtcacgggacgccttgaaccgaggtcaccgaggccacggggcccgggaggcccttccaggcaagaagcccggggtgactcccgaacccatcaaagggccgtcccaggaaagaaaccagcagcaaggagcccagggcgcccacagggaagcccccgaaagatgtgtgcgcgaacgtccagagcagtccaaggccctcgaaaggaaacggcctcccagggggggatccaagtgggcgcctaagccg

SEQ ID NO: 646117 - DNA, 154 bp, Homo sapiens
tccattatttgaaatatctctaaaataacaacgaaagaactgttacaaaaatcgctctccaaatcgtcatctctattcgttttccagttgttttctcgcctcagccaaccctttttggtcttcttcagaaagtttcgggaatttcagtttcatt

SEQ ID NO: 646118 - DNA, 1346 bp, Homo sapiens
agcgggtccacgcctccctataagacaaagcgcggccgacgggctccgagcgcggcccctgggttcgaacacggcacccgcactgcgcgtcatggtgcaggcctggtatatggacgacgccccgggcgacccgcggcaaccccaccgccccgaccccggccgcccagtgggcctggagcagctgcggcggctcggggtgctctactggaagctggatgctgacaaatatgagaatgatccagaattagaaaagatccgaagagagaggaactactcctggatggacatcataaccatatgcaaagataaactaccaaattatgaagaaaagattaagatgttctacgaggagcatttgcacttggacgatgagatccgctacatcctggatggcagtgggtacttcgatgtgagggacaaggaggaccagtggatccggatcttcatggagaagggagacatggtgacgctccccgcggggatctatcaccgcttcacggtggacgagaagaactacacgaaggccatgcggctgtttgtgggagaaccggtgtggacagcgtacaaccggcccgctgaccattttgaagcccgcgggcagtacgtgaaatttctggcacagaccgcctcgcctgccgtgtaagaaggtgcaatcctagataacacagctagccagatagaagacacttttttctccaaaatgatgccttggggtggggagtggtagggggaagagctcccaccctaaggggcacacactgagttgcttatgccacttccttgttcaaaataaagtaactgccttaatcttatactcatggcttggagttaccttatattcaggtatatgtgatattttgcctggtttgttaaaattgccccatttagattccttctataattgttcttatagataagtaatttatatatgagctgtgttagtattttttcagtgtgagatctctggattctttcacaataaagctgttgaattttaacaggagtattagtacataaattttctactcaacaattccgagataggattatgcctagtttgtcatatcacagaaaaactccaagttaacttcatgttttggaagggcaggtcgtttttaaagtatttctttttttaactggatgaaaaatcttcatgttaggattaattttcttaatcacctccacactgtacagaggaaactcaagccttaaatgtttaagtaaactctgtctcagttttaggattaaaatacccaccggtggtgtgatgatgccatataccgcagggcttgcttctgtcaagtgtgactctatctcagtaattaaaataagtgctgatctactga

SEQ ID NO: 646119 - DNA, 781 bp, Homo sapiens
gagtattcaaaatgcgcaacacaggaagccatgaaaaagtccttgggctctgtggggttccccacgctcacggctccttgctcccagactcactgacctccgtagccgtgcagccgcatagtatgttgatgcctaaaaagaaccggattgccgatgtatgaactccctgtttttatacggatgggagatcgaagtgtgtggacgacaggaaggatgtcctacatgcactatagtcgcccggtagcctgggagcacaagaatgtgccgcatagccttcaatggtcatgaaggccatgcagtctctctaagtcccgaggtgtacgtgaaggaacagtttgcctggagacatttctactggtaccttaccaatgagggtatccagtatctccgatgattaccgttcatcgtgcccccggagattgtgccatgccaccctacgccgtagtccgtcccagatgacttggcaggtccgtcggtgctaaaggtctggagggtgagcgatctgcgagaatcacaagaggggaagctgacaagagatacctacaggacggagtgctgtgctcactctggtgccgacaagaaagtcgagggtggggctgggtgaagataggcgaattccagtttagaggggattggtcggtggacgtggtcagacactcagtaaaattggatgaggattcttttgcattgaatatagcttgaaggcgaagagagctttataaaacagagctgttggttgacatatatggggggattaaggggtgggggaaaaagccattaa

SEQ ID NO: 646120 - DNA, 209 bp, Homo sapiens
aggggggaaggcaggtggaacaggaggtcattcttaatgccatgtattctcaccagcatttaacagcagagttacagccaaattcatacttagatgacagatcaaaatatattccaaaaagtcataatcttcaagtattctgtcattttggactatccagagccaaagtgaagataaaaccaagatttgaatgtagactccttgatgga

SEQ ID NO: 646121 - DNA, 142 bp, Homo sapiens
acccttttccccaaaaaaggggaaccaagtttgggttttttataccctgtcctttggggggttttttttttctttgttgcctttaaattccatcccaaaaagttgtttgccgtagggggaataaagtttattccaattttta

SEQ ID NO: 646122 - DNA, 338 bp, Homo sapiens
tatgtgccaactcggacagctcctgactctgggtagagaggaagcaactttgtcattgataagagaattcaagtaggactcctttgaataagtgttcaatactatagaatctttacacacttgcgattacatttcctagaatacataactacttactagttgtccttgtatagtagccatctgggacgctgaatttccaggtcagtctccaatgcacgttacgtctagtggtgggacaagatgagttatttcttgatattataaagattgatattttcctgatatttaaggatattaaatttaaattgatattaaagatatttaaatatcttattgag

SEQ ID NO: 646123 - DNA, 84 bp, Homo sapiens
tgtggccgaatttctctaactgggattcgcggtagaggttactttgacttctggggccagggaaccgtggtcactgtctcctca

SEQ ID NO: 646124 - DNA, 109 bp, Homo sapiens
atcccagtgttcctgggtccagatgttctccagccttcctccccagactgggccctcccttgcactccgtcttctctgatccttccttctcctctactcccaggggtca

SEQ ID NO: 646125 - DNA, 474 bp, Homo sapiens
catgagacttactatcgcatcctgctgggcaccatcacgctgatcacggatctctgcgaacgaagccctgcagtcctcaggcacttccgaaaggtggtaccccaactggtacacatcctccggactctggtgaccatgggatactccatagaacacatcatatctggagtccgcgatcccttcctgcatgtccagatacttcgtctgtcttcggatcctgggccggaaccaccaggagagcagtgagaccatgaatgacttgctggccctggtggccacgaatcacggacaccagccgatactgccgtgacatgcggtcctgctctgagacagtactcaccatcatggatgtccgctctgcagctcgcctacgggttcttgctttcgacattcttggtcgcttcctactccaccgtgactcgaacatttggtatctagcccttacatcactgcttccacaggcgccctccgtga

SEQ ID NO: 646126 - DNA, 197 bp, Homo sapiens
gatctcattattagcatattcttggtggtcttggagttctcacaggtgtacgtgtatagtgtgtgtgtgtgtgtgtgtgtgtgtgtgtgtgtgtgtgtggtgttttttccccccaagtccaagtatattcttagagtcacacttgcataacaaagatacggagagagtataaatccctaacaaatctagcgtgagga

SEQ ID NO: 646127 - DNA, 442 bp, Homo sapiens
ttgaaatttttctccccccttagggatttttagttgttcggttgccaaggatccctgatcccattttcctttggggccccccctccccccataggagttaaaagttagggtttaggcctccttttgaaaaagctgcccctttttcagggctgtgattgagggggggcctgggtaaaaatttttctttaaaaaaaggatgacccattttttttttttttccggttatatcccatagtaaaggtggctttttttttttttttttggtcataggggggggatttgttcccctgggccccctggggttttgtaatgcccgggctaaaaaaaaaaagcctttttttttttgatttgtttctgtcccccttgcccttgggggctcttgcttttaacgttttttgtaatttagtttgtggccccttaaaaaaatgggcctagtttttta

SEQ ID NO: 646128 - DNA, 517 bp, Homo sapiens
taggctgtctgcttctgcctctgagggatgtacagattggctgcggagctgagtgcatacaagtaaagtgaggacagtaccgagaaacagtgcagggcaaaggcaggaaagagatctgagctgcctggagatcatctggggtgcggagtacaaagctttgcaagggtgtggttttggaatgtcgctactgtgaaagtcctgacgacagataaaaaggttggaagttgcacactgtacactgttaagaagtagagcttttatcttagaggcagcagacggtttggagccacggaatgaaatgatgaggcgtccttcaggtaatgaacttcagctgcagtgtgaaaggggcaggaagactggcagctgtcaaaactggaacagtccagtgagtatgtgcaggcccgggcttgggcagtgaagagggcagggagcacacatcaatttctgcggtaaaaccttctagaggaagaccagacagagggtcaacagagttgacaggagaacataattgaggatc

SEQ ID NO: 646129 - DNA, 154 bp, Homo sapiens
ccagaaccaaacatatagaactggcgggacctgagaaactcccattgtgtttgtactccagtcgcggctcccccaggatcagccttgaactcctggagtcaagcaatcctcctgccttagcctcctcagtagctgagactacgggcacacaggt

SEQ ID NO: 646130 - DNA, 238 bp, Homo sapiens
gcccccccccccccggggggacaaaaaggcaatttttaggggggcttttgttccaaaggggcctttttggggcccccgaattttttcttttaaggaaaattttttttgggggtttcggggggcccccccggggtttcttttttttttttggggggggtttttttttcccccccccagggggttttttttgggggcccccgtttttggtttccccccaaaagaaaaaatttccccccca

SEQ ID NO: 646131 - DNA, 150 bp, Homo sapiens
atgacctttgatgagatcagcatacacaaatacaaaagtctgagtttttttttatcaggagggataaacaccatgaaataaacttgaataaactgaaaatggaccttttttttttaatggcataggcatgggcgttcccgtttggacaat

SEQ ID NO: 646132 - DNA, 90 bp, Homo sapiens
caccataaagttttagtttcacactttgaatatcaacaaagcagtaattcctaaaatcatgaaaacatgataaagtatcaaaaaaaaaaa

SEQ ID NO: 646133 - DNA, 308 bp, Homo sapiens
tagaggatcactaacgatacagtcagatcgttcttctatctggttgatctaagacttataaaaagggtgatactgaactctgctcctatggttgtgtggttgtctacttctaccttcagtttagtcaatgttgtttcatacacaggttgaatatgccttatcccaaatgcttcggaacagaagtatttcattttcagacttttgtttggatgtttgaatatttgtatatccataatgacatatctgggagatgggaccaaatctaaacacaaaatatatttgtttcatatataccaaatacacatggc

SEQ ID NO: 646134 - DNA, 467 bp, Homo sapiens
  misc_feature (200)..(200): n is a, c, g, or t
ctgggtgatgcatgtgtgagagaggagagcatgctccatgggggagtgtgagtaggtgtatgtgtgatgctcaaaaatgtgggaggctttttgacaaacacgcatgagttcttggcctcataactacgttgaaaaggaggatttcttccaaaattcagcagattgcttggagggtaattgtggcttgctggtgggggagnaccagccctgcaggtgagttagttcagcttctcaatctcactctggaattttataaatgcccctggggggttggcagaaggaaaagggcttccgtgaaatggtgaggcatttcccagagcctctgatccctcactcctgaaagcatctctgctgaccaccattcatccctctgagatggagaagttctgggccttagggagtcttcccatgaaatggatggaggtctgtccctgagccaaggctgggaaacaaagggcagtgagaat

SEQ ID NO: 646135 - DNA, 118 bp, Homo sapiens
gcaagctgtatgcttgataggtagatctctagcaggatcccccgttccaaatcatgaaaatcattaatattactgctgttagagaaatgaagtgagcctacagatgataggatgtttc

SEQ ID NO: 646136 - DNA, 113 bp, Homo sapiens
atcttagttaccgcgtagggtgtactcaaggctttagctacatcaacggtccgattcgtgacctgttgctgggcaaggaccgctggaccagaaaaccccttggcacacaatga

SEQ ID NO: 646137 - DNA, 1008 bp, Homo sapiens
gagccaaatagggtgcaacatgctctgagaggattttctgtataccatgatggatacgcatgttcctacacatccatggacgaccgcttctgagagggatagaggaagaggaccgttcactccgacgttccagctcagcgatgatagacgcccaactttgtattggttacggcatttgctgtgtccaaggaactgtgaacattacaattggtgatgacatggttatctggttgagagttggacaagtgattagttgaagaaattatgtagatcgagtgtgtggctcgtaaacggggcacgtgttagtgataacactttgcgtccttgaggatatctctatatctattattatgatgagtgcaacaataaatgatcacgtaatagggatttgtgtggtatctatcttgttgaagctaaataagaagtggcgtattgagttttgaaaaatcattgagtttacttgaagccaccccacgtactcaggagtacgctagcgccccgtcgagatacgttactaaagatgatacgtagcgacttgatgttggctcgcggttattgcgtaggcagcgaatagataccgaggaaattgttacgccggttggcagcgcaggtatccattgttttcacgcaagaagtcgctcacacgcggcaagtcgcctgtggcaggtggtggactctgtccaccagacataggattaggtgaggaggaggctaattgggagggtattaaatcatgccgatgatcggatattgctggaaattgtaagctccccagcgggctagaagaggttggggatagcctgcatctgttatgcagtaagttcactcctgtggcggaccagtttattatgaacccttactgttatttatcagaattttacttgtgtagctctagaactcccgttacataccagctgtgattctccctgaatttttttacggaggccaaggccaacaaataaagcatacgcctggccaaaaggtgagaacaatgggctggaaaccccg

SEQ ID NO: 646138 - DNA, 379 bp, Homo sapiens
  misc_feature (291)..(292): n is a, c, g, or t
gaaggcactccaggtcgcatcatatcctcttcgcgaggagtccaagctctactcccactaataggtttttgatgacttctagcaagcctcgctaacctcgccttaccccccactattaacctactgggggagctctttgggctagtaaccacgttttcctgatcaaatatccctctcctacttacggggctcaacaaactagtcgcagccctatactccctttacatatttaccccaacacaatgggggtccctcaccccccccattaacaacataaaaccctcattcacnngaggaaaacaccctcaggtgtcatacacctatcccccattctcctcctatccctcaacccgggcatcattacggggttttcctctta

SEQ ID NO: 646139 - DNA, 1582 bp, Homo sapiens
  misc_feature (433)..(433): n is a, c, g, or t
  misc_feature (1202)..(1202): n is a, c, g, or t
  misc_feature (1414)..(1414): n is a, c, g, or t
  misc_feature (1423)..(1423): n is a, c, g, or t
  misc_feature (1427)..(1427): n is a, c, g, or t
caccactgcactccagcctggacaacagaataataccctgtctcaaaaaaaaaaaaaaaaaaaggaaaaaaaaaaaaagaaaaagattttgcctttgagttcaagaacttttacccttttatcccctttggctaagaattggattgttaggaaggttgacatgtggtctacaaaattgcttgcagccagaagcgttggtgttattgttgcctggaaagaagggagtttgcactagggccaggtgattgtgacattcttctgtgtcccaggattattttggcttatacctttccctgtgttggggccccttcccttattaggaggcgcatttattattcgcctcatttcccttactttacaatatagggtttgggcatattagggactttggcttgggcgcccgggtggcgacaatattaggggctagagcganagagcggcgaaatatttatcgggcgcggggcgccgccagaattgggcggtttcccccaccgtttgtttatctcccccagaggcccacttttttgtgcgccgcgagggctagttgaagcgcgaggggttcggacactcacagcttttgagaagcgttcccgcgttgcgatttctcgtggagacaccccagttttcttgttgtggccccaaaccgtgtgttgtgtgtagagaaaccccctgttgtgtctctctatatctatagcacaagggcgcctacccacaacaaatgtttagcgcccaaggtgccattgttgggtttggcgccacggggggcggccctgttgataaacttctcccaaaggcttttgtctgtgggcgaaaaaaggcgccctggaagggcgccacggggaaagacatctcccacctttttgaaaaccccccccgtgcgtgagaatagtggcgacgggacgaatggttgttttgcctaatttgtgatgcggcccccaagagattttctatttttgctgccatgtttttggaacgcttctcccccaggtgctcgtctgggacacgaacaaagcatgtgtgttgagagacctctctccgcgggttctttgccaagaaacgagaagcaatccagcatcagatgatcagcatgacaaaaagctcttggcgcgagagacgactcattatatatattcggcgcgcgcggcaggcgcgcagagaacacaaagcagcgggtgattcttcagtgaacgaacttcggcgcncgcattgtgtggccaccacataagcgctgtgtttgtccctgtagagaccccaccaggggttttttcttttgtgtgttcaccacaggggtgtggtggacacaaactatcgacggggggggagacgccccaacaaaataagagaggagagcggcgcgccgataacataattctatgtagcatagcacgacgcagcgagacgtgtatgacttatnttaggaggngacnacacgtcagacgacgcaccactgactcgacacgtactgtaggcagatcagacgctagatagaccgaccatcgactgcactactgcatgccgaccaacagtcgagcatactccgatagtacgaactccagcagtcagcagtacgtacgctgacgat

SEQ ID NO: 646140 - DNA, 228 bp, Homo sapiens
ttagttgaggacagtatggctgaggtggtattaatttgcagagttctggagcaaatgtagattagttagtgcagggaggttatcaacaaggatctgacatgagatagtcggtgtttgtatgaacttgagcacatctgttaaaactttctaggtccacgtttcctcactctgtaaacacttggggccgaggtgacagtggctcaccgccttgtaactcccacgcacctt

SEQ ID NO: 646141 - DNA, 509 bp, Homo sapiens
  misc_feature (434)..(434): n is a, c, g, or t
  misc_feature (490)..(490): n is a, c, g, or t
tcggggctaatatctcagaaaatatcacttacattgaaaggctggacaaataatttacataccatttcgacacagcattcggtcacaccaggtataatctggatattatcaagtaacggtggatacatttaaggtggaacttacaatttaatacttaaaagccatggttccggtccattaatggctggaagggataaataaaaggtggtacacactcatacaaggaaacatcatttagccataaaagggaaggcagtacggatacatgccacaacagggatgagccttgagaacatgatgctaagtgaaagccaaagacaaaagggcacaaattatggcataattccatttaattgaaaggtccaaaacaggcaaaatcacagagacagaaagtacattacgggtttccaggggccgaggaagggaagactggngagtgatggctaataggcatgtggagttcctttgtgaggtgacagaaatgctctgnaattagacagcggtgatgc

SEQ ID NO: 646142 - DNA, 370 bp, Homo sapiens
  misc_feature (280)..(280): n is a, c, g, or t
  misc_feature (282)..(282): n is a, c, g, or t
  misc_feature (362)..(362): n is a, c, g, or t
gtttcaaaaagaaaaagacaaaagggccaggcacaatgggtcctgcctgtaatcccagcactttggagggccgaggtgggtagatcacttgagatccggcgttcaagaccagcctgggaaacatggcaaaagcccgtctctaccaaaaaataggaaaaattagccaggcatgatggcacacagctgtagtcccagctcctcgggaggcttgaggtgggaggatcactttaagcccagggaggcagaggttacagttgagccaagatcacaccacttgcantnccagcctggggttgacagagcgagatgccattttcaacaccttttttaaaacaaacaagacaaggttgattcccgggttncaccaggt

SEQ ID NO: 646143 - DNA, 362 bp, Homo sapiens
  misc_feature (362)..(362): n is a, c, g, or t
agcagcaccatggctcaacagaagaaccttgaaggctatttgggatttgccaatctcccaaatcagtatacagaaaatcggtgaagaaggttttgaattcacgcttatggtagtgggtgaatctggattgggaaagtcgacattaatcacctcattattcctcacagatttgtattctccagagtatccaggtccttctcatagaattaaagggactgtacagggggaacaatccaaagttttattcaaaggggggggtgttcagtgctgctcacaatagtttatacccaggatttggggaggcgtggctacatgatgtaattgggggctcctaagtcgagtccggttacacgtcatgcctn

SEQ ID NO: 646144 - DNA, 962 bp, Homo sapiens
ggactagttctacaacgcttatgcgtgcacgagcccatgcattggtaataatcttcttcatagtaatacccatcataatcggaggctgggcaatgtgactagttcccctaataatcggtgcccccgatatggcgtttccccgtataaacaacataagcttctgactcttacccccctctctcctactcgtgctcgtatctgctatagtggaggccggaacgaaggaacgagggttgaacgagttataccctcccttagcaggggaactactcccacctcgtggagcctccgtagatctaaccatcttctccttacatctagcagggtgtctcttctatccttagggggcatcaatttcatcacaacaattatcaatataaaacccctgtgcataacccaataccaaagcgcccctcttcgtcgtgatccgtcctaatcacagcgagtcctacttctcctatctctcccagtcctagcgtggtggtatcactatactactaacagagcgaatctcaacaacatcttcttcgaccccggcggaggaggagaccccattctataccaacactattcgtgattttgcggtcaccctgaagtttatattcttatcctaccaggttcggaataatctcccatattgtaatttactactccggaaaaaagagaccccttgggcactcctaggtaggcgtgagctaagatactcaggtgggcttcgaggggttactcggtgtgagcccccccattattttccggtgcggattccgctttacccgggcgccattttccctccggatccatattctttggtttccccgggggcttagtttttgggggtcgcccccggggacactattaagcttttgggtggggctgcccagagacacttctccccggggccgggggtgttaaacccctcaacgcacacgcttgtgccccatgtgtcagggcgtcacggcgct

SEQ ID NO: 646145 - DNA, 158 bp, Homo sapiens
  misc_feature (106)..(106): n is a, c, g, or t
  misc_feature (127)..(127): n is a, c, g, or t
  misc_feature (148)..(148): n is a, c, g, or t
gtcatttattgcatcgaatcaggaaaaaggaaccgcataagcttttgtataatataatataatgttgaagtggataaacggtgggctctcagcagtcactggtatngctgagctgaatatgggaagnttacattcatagtgttgctgntagggtaaaa

SEQ ID NO: 646146 - DNA, 104 bp, Homo sapiens
tactggttcaggggtagtccttgctactggttgcagcggtactggtttgcagcggtactggtttgcagcggtactggtttgcagcgccctcacaagaccctggc

SEQ ID NO: 646147 - DNA, 318 bp, Homo sapiens
  misc_feature (41)..(41): n is a, c, g, or t
gtgaccttggtgaggcactcactctagcagagctctgttcncccacccaatccccatcccatgccattccccaccgtgcacacacggcacaggctggcctgattgaacactggtgacgtaggggcagccattggtttaactcacctctccttaccctttctaccccatcttggtggaggaagtctttcttcaaccccaagcctcttcctaggattgttttgtgtgtttctttaacccaaccatcaaccacaaaccagacttgaaggctcctccagggcacacctgtgagggaaggaggggtggtgagtcccttcctcc

SEQ ID NO: 646148 - DNA, 408 bp, Homo sapiens
  misc_feature (123)..(123): n is a, c, g, or t
tgtgcggctgatgttaatcagcatggccaatgatttgaaagaagtttggatctcagaacaacctttcttgttagtaacatatttgtggcaatacatgccaacctgggcctggtggataaccancaagatggggaagaaaaggattgagaactttaagagtggtgtggatgcagactcttcttattttaaaatctttaagacaaaacatgactgaaaagagcccctgtacttttcaagccaccggagcgagaaatggaaaacatcacaacagcaatcctcttatgcctctgcatcatcaaagactaatctctgcttctactttttaatagctctgcctctgctcccaacatgcactgcaacaaaacataaatactcaacgactgccctgaaaaaacacaacaacaaaac

SEQ ID NO: 646149 - DNA, 773 bp, Homo sapiens
gcgcacgtctattaacactcacggtagatgaatctgccgcagcgtagaaatgctcaagaaccagggggaccacgaagaggagtgcttgtccacgtccattgctcagctcaaagtggtacagaccaagtatgtggaagccaaggactgtcttgaacggtgctgaacaagagcaactgagggtatggggtaggcgggtgagggtaacgctacagtggagaacctgcttctctcgtccacacgcgtcctaacccagttttacttacctgaaacgagaaaatccattgacatatcgtataccgcgttcagtagaaccctttgcatgttagcctgcctagaattgaaaagtacaggacattcctctgctgcctattagcccctgtgatccgttctttgtcacactgatctgtagggtgctgtgccctgattggaactctcgtttaacgtcattacgttggagccgactaaaccttaccccgagggtgtggtctatcacttgctcttcacatgggaaagaattactcgtcccactgacgaagtactgtatcctttccacaggaacggctacctgctgccttctccctttctccattcactcaccccaaagaagcggggagggggaatgctatgattacttcagattaccctgtcctcacaatgatatcgaggatacccttacccatgacttacttatagggagacggaatttcgctctgtcgcccaagcgtgtagcgcaatggttgagaatcttggcgtaactggaagctccggcatcc

SEQ ID NO: 646150 - DNA, 603 bp, Homo sapiens
  misc_feature (188)..(188): n is a, c, g, or t
  misc_feature (208)..(208): n is a, c, g, or t
atggaagccattcctcctggctctttgccctgctccacaagattggacgtttgttgatcgaaaaggttcttggtgagctcaagcaggaagacctggcaacggataacgtcatggttttggacactgggaccaggtttttgtttgggttggaaaggattttcaaaaagaagaaaaaacaaaagccttgncttttgttaaacggtacatngaaagggacccaaccaattgggattgggggacgcccatccccgtggtgaaacaagggtttgagcctccctcctttgtggggtggttccttgggtgggaaaaaaaataatggtttgtggaccccttggacagggccaaggtttaattggttgccttaggaggggcagggcccccccatgttcccgggcagggccttttggaaatgtccttccctcaaaaaggccttaaagggaacaaaacagcttttctaaaaggggggggggggggggggggtgtttttttttttttttttacaggatccaaaaaaagccccgcaaaaattcaaagtccttgcaaaattgtttaaaaagtcagggtttgggaaattaaatccaaaaaaaacatttttaagggtga

SEQ ID NO: 646151 - DNA, 139 bp, Homo sapiens
acccttctgcctgctgaatgagagaagcaacagccagatggggctcgaatcccatgaaatgcaaatgtctaacacaggctttctctatcatacttcacgtatacatatatgcacctataaagaagtgaacactagctgg

SEQ ID NO: 646152 - DNA, 600 bp, Homo sapiens
ctgggagtggtgcttcaggcgctcacctgtcaccatcctcctcaatgccatagccgctcctctgcccctctcccagtggcccgtttacctgaagggctggggggctgcggaccactctcaaggaccccaaatcccgtccgcaggccctcctggaagtagcccttgtacacctcgtcggtgctgtacctggggagggccatcaacaacgagctctgcctcatggagctcagcccagaggatggcccagcccatgaaccccccagccagggtcacttactcacagatgccgtagccacacatgctgccttctcgccagtgacacttgtaacagttgaacttgtcctcagaggcctggggcagcaggcggatgccgaagctgacagcatggttgtgggggtggggatcagccctgacctgagacgcccattacacctactccatgccacccaggagtatccctgcccccaaggagccttccagacaacagggagactctcagaggccctcagccttcctatccttcaaagggcccctctcaggacccctccctccagcctggtcccgagcaccttggagcaccttttggcctgtaccactccc

SEQ ID NO: 646153 - DNA, 212 bp, Homo sapiens
ataatcgcaaccacttgggaggctgaggcaggagaaccgcttgaacttggaaggtagaggttgcagtgagctgagatcgcgccactgcactccagcctgggtgacagaacgactctgtctcaaaaaaaaaaaagaacaatggcggcttctcaaaaccatgggggggtgggtaaaacctggattccccggcgggggggggaacggcggggtgc

SEQ ID NO: 646154 - DNA, 652 bp, Homo sapiens
gaaactgatcacaggcaagtgcctatgctttgttccactggctgtggattttatggaaaccctcgtacaaatggcatgtgtgtcgagtatgctataaagaacatcttcaagaggagcaggaatcagtaggtaatggtagaatgaaagcccacctgcaacctctgtcaggtgaggtctgtctgaatctgttaccagttcaatgcacagatggcagtgtgccaagaagcccagtcagcattagactctacatcttcatctatgcagtccagtccctgtatcaatatcagtgcacttttgatgccagaatctagtagcatcttctcaatgggacagtacatgtgtggacgaagcagtacctgaaacagaagatgtagcaggcttgcagtgatcggagacacagcacagaagtgcatctgaagagctagaagcaagtctcttgaaagaatgggaaacaaaaaaagaatcgctgtgtcatgtgcaggaagaaagtgggacttactgggtttgaatgcggtgtggaaatgtttactgtggtgtacaccgttactcagatgtacacaattgtcttacaattacaaggcgatgctgtgagagaatcagaggagaaaaccgagtagtcgtgggggaaagatccgagatatgaatcctgtgg

SEQ ID NO: 646155 - DNA, 1209 bp, Homo sapiens
  misc_feature (659)..(659): n is a, c, g, or t
  misc_feature (911)..(911): n is a, c, g, or t
ttggcgacatgcactctcttcgttgttcttattatagtagtcgtgcgtccgtgtgtgagatcttcgccctccgtccgtgagatggggcgtctactcttgttggtgtgttcgcctgtggcgcacacccttgtgttttttcctcgtcctctggggtatgcttcctatcgcgcctattgtcctgttactgcttccccgagcgcctatttggccacctgtttgggccacccctctcggacccggtataccctctgtggggtgccaccgccccctggttctcgtgggggttgcccgcggggaagatcccacagtgttaagagggcacccccatcaaggtgtggccagccctatccggttgacacatgtcaacatggcccaaacccttcccatagtccccctttcacgtcaagctcttttctgggacaccccggaagtgaggtctttttggtgaggaaggttgaaggtgattatctggattgactggaccagtgctctgttaaggggcccctactggttgagagattgtgagttccggttcaaacaactctgtcccctgaggtactgctgtctgtcacaggagaaccatatggtcgacctatcagtgggccaaaagaggtccatggcatggccccagccacagtcaggaccactactggcaagcncctggaaggcatctttcatgaagccccgtgacgttctttgaaaggcacgaagtcccacccactgcaagaagcctgctgaatttctagaggcttctgagcccacctcgcttaacgccacccaatgttcaccagaacattctgttgactgcctcacccttgggagtccctgccacccagttccctctgggcacgtggccacatgtcacccacttgaggatgaaagaatataccacaccacgaaaatatgtgccntgtgtttggagagcttcacgccctgcaccacatttgaaactatgtcaccttctcccacgacttgcgctgggtcacgttctctttctgagtagaggacttgactggtaaaggggcacgatgctttttattagtacctgatataaacccaatctgaggggaacactcccttctttgcctgggacaacttttactcttcacggagcttggcatcatggactgttaatagtatgtgattttccccctattttctctctcccaaactgactaaacaccataattttaaaaataataataaaaa

SEQ ID NO: 646156 - DNA, 1300 bp, Homo sapiens
tgggtgccgtggggcccgtgcgtagggtgtggtcgccggcgcgcgtggtgtgggtggtggcgggggggggtgggggggtctcgctggagaggtgtttgtgctcgggggcgcgcatgagggttggggggaatgtgcggtgtggggggctgtggtcgcgcgtgcgcagggggggagtggcgcgtgcccgcggggcatttgtggctgctggttagtggggggtgtgagttcgcggcggtgttccgcaggggggcgcgcggtgtgggggtgctcgattgccccgctggggagcgcggggggagcctgcgtgggaagagggagtggaagggggcgtttcccgtggagaggggggtgttcggtggggcgttttgggggagtcgcccggggtgccgccgggggggcagaggccaagacggttgcgagaggaggacccgggatgcagggccgcgagagcgtggtgagcaccgcgggcggcacaagatctgcgttgcctgagtcctgcgcaaggaaacaccgggacccaagaatgggggagagaggcctttcaccggaggggcccaagagggggtaaaatgggaggtgtcgctataagaagaaaggcgttgtgtagaaattatgcgcagagtccgggggcccatggagacccgcgttctgcgtaccacaaggtcccacgctctgttgtagataggagagaatgtccgtgagacccacgagtatttagtgctaatgtgttgtaggtgagagaagggagaagaatgaatgcgcggtgagacccacattgcacagcgtttgtataacccacggcttattccccagaagagtgttcgaggagaagagcctcccgcgagattctgtgagatgcccacggtgagaggagaaccacgaggcacgaattaacgcacaacactttgtcactaagcaccacctggaggcactcttgcgccttgcgcgcgggaaatcacccacgaaattccgagggggcccaatttattgaaggtctcaatcctttaaaaaagggaatagctcacccactactcctttccacatggacacatccacgtgagggttttaattacgctaggtttcccttccactagagttgtgcctttcacgaaaatgctgaggtaggtttcccacatttcttacctgtgaatgtgttttacccacgcacacctccggacacctcacccttcacggagcccttaaataaaaattaattcacacttggtaaagtgttcaagtctttctgagtcacccccagtagcatgactgatctgccaatttaaaattcctgtgatctgta

SEQ ID NO: 646157 - DNA, 1163 bp, Homo sapiens
caacaacgacctatttagcatgtgcctccgaaccgttttcctcctgacgctcgcctaacaattcacctcctcgctagatagctaagcgtacctgacgtcctaccacctcacaatgcatggtcaagccagcgccacttatccagtgaaccattatcacgaaaaacaactctacctctctatactaagtctccctacgaattcatccttaattataacagttcacgagccgacagaactaatcatattggtatatcattcttcgaataccagcactttatcgcccacgcattggcatatcgatcaccctgatgaggcgaaccaagccgagaacgcctgaacagcaggcacgatagcttccatatatctagaccctagtaggctccgcttccccttactcgatcggcagctaagtttacacgtcagcaaacaccctaggctcactaaggcattgctagctgactgcactctcgagctggccaagaagctatcagaactcctagaactgaagaagttaagtattgactaggcttacgacaatagctttgatacgtagcagatacctcttgacggactccacttatgactcccgtaaagcgcatgtcgaaagcccccatcgttggggtcatagtacttgccgagtactcttgaaagctaggcggctatggtataagtacgacttacaatcattatcaagccacctgagaaacaaataggctaaccttcctggtactattcctatgaaggataattgtcacaagggccttcggccagaacacacggcctctaatcggcaaggaatccttcaaacggacatatgcctccggaaaaagcggtctaattctaacacctgtagagactaccgaggcgagaaatacataaataggcgcgcgaaaataaccaaaaaatagggcagaaacaaaataaagagcaacgagacaaaaactctaggggaacacccccacatatagtcaagaacacaacttcaccgaggacgagagagaggacgcatacgaagaggagatgaagaggagagccggagccatccgcctcataccaccacacaggtggtgagtctcagctgcaaagagggagatgagacaaaagaatagcaacaaaaaacagaaagaatcagaaaaaaacgaagaaaaagaaagaaagcaaac

SEQ ID NO: 646158 - DNA, 657 bp, Homo sapiens
agtggtggctcacacctctaatctaagcactttgagattacactttgggaggccgaggcaagcagatcacttgaggtcaggagttcgagaccagcctggccatcatggtgaaaccccgtctctactaaaaatacaaaaattagtggagtgtggtggtgcacgcttgtaatcccagctacttgggaggctgaggcaggagaatcacttgaactcgggaggcggaggttgcagtgagccgagattgtgccactgtactccagcctgggcgacagagaggacaccatcccaaaaaaaaaaaaaaaaaaaaaaaaaaaatttttgggcccgcacttgggcccctccgaaaaagagttttctaagaaccactgctccgtatggagcgccgcggggcccccagttgggctcagtcggcacagtgtggccataagcggtgttccccagggaagaaccgcgggccatgcaccaagggcgttgagcttttctccacgccattatgaaaagaaaggcccgaggtcgggaaacacgcgaaggttttgcggaaacaaattccccacaatagggaattcttagggaaggccctacacggggacctctatccacacgcggagttcccaaggggaagccccatatcacaaattaagcccccgggccgcgagg

SEQ ID NO: 646159 - DNA, 163 bp, Homo sapiens
gttagcattttttgtttgcttatagacaaaatttctctcctctatccaaatcagtgggccataggcatttattttaagacaaacttttgagtataaacgcctttgtgcttttaccatacacaaatgcacacatattatagggttttgggccagactccacacc

SEQ ID NO: 646160 - DNA, 635 bp, Homo sapiens
cacgccgtctgggaagtgaggagcgtctctgcttggctcctcatatccagacgatgggtggccaagcagagacgctcctcgtctgggatatgaggagcccctctgcctggctgcccagtgtgagaaagtgaggagcgtcgtctgccgcggccgccatcccatctaggcaagcgagaagcgcctcttgccccgacgccatcccatctaggaagtgaggagcgtctctgcccggccgcccatcgtctgagatgtggggagcacctctgccccaccggcctgtctgggatgtgaggagcgcctctgctgggccgcaagcctgtctgggaggtgaggagtgtctctgcccggacgctccgtctgagaagtgaggaaaccctctgcccggccacgaacccgtctgggaggtgtgcccagcggctcattggggatgggccatgatgacaatggcggtatttgtggaatagaaaggcgggaagggtggggaaaaaattgagaaatcggatggttgccgggtctgtgtggatacgaagtagacatgggagactttgcatattggtgactgtactaagaaaaattcttctgccttgggatcctgttgatctgtgacttatccccaaccctgtgctctctgaaac

SEQ ID NO: 646161 - DNA, 312 bp, Homo sapiens
gtaaagcaagactacatctctacctcaaatttatttatttattcatttttgttcctatttatatttttagacagagtcttgctctgtcttaggctggagtgagctatgatcgcaccagcctggcccacatggtgaaatcccgtctctactaaaagtacaaaaaattagctgggcatggtggcaggcgcctgtaatcccagctacttgggaggctgaggcgggagaatcacttgaacccgggaggcagaggttgcagtgagctatgatcgcaccactgcactccaccctgggccacagattgacactgtcttc

SEQ ID NO: 646162 - DNA, 139 bp, Homo sapiens
  misc_feature (134)..(134): n is a, c, g, or t
tggtatcagtactgatcagctgaggaggaggatgaggacgaggaggatgggaatagcggctgaccttcctggtggggctcattcagaagcaccgacggcggcagaggaagattgcgcgaggaacatgcacacancatcg

SEQ ID NO: 646163 - DNA, 685 bp, Homo sapiens
  misc_feature (187)..(187): n is a, c, g, or t
ctgttgctgccgggcagtgaggcccagcccagcgccccgtccaccccgcggcagctcctcgcctcagtccgcacggcccgtgggaggaaggccaggctcgggggagcctcctccagcccggccgacccggactcccggtcacctgacccctcagcaagaacagcctgcctggtggccttctggggcnaggacccctggtgggcaacgtagccacaggaacaggccccgtccaccgcctccacgccgcacctggaggcctcctcgcaggcccgtgccccgcctccctggccgcgccgcctccgtgtagtcttggcctcctcaggctgcctcccgtcctctcgtctcacccgcgcctcccttgcctcatctggggcggctgtgggctctggcgctcctctctggctgaggtggaaacagagacaccctgtggcaccagagccttcccagcaggccaggccgctgggctgggatcagtgttatttatttgccgttttaatttatggattctccgcacctctgttcagggaagggcggcggccacatcccctgccgtctgcgcgtctcaggcagtgggggggctggggccagggcgccctctgaggacagagctggtggggcgcgggggggctggcgagctactgtaaactttaaagaattcctgcaagatatttttataaacttttaa

SEQ ID NO: 646164 - DNA, 111 bp, Homo sapiens
ctcaccaagaccctgcctttctcatccttcccagcactcaagagacagccttcaaaagcacttctagatgaagagcagccctgctttcccgtcccatcactctgttattat

SEQ ID NO: 646165 - DNA, 495 bp, Homo sapiens
gttcttataatattctatatatcctatctaagatgtgttgtcattcaagtttaaatgtgtgcatgtacagtccccatcagataggcgtatagaacatcccactctcctttactacatgtagagaaaatgcctttgttgtcatgctccaaatcccacactgggctgccacctgggagtgctggataccgagaaaggtgtccttacccagaggttctgctgtctgccatcagacgacggtatgagcgtgctgtgaggatgggaagaatgggttcaagatcatcatcattcatcacaaggggacactaaatagaagccttaacctgttgtacttgccaaaattgagaatcagagatgtgtaaatgcagcaaattaattataatgtccgttgagattcgctttttgccaagtcgccagagtctgtatccacatcaggtcactgtaactaatgtcattatcttgtaccaactctatgtcataggctagggaagctcatag

SEQ ID NO: 646166 - DNA, 342 bp, Homo sapiens
aagtcttctgatctcttccttctccttcctcaggctgaaggagtctctccctgcactgaactgcctggtggtggggaaagagtgaatgtgaacactcctgtgattactgcatgcaggtcttgcactggtttgtatctcaatgcccacttgcctcagagaccaatgccgtaccacggcttttccaaggtacaacattctctgtagcctgactgacattcaaacttatttagagccccaggacactttcatcagcctgtgcatattaggactcaaataccttcctctgaggtggaacgttcccctctgccccaaggctgttataaatgctaccctccaggaaac

SEQ ID NO: 646167 - DNA, 240 bp, Homo sapiens
  misc_feature (1)..(1): n is a, c, g, or t
ngggttcctctcccttctcccttctccttcttcttccttcgtcaccgtcttctccttcttcttactttcttcttccttctccttccttcgtcttcttctccttctcctcctccttccttctccttcgttcttcttctccttcttttctttttcttccttcttcttcttcctcctctccttcttcgtcttttctttcttcttctccttctttcttcttccctctcctcctccttcttcttc

SEQ ID NO: 646168 - DNA, 1198 bp, Homo sapiens
gtggagagggggcgtgttgagctggaggtctccatgcctcgttggggagcacggagctcacgtacccacagcagcagttgcgtgatgacgacgatgggcgagctctggacgaccaggtggacgtggggagctgcagctgctggtgtcctctacgactggatgtcgatgcggacccagatgatcgcgacatggtgccaaaagcaggagaacggtagccacgtcctggagcctgcacggctgtgcccacagctggcgtgcccatgatggcatccatccgacggtgctcagcaggctgccacgtgaaccacgtacgctgctcagtacattgtgcagctgaatcctactgacgtctgctgcatccatcccatgcaagaccagggtatcaacggcaaacaggctctagcggaacccccagccaggactatctgcaccatacaccacggagcaccgctctcagggctatcgcacaccctacagcaaccctccacacctgcatctgattcccatcacgcttacccgcagaaagagtcccgccgcagggccttgcgcacggaactcgacgtgtcgctattcaccacacgcggtttggccgtgtcgatgtgccaaatagcacggtccagaacccaaggggttcagctctccacagtggaacaagcacggttccacagtaccagaagacgcgcaacagcagggaacagcgctggctgtgcccagtgttagctcagtcggattgcacagaaacactcgcatgcacgatgattgggcgcccaagagatacaaggccatggacccaaggctggcgcaactggcaccacacgggagcggaacaggcgacgggacacacagccctgcgccagcaccaccgcaaacacaaagccagacacaccacaccccacaaagacccatccgcgaggaccatcagggaactccacatcgagcgacaccaaaacattaacccaacagaacacgccatccccatgtatcccacccaaaccgccccttgcaccgaccatgacacaccctaacgtccgctcattctacccactccaaccccctcgtacgaccctcacccaccacactgcccacaatcccacccacactcactaccaactcaccccctccacaatatctggccccacccccactccccccacatgaatcaaccactccaaactcaaatcacatccacaactactcc

SEQ ID NO: 646169 - DNA, 137 bp, Homo sapiens
gcacaggaggcggtttcagcgcttcggagagttgcaggtcacttttattaggaccagcttcagcttccagtgttgaaaacttgatttctccaacagattctaccccagctcttctctctgccattgtcagccctttc

SEQ ID NO: 646170 - DNA, 101 bp, Homo sapiens
actgaagaaggagagtgaggctgtgccagtggcagcataaggcccatatcgtacaggacagactatggagtaagacccgtgctgagactggagactgccat

SEQ ID NO: 646171 - DNA, 762 bp, Homo sapiens
  misc_feature (56)..(56): n is a, c, g, or t
  misc_feature (77)..(77): n is a, c, g, or t
  misc_feature (88)..(88): n is a, c, g, or t
  misc_feature (90)..(90): n is a, c, g, or t
  misc_feature (105)..(105): n is a, c, g, or t
  misc_feature (107)..(107): n is a, c, g, or t
  misc_feature (115)..(116): n is a, c, g, or t
  misc_feature (123)..(123): n is a, c, g, or t
  misc_feature (126)..(126): n is a, c, g, or t
  misc_feature (130)..(130): n is a, c, g, or t
  misc_feature (132)..(132): n is a, c, g, or t
  misc_feature (138)..(138): n is a, c, g, or t
  misc_feature (145)..(145): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (157)..(157): n is a, c, g, or t
  misc_feature (161)..(162): n is a, c, g, or t
  misc_feature (168)..(168): n is a, c, g, or t
  misc_feature (196)..(196): n is a, c, g, or t
  misc_feature (205)..(206): n is a, c, g, or t
  misc_feature (219)..(219): n is a, c, g, or t
  misc_feature (280)..(280): n is a, c, g, or t
  misc_feature (510)..(510): n is a, c, g, or t
  misc_feature (521)..(521): n is a, c, g, or t
  misc_feature (528)..(528): n is a, c, g, or t
  misc_feature (540)..(540): n is a, c, g, or t
  misc_feature (664)..(664): n is a, c, g, or t
  misc_feature (666)..(666): n is a, c, g, or t
  misc_feature (732)..(732): n is a, c, g, or t
acaagtttttgtttttatagttcctggtacacagctaagtttatcacgaaagatanaaatccttttaaacaaatccngcagggaattngngaggcaccggctcgngnggagacannggagggntgngatngngcaatncatctgngnganggnttcnatcnnaatggncatcattttttccatttaagtatatttnacagaactnnaataaggcaaganaaatttgtgaaaaaagatgtagatacaaaaatgatgtaaactaataatttatattaaaaanccccaaagggataacagtggagatgggacagctcaaacaatgcctttttttaacctaaaacagaattgtgcacaagctgaagatgacaaacaacttctagactctgcacagttttggtttttttttttaacatctttatattacatgttttaaatcatatcaggaatgcaaactagaactgcacactacttcagtggaaaaaagttcaataaagtgcaatttaaaaaaantaatagttaanagtggcngcaatccctgcntttgtgtttgaaacaaggatctgagaaactttatcaaaaaggtaatgaaggcaaaaattggcagacatccagcatcttgtttctttttaaaacaatgtggatgataagtaatttcatgattaanantgaatcttttaaataaatacattgtatctgacatttgcactgactgatttgataaatctttaagtnaacaacggctttactacactccctgtagcc

SEQ ID NO: 646172 - DNA, 549 bp, Homo sapiens
  misc_feature (429)..(429): n is a, c, g, or t
ggatacacaggccagcaatcataggaactcttgcacgaccgcactccaactctgcgaggacggtgcggagcatgactaggagagctgctgagcgttgcaataccagcgaatccgttcacacagtgcatgcatacgtagacacgctgtgcagcctggaccaaacacagggacggcatgtgcctgctcatgactttttggacagaacgtgttgtctagacgacatggaagccttactcagtcgactggggctggacatagagaatggtctaaactgatgtggtcatgttcacaagcatactcagttaacataggaagcaactagaagcattgtggaatcaagccactgagctaactggaagaccttacagaacgatctgggagcgatgatctgaagagtagctaacagacacatgtagggctcacataatnttgtgtgaagcgagcctagttcagagccaattggtcataaccaaacgaggactggttgtactgtatcgctgcgctaaggaacagttagtagtgcggtcatctcacatagacttgtttgtg

SEQ ID NO: 646173 - DNA, 1045 bp, Homo sapiens
gtgctgccagccctgcgccccgcattgcttgctgcctggggccaggcctgtggagctgggcttcgccgagtcggcgcctggctgtgggactgcgcagcgagcagttccccagcaaggtgggctgggcggccgggcattgctggtgctgcggccgggctgccggtggccccaggccctgtgcctgcgagctgtgcgtgcgccctgatctccttcctgctgcaggtgtatgcgccgctgcctggccgcccggacgccttccaccggtgcatcttcctcttctgctgccgcgagcatccgtgctgtgccggcctgcggagtatacaggaatcaactacccaggaaaaacgatttacactcatatgagccaccttctgagaatcctcccccagaaacaggagaatcagtgtgtctccagcttaagtctggtgctcatctctgcagggtatgaggctgttataggccccaaaacgtgctccagattgccacaaaagcatattactgcacgcacggcagcatcagaccctagacttggagattgggacataagcaggcttgtgcacaaccaggatcatcgtggaaccatattcaattccacgagcacaatcttcctttaaccagaattttgcaacattgtaaatagcacaccagaagcatgagattcatgcgtgaggttgtggcaacagtgaaagaatacgactccaagcagcactaaataggcgaacgaccaagcagtcaaacaatacaagatcaagaacacaaaacaacacaagatgaccaagacacacacaagagaggaaagtctaatattagagagaaagcctaacaaggataaacctcacaacataaggggaacgacttcaacacagctaacactactacaaaacggcacaagaaaaaacagaaataaacaaccaaccaaagaagaccagatggagacagaaaagataagacaatagcacagacacaacattgagcatgacaaaggacggacgacaggaactaaatacacaatgacctacacacgaccaaaaacaagaaacacaac

SEQ ID NO: 646174 - DNA, 277 bp, Homo sapiens
tggagttgacctggtcttcctggcttgctctaggtctacttcaaggggaaaaagtcttgactagacataaaacctttgcgctgcgatagagcgttaaagtatacaatgaaatgctatacaagttgaatgctggccgagcgcagtggctcacgcctgctatcccagcactttgggaagctggggcaggtggatcacctgaggtcaggagtttgagaccagtcctggcctacgtggcgaaaccccatcgctacaccaactagacctgcagcaagccagg

SEQ ID NO: 646175 - DNA, 615 bp, Homo sapiens
  misc_feature (239)..(239): n is a, c, g, or t
  misc_feature (258)..(258): n is a, c, g, or t
gtcaattgtttggatcagagaaatttcctgacaaggtatatttgttttctagtgacagaaaggcaaaggaacaagtcctagttgtgtgttgtgttgaatactaaatttaagatatgtcagctgctttcaatgagcctgggcttctgttatgcttgagcattggaactcgagcttccagagaaattgaggtcctcgcttgtctctgccttcaagaaacaatgacctgattctgtctttanaaaaaaaaatctcagaatncttttttggttggttttttttttttttttggagacgagagttctcattctggtttgcccaggttggtggagttgcaggggcgccatctcggctcacttggaacctccgcctcccaggttcaggcaattctccgtgcctcagcctccccgagggtagctgccacttacggggtgcgtgccaccaccacgccgggcataatttggggtattttacagtaggcagcacggggtttcaccatattagccagggtgggtcttggaactccgtaacctgtgatccacccggcctcggccctcccaaagttgcgtgggaattgcagggttgagccacaccttgccgggcacaaaattctcagat

SEQ ID NO: 646176 - DNA, 295 bp, Homo sapiens
  misc_feature (12)..(12): n is a, c, g, or t
cttagctacctnacatgtgcttagtacacttacattactttatagtggagcaaatcatctaacacaaagccagttttataataaagtgctgaatatctcatgtcatttagtgaatactatattgaagtgaaaaacagcatggctgtgacaggtactcaaagtatggtttcaacttaatgtgtatcacttttgtgccatcataaagtagaaaaatcataagctgaaccattgtaatcggggaccatctgtattaactttgaaaactgatgtaaatgcaaaattatcttctgtatat

SEQ ID NO: 646177 - DNA, 361 bp, Homo sapiens
caaatccatcagacgtagaaatgataaatgaatattaaaaatcaatatggtggccaggcacagtggctcacacctattatcccagtactttgagaggccagagtaggaggatcactgtgaggccgaggagtgtgagaccagcctgggcaacataacaagacgttgccatctcgtacataaattaaaaaatgtgaagggatgtgctaaaacttactttctgtctcccaggatgatcagtcttgtgtctccgctagggtgtcgtgtcgctcccgcatctctgtggatgaccagcgtgcctaaggcgggaattccctagatcccagttatatacaccgccacccaccctgttggacttacttcc

SEQ ID NO: 646178 - DNA, 179 bp, Homo sapiens
tccatttctaaactgtgtgctgctttgtgatgacggagatcataaaaaacctatcagagacaagagctgtttgcatatgttcccatgcaatagttgtttcccagtttaaagcagctttctatatgagagatgcaaattattaagttgttccaatacaataaaaaaagcatctgtttttc

SEQ ID NO: 646179 - DNA, 150 bp, Homo sapiens
gatacacacatacatacagatacacagatagacatatagacttagatagagatacccagacatagacatatagcatagactagagatagagttagagagccaagacagaggcacacttaccccaagaaaagagaaatagacttagcaaaa

SEQ ID NO: 646180 - DNA, 150 bp, Homo sapiens
tgatacgaatcgagctcgtgtacccctagttttagaagtttcaatagcagatttctaagatagagacctattatcgtatgaagtaggagaggagtaggttcaaatttgtggtcatgtgaagagtagagacgcgggttttgcaggttcctg

SEQ ID NO: 646181 - DNA, 393 bp, Homo sapiens
  misc_feature (244)..(244): n is a, c, g, or t
  misc_feature (303)..(303): n is a, c, g, or t
tatgggatgtttataatgaattttttttggaggcgggtacacctacaagtttccctttttactttgccttacgaagaatactgtctgatagaatgaaaaatgatttttacatttcagaaaacccataacagactttgcctttgccctgaggcaagggtttatgtaccccctaggaattactgttctgtccaacatagtagccattagtcatatgtggctatttaaattatgaaaacatattgtntatgttttaaattataaattgtagtcatgtgctgcatatgccaggggtctcaaaagatngtaaattgcttttattttttatttttatttttcgagatggagtcttgctccttcgctaggctggagtgcagtggcacgttggactctggg

SEQ ID NO: 646182 - DNA, 121 bp, Homo sapiens
ctaacgatgtaaattagaattgcgggcatttacagccaactcaatgatgaacagatatttccttgatgcctggtacccgaagctctgacattccgtaatcactgggtcctacgctgatttc

SEQ ID NO: 646183 - DNA, 122 bp, Homo sapiens
aacaaaaaaaaaacaaacaacaacacactacctggccgatgattatgtgtgtgtgtgtgtgtgtctgtgtgtgttgtgtctctctctctatgttgcccaggtgtgtgctgtgtgtgcatgtg

SEQ ID NO: 646184 - DNA, 111 bp, Homo sapiens
gtaacggtgtcggcgcacacgaggtcttgagtcagacaagtcagctcagcacttactagccatcgggaacttggacaaaatagctgatccctccaagtcgtaatctcatcc

SEQ ID NO: 646185 - DNA, 109 bp, Homo sapiens
taatggtaaagcttaacacaccccagcaccaagaatggtgtggagttgcagtaaaaacaggccggtgaccccccatggagcctcacataaaaaagaggatgaggaaggc

SEQ ID NO: 646186 - DNA, 815 bp, Homo sapiens
ggagtggttttctgaaaagatcaacaaaatagatagaccactagcaagactaataaagaagaaatagagaagaataaaatagacgcaataaaaaatgataaaggggatatcaccactgatcccacagaaatacaaactaccatcagagaataactgatgaatagacccgaatagacctgaataaacacctgaatagaccaataacaggttctgaaattgaggaaataattaatagcctaccaaccaaaaaaagtccaggaccagacggattcacagccaaattctaccagaggtacaaagaggagcaggtaccattccttctgaaactattccaatcaatagaaaaagagggaatcctccctaactcattttctgagtccagcatcatcctgataccaaagcctggcagagacacaatgaaaaagagaattttagaccaatatccctgatgaacatcaatgcaaaaatcctcaataaaatactggcaagatgaatccagcaggacatcaaaaagcttatccaccacaatcaagttgtcttcatccctgggatgtaaggtggttcaacataggcaaatcaataaatgtaagccatcacataaacagaaccaacacaaaaaccacatgattatctcaatagatgcagaaaacggtcttcaccaaaaattcaacagccttcatggtgaaaatctcaataaataggtattgacggaaggatctaaaattataaaagtattattgacagaaccaaggcatatctatgaatgggcaaaacggaagattcctttgaaacgaagagaaaggatggcttttaac

SEQ ID NO: 646187 - DNA, 291 bp, Homo sapiens
  misc_feature (199)..(199): n is a, c, g, or t
gctctgcgggtttgtagggctgtgttgacatcaaggatctaccagtgtctgagcagcaggagagagcttcacgctggggctagcaggacttcttggcgagggagtatttaactcttggagaactcctcatgcaccctgtgcttggagtccctgagggaatacttgaccggcagtggctgatttgacacccgtctatgcncttcaacaagtggcaacgtagaagcggttccatgactctgcaagactgcctggggccaagcagccctgatttcagcaagctaagtgaaggct

SEQ ID NO: 646188 - DNA, 189 bp, Homo sapiens
  misc_feature (76)..(76): n is a, c, g, or t
gacttagaggatcccggctcttctggaccttaactgggtactgtgcctgggcaatgcgtctcgctggagctttgcntccttctactgggcttccacaagccccaggacatcctaacttccccttaatcttgcttcatcgcacactccgttaccacacgtggtccttggcatttggagccctctgtctga

SEQ ID NO: 646189 - DNA, 628 bp, Homo sapiens
  misc_feature (307)..(307): n is a, c, g, or t
  misc_feature (389)..(389): n is a, c, g, or t
gctatgtgcttggctctggacgctcccgctgtctgctttctgcccagagagaagattctctaccagtatcacctttccctttgtccgttgagtttgtgctcgacatgccccaacacctatctctctttcccttcttgggtgtctttgactgggagggggcatgtgttgggtgagcccctcccgggttctcacactcgcctggtactttaactcacaccctggtttcgtcgtagccgcccatgtctcgtcgttctcgtgctatagtgtgctcgtgtatagatcatgtgcgtacagtccctctcccaanttggcttgaccagaatggccttatcggtgctgttcgtgcacgtcctatagttgtgatacttgtggaagagcggtgcacgtcnttggtgtccttctgaacatctcctcactattctgtgggtctacagtcttggtgcatagcagagcaacagtatgcggtgcagaggatagccctaggaagcgactactatgtaatccaagcatagcacgaggcaacggggtgtcaacgtgatttcgatattcaccaaccttgataggtgatgcttggaccaccaatccactattcgcattcgtaacccataatgtgaactctactttattc

SEQ ID NO: 646190 - DNA, 303 bp, Homo sapiens
cttaaaagcccccccctttttttttaaggggaagggcccagtcttttcccaagtccacacagggggggggaaagcattgtttttgtgtaaattatgaaaggccaaatttttttaattttggcccaaaaactttttttttttggtttttttttgaaagaggggccttggggcccccccttcccccttttttgtcccccaatttgaaaggtatgaagggttttggtttccctgggggggggggggggcagccggggtttccttgtaccttgatttgagaccagttgaataaaagggcccccctta

SEQ ID NO: 646191 - DNA, 864 bp, Homo sapiens
  misc_feature (691)..(691): n is a, c, g, or t
gacgcgagttcccctaatgatagaagagcttattcacctttcatgatcacgccctcataatcattgtcgcttatctgcttcctagtcctgtgtgccctttgcctaacactcacaacaaaactaactaatactaagcatcttcagacgctcaggaaatagaaaccgtctgaagctatcctgcccgccatcatcctagtcctcatcgccctcccatccctacgcatcctttacataacagagcgaggtcaacgatccgtcccttaccatcaaatcaatggtcagcattggtgactgaacctacgagttacaccgactgacggcggactaatcttcaacgtcctacatacttcccccgattattgctagaaccaggcgactgtgactcgttgaacgttgacaatcgagtagtactcgcgatctgaagcccccattcgtgatagataattacatgcacaagacgtcttgcactcatgagctgtgccccacattaggcttaagaacagagtgcaatgcccggacgtctaaaccaaacacttacaccggtgcacgagcgggggtatactaggtcagagctctgaactcgtgtggagcaatcaggagtgttcattgcccagtcgtccttatgaatgtatttgcccctacatggaagttctgttgaaagtagcgggcccgtatttagcccttatgaggnatcgccctcgtaccctcgtgctaagaagcaaaatgtgaccaagtaactaatctaattaaaagaaaaacggggcgtgcatggggggcggaggaagacacgggaacacacaggggcaggggagaactcggtggccaggccccttattgtgaaggggggaagtgtgcggtcgcata

SEQ ID NO: 646192 - DNA, 304 bp, Homo sapiens
ggtcctcagaggttggggagagccccgaagttgagaacaagtaagtgaacagttatagtatgaacgattgttagagacagctaatcacaaacaacctgcgggcacaatgacctcattccacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 646193 - DNA, 349 bp, Homo sapiens
ataaagcagtgtcggctgctcacactggagtgaaaaattaatgatgtatccggagaatatccgcacagcacaaacaggacagtcgcaccatgaaagtcacaagagtagtacatacttgccgtggattctgcctctgggcatataattcacaggacatcttcaacacttcttccttttgagtcagtcttttctgatttttctaccaacatcttttaactaacaagttttgtaaatcagtgcttatccaaagtataagtcatttgtagcgacaatttggcaagggcatctcaccaaccatcttggccattgcacatagtgacctgactaatggtacacgttgtaagcaaaa

SEQ ID NO: 646194 - DNA, 196 bp, Homo sapiens
accggatggccgaggcataaatgcagcatgggtcgatctcaaatatagcacaacaggctcatgcacatagtatcctttcggagacactccaaaacatgaacgcaacgtctatattgtactagatttgtttatataacagacagtaattgcattggacacccgactccgagtgaggttgtcaccacaaaaggagagg

SEQ ID NO: 646195 - DNA, 224 bp, Homo sapiens
atgaagttcaacgttgatgcattcaagagattcaataaatatatcaacaccgattgcaaagttccagggtatttcctgaagcagattcaacagcttccttgggtggacttccaacattgcttggtgcgcttgttgttcacttctgttccctggaccgatttgaaaaccaggtggatattgaaagttgccgaggtacttttttgattgccgcctgctcgcctaca

SEQ ID NO: 646196 - DNA, 345 bp, Homo sapiens
ccccccccccccggattttatttccgggtttcccccagagggccccggggtttattttaagttttcccccccctgcgccttttcctttttttcccccaggcccttttttaaagtgggatggtaaaggatgggaccggccgtttttttaccaaaaattgttcccccccccccccgggggtttaaattgggaaaaccgggtctggtttggtttccccctaaacccccgcccggctttttgttaaaggcccctaattttttgtttgggtttaggttgttttcccccaacctgggttttttttttttttttttaatttggggtttaaaattaaaccccccccgggttta

SEQ ID NO: 646197 - DNA, 110 bp, Homo sapiens
tcgaatacgacggtttctcaacagaagtggacatggcaaccgggattcaatccaagctcagcctttgaactattcgaactgaatcttacccaagctctactggtaagtaa

SEQ ID NO: 646198 - DNA, 775 bp, Homo sapiens
  misc_feature (713)..(713): n is a, c, g, or t
acggttcccgcctaaaaccgaaggcctgtgctagtgggccccaaaccgaaggcccggtccaaacaccccaagggttgctggaaacgctgccatgcgacttgctatcgaggagacagcactggtggagtggtcgcccccccctgcaggcactgagggagacctgggcaccacacctgaaaagtggaaagaaaccgttccccacagagggcacaccacacataggaaagacgccgggagaatgatgtgggggtcacacattccccacacacagcactaaatgctgtgagagtatcctgctgcgtttttataccccacttcacatcacatttgttaccaccactattttgttaaatgggaaaattccacatgtttgtccctctattatgtgcatgtgctgagatgtgcaaaccaccagcctgtatcaaatactgtttctggctttaaacaacgattatttgggctcgcgttcccccggtgcttaattaaccataaattctacacccacctcttggggaccccctctacgctcccacgaaatattcttcctgaggcccccccacatgttacgaccccaccctaggccaccccgcaagaactgtttttgccccgaaatgccaccaaaacaccctcaattcatgtttatacaataattatgcgatccgtactataatagacctctattacaaatattctgtacgaatagacttctcccnagaggatatttaactacccactaggtattctctattcgggggtgctgagacccatgcccccc

SEQ ID NO: 646199 - DNA, 170 bp, Homo sapiens
  misc_feature (43)..(43): n is a, c, g, or t
gcgtcagctcgccgggcaccgcggcctcgccctcgccctccgnccctgcgcctggaccgcgtagaccgaccccgtgtgtgtgacgtcgtctacagccttgctctcttgcgctcaacaaagaaaacgtgattttgtgcacgttataattggagaatacacaaacagaagcc

SEQ ID NO: 646200 - DNA, 411 bp, Homo sapiens
acccacacatgttgtgccatcaccccatccttgtccctggagaaagggctattggccatcgtgacggggagcctctcagctgcgactgggccctgggagccatggagtcttctggccgcctctcctggacaccaaccaggaacccgcagccccaggcccacggttgcatctgctgtgccatcctgtggacaaatggacgatccaatccagacggcactgcaggggactgaacggggctctgaaacccggccggagctgccatcaggccaccatcatcaccttgagccattcacatgatccgtcaactgtgtcaagactgggtgccaccaggaaacatcattacagctctactgcaagcagacacacgtgttcaagggcataagacgaaatccaccatggaagaacactatc

SEQ ID NO: 646201 - DNA, 912 bp, Homo sapiens
caaaattaggctgagacaggagaattgcttgaacccaggaagcagaggttgcaatgagctgagattgcatcactgctactccagcatgggcaacaaagcaagactccgtcacagaaaaaaaaaaaaaaaaagagagagagcttagaggagggttggccagcccttgtggtgggtgggatgctcagagacactttcccagataagggtaagagtttaaccctgcacctcaggttgtgatagtgggagtcagtggtatgtgatccaggctggggagccagatggggatgcaggtgccaagttccacatccttctcctgtttctagggccctctcctcccttgatcggttttagggcggggaagctcagccttcgatgtgagagggacgagagcacagagctcttcctcctggtggcctcttgaccccttgacggccttgtggattcctcccttagtccccttttgcccatccatccctcttgttccaagttctccacttgctcccagcatgatctggggcatctgggcttcgggttcctttaatgatgtattattattatcaagttatggtattcctggtccttcacttttataccgtccttagttcctgaaagtaaacaaagacagaacaaaaacgaaaaaacaaagaacacttgggttcctgatggcttgctgaacccagccctgacctagtggttcacaagctgacggctgagatgaggttagaatgactgggcccggttgaactttccaaatgggattcaccatcgtgctgagcaaaggttcagcgaaaggcaaagtggccagggtcacgaaaggctcccaggcccaggtttcacagggcctcagctggtcctggtttcgagcccaagacgtggagatcggggagaactgaggcgaaaacagggccccga

SEQ ID NO: 646202 - DNA, 337 bp, Homo sapiens
tcttacgctgaattacaaacaatattaaagtaggccaattaacaaccctacagtggcctctacatattcaaatgaatgatagtcacacatctcacacttaaaatcaaaagttagaaatgagctcagtgaagaaggcatatcaagagccaagatacgacaaaaactaagcctcttgtgccaaacagccaagttgtagatgcaaaggaaaagttctggaaggagattaaaagtgctaacccagcaaacacatgaataataagaaagctaaacagtcttattgctgatatggagaaatcttaatggtgtcaaaagaagaccaaactagtcacaacatttc

SEQ ID NO: 646203 - DNA, 1043 bp, Homo sapiens
cgggtagggacaggacatgagagacgcctctaggggcagaggccctgggaggcaaagaccccgcagtgagagatttacccaccccagactggaaatggcgcggctcagagtcggacgaggggagactgtcagaggacaactgcgacccgtagtgtctcctgtggagacccctgaagctgacccctgtgtggtgcagccctggtgcctgtgtccagggctgatgtgtgtgaccatatcacttggtttgagcatgcgactggtgtgacatcaatgcccttgcacggcgcttccgtcgttgtctccatcttccgtcgcactggcttgcttgcatgccctgctgttgggtgccctctgggcttgggatgccctgcacatggtccatggcctgtcgctgacaatggctttccaatggttgaactggtgtgcctgacctacctctggcgggccatcccatgaaagcccatgcagccatggtgcaccatggtagcctggtgtagctggtggcactgcacccaggttggccccttctttacatcgggcgaccccaacgagcctgccatgctatctctatgcatgctttaccaatgcagatgccgccccaagctggaaccctccgcaaacctgggccccggccatggggagcgccattgacgtgtgggactgcctaccgaatacccgttctccctaggccccggttaaaactcccgcaaccggaatcgcgggactgcaacctctgattgacccaatgcacccgccttgggtactggccgatcacctgtcttgggtgccctttgggtaagcaacccacggtaaagtggctcaggtggggccaacatccctataccactggggtaccgtgccccattacacacatggctacgtaaccacattaaacccgcgcgttacgctttggctatccacccaaaattgtgcctctacggggcacctacacccctgtgtgcgacaatttgccactatacgagatggaagagccctaccacagtagtgtcggccacactcccttccgcaaaggtaccgcttcc

SEQ ID NO: 646204 - DNA, 582 bp, Homo sapiens
  misc_feature (35)..(35): n is a, c, g, or t
  misc_feature (37)..(38): n is a, c, g, or t
  misc_feature (125)..(125): n is a, c, g, or t
  misc_feature (175)..(175): n is a, c, g, or t
  misc_feature (201)..(201): n is a, c, g, or t
  misc_feature (292)..(292): n is a, c, g, or t
  misc_feature (329)..(329): n is a, c, g, or t
  misc_feature (446)..(446): n is a, c, g, or t
ccaaattctcgcagaaaagcctcggagtgaacggngnnctcctccggattcgtctcttctcctgctagatttcgcacagacgaggccggagaaatcccattttcctcgttaaaggcaatttgaanctgcctgcgcctattggtttcatcgatcgcctgtttcatcgccggagtcnccgcgtcggcgtacaagatcgccttnccgttttcattccgagcgactcgacctatcatctgaatgagagcatgggccgaacgcaagaatcctgcacggtctgcatcgagaatagcanccaatgatgcctctggaatatccagcccttcgcgcanaagactaatcccaatcaaaacatcgaactctcctgcgcgcaggccattgatgatctcaacacgatcctccgcttttatgtccgaatgcatgtagcgcgctcgaatcccgttgtccgncaagaaatccagtagctcttctgcactgacctttcgcagcgtagtcacgagcacgcgatttttcttcttcacgcactttgatatttcggcaagcagggcatctatgtatccggccgctttccgctcctttagccct

SEQ ID NO: 646205 - DNA, 746 bp, Homo sapiens
aaaattaaaaagagaaaagaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaacctttggggccccttggccccattcctttttttttttggggggggtttttctggggccccctttttgggcccttttgccccttttcccctttggggggggtttttaccttttcggggccgggtttttaccccggggggggggggaaaccccggggggtcccccctttttgcggtttgggacacttcccctttttgccggggggggttttggggagggggccccccccgttccccttttccaccggttggccccccctgtttggggtagggtttttgggggccttttttttttcgaaaaatccggtgttatttttttgtaaccccgcccttttttaccccaatgggcccgaatgggaaaatccctttttatctcaaaagtttgccccgcgctggggtggggggttgtccccttttggcacaaagtcccttttttaagggggggggtcctcccccgcaaagggggcaaaccccgttttttgggggggggcccccctcttgggcccctcccccttaagagtttttttgcgggggggggccccctaagcctttactgcgcacctctttggggcgccccgtttttgctttgtcggacaaccgcccacccgcgggtc

SEQ ID NO: 646206 - DNA, 230 bp, Homo sapiens
cttccggcgcttgttggccgcgctctcccctaggactgggtcgctatgtgcgcagctgccgcgtctgcgcttcgcgtcagtcgcgaggcgcctcgtctcgcggcgcccgggcgttcgtggcgcgggcgtgtgatcgacttcgcccgacggaatccagtggtcgtcatctatgtccactcgcgtccgtgctgcgtgccccgcgtagttggccgaataccttaactggggct

SEQ ID NO: 646207 - DNA, 1056 bp, Homo sapiens
aagatactatcgttcgactcacccctaaaatttttatgattctgtactagatgagcaagattcagaaattattggtgaggacacatctctttaataactgcatatagagaagttgggccggtataaatagttgaagaatcttgcgtatgctttgccccagtaagtaagcagcagagagcatgaattattagttccacgtgcacgtcaaagcagtgccaggtagaacatattaagaatgtccatttaagaaatggttctagctggtaactaataacatcctcatcaagaacttttgctgtgagcctgtaaagaaacagagtttttctcatacaacaagtttaattctctcccatgtggctttatctgactccatattttccatcctaccagcacccccaaccctctcgcacacagaggttaacaggagtacctaattacagaaagagatcccccaggcgattatagaaagagtggttgcgttctttacctcgacagcaatactgagaactaccatcattacaagtggcagaccagcacttataatgatacactcagcaaacatgttggtaatgttaacaacggtatatcagcgccggtgaaaatcatcttatgtcacgtcacgctacatcttcggtagctactactcatacattataatatactacctaatactcaggcccactcgttacacaccaatcatcttgatgcaccgcacatactgcgtactaccatgatataaaatactagtacgagacaaaacaagagacaacacaaacacaagaagacacaagcccgcgcagcacaacgagcgacaggaaccacaagactaccacgacaaaggaaccagacgagaaacaagcgcccgaaacgccaagtcacgaggagcacgcaagacgcgagagggcagaggcggcgagcgacgcagaccaggacggcgagccaagaacaccgagaacggccaaccaacacagacgcaacaagcagagaagacgagacgcggaggcacgaaagacaccacagcgcacggcgcgccaccgaccggagcaggacagaaac

SEQ ID NO: 646208 - DNA, 209 bp, Homo sapiens
tgagtccacagccggacgtccattataccagtcccacatcttcctaccccttccccatcactagtcctacagagagacgctagtaagacagctaccttgagagtgattctctcaggctatagttgtagttctactgctgtcaagtctgagctgactctctcttccggattctgctttcctcacctgcgaccgacctggattcgcgaccg

SEQ ID NO: 646209 - DNA, 115 bp, Homo sapiens
cccccactgcagcctggtccactgaagcctccattcagactgctattacataataccttagactggtagcttataagagaaagtgttgtttctcattcaggctctcagcgcctga

SEQ ID NO: 646210 - DNA, 430 bp, Homo sapiens
ctagagagatcccgcgcctccttggttgccttgggaaatgcgtttcccactatcacccatctcagccccgagggaactggggtatgtggcggtggaaacagcgctgtgctagtgggtcatggcagacaggttctctcctgtttctgcctaggactggtcgcagtaataagtcacttctccattctcagcctcagtgtttctttttcagatgaggggaacccgggtgtccctgccgcctctgtcttgcctatcagcttctgtgtatctcactgcaggagttaatgagtgagtgaatgagccagtatgagtacttggcaaaggctgatctggggcagggagagagaagaggaaagacgactagctcatgactgatcatccacttggggcaggcgcacccttgccatcacctacgttcaaccaagtgggagga

SEQ ID NO: 646211 - DNA, 534 bp, Homo sapiens
  misc_feature (40)..(40): n is a, c, g, or t
  misc_feature (62)..(62): n is a, c, g, or t
  misc_feature (115)..(115): n is a, c, g, or t
  misc_feature (206)..(206): n is a, c, g, or t
  misc_feature (219)..(219): n is a, c, g, or t
  misc_feature (259)..(259): n is a, c, g, or t
  misc_feature (262)..(262): n is a, c, g, or t
  misc_feature (307)..(307): n is a, c, g, or t
  misc_feature (363)..(363): n is a, c, g, or t
  misc_feature (373)..(373): n is a, c, g, or t
  misc_feature (391)..(391): n is a, c, g, or t
  misc_feature (413)..(413): n is a, c, g, or t
  misc_feature (456)..(456): n is a, c, g, or t
  misc_feature (469)..(469): n is a, c, g, or t
  misc_feature (485)..(485): n is a, c, g, or t
  misc_feature (527)..(527): n is a, c, g, or t
ggaggatgaaagttcgtgtacaaagaagagcattcgttcnagaaagcgccgctctgagggcnaagaaagatctaaagaaatcccggacccgggtgccggtgatagtagaaaaagnttccaaagcttggataggagacctggacaaaaagaaatacctggtgccttctgacttacaggtgggcaggtctacttctttgatccggagntaaatcatttccnagctgaggatgcttggtttcttggcacaatgtcattcacnacnagtgcacaatgggtaacttgaccaggacaccatgaagaagacttnttctctacattgctacagtgactgtgtctacggctgtgaagttgtgcctgactganggggtctatntcgagaggtggccccttntgactctctcttagctaacacnacttcttattaggaccggacttttaagttgggttttcagcttntaagagggaatgnggagtggatttgactntcttctcttcttcccttcttggccgctttccctgtgagactnttgatgc

SEQ ID NO: 646212 - DNA, 378 bp, Homo sapiens
gtgaagcgcacagaagcacagtgaaccgcaatatccacagagagtgttgaaggagaaagaagcatatgtggctttatatcctctgtgcctcggtttcctgaagtcaccacacatataggagagaggatccttgctgtccaagttccctggcacaaggacagaataattctcaagtctggccctacacatctctatgctgagcagctctcaagaacggctttcacttgtgcacggagcaccaataagagaagctggctgtataggattctaccttcaggttctcacaagccctttgaatccattgaccaaggccatgtgacttacaactgggatgaagttgatcctgatcctaaccagcttagatggccatttgagtcc

SEQ ID NO: 646213 - DNA, 725 bp, Homo sapiens
agcggaaaatgagtttcttcacatgctgagagcagtgctcctcagacagtaacatgcacacgaaatatgtgaggatcctgttaaagcacagattctgattcagcaggtctggggtggggtctgaaaaactatgtttcttacaagcttctgggttattccagtggtgctgatccaaggaccatactttgtgtagcaaggacttagaagcctgcctcacttagtgaatgttacatgtggtagctataattatatgtgtttagtaattgatgagcaaaattgagctgaagtttttacagtctgataacagtatattcagggttttcatatctctcattttctttaatcctcataattcaacaccgtagggattcatgtccccatttacaagtaagagatttgaggctcagggggtaactcagagtgaccaactgtccaagtttgcttgggattttcctgggtctagcactggaagtcttgcatcccaagaatcccctcaggcccagacaaactaaaaggggttggtcaccctagaactaataagtactctactggaattcaaagccagatctctgaattccaaagatgtattcttatcctggagactagcactgcctcgaggctaaacagaggagggatatatgctcatacactgtaagagatcgtctccaaaggtgccaccatcagaccccaatgaataatgcctctcagaacttatgtattaatat

SEQ ID NO: 646214 - DNA, 178 bp, Homo sapiens
tacgttgtctctcagtctctgccagcttatatatacatatgatactctgtgtgatagaaccaagagagcgcctgcccctgccttctactagaaccgcagcgtgtatacaccatatggacagggtgtgacagtgtgcacacagaagatcttctacttggaggctgtcttctttatttca

SEQ ID NO: 646215 - DNA, 270 bp, Homo sapiens
aaaaggccccaagtggggtttttttttggtcagagagatgaaaaagttaatccccaggccaaatttgttgtttgtttgaagaggggacccgttttacccagccaataaaatgcctttttttttttcccccgttcccattatagatcctaatcttgcaaatccctgtcccccaatgcccccccttttgggaatgatggtaaaattgtatgcctgaaaaaatcctaaatattttagctatattgtttttttaataaattggggccttcccga

SEQ ID NO: 646216 - DNA, 374 bp, Homo sapiens
cgacgtttggtagcttcacaaaaaatgctaatatcctggtagcttcccaatagaattagtcatttaataagatctctatagttgcttcactaatattgtgattaggcccagagtgcctgagggatctgctgtgatgcaattcatcctctgttatttctgagtgttccattacaccatgtcagagagaggagacagataaacacaggtttctaacagcccccctgccagaaagtccaatatgagactcaccagacagatactctatgagaatcatgttggaataaaagtttgatatcttttaggattccattcatgtgttagtttgaaagtttctcaagagatcagggcatcaatatctatcttggtgtcgacgc

SEQ ID NO: 646217 - DNA, 86 bp, Homo sapiens
aaaaaatcatctcaccttgagcccacccccaccccattgtctatctggtagaagctaataaataatcatccctccttgcctagcat

SEQ ID NO: 646218 - DNA, 826 bp, Homo sapiens
gatcgacggatagttatattatagatacagatatacatatacatatacatatatatcaatatagagatataggcttatgcatgtatatatagagagatttatatatatatacatatatatatatcaatatctgcctatatcattagtaacagataaatcacagtctgcatttaggtaaattatgtacttatttgcctatttaacattctatttcttgccataaaattgcaagttccacaaggacagaaaattggcctggcttgttattgttctattgtcaatgcctaaaacagtgtccggaacacagtaggtattcaatacatttttttaaattaatgagtgaacgaattgttgatgcacaataagtacatagcttctctctgagtttcatgcagacacagaattttttcttctgttctccagctgtgacttattggatgagaattgcataatcacactaattgacttcataacaaatttatgatttcccatctcagccagactctaagtgtttctcgataatcctttaacatgggtctactcaattcgctttcatttatccaaggaagctacttctaacatcaccttttcccttgacttcttcagtcctccagttcacttgcccttctacccatctacagagaaaagtaaaagtctaagagatcactcagccttttttctcctcctgtctcctttagaccttgtcccaactgtctcccatctcctactttcagtttctcatcttccactcactctataggataataccctccgataatctctgatagaattcctcaaagacattaacacttactggcttgtcgac

SEQ ID NO: 646219 - DNA, 715 bp, Homo sapiens
  misc_feature (38)..(38): n is a, c, g, or t
  misc_feature (41)..(41): n is a, c, g, or t
  misc_feature (65)..(65): n is a, c, g, or t
  misc_feature (67)..(67): n is a, c, g, or t
  misc_feature (71)..(71): n is a, c, g, or t
  misc_feature (95)..(95): n is a, c, g, or t
  misc_feature (125)..(125): n is a, c, g, or t
  misc_feature (129)..(129): n is a, c, g, or t
  misc_feature (158)..(158): n is a, c, g, or t
  misc_feature (162)..(162): n is a, c, g, or t
  misc_feature (179)..(179): n is a, c, g, or t
  misc_feature (183)..(183): n is a, c, g, or t
  misc_feature (189)..(189): n is a, c, g, or t
  misc_feature (193)..(193): n is a, c, g, or t
  misc_feature (222)..(222): n is a, c, g, or t
  misc_feature (224)..(224): n is a, c, g, or t
  misc_feature (229)..(229): n is a, c, g, or t
  misc_feature (268)..(268): n is a, c, g, or t
  misc_feature (276)..(276): n is a, c, g, or t
  misc_feature (290)..(290): n is a, c, g, or t
  misc_feature (342)..(342): n is a, c, g, or t
  misc_feature (355)..(355): n is a, c, g, or t
  misc_feature (357)..(357): n is a, c, g, or t
  misc_feature (376)..(376): n is a, c, g, or t
  misc_feature (404)..(404): n is a, c, g, or t
  misc_feature (422)..(422): n is a, c, g, or t
  misc_feature (436)..(436): n is a, c, g, or t
  misc_feature (519)..(519): n is a, c, g, or t
tgttcttcttcacgggctgggccgtccctgggatgggntcnggggggaccatgcgccccctcctnancagntggttcagacttaggtgcagggtnaggggttggtaatggggaaggggacccggnggcnctggacatgtacctggccaccagcacatnggcngcagatggggagatggnatgntccagnaggncaggcttcaggtagacacttgccggctcntnggttnccaagtgcaccagagcggccgggaagaggttcgcttganagagggtntgcgtgtggtcgtncaggattgtttttggaggggtgatgaacaggtaaaatgacagttcggggttncccaggtggttcntnacgaagtttcgcaagtttnccattgtttcgttggggcggaagaagcnctgtaggatgtagtggtnggggaacaggaccntcagagccacctttgggtagcgttccagttttttctttatttgcgcttccttgaaggttttggttattaagggggtttttttnaggcgcttccgctcactcttgagctgggccaagcgtcttctcacgtcgtccaccgtcagctcaaagaactcatcaggcagctccgctggccaggcctgcagccgctcctccaggtcggggtggcacacaccggctcccggtccacgggctcccggtccacgggccgctcccgctcctgctcctgctggggatcccg

SEQ ID NO: 646220 - DNA, 211 bp, Homo sapiens
  misc_feature (1)..(1): n is a, c, g, or t
  misc_feature (6)..(6): n is a, c, g, or t
ntctanacgatccccttcgcggtatcataaccaaaggagtgctgacctggtcttcgtcaggaaggtttgcacaactgttgcaatactctggatgaaagagcatgccgtttcatactgcttctcccggaagggacaaacccaaccacactccatagggctgtaaagaacacctacaggcccaaggctctatgtgtatctgtggtatccacca

SEQ ID NO: 646221 - DNA, 264 bp, Homo sapiens
cagtcttacctgtgacacacagggataccctcacccacgaggtggggggtgtagatgttgaagatataatctgatggtcacttgtggtagaatcgcgggttctggctgtgttggatgaacggggagcctgatgtgccagtgttggctggtagctgcaaaggctgactttcctgctggctgcatctgcccagggagctgggtgggaagcaaggagtcgaggggctgaatgcagagcctgggggtgcatggggggcagagaggatg

SEQ ID NO: 646222 - DNA, 1259 bp, Homo sapiens
cctgattgctgggcacggtggctcatgcctgtgaatcccagcactttgggaggcggaggcaggtggatcaccaggagttcgagaccagcctgaccaacatggagaaaccctgtctctactaaaatacaaaaaattagccgggcatggtggcgcatgcctgtaatcccagccacttgggaggctgaggcatgagaatcgcgccactgcactccagcctgggcaacagagcaagactcagtctcaaacaaaaaacaaagaaaagaaaataagctactaccacttttaattgtctctcataaataatttgatgtaggagtgaattcaaaatcatttagaagaatataatatgacaatgacaaattatacacaccgtaatatacaggatacttttggatctgtactcagagtataactcctaattttaaatactaatgtatattgtcttaaaaacaaagagcctaattaactaggtattcaaacctaaattttaaaaagaccacaacatgaacacatgcacacatatacacaaacacatacaaacacaactaaagtaagcaggaggaattaggaaatattaaactaaaaatttgttgaacagagaatgaaaatgtaaaggctgattttttttttggtaaaaataattagtaaacagataaaccactaacttaaaaaataaaggataaagtgcaattaaaataggacatgttaatcagaggtaattagagctaaaaagacactaaagaaatgggaaataaatccttgttatacctgagggaaatgtacttgaaaatatgaaacaaaatttaacagtttcaacataaatataaatttccaaacatcaatccagaagacaaatctaaacgaacctattactaacaacaacaaaaaaagaagttgtctaaaattcacttactccctactccacacagaaagaaacagaagacattatcccctgaaatttacttaaacatttaattaaatatattgcaatgctgtataaaccatttcttagtccatttgagctactgttaaaaaatatcataaactaggtggcttataagcaacataaatttatttctcacagttctggaggctgagaggtttaagagcatggcaccggcagcttggttcatagatgaccatcttcttagtgtcctcacatagtggaaggcactaccaacctcgttgggacccctttaattgtgctgttttaatgtacaataaaatgtattaaaaactaaataattacataaaaaaaa

SEQ ID NO: 646223 - DNA, 400 bp, Homo sapiens
tcgtggacctctgtagcattatctctagtgagagactcgacacgggaattgaccatctctaggaaacccaacgtgtcgagaaaagtatgacgacaccatgtcccaggtagccagcaacaatggcttagaggaggcagtcaggaagttaacatcaatcgtccgtccagaatgacaagatgcggactggaaaccttccagccaagctgaagaataaccgtgtttgaccgatcattccagtatgaagttcaacagagtgatcattccagttaaggcggggcaaacagaatacagactatttgaacgcatccgtcattgattgctaccggcagaaggactcctatatcgccagccagggccctcttctccacagcattgaggacttctggcgaatgatctggga

SEQ ID NO: 646224 - DNA, 155 bp, Homo sapiens
tcacggggatacaccatatatttccattacatttaacattattaacaaatacgttatattttttgtcataatgtaaaaatatgtacatattataaaagtacacattagaagaatcacagtatttaattccagtagcaaagcccactatttatttc

SEQ ID NO: 646225 - DNA, 229 bp, Homo sapiens
cagccaccgttacaccacaattactatggggctcagtcacccaccacattaacaacagtgataccctcattcacacgagaaaacaccctcatgttcacacaccaaccccacggttgcgttggcccaggggctctaacgcaccgttgattgggccaacgcaccgtccagttcgtccctttccagttttacagtgaattgctgccgggcgggagcacggtgcgttggccaa

SEQ ID NO: 646226 - DNA, 470 bp, Homo sapiens
agcaggtgctcctggcccgggcctcctggatgcccagctaggctgcggggctgaatggagctgctagaacaatgctgaggcgggtgagtgtgaggagcagaccctcgcggaagtcccgacagacgtgtctggaacatggtgatttggagtgagccggagacccaggcacctgtgcgcatccttcccctcgcctctgccaggccccgcgcccctaaaaggtgggaaaaccatgtgctgaacaatttcagtgacatcgtcaagcaatggctacgtgaagatgaagagcaggaagctcgggatctacctggagtgtgcctggctggtgttccggaaatcctccagcaaggtggcccacagcggctggagaagtactccagcatgagaacgtcggtgtgcctccgtgggctgccccaatggtgactgagatcagcaactgtcaagtgtgttacgcgtgctccccaaggagacca

SEQ ID NO: 646227 - DNA, 107 bp, Homo sapiens
tttcacatttgtctttactctcgtctgaactgagtttaagtgaaacagttatgatgttagaaattcaacttaacatttttcatattcaaagtgattgttccccgcgt

SEQ ID NO: 646228 - DNA, 1090 bp, Homo sapiens
gcgagtttaattcggacaaacttgacaattgactcaatatttaaacttaccattctcctcttgtctccgatcttttgccttctacatatgttataatcgatttcatccttagttagtcctactcatactatctctcaccactatcatagcgaattactgcattcaatggaaacttatcgggctgtttacctcctaggttgctccactctgtcgagctaaacacgcaacccaaacgacacttctgcacgcgtacttgctccaacagtggacggctttaccgttataacgttcttctcgaggctgaggcacgtttgcacgcaacatttcctcccgctgcagttacctaccaaaccggtttcacggacctaaaacttacgaccttctcacaccgcttaaccgaacaccatctagcttcttgtatcacacctacggtgacggcgagttagacctatccgcgaattcctttaatctactccaacattcgaggggcgcttaaacccaacgatggggttaatctcaacccgggtggccccttttatggctggacgtttgcaaactttgcggatcttcgctcccaccccagaccgacaagaacctttccttgttaagcaaaatacagatttccaacctccatactctctatatagcacaggcataacccaggcttaattttaccaacgctttgctttatcaaccgcctcacaataacatcatcccttaagcacctccaagataaccccacccccataaacagactccccgtaaaattcacggaaaactcgcttataagctatatcattttggaccacattacatctcacaccacgtggactcactcccattgagtcaggcacacctgaggcagattacccaaacgccctaaaggagaagtaacataaggcataatacggtagacactgaccaccgtcacatgttgcaacatccacacacgactgccacaaaggcgaacacacgcgacaacccgccactagcgtcaacatgttggaacggcatagaaacaccggacacacggcatatacaatggcatacagagtgtacgtagacacgtgctaaagtaggtgtacaccag

SEQ ID NO: 646229 - DNA, 1031 bp, Homo sapiens
  misc_feature (704)..(704): n is a, c, g, or t
ggccagctccgggcgtggggtgaaatctcttgattcctagctctctcggatatggcacctccgctgcagctctttgcgcgacggttcctgtcaggtcccagacctgtcctggctcttcgaagctctagctgcgcgacttcagggtaggatccgggactccccgtctaaggtcgaaccgtgggtagtgggagcatatcgcacggatgacgtgccatccctgggttttgcctggtagtgaagaaagtggagcagaaggattgctaagtgacgaatagcctaaatcacgacgtagtctagccaactcctggtgcctggcgtgagttccggagctgtgcttcatcgtcttgcccttggggatgatcagccctagcgacatcaaggagaagcgggtaggaggtgtgcaattctttggggggaacaggtgcacgttcgaataggagctgatttacttagcagcgtcgggtacaatggagactaaagaacaagagcaagatcgctgtgctatgtgtcctgcagcgaagtctgggagaatcgacaatgctagttgtttatccgcatgctgggtttcccaggacagttcggtcctatcgctactgggatgcagagaagaagacggattggatgctccggggcttcctgagatggtctggagagagtgatcctgagttctcgcatggttggcctccaaggcctgtgcgcatggnctcaactgggatggaccctagatccggagcaggtggaagccagatgctgctgtcgtgacggaccgggttgctgtaccccgttctttgactcagactatcagggcttcggtctggaaacctggaggagagatgcgtggggcccttcgctaattggtggtctgaaggcctcgaagttcatcttgggccccagtcctttcttccaagagactttcggggtctacaatgacaaacgtcgggatcttggctggtggttggacaagagctgagaagattctgggaagcatttcccaagatggggaaaacgggcggctaattgggccaatcccc

SEQ ID NO: 646230 - DNA, 308 bp, Homo sapiens
ggaggtggggggggtcagccccccgcccggccagccgccccgtccgggagcgtagaccatccctcccagaactgttactcccagcccacttcgagcctgatgaagtgaagacacagtggtccagtactggctaaaggtgtcaaaacgttctacacagctgagggctctgctatcactccagcgacccccctgcaaccgagtatatccacctaaacaaaagaagaaaaggtagtaatgaaaatctactgttctacatctaaacatttagtataactactatataacaagaaataaatggtttagaaatt

SEQ ID NO: 646231 - DNA, 1296 bp, Homo sapiens
ggcggccgcagccatgagtatgctcaggcttcagaaagaggctcgcactctagtgtcctccgctgtgagtcaatgaagataggtctggttaagaccccaatgaggaccaatgaaatctgccaattgccaacatcccgtcagcatcaatcgcggatcgcatcagtcttaggagatcatgtggtcgtgatcatccagtcaaggtcgctgtgatccggtgccaattcccagtggctcggattgccgtaagaaatcagcacttggcccggccggatagggcaggcacaatgcggacactagggatacattgcgagcaaggggttatcatgctcgaaatgtcaccgatagtgacccacaacgaaggtgtcaccaattggtagtttaggggacgaagtgaagtgcacttttgtggcgcccctgctgactcatgaaagactaccgagatcatctaacgaaacatcgtactcgtccggagaatcgattattcatccatgagcgcaaggctaagcacttggaacatgggttgggaaatggtggggatactgggttgctttgcgagagaaaaagcgaaagaacgggaaatttggcgtgccatcgaggaaagaggcaccaatttccaccacaaggaagtgggacacgggcccgaaaaaaaccatgagggattctccccgtcccacatggatacgccttgcgcatgtgtgtcgtggaacccgagagaccggtgggacgtggccaccgcagacaaggcgttcgttaaaacggaatgcccaattgcgggaacggggccacctggtccaacaaggccggccgcaggctggaaaagggacagagccgtcccgatccccaatgggggccgcacaacagagaaaaggcgggacgggggaggcaaatctaagtcgacaaacggaaaccttttttaatttcccttaaaggggcacagggaaagatgtaacggagacgcacaaggggaaaagtagttaacacataagcactttcggcccaatctttatttgattcttaggtaataccagttagcgttggtggggcgcctttcccttgttttggaacttctccacccaattaatggcaagttccaacgtgccccacttctcatgacaaaggttaatacaagaacaaaacgcgccccttatttacatatggaccacaaaacaacacaaaatcacattacacacagagagtaaaacccacattctcccaaggaagggagggagcgaattaatcataaatggtaatatacagcgagagggtagtagcgctcggaagaggagaacgaccatg

SEQ ID NO: 646232 - DNA, 237 bp, Homo sapiens
atggcaaataggaagaagctcagtatcctcctcccaccataaccccactctccactgcctcctggaccatagtttcctccactatacggtccccccatgttcctgctaccaccaaagtttccactctttatcgaaccgtattagaaggtcgctggttataatttccaaaatatgtaatttccacttccaaatcctttatagttgtcataaccacctccgtagcccccaccctgttgc

SEQ ID NO: 646233 - DNA, 464 bp, Homo sapiens
  misc_feature (197)..(197): n is a, c, g, or t
  misc_feature (204)..(204): n is a, c, g, or t
ttaaacgctttattgtgcccataaaaaaggcccatggaatgaatggaagagcccgcagccctgagcccgagcgattgttttcgcgcacccaaatgcaaggagggtggggatctgggaaaggtattggcggcctctcgtccccgcgcgcctgtgcccggccaactcagcgatcctccgcggtgggcatgcgcgtcctncgccatncggcgctaggggccagtaaccatgacgatcgccgttgccaaggccgagatccaatagaggcgttgccggggctgtttcaaaaacctaaagcaaacaacgaaaaacgctacatcgttgggggaggggaaagactgagaggacccggggcccctccctgaggctcagaccagctcgtccccggccgacacgctcacttgcgcccttgggcactttggggacgctggttggccgccttcttcaccttctcgccccggcggccc

SEQ ID NO: 646234 - DNA, 164 bp, Homo sapiens
aaaccacgagtcctacatcagaatctggacccaaccagcagttcattcagcaaatggtgcaggccctggctggagcaaatgctcacagctgccgattccagaggtcagatttcagcaccacctggaccagttcacggcattggggttcttaacccgtgaggcaa

SEQ ID NO: 646235 - DNA, 442 bp, Homo sapiens
  misc_feature (47)..(47): n is a, c, g, or t
  misc_feature (62)..(62): n is a, c, g, or t
  misc_feature (79)..(79): n is a, c, g, or t
  misc_feature (110)..(110): n is a, c, g, or t
  misc_feature (134)..(134): n is a, c, g, or t
ccggatcccaaatgcaatggtgtaaaacatcaaaagctgtcgtcatnggaagggcagttctntcaagcgtctccacagnaacccacgccaagtccaagctgtgtgtcccntggtcccaaggccttctgcttccncaacctttagcatctccctgttgatgtcacagaccgtggcaagtgaacctcccaaggaatcctcttcattctggtactttttggcaatttcttcccaggataggttttgctgagtccttagctgtctcctctgtctcctctgatgttgtgcctgaacgtaactaaggaaccggaacgcaatgtcacctgtgcctccagccatgtcgagcagctgggtcccgggcagcgggtgcatcttcctgataagcaaatccttccaagctcgatggatgccgagactcatcatgtcattcatcagatcgtacttc

SEQ ID NO: 646236 - DNA, 494 bp, Homo sapiens
  misc_feature (48)..(48): n is a, c, g, or t
cttaaagtgcccggggtgccgggcccggagtttgtcagaaagttgaangacaaaggggccaaatcctacatccggtcccggccccagacccccaggaaggattttattcagttgttccccggggccagcccccaggttggggccctgttggaaaaaatgttggggttaaaagtggacaagggcctgagggcggggggggccctcccccatcccttttttgaacccttccggggccctggggaaaagaggggggcccaccacccgtttgatgtttccttagaacccgagaaactcccaggggatgaatggaagcggcccttttccaaggggtttgtgaattttagccccctttgccgggagggactccgggggccggggggggataaagttgtagggattttttttggagggccccccgggccagacccggcccaggggccggtttttgtccctcccaaactcagccctttttggaaaaccccctttcaagcaga

SEQ ID NO: 646237 - DNA, 380 bp, Homo sapiens
atccatttaacaaaaatattctagggcgaaaatctagcgtttcttccacaatctatttacggcctattcgaaaaggcccaaagttaatcgggataccccgaagcaaacaccacattgaacatcctattatttgtagggtcatttatttcttttacagcaggaagattaataaatttcatgatttgagaagccttcgctttgaaaggaaaagtccttatagtagaagaaccctccataaacctggagtggctatatggatgcccccccccctaccccccatttgaagaacccgtatacataaaattttggcaaaaaaggaagggattgaaccccccaaaactggtttcaaaccaaccccatggcctccatggcttttttca

SEQ ID NO: 646238 - DNA, 691 bp, Homo sapiens
ccccaccggttaagcccttgggcggcgctgggggaacacactaggaccgccccctcgaggccacaagccaagactgtgttcgtaaacccaccccctgtcttgaggctaccctctttttgttaaaatagatcccgccagaagggtttggagattttacgactcttttttgaaaaaataaatttttgggaattctagtgtttctaaagttaattttaagtcgttttaatacatgtgtccccccagaaatttatactctttgagattctgtgcacccacgccactataatgagtttcttggtgaataccacaatgcgtgaagaacttgtaaatgagcccacaaagggctacccctcggagtagctcctgcttgttcctctcttttcttagtaacctcgttttttgagttacccgtaagacactcccacgattatcctggaaccccttccacgtataacttaggccctcccttccttccgaccactttaattgcttaatagtttgaagaaaactattggagaatgggccttttatatgacatgtatggctttaccatattaaatatgagccaaaagaaaaaatatgagaaggtttatgtgggtctgtaaggtatggctgtggaaagatattgtagtagttttgaccctattgttattacctttaaaatcatttaccccatcgaatgttaaaccga

SEQ ID NO: 646239 - DNA, 519 bp, Homo sapiens
  misc_feature (58)..(58): n is a, c, g, or t
  misc_feature (201)..(201): n is a, c, g, or t
  misc_feature (232)..(232): n is a, c, g, or t
cgagctcggttcccggttgccgcctgctgagcatggggcagcagggatgttccctggnggttaaattctccttgagtcttcatggctacaggaaataaggggtctctaattatttacttcatggccctcagaaggtttctcagcgatgactgtgttgaggtcttgtgaataggaatttatgttttctaacaaaatgaacancgtagtccacatcctggctggcacattgganccttgttctttgctgcatggatccacctgtaatggtggcttctgatggggtgggcagctgaagctagtctgcagccatctgtgcgggtgccgggcccttccacctctgcaggcttgttggaggctgccctccgcgggccttgccacctgcctttctcactctacccggagactccctgtagcctcgctcaccttccctatacacctcagcgtctgaaagtgtgctctgcacctgctccgcaccgcttcctttcgcacctcactcagcccgggatcctctatggtagc

SEQ ID NO: 646240 - DNA, 313 bp, Homo sapiens
atccctccctcagctggaaaatgagttagttctgattgtttatctgttggtcactgttgttgtatggaagagctactgatttctgtacattaatctgtatccggaaactttgctgaattcttttatcagttctaggtgcttcctagaggagtccttagggttttcaaggtaaacaatcatatcatcagcaaacagtaacagtttgacttcctctttaccattttggatgtccttcatttctttctcttgtctgattgctctggctaggacttccagtactatgttgaaaaggagtggtgagtggccatccttg

SEQ ID NO: 646241 - DNA, 858 bp, Homo sapiens
tggctgcgtcgggttgcaggagagagatggcggtctccacaggagttaaagttcctctgtaattttcgcttgtcggacatcatacttgaatgaatgggacacaaaggatgtaggcgacggttacagttagctggggccttgacgatgaatgatgatatgacacttacaaggtggacaggcttgattattgggcctaccataggaccggattatgaaaacagaatatataggcctgaaaggtagaatgtggacctataatacccagaagcatcctccgtcacgttagcatttgtcaaccagcaacatgtattatgaaccggaataaactaattccaggtgggatggtgggaatgcccgcgagtctaccagtgttagcaaaatggcaaatcttcatatagcattaaagttgttacttcactgagctaagacggtctaatgagtgtccatagaaacttatgaaggcttccacagatcaccaagaatggacgacacatgcaacaatctactttctaggtggatctcaaatttgtgttagatcaacaaccttctactcatgttaatggtcttgatttagacctatcacaatgcacaaatacaccatgaagtaaacagattttccagactgtaaacattgacctgaccatttgtgaggaatattatttactatattgtaccgcatttatgtttccaggcaacaaggaggcacaaatgcatgccacaatttttttgctcttgaaaaggcgtgtcatttaaacattaaactcggagtctcgaaatagaatccgggttaccacgcatgaaagcgtgcgcgaatgtcaatggatgtgaacctttggtcaacaagtaaatcccaaaaga

SEQ ID NO: 646242 - DNA, 391 bp, Homo sapiens
  misc_feature (4)..(4): n is a, c, g, or t
  misc_feature (9)..(9): n is a, c, g, or t
  misc_feature (202)..(202): n is a, c, g, or t
ggantgcantggccgcaaatctgggcctcactgcaacctcccacctcccgggtttgagcgattcccctcccctcaaccctcccagagtagcctgggataacaggtgcatgcccacccacacccggcctaattttttatttttagtagagacagggtttcaccatgttggtcaggccagtcttgaactcctgacctcgtgatnccgcccgcctcggcctcccaaagtgctgggattacaggcgtgagccactgcatggccacattttatttttcaaaggagtcaaaggtttcttggccgggcatggtagctcaggactgtaatcctagcaattttgggaccccaaggtaggaggatccctcgagctcagagaccagcctgtgcaacatagta

SEQ ID NO: 646243 - DNA, 111 bp, Homo sapiens
acgcgaaaaagactatcaagagaggagcagctctataatcatcatctgatgaaaggtacactgaactgggtgatcctggccagtcagtggcctcagttggcccttatcgag

SEQ ID NO: 646244 - DNA, 236 bp, Homo sapiens
agactcaggaggaggccgctgctagtaagctgagattgcaccattgtactgctgtctgagcagcgagcaaaactctgtctcacacacaccagaaaagagcacgcagcaactgactggttggatcaggcaagactctgagaaaggactcctgacctggctcttccagaatgaggatggattttccatatgaaggcgccgggggcaggaccttctgggtagacgcgtgaaaagaacat

SEQ ID NO: 646245 - DNA, 719 bp, Homo sapiens
ggtgctagactataggctggggggagggtaggaggtgggaggcagatacttccacctgcgtgtcaatctccggctcctccacggcttctatggaggactcctctcttctgcttctgtggatgtgatgccctggcaggccagggcagctgattcccctaagaacttatgattaccaggatggaaaggccttggtcccatggcgactgggtggaggctgggggatattctctactttgaacacttctccaaagaggcagaagggccacagagttctgagcaccctgaacatataactcagatccctgggagtaacacagtaggcaaggcactcatgtgggagtggtctgactggctgttgacctagacatgcttcataaatcagggtaaggacctctgcttggagcatccaaacccttgaagctcaaaactgtcagagcaaggaggttaagagttctgtatctcttgacgcaagcctggactggtgcaaatggcctgtgaccatacttgtcactggagaggcaaatatgtttatccatcctgcccatatgacacctatgagaaacgttcacagtgaggagtagccaggtagctaggacagtaaccctgacacacactgactgaaaatcggaaatcccacggactccctcttaactaagtgacccatgtagacggaagccaggagatatggtaaccgaaacgatgacaggggaagggatagg

SEQ ID NO: 646246 - DNA, 173 bp, Homo sapiens
  misc_feature (37)..(37): n is a, c, g, or t
gtcaacatctctgtggcgcagtccatgtctccagtgnctatggtggtgcagtggtgtcggcagtggcttaggctgggtggatgaagcagctacatcctatggcagtggtcttggctgttggagtgtggcttcagtttccagctgtatgcggtcgcaggggtaaccgaagctcg

SEQ ID NO: 646247 - DNA, 426 bp, Homo sapiens
cttctagagtatcctacctcctaccccacgggggtctgggaacatgggtgtgtatggtgaggggaggttctgaggttgtaaatagaggcctgaaggaaatcgggtttgctgaagtcactcaggagttggactgtgtgtgaaaggatggtctgaaggggctctcagaggtctcagggttcccctccctgcaccatgctgcgtggggaagaaggaggtggctggggagctcagcaaagggcccctaggctgcaggcagcaaggttgcgaaatgggtcccaggtccagctggccaacttcacttttcccttcctctccctttcttttatttatttatttttttagtgtgtgtgttttcgaaatcacaacaggaaatggggtagtgatttgtctagaggggaggcaaagaatgggcagacagcagtccct

SEQ ID NO: 646248 - DNA, 540 bp, Homo sapiens
aagaccagggtctctgtagttctctaacatcacttccctatacaaatctgtgcatgagcagggtccaggcatggcgactcctccagagaaacttctctggccacatccctaaatgtcaatggccccttttcataaaaagagtacctgagacgcttcctgtcagcccgtaggaatccacttgcttccttgagaggctacactcgagacttcaggttctccattgctaggcttccaggggtacctggcgtcttagctgtagctctcccaatagctgcccaggggctggggctctcaaaggctttgtaggtgcaggttccattggcccttcaaaggtgcaggagccatgcaggggaaaggcaattccctccttgctaggcacggagatagtccagccaaatgatgccgggctactgaggccagaggcgcaggtgggctggcagcagccctggggctggtgtccgaagatgcctgacgggactgcaatctagttggggaggtgtacaagtggtgtcaagacaagcactggaggtagctcctggg

SEQ ID NO: 646249 - DNA, 203 bp, Homo sapiens
gtcgatcagaggatcccccatgtgggcatcactggtttgagctcgtgctggcccccgaaatggtaatatatatacctttcatccttagatgaatatttctaattcgcgatattctctgacaaatcgaagtcaagtacacagttctcgtgaaatatacagtgaatgaggctatcattcactagattacaatacgtcaaacatgg

SEQ ID NO: 646250 - DNA, 915 bp, Homo sapiens
tgatggttatatgtgcatgccttttcttcaaaaggaaatacgcaaggttatagcatctaaaaataaacataagagtcagacaccaaataaatcaagtttacataacagtgtgtatgcccagttggtattaggtgagattttcacattacagaaagtattggaggcagcatgaacaagtgggttatctatcctgtattttccagttgggaaaaaagtacagaaatttcatcacatggcttggccataattgtggcccagaatttaatcttaagcctctctctgacagtgatgaatcatgctcaaaaagccattctaatgggacctttttaagacagggaaagggctcagtaggcggatgtgaaagaaattccaagtcatgaaattattccattgagatttcctacaagggaccaacaatgtgggcacacaaataagacacctaccgacttagattgggctacgtagctagcacacgtatctcccctacataccatacaggccaatcgtatgtctgactcaaagggaatatgtgtgtgtatacttacagacaaacaatcctttacaaggagaaattcactggaacaaacaaaaggctgtggacgtggctcacgaggtatggcacataccctacacgcggaattacacatggaccagcaacacccaagaacactcacgcgcggtcacaccacacagcgccgactcaggacacacgaacgacggtcaccagcgggctaatgccaccggcggacctcctacacaaaacccggctcccataacaacctcaagacacccatggacacacaacgacaagcagcggcaacatcacagctacgccagttcggacaaccaacacacaactatacgcaaacgccgaagaaacaacacaccgacgatgagcacccaaccgtcacacca

SEQ ID NO: 646251 - DNA, 530 bp, Homo sapiens
ttgtgtttgtaataatagccattctgactatgtaagatgatatcttattgtgtgtgtgtgtgtgtgtgtgtgtgtttgagtcagagtctcactctgtcactcaggctggagttcagcggtgcgatcttggcttactgcaacctccacctcctgggctcaagtgatccttgcacatcatcctcctatgtaactaccgtctgcaggagcacaccatcatgcctggcatagctttcccttttgtgaccagtccggaagtccccatggtggccgcactgggactaaccttgggtcctcgtatcctggctcctatgactacctaccttactggatgacaggttcccgctgatctggctgccatagagttccttcgattgtcactatctatagagattgcagccttctaagaggtcaccgcttttcctcagtctctgaaggactgtgattacacctacttacctgccttcacagctcgtaattgccctctactgtttgctagcctttgggcattatccctgctgcctgttttcccg

SEQ ID NO: 646252 - DNA, 224 bp, Homo sapiens
  misc_feature (153)..(153): n is a, c, g, or t
gttatgttgatcgagttttatcgattacagagcaggctcctctagagggatatgaagcaccgccagtacctttgagttatacgctgtgtctcgaagtgaactgtcagagcagtttttgtgatttaactgttgagcgttatggctaagcatagnggggtatctaatcccagcttgggtcttagctattgtgtgatcagatatgttaacgccactttcgtagtcta

SEQ ID NO: 646253 - DNA, 221 bp, Homo sapiens
cttttacttaaatggctgtagcaccctcctgtataaccatagttaatatatgcttactatacccttggataatcttttcatatacacacatctcagcatgcaacttcagtgaggaactgtacaaataaaactcacaaatgagcaaaggaaaaaaatgacagttcaacatgtctcgaagaaatgtatcatcgatccactattcacaaccacacatacacagg

SEQ ID NO: 646254 - DNA, 432 bp, Homo sapiens
actgcagactgcccataccaatcgctgttagcagttgcacctccactttcccactgagaactgccgcatcttcaaggatatgagaaagcccagactcacgagatgagaagacccccttggcgaaatatagtgtactcttcactgccaatgccaccaccaaatgggtttatagagcttagaaacacaatctttgtaaattaatcaaaacctccctgtgacccacctgccttctccccatacccaaatttgaccactactggcctaaaaggcaagatgggcttcgatatagaagggctgcaagacagtagaaagggctgccacggaggtgacagtagctccttcctctccaacatgtgatgctacacatctctgtggataatctaagttggacttatgactctaaaacagctataatccaagaaagttaactca

SEQ ID NO: 646255 - DNA, 440 bp, Homo sapiens
tctatcgtgcttgatgagaaagacacattgaggcccctacagaatatccctggttcactatggagctagtaggatagaaggcttccacaaataccgagcaatacctttaccctatgactacatactggcaagtgagtaccgctggaacaatcaaattcaacacattcttcattgattgcatggacgacctacggtctggactatgaccggaagaaagtctccaaggccgacatcttggccaggattaacagaaccggagatggaaactacaagagtaggctgagttaggggtccctcaggttccttattcaaaaaacagccaggcagaggtattaaatagtcagtttattcactactgaatcatgctaccaggatgctaaagatgatgatgttcacccattccagtacagtatacttttaaaatacaaaagtattgcaag

SEQ ID NO: 646256 - DNA, 401 bp, Homo sapiens
actaataccaatcctactcaaactcctcaaaacaaaaatttttttggaagagaagggattacttcccaactcattctacaagggcaacattaccctgataccaaaaccagacaggatgcaacaagaaaatgacaggccaacatccctgatgaacacagatgcaaaaatcctcaacaaaatactaacaaatcaagtgcaacaatacattaaaaagatcatcctgggatacgaagaggggaagaacagacttacttgagggtggggggttggaggaaggagaggatcagaaaaaatacctattcggtactatgcttattacctgagtgatgaaataatctgtacaccaagcctctgtgacacacagtttacccacattaccaaccagcacattaccccttaac

SEQ ID NO: 646257 - DNA, 111 bp, Homo sapiens
aaaccccccaaggagctaccggagagaataaggcctcccggagttaagggctcccggagggttaaaggctctcggagggttaagggctcccggagggtaaagggctcccgg

SEQ ID NO: 646258 - DNA, 1575 bp, Homo sapiens
gctgctgtgcgggtgtttgtcccctctggtgttttgcgtggggcatcgttgctggtgttgtgggctcataattgttggttcgcgtgggtgggggtgctgctgctcgtccttgttgtccctcgccttttgttgtttttgatagttagtgtatttgggttgtggttctcctttcaccgtgggttcatcccaatactgcctcttctgtgtgggggcctcttcgtgtggggcagttttgcgtcttccctaagttgtggggggctccctcgtttctctcctccgtgaatgtgccacggatgggggtgtttgttttcttgttggtgtcgttgttgcgctcagtgtttttcgggggggggtattacctgtggttgtcgctggtgctccctgtggctcgcctggtggtggtgtcccattcggcttggattgttcctgcctctggggatgggtggctttctcggggtaggtgctctcgctgtggtgttgtgtgtttgtgcgccgcgccgccttttggttgtttggtgagcaggggagatttttggggtcacttgcccccttttggggggtcccactttgtgtcactgcgggtgcggcccccgctgaggggtggggcccccctctaggtacttttttgtttggcccacacgcgcatctgttgggtgaaagtggtcaccgcctcgtttgcgcgggttgttgtgggagacaccatctttctcgccccccttgtcttctcgtgtgtgtggggcgcgcgggggggccgcccctcctcgtctcacacgcgttttgttctgcgtcgttcctcttatgatcgtgatctgttgtcgtccccctcgttgtgaagagaggagatattttgtgaagatatggtatttggggaagaaagcacccttttctctgtgggagacccaccgcgtttgcacagatgtgtcccacatcggtgagatcctctcccactcacatactcacacaaagagagacacgctgtcttctctcgagatagacactacttggggaggcccctcggtactccctccctcccccgtaagagtgtgtcccaacagaatacttctcttgaagggattatttctcccgtgagctccccggcgtatcccccctttctgtagaggcccccttctcgcttggtctccccgcgtgtgggggcttgtctcctccagagagagctctgttttgttttgttttgtccccccactccacccacttctcactggccacacactggcgtttttgtgccacatggtgggccacagcgagaggggtgaacgtgcgagatataattataagagctgcacattattgtagaaagtgccacacacagctcttttcccctcacgcttttttcctgtgaaatgaactggcttcccctcacaaattggcacctgaagaatttgctaacacacttttccccacacctggtaacactgaaaacactgagacccccggttccacaggtgtagaaacctgagtccccccttcccccatagccatccctgcctctcataagtcttgactctcctgtttacttttgcacaccaccccttaatttttaattggttttccttg

SEQ ID NO: 646259 - DNA, 206 bp, Homo sapiens
atcccgggattctattttgctgaatcaggattcaggatcccatgattctgttttgctgaatcaggattcaggaccttttttcaaaacaagtaaaacagaaaaataaagtgcaagtaccaacagaagcagcctccagaacttttaattgttatactcttacctctttttctctttttttttttttgggttttggttttcctttttta

SEQ ID NO: 646260 - DNA, 791 bp, Homo sapiens
  misc_feature (501)..(501): n is a, c, g, or t
  misc_feature (649)..(649): n is a, c, g, or t
cacgagggggcatgtgtcagttgggtggcccttctcaatgtggcacatttcttgccgtcatgtattactgcgtgctgtcgtttgcagaatgacatctctgaaaaggagcaacgatggggagccaagaccatcgaggggtctggacgcacagaacacatcaagtaggtgccgaaaggactggagaaaaggaagggggttatgggaagagcccaaagaaaactcggagacttgggggaaggtgagggaggaaaaggatagggtagttcatgtctatgtattattgtgtttgttttttttctagagtctgttcctgtgtgtacctgtgtgtcattgcatatttccattttatgtctctcctcttaccctcctcaaccctattatctatcttttatacctaacaactctgctatttccccaagtgggtctattggattaactgcctcccttcctttagtaaggcatgagagattcatagaggaagtggaccaaatactaaggtcntctctatctatctacctggcatcatctatctcctatctatctcttcagataaatgtaaatatgtatttagaattcagggtgacttccttcagatgaactaagaacaattcagtaaaagtcaaggtgaagaactcagaataaatgctanaaaaagaggccacttcagctcccataactggcccaaataacttttaaaatacagatttgtacttagctatttgccagaagtgggaagccatgaatggtaatatgaagaaatgtaacacttggaaaacctgtagataaaaact

SEQ ID NO: 646261 - DNA, 562 bp, Homo sapiens
tggcgagggtgtctcgctcggtcacccaggcgggagtgcaggggtgtagtccagctcacggcagcctcaaagttctgagttcaagcaatcctctggcctcagcctcccaaggtgcggggatctcaggggggagccatggcgccgggcccgaaaccaagctttcttatcccaagcacggacctttatcaggtggacctaatcctttatcatctcctaggtgtccctcatgagtgatcacttcacattcctcccacagtgagagctcacccacgggggcatattttccccatgggaaaagtgtggttatgggaagttccctgttttgggaaagaacaggatgggaggtgctctcgggggtgtcctcctaccaagcagcctgttgaaggcctcggggtgctcagggagcacgagcaacattcgccgtcgcttcagtttcatctggaggccacacagaatctccgccaccggccacccagatctcctcgggctcaggggcgagcaccttcgggggctcctcctcaaaggattcctcagattcgtcccacaattccctcttcttttt

SEQ ID NO: 646262 - DNA, 748 bp, Homo sapiens
gcttcaagatgaagctgaagcatctccttcccagccactggctggcagcaatgtctagtggaaggggagcgatgaacgcgagatcgttcgtacctttctactgagaagcgtagtggccacatgaagttgctgctgacgctctgggtgaagaatggaagggttatgtggtccgaatcatggggtgggaacgatcgaaacagaggttgccccatgaatctaagggtgtctctgatccatggccgtgtgccgcactggctactgagatacagggtgggattcctgttgacacgaccaaggagaactggagaaggaacacaagaaatatcagctgtcgctgcgttgtcattcgctaggcatgcaagatctgagcgttctgcaacattggttattgtcacaaaggaaggtagagaaggatacttcctagggactggactgatactacagtgcctcgccgaacgtgggccccaaaagagctagacagaatccgcatgacttttcaagtctctctagaagaagatgagtgtccgccagatatgttgtgaacgaaagcccttaacataagagagaggtaagcaaacctaggaccaaagcacccaggatgcagcgtcatgtaactccagagtgtcctgcagcacaaacggcggcgtatggctctgaacgaagcagcgtaccacgaaaaatatgaagaggctgcgaatatgctaagttgggccggaaatgaggagggaagggagcgcgggaccagtgg

SEQ ID NO: 646263 - DNA, 320 bp, Homo sapiens
tataacataacttgtttcgaagatacattcctcagtaacagactgagctcatgcatgcctttgtcactgaagttgcctaccaaatgaagcttctgcaaaacgaaaacatgagcttgagcctcttcaccctaatagatgctgctttgcttcagaaccggtcatccatgtagtcatatgctctgttgcaccagactttatgagtaaaaggcttaacccatccgttgcggagcagcacttattaggcctgataatatacctgccgtagaagctgttcgcagcagcattattctgcattccaacattgccagacttgccaacga

SEQ ID NO: 646264 - DNA, 259 bp, Homo sapiens
ccacgaggcacaatcgtggaaggatctcccattggccggttgggtgcaaaggcctgaggcactctttcatccccttttgtcctggcgatgactttcccattgacggtgcagtgtacgttgggcatctctgactatggtgtggactcgaggtgttgacctctgcaagctgaggatcaccacgaaatgcctgcgtctcccctggcatgtaagctgttggtagagtgagacaaagatagacgcacgccctgtatgtattcta

SEQ ID NO: 646265 - DNA, 406 bp, Homo sapiens
acatgaggatcaccacagttgtcataccttgcactgttgattcactagcctgcactgttgttcatacctggtcgctgtattgtggggtggactcataatcagaaaggacaggttctgacccaaattgcaatgccccaaactgcgagtgtttaactcctgacatatctagctgagaccaggctatttccacagacctagagcgatgtaatcttacgaatgtcaaggtatgcttttttcattctgcatgtttcaagtttctgactgtagccggcttgacgggctatgaggacttggccgtctgtaagataccaggcgacattctgtggagccgatgtggattttgcttgagcagaggagaagacggaggtggcaggtgcacgctgtggagggtatgaacaacagtgca

SEQ ID NO: 646266 - DNA, 187 bp, Homo sapiens
tggagctcggtccaacttctcatatttatatcttcttcgaaagcacaccttatcccaccctggtcgtatatcacccgtatgaggcaagcagccagaacgcctgagacgcaggcacatacttcctattctacaccctagataggctcccttcccctactcatagcactctgtttgtggaggtagcact

SEQ ID NO: 646267 - DNA, 740 bp, Homo sapiens
actgacaaaacgacaagagctgcaatgaccataaagaactatcaataagccaggtgttgaatgctgaacttttagaaagccatcaagaagaaaaaaatcagttacttaaaaaaattgctgcgaaagatgatgatctaaaaccgaacagccaaaagctatgcagaaatccttgatgctcgtgaagaagaaatgactgcaaaagtaagggacctgcacactcaacttgaggagctgcagaagaaataccagcaaaagctagagcaggaggagaaccctggcaattatcatgtaacacttatggagctacagacacagctagcacagaagacgcctttaatcagtgcttcgaaattgaacgagcaagagttcagagcacagcatcacaatttagacgaccgtttgaagaaatatgaaaagaatgtatatgcaacaactgtggggacaccttacaaaggtggcactttgtaccatacggatgtctccctctttggagaacctaccgaatttgagtatatgcgaaaagtgctttttgaatatatgatgggtcgtgagactaagaacatggcaaagttataacacgtactgagttcctgatgacagctcaaaaatttggaagagagatgccggtgtgttacttactccagggatttcggaaacaaagcggcaataatgtcggtccgtccctgaaaggatgggcgggtgactcactgacagaaggcagcccacacagggaaacggag

SEQ ID NO: 646268 - DNA, 178 bp, Homo sapiens
cacctcgcaactccgacttctcacgaccgggtgctcatctgtgtgctgtgtgtgctgtgcgttgtgtgtgtgctgtgctcgtgtgtgtgctgcgttcatgcgtgtgctgtgtgttgtgtgtgtcgcagcggggatgcataacgtatgagtgctttttaggatgggaattgagcatgta

SEQ ID NO: 646269 - DNA, 123 bp, Homo sapiens
tatgggcttttgccatatcttgccaaagattccctgtaaagtttaattctattaatggtttcataacccggttgatttaagtaatcatcagttctgtaaagtgcaagagcccgcccccccata

SEQ ID NO: 646270 - DNA, 483 bp, Homo sapiens
tactttccacagggactacacagcagagttaataagaaacaagtcatcagagctgagcttttctttagtagaaacaaattacatgaatataaggactgttgatgtgcaacagtctaaagcctgtgtgcttaaaatcacactaacagtctccttttcgtcttttgcagcctctttcattagcgaagcccatcctatgattattttacagggttctcaagtgtgaattctgctttagagacttgtaattcattaaacagggctagatctaactcctttaacccacatttcacccatggacgtctactaccttctttaaaagtctttcagtgtaggaagtgggaaggtgggatctgtaatttggatcaagtgatgagaccaaaagaagtcacagttacagtttcagctgtgaagtgtgatgcatactaacctagagactaactataaagcgtatgagtaggtttgcttattggtgaaggtgaatga

SEQ ID NO: 646271 - DNA, 189 bp, Homo sapiens
atgatttgttcccaaaggtttgaaacattcagtgaaactttttaaaactttgatggcatgaggtattttttttttaaaaagttattgtttgaaaaaaatgtctttttaaaccaggaaaaaagttatcctgaatgacgttgaaaactcccccccccctttatttttttttaatcaaaacatgtgaaagta

SEQ ID NO: 646272 - DNA, 886 bp, Homo sapiens
gatcgaaaggggaggtggtggagatccacatatgatcgaccaggtaacagcgcacggactcgcacaggtgggcaaactgacccttcaagagcacgcgagatggaggaccatcgatccgaccgtgggcaccaaagatagattcgagtccctgagccagaggaacaagggtccatgccggggggacgtgatcagccatcgagccaaagcgacgggcgaagatcatcgcagagttgggccggtcgcttcactcgcgcccgctagctaaccgaacgcgagtggggctcccagaccaaggttcgtagcagatgctcgcagatggggagctccagaaatacgcaaggaggtggtgcacactcgtgtccctgacactgagatcctgactgtcatcaactctcgcacactcagggcttcctgtgcgctacttctcaggtgacacagggcgagatcaacgtcagaagtccgtgagtcagatcaatgccaagggtggctgagtggcgcgatggagggcaagggcggagatcaagtcccgtgtgacgctgctgatttcactcgaacggagggtccgaacatgctgtgacatcaggatcagccttctccttcctcaaccgggccctggtgagaagtgacccctggccgccatggtctcgtgatcatagagccacctagaaaccggtggactatcaagcgacgaatccggggacacctaggcatagccagagcgcctcgacaggtctatcacccaattagacctgacttggaccggggcttgcgttatcggtcatccaagcaacctcccgtaacaaggcgcgaaaaagacactcgaaagcgggattcctccggcaattcggggtgcagaagggaagaatggcatgtcgggcagacttgg

SEQ ID NO: 646273 - DNA, 507 bp, Homo sapiens
  misc_feature (8)..(8): n is a, c, g, or t
  misc_feature (24)..(24): n is a, c, g, or t
  misc_feature (63)..(63): n is a, c, g, or t
cagactgnacctaggcacctactngcaccatcctgccctgatgcacttgggttgagagagggntgcgtgtgtgtgtgtgtgtgtagagaatatgtgtggtatgtgtactgggagaggtgtcccagacctctgccagctgtggcctaattgggagaaagaggccagtggggcacctcccttctgatctggagcttcttggcctaaccttaagctactgatcagtcccatcacttcagggcaaggtgtaccagggccatggttgctaacactagctgtaccaggtcgctcaccttcaggtctgcctgcccttggccctgagtcatggacaggagtgttatgttgtcttttctcttataaaatgtaaataatggctgggcacggtggctcacgcctataatcccagcactttgggaggccaaggtgggtggatcacaaggtcaggagatcaagaccatcctggctaacacggcgaaaccccatctctactaaaaatacaaaaaattagcc

SEQ ID NO: 646274 - DNA, 375 bp, Homo sapiens
  misc_feature (1)..(1): n is a, c, g, or t
ntacatcgagctcggctaccgatgatcaaatgtgggagctggcagccagttcccacattgattttttggtgaccttgggatctagttcactttagcctccgacacgtcttgtatccatttacgacgccatcaccccgccatcaatcatttttccttccgcaccgaaccgcttaagctatttggcatctgtttaatgtccgttgcgtttggccgaaggcatgtccgaaccgttttctctgatccagcacgtgccaggaacggcgcgggattgttcacgacaggttgtatttatgcaccgcaggaatttgctcaaagcgtccatggccatcgcggcttacaccggtctctcggccagcggcctgctggccgcgcaag

SEQ ID NO: 646275 - DNA, 484 bp, Homo sapiens
aaaaattggaaatatcttgtcatttaaacataaatcatgctctttgaaaactgtctattttagggtgaatttccagtttgaggacagttttgacatagaccttaagcacaaagtttggttcaaagagagatgtacaggacatgcccaagtataggcactggcttctcaagggcctgttccagggaatctgtcatggtaaagatgacacagctttccaagatcgacacagtcattttgtcagcacagtaagtgtgtcacagtggcatgcatggacgtacctttagattctgaagtaccctgaatgtcagtgaccttcctgtttctgaccatcgcagaggccatgtcccacccattctcttcagaatctgcattctgcttttcagatgagctgtgcctccatatgtactgctggatctgtctctccactgaggaatgaagaatttggccctaatcatgttcaacatacccctaccttatttcacca

SEQ ID NO: 646276 - DNA, 231 bp, Homo sapiens
cattaaatgcaagctattactgttctgccacatgaatatttattgtttgtttgcttagatgagatccaatcctttcaaaaaaaaaaagcctaaattttgggtgaggttgtttccccagcattgtaaatccattatgtacagaaattgtttccaataaaataagattaaacttaaaagtcttgaaaatgtagacccaatggcttaagaacctgccaaaatatgaagtccata

SEQ ID NO: 646277 - DNA, 223 bp, Homo sapiens
cctcactctactgcccaataatactatcaacctactacaactaatatatgacatagctttactactatagcttttaattagtaagatacctctttacggactccactctataactcccttacaagtcccatagtctgatatcccccatcgctggcgttcaatagttacttgatcgcatatactcgttaataactagcgcggactatggatatatatatcgcct

SEQ ID NO: 646278 - DNA, 1306 bp, Homo sapiens
  misc_feature (427)..(427): n is a, c, g, or t
agcatagtgtctggggcccataacaatgcttcggcatgaatgctttagacctaagacaattggctcctaaatgtgaaaactgcaaggctgaaatgaatgcatgtttaatgccttacaacattgtcaagtgatcagctgcaactcctttctgagggcatgatgcctgagatatgcctgtaatgcgggttgattttaattaatttaatatggtgtggagtggggccttcaaaagtaaagacgtcagttctacgttggttacagggttatgggcaaaggtcttaaaaccccatggtgagcagatggccaatcctgaacaccccaattttaaaacagggctttttttccaagagactttttgaaaatagctcctattttgagaggaggaacccaggcaggagagagacagagttaagcccagctgagaggnggttggtaggcaggggcctgcctgatcctcactgaagcttggtactcagggtgagcttcctaaaccagtgcagatttgccggccactgagcctcccaaatgagaacctgcatttcaacaaggtccttgatgcagcaaagtttgagatatactgccctagaacacttcagggacaccaaggttctctgaaaacttaaggaaagggccaggttgtagtgctaatgcctggaaccttgaatttgcgatgccaaggtggccgttcattaagggcaggaggttgggaccagttgactcaacatgtggaaacccatgtttccaaaaattccaaaattacttggttcgggccggcccacgggtttatgcttggagcccagaattttggagtcccacccgccaaatccagggggccggtaatcggacccttctgggttaaacgctgaaccctggttttctaaaaccacaaaaaattcccctcctggggcatgttccttgaccccactattcggaggccttggtggaaattgcgctaaccttcgggggtcttactggtgctcattgccccatcttctccctcttgaaacatcccactttttttaaaactaatatttttgcgacaggcggttcttgatccccctctctttggtctacaccgcacattctcatctctatgcaagatacatctcagagtgcaacattaacccctctgtatgggctcctctacaacttaaccatccccttcgacaacacttccatacaattcgccctcttctcatatcaatgcgagtctctattctcctctaatcctttctttctataatatggcattatctccgtcttttactattgcgctccttctatatctctgctgttcctacttccc

SEQ ID NO: 646279 - DNA, 441 bp, Homo sapiens
  misc_feature (114)..(114): n is a, c, g, or t
  misc_feature (116)..(116): n is a, c, g, or t
aaggagacacataatggaactaatacaagcccctctcctcccctcctgttctcctccctgtcaagaggtgaacagctcatagaggactagagtccaggctgcaacacagacccnancgtccatgaaaaggatctgcatctgtgatgggaaggagaagttcaattaaaagatatcaaagggcgaaaaaaaaaaaaaaaaaaaaacaaaaaaaatttttcggccgcctggcccctgaagaaaagtttcataaaaccaatcggttgagggcagcccggccccacgatgagcatacctgaaacggggccacaagaggtgctcccagaagaagaccggggcccacggacacaggggcgggggctcccgcaccactatacaaacgcccgggggaacaccgcaacggttcgcaaccaccaaaaggcgccaggacggccacagggatca

SEQ ID NO: 646280 - DNA, 149 bp, Homo sapiens
tgcggggataacaggcatgagccaccaggccgggcctcctagggcactttcggtgggagagctgtggggttcaactctgtcttctttcaccaggccgggagaggtgcctttactggtggaccggttcaggagtttccagcaagaagagg

SEQ ID NO: 646281 - DNA, 426 bp, Homo sapiens
  misc_feature (426)..(426): n is a, c, g, or t
gagagagagaacttactggaaactggagcaaaggtcagttttgttatgcattagcaaagcacctggctgcattgtgcccctgccctagggatctgtgaaaatttgaacttgagaatgatttagcctacctggcagaataaatttctaagcagcaaagtgttcaagaagtagcctggctccttctggtacctatgttcatatgtgtgagcaaagaaatgatatgaaactggaacttatatttaaaggaaagcagagcataaaagtttggaaaatttgcagccaagccatgtgatggaaaagaaaatcccatattcaggggaggaattcaatcagcctgcagaaatttgcataactaaaaggaacactgctgatggccaagacaagggggcactttgaaggcatttcagagctttgtggcgcctctcn

SEQ ID NO: 646282 - DNA, 325 bp, Homo sapiens
ttggcacgaggggggtccccataccttgttggggaacagtccccacctgtgggcaattggcccttggggctttgttggtacatgccaaagaggggcaaggcaatcagaggggctttgtgcaatagcttttgcatccgagctcccgccagggcgtgagcatgtcagtattctagtccagtatttgccggtttccaagtaaaaggggggcaaggcaatcagaggggttttgtgcaataggttttgcatccgagctcccgccagagcgtgagcatgtcagttttttagaccggtttttgccagtttccaagtaaaagcttttgtgtta

SEQ ID NO: 646283 - DNA, 670 bp, Homo sapiens
tgcccacaccaacatggtccccctacacaaaaacaatatgcacccttcttgaataacacccaccaatggggcatttttgtaaactaatatccccccgacccctccactgtagagaacaacttggaaaacactttttacaaggaccctttcatgcggttcttcataacctcaatgacccgctttttcccaaaaaattctatactcactactgaaaccaaatatacatcatgaagaggcatgatatgacacacataaatagtcccccggcaaaataataatgggtggaacaataatagcgtgggaggaaagaaaatgagggctccaaagggagcatggtcttctcccgacaattcagcctcgtggtgttccttctatatggaggtaaacagagttagtcttctggttctcaccagcgggtgtcttcccacaaattctgtctgcggacgcagacttaaaaccgcgcttgttctttagtacgcaagactaattatcatagggcggggtgtctgtagcagtagatggagtctggtgataccacctcctgtggggaacacctctccagggagagtcgtccccaccaagagtagtaccgcccccctagtgaacgtggttaaagacacctggtgtgcaccaacaagtttttcctgagccatcactgggccacatgaca

SEQ ID NO: 646284 - DNA, 416 bp, Homo sapiens
gtgagagagacgaggcggcacactatgaggcgggatatctgctgtgggactggaggcccagaaacggtcatgtgacctgtggcggcttgagtgccgcatgggtctgagggggcgtctattcttgaggcgtttgcggcccggaaggagcggaagtgctgcgggcctctcgggtgcttcttgtcggcttgcaaacaggacttggtggctgaaattgccaagaatctcatcttggcaggagtgaaaggactgaccatgctggatcactgaaccaggtaactccagaagatcccggagctcagttcttgattcgtactgggtctgttggccgaaatagggctgacagcctcttttggagcgagctcagaatctcaacccatggtggatgtgaacggtggacactgaggatatagagaaga

SEQ ID NO: 646285 - DNA, 169 bp, Homo sapiens
aagccgtcgggagccgccgccgccatctgagggaggtaccctggaaaccacctttcacggtggggaagtgcagtcgcggtgggcagctctggggccacgaaacgggagcctctaaatcttggtcgggactgctcgcctggagccgcactcttgagtccgaggccatctt

SEQ ID NO: 646286 - DNA, 909 bp, Homo sapiens
  misc_feature (791)..(793): n is a, c, g, or t
  misc_feature (800)..(800): n is a, c, g, or t
agcgggcctgcctcttccaggctgcgtggccggggcgtcatctcgcgcttccaactgccctgtaaccaccaactgccattattccggctgggacccaggacttcaagccatgtggcgcgtcttgtttctgctcagcgggctcggcgggctgcggatggacagtaattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagccacagcaagattttgcaaagtatatagaaatgcatgttatagttgaaaaacaattgtataatcatatggggtctgatacaactgttgtcgctcaaaaagttttccagttgattggattgacgaatgctatttcgtttcatttaactattacaattattctgtcttcannnggagctntggattagattgacgcttaaattggcaacactggagaaagtaatgaggttttccccacattttaaagaaggcaaaaattcttatcctggtgaaggtcctcatgaagtgg

SEQ ID NO: 646287 - DNA, 524 bp, Homo sapiens
  misc_feature (30)..(32): n is a, c, g, or t
  misc_feature (74)..(74): n is a, c, g, or t
  misc_feature (293)..(293): n is a, c, g, or t
  misc_feature (484)..(484): n is a, c, g, or t
atggcgcgacactcgatgtactggatttcnnnatcgctcggccgagcgcctcggtcagccggcgctgcgctggngagtagcaggcagccgtcgccagttgcggttgagcaatggcatgacgctgaaggccgatccgctgtccagcatcagcgatggggctgccggcgtactggtcatccccagcctggggctggacggcatgctcgatgccaacgggcacgagccatgtggactggatgcccgctacaccgacggtattgcattgcgccggttggccatgccggatgcccagnatctggcacgcttggttgcccacttccacgcgagcgggggcagggtgtgcgccagctgtacgggggtgctggtgctgggggaggccggattgctcgacggccgtcgtgtcaccagtcattgggcattggggggccttgctgtgtaaggcgttccacggcagggcacggttggatcccggcctgcatggtgncagaggaggggcgaccgaccacgttgccggccaacatggg

SEQ ID NO: 646288 - DNA, 832 bp, Homo sapiens
  misc_feature (261)..(261): n is a, c, g, or t
gcccgaaactcgtgcgggtaggcgtctgcgctcggttggagggctcggtgcgggctttcctgtacctgtcttctgcgcgtgtgcagttcggggacttcggcctgaccaagaccccatggcttcagaagagctacaggaaacgatctaagaaaagagggtaaaggtggtggttggcttggaaaagggctacgtagagaaaaggaggtacgttgagtgcgcctttacatgcgtgtagggaaattcgcacacgtactgtgaganctcggaagtcaaagggaagcagaggattgcacacctagaaaatcactaggataggagaaaggcaatgaaaagttctgggcattaaatgaacaagagcaagcttgctgtggggttgcttccgctataacaagcgggtctataaccgggggaagaaactcaagtaatgtatggcgatggcggatcacgtcagataaagtccgtgaaaatctacatttacgctgtaacctggaagttcagtcaaagttcccactgacgaaatgttgcaggtgcatttcacagagagtgtcattggaatctttcggtaaacgaaatctagcatgggaagatgttaactcacacttgattggtgaacaaatctcgtgtgaaagcccgatcctctggtgggaaagggcacgttctagaaataaacgtcaagactgattacaggtttcttgatactggtggtacgaagccgaaaatgtggaaaaaccgcaaggtgggggaatgacctggaccgcaggttgaacaggcagtgccaccggaacaagaagaagccctcctatgacacttggaagcaagttcctagtgaggg

SEQ ID NO: 646289 - DNA, 959 bp, Homo sapiens
ggtataggtgtatgggtgtttgtgatgtgtaggaaggggtgttggtttttagggcggtgccgaatgtagggagaggttcatggtgtgttagcgggtgtatatgatgggtgttcagtgatagggcaatgaagtaccggtttgagaggttcgtgtatacgcgtgtgtgtatgtcgcctgtgtttatgtttttaatgacaactgtagagagagatttgtgcaaagacgaagttgtgagaagtagatagatagaaatagagtatgatgtgttggattattagtggccatataaacagggcagtggtcaaaggatcctgcttgtgccaaagtaggtgttggtctgttggaacatgcactgtgatactgtcttagaagaagttgataggtgttggtagtgaaagactgtgtgtgtgttgttacaagtgtgtcttgttagagtagagattgtagaacagcagcgtggtctctgtcgctgctcattagtctgtggatagagaacgcttgaagtgcatgtcatggttgtggaaacgcaggggtatagcccttttgtatgtttgtagcgttatagaattctggggtagctgacaccttcagcaggcttaagtatatgaacactgaaggtgtttgtgctgcagcaatttgcaagctagagagcgtgtaaagcatggttaggtactaacttcacgtgattgtcagcttctgagaacgtctgtaatactggacagtgatgctattgtttatgcttacaggaaataagaggtcaacttgtagtatatttttctcgttgatacaaagaggactgtacgagaactttgtttcctgaatatttttcttctcttgtacaatatccgtgacatcctaccagtactcttgtccgtaccgggtttttgttgttttgctgttcgtgtataatagtagtctaatgattggcaaagaattgaatgtttttgaagtatacagag

SEQ ID NO: 646290 - DNA, 595 bp, Homo sapiens
  misc_feature (360)..(360): n is a, c, g, or t
ggtcccctgagccaggctctctaaccttgtgacttgtagtcgtgagtctcattcttcatctcgaaacggtctgcggggctcatgcggtcaaaggagggggggtcgttgacaggtcgggctcacatttcctctcccacagaagccccgtccagagctgctcggtgccctccaccactccatgggcgggtctgacgagtgggggtcccatactggcatcgtgggcggtggtgtctcagtgccctacattcttcggtgagctccccatatgtaagaatcacttctcattgttttggtccgctcagctaaaagaggggggtgatcaataataacggtcaaggtaataagggagcctgctatggnaactgggcagattatcggtagcagaaaacctggatgtggggaagggaatgacgtgagagtagaacttagcgggggctagttcgtccagagtctcgagtctgggggaggacctggccctttcatcttaaccaggggttgctggaatccgggctccggaagctctgcctttcgagagaaatcagcatttaggccggtgacagactcaggtgtcctgggtgtgccctccagggaatac

SEQ ID NO: 646291 - DNA, 710 bp, Homo sapiens
  misc_feature (638)..(638): n is a, c, g, or t
  misc_feature (657)..(657): n is a, c, g, or t
gcggaggtactcttatccttgtgcctagcgcagtcatggctcgtggtcccaagacgcatctgaagcgggtggcagctccaaagtcattggatgtctggataaattgactcgagtgtgtgtgctcctcgatccataccaccggctcgcccgacgagttgagagatgtgtttccccctcatcatttgaccgtgcaggaagcagacgttaacgtatgcccttgacgaggagatgaagtataacgagacatttgacatgcacgcggtgtacaaccatgagtgcgatggcaaaggtaccgaacttgacttagtaaccctaccctgtcattgcattctcgtggattgctatctccatacatgtgacaacgacgtgggaaagaggagatttccagtccttgatctacttggaccacccacaggggtctggttacgtcttgtacagtcgctccttcacaccgtgcaggtagggcacatagttcagcaagcttgctcgcaaagtgtgcacgatacacgagtctctctggtggcggccacgagaagacgggacattcccccctccaatctgttgcctgggaccttccaatttgactggccgggcgtgatgccccacttccgttcctttaccgaccgtgaatttgcgcnctgtacaattgcaatggcntgcagagatgacgtatgcctaatttgtcacgagtgtgcgcacttccctttgca

SEQ ID NO: 646292 - DNA, 614 bp, Homo sapiens
  misc_feature (13)..(13): n is a, c, g, or t
  misc_feature (68)..(68): n is a, c, g, or t
  misc_feature (187)..(187): n is a, c, g, or t
  misc_feature (198)..(198): n is a, c, g, or t
  misc_feature (285)..(286): n is a, c, g, or t
  misc_feature (306)..(306): n is a, c, g, or t
  misc_feature (388)..(388): n is a, c, g, or t
  misc_feature (430)..(430): n is a, c, g, or t
  misc_feature (453)..(453): n is a, c, g, or t
  misc_feature (580)..(580): n is a, c, g, or t
cagcctgcttatnaagcccctcttcagatatgtaccaggtgttttaaacagaggcatcatttaatggnaatctgcacttcagaacagcacttgagggaccagccattggccctccaatgtaaatacttctcatttcacattatcagagaaacagtgcagtttactaaccactccttccttataaganattcagtagcngtgaaattttttttcagtttcaaaacatttcaatactttttaattccaaagatccggcccccatgtggttgtggcattttgggagtnngtacactcgggggggaggcngtgtttaggatgaggtgggtggggtcatacttcgtatagaaacttgccagagaatatagaattattggggagattgtgaaanacttccgtgaggatgtgaactgtactccatagtccagtggtncccaatgagtggggagccttgcnttaccctggtcaggagtgtcgaaaggtgttcctttcactgcatgcaaaaatacgtacatccccagattatgtataatatttgttaaagtccaagcaacaggaacactgaagaagggaatgctgagtnagacaatatgaagcaagccaactcccaatgcata

SEQ ID NO: 646293 - DNA, 228 bp, Homo sapiens
tccgccgcccacataacagcccagcctcggcttcagcttcagacattgtgtgttttctgttctccgcgcctccctcagtgagtcttttagtgctaaaggagtttagttgtgttcgtctggaaggattggagctcctcgcctcctcctcaaactcaccttcgtttcagattaacatcaagacgcttttttattttgactgggtttcataataaagagattgacatccta

SEQ ID NO: 646294 - DNA, 163 bp, Homo sapiens
ttacatcaggaaacactgagttggtggtagcagacatagctgtggtcttgtacgtaaattgagatcctgacatgtagtgcacattgatgtatagcttgtactgaccctgggtttagacgaccagggttggtttaatacactccattctaggccaaatcaggac

SEQ ID NO: 646295 - DNA, 114 bp, Homo sapiens
tggacgttatgggaaagtagttagtgtaaaaaacatcaatcatctaaattaataaggtgatagtaaattataccttgtagttatagtatcatcatcatcctacagatcacaata

SEQ ID NO: 646296 - DNA, 474 bp, Homo sapiens
tttgtctagagtagttatgaaggaatgagagcatctttaagggcgatgttgtgtaactgctgttagtgagtaacatttggtgctgtattttctattgagtcattagtctgtttgcttatttgtaggagttctatcatatttgctagatataaagtctattatcagttataacttattgtagagatagtttactctccatctaggctatatcttataaaaatctgcaaaaaacaatgttaacttcttttccccccatttaaaaaaaaaaggtatcctgggggtttgacatgtctgtcagttttaatggtcaagtttaccaatattcctttatgggtatgagtttgggtatgtgatttatgagacgttcgttaaccggatgtatggaaaattttctctaaagtattcatgtaaagggctaagggtgggtaacagttgggttgttcacattgaggtcttaaaggcatttgaaatttt

SEQ ID NO: 646297 - DNA, 141 bp, Homo sapiens
gcgcctcgactgtacaaccaagcacaggcatgctcataaggaaaggttaaaaaaagtgaaaaggaactcggcaaatcttaccccgctctgttctaccaaaacacatcaccttctagcatcacgcagtgattagaggcaccg

SEQ ID NO: 646298 - DNA, 235 bp, Homo sapiens
aatactgctgtttcataaacctgcaagtggaagataagctgttcaataaaagccttctttcatatatgtatctatatatagtgatacagacgttattttagaggtctgttcatatacagattattttggtactacaaagttgtacacattcatcattgtatggctagaaatgaacccatactaaccagacacacagggctttccgcacttgttgtaggaaagcttccactattct

SEQ ID NO: 646299 - DNA, 4741 bp, Homo sapiens
ctcgactttttttacacatatggagacttggagattcaggttctccttagatctctctgggtaatttattagaaatgcttacatagatttgcttcctaatctcaagctggcttcccctctccacaactcagcaactatctattctcccaggaggccatacaagcgaggggccctgaagcttaacatttattaacttcatgtaaaggtctgagcggacctttcaggccaggcagcgtgtcacttgcctgtgttccttgttagggcctaccaccgggtaggtgcttggaatgtgctgtggattaaaggcttaaatcctgcgggcccctcaatctgatctaaggacatgagtggcttagagaacggcgcaacaaggctaagcgaaagaaaacaaagcggtgtggctgggagtgggctccttccctccgctggtgagggtgcgatcttagactcttgagagaacccgacataaaggccgcgttccaatggcggccttctcccctaccggccaacctgccccgaaaagagcagaaggcaccctgcgggatctgcagatcagcttgcgtctcattctggggcaccgacacggtggaatgcaagacaccccactaccggaagtttctttgatgttaagaaaaacggcggaagtaggccgcagcgcttcctcagtatagtgcctcgagctggctcgcctactttctacggtaaagggaggtgctccacatctctatgcagctgtgcagcgccgcaggttccatgcgcaggctcggttggctaaatgcgctttccagccatctttcagccacccagtcctttcccaggttctcgagccaggacgtgacgtattcagacgtactgggggcggggcctcaaggggaaaagcgcctgagccgggatatcgcgagaacatcccgttctttcgtagctctggtgctgcggctccgctctcgtcgcaacgagatctttcgagatcttctccgcccccgctaccggcgcctcctctgcggccactgagccggagccggcctgagcagcgctctcggttgcagtacccactggaaggacttaggcgctcgcgtggacaccgcaagcccctcagtagcctcggcccaagaggcctgctttccactcgctagccccgccgggggtccgtgtcctgtctcggtggccggacccgggcccgagcccgagcagtagccggcgccatgtcggtggtgggcatagacctgggcttccagagctgctacgtcgctgtggcccgcgccggcggcatcgagactatcgctaatgagtatagcgaccgctgcacgccggcttgcatttcttttggtcctaagaatcgttcaattggagcagcagctaaaagccaggtaatttctaatgcaaagaacacagtccaaggatttaaaagattccatggccgagcattctctgatccatttgtggaggcagaaaaatctaaccttgcatatgatattgtgcagttgcctacaggattaacaggtataaaggtgacatatatggaggaagagcgaaattttaccactgagcaagtgactgccatgcttttgtccaaactgaaggagacagccgaaagtgttcttaagaagcctgtagttgactgtgttgtttcggttccttgtttctatactgatgcagaaagacgatcagtgatggatgcaacacagattgctggtcttaattgcttgcgattaatgaatgaaaccactgcagttgctcttgcatatggaatctataagcaggatcttcctgccttagaagagaaaccaagaaatgtagtttttgtagacatgggccactctgcttatcaagtttctgtatgtgcatttaatagaggaaaactgaaagttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaattgatgagtgcaaatgcttcagatctccctttgagcattgaatgttttatgaatgatgttgatgtatctggaactatgaatagaggcaaatttctggagatgtgcaatgatctcttagctagagtggagccaccacttcgtagtgttttggaacaaaccaagttaaagaaagaagatatttatgcagtggagatagttggtggtgctacacgaatccctgcggtaaaagagaagatcagcaaatttttcggtaaagaacttagtacaacattaaatgctgatgaagctgtcactcgaggctgtgcattgcagtgtgccatcttatcgcctgctttcaaagtcagagaattttctatcactgatgctaagaacgcagtggaggaatatgtgtatgaaatgagagacaagcttagtggtgaatatgagaagtttgtgagtgaagatgatcgtaacagttttactttgaaactggaagatactgaaaattggttgtatgaggatggagaagaccagccaaagcaagtttatgttgataagttggctgaattaaaaaatctaggtcaacctattaagatacgtttccaggaatctgaagaacgaccaaaattatttgaagaactagggaaacagatccaacagtatatgaaaataatcagctctttcaaaaacaaggaggaccagtatgatcatttggatgctgctgacatgacaaaggtagaaaaaagcacaaatgaagcaatggagtggatgaataacaagctaaatctgcagaacaagcagagtttgaccatggatccagttgtcaagtcaaaagagattgaagctaaaattaaggagctgacaagtacttgtagccctataatttcaaagcccaaacccaaagtggaacctccaaaagaggaacaaaaaaatgcagagcagaatggaccagtggatggacaaggagacaacccaggcccccaggctgctgagcagggtacagacacagctgtgccttcggattcagacaagaagcttcctgaaatggacattgattgattccaacacttgtttctattaaaacagactattataaagctttaagttgtcaactttgttctaaatatcaactagcgcaagtgaatactgaagatttcttagtcagtttttaggggattttcggggaggggaaataggtaatgtatggagcattttcacttctaaatagttagatacagaaattaagtgcattgtatctttttcataatggtactatttagaagcccagttagtcttactgagcttatgcttcactcctttatgtttaaccatgtgtctacaagaataagtttgttttggaaagttgagctatagctacagctctagctatccagcagacttttcattatgacttacatggcaggagctctaattatgctttaaaaatctgttgtggagattgctttaaatgctccctgcctggtgtggggatggggtccccctctttgtgagggctggagcatggcacggcatggattaacacggcagaggaacaaaggtgtgctctgagcttcttcatatttcaccttcaccctcacctgtgttctcttccctctctcccaataaaagggctcccattataaatgccatgtacttctcttgggaaaatagacccccttgcctagagtaagttgttaactgagggctttaaacctggaggctcttcctgaaagtatgttcatgaataccccaagcatcaaggtctaaataattttcagaagattagaattgggtagatatactgttggatatagccatggtaaatttaactgaggaattaaatccttgttaattttggtgtaaagatttgtatcctggcctgtttattcaggtgggagatgttctgtataattttgaggtatagcttgaactcctagaacaagagttaaaagttctttttagctcattcacaatcacttgtgtgttaagtgttaatatctgtcatgaacctgccaatttgtacgtgttaagcagctgacagatgatgcaaaaaaaactaagatacactggattgtactggatgagtctgaaattagtgttaaagaagtgtggtgcctgatgttataacaacacctcattcttaactgtgtggccaatgtcaggtataccaaagcattcctctgactgctttttggggcagtgttgacaggagtgaggcattttggaaactccaagggaagcctgtgtttgaggccagagttggtacctgctttaagaaactgttacagggcttgttggtaatgttttgaatctttgtaaaaattgatattctgtataacagagtgcctctctgttacttttggcctatgttgttagaaataagatgctatcttgcatagttagaattaagcgtttgtccatctctagataacattgaaaagtttgagtgttacaggctctaaagtgcaatggagaacaattgcttaggaggaggaaggggaaagtatacttatgttggtgtgtaagcatgcatggaggcctcgaggcaccacaacaaggccaggttcttagcacatcctctgttctctacctgtcatgcttcaagagttccagctggcctgctgtgaagccagtagctattttaaaagtgctggctgcaggattaagccaaccctttacaactggcccagaccgtaatggccatttcttcttaaaaaaaaacatctgggttttta

SEQ ID NO: 646300 - DNA, 711 bp, Homo sapiens
  misc_feature (1)..(1): n is a, c, g, or t
ncttggcgagagctccaccgctgatgccaacgaggccatttttttttttcttttggaacacaccccctcagataaggggggactactgtattactttttcaaaataaacaaggaaaaaagaccaggcaaggtccaagacattctagggcttctagttaattgcggaaggcaattcatcacaaaaacagatatatcagtcaattctgtgcaccagatccagatatgaggatcacggttattaggtagtttcaatgagggagtggaggaatgactcttccaggagtccaattcacttgcttcaaaagggcagtctctatcggctagtcctgggatgtgggcctggtcccacaggctgccagcagccaaagctaacaggctacagacgaacaaaggttcattgaggagctggcacgcgggaggggccactgccaatggcttgacaggaggggcagtatgcatgtcgggccacctgcccgagcagagagtctcctatggaggaaccccagggggtttcaggtcctgctccatcctcctcgtggatctcttggcatcttttttcttacattcaaagaacatcctgttggagaagtaggatccgagggctgtggcgggaaggctggtgcacactccagtgtgcgagtgttcgagtgcctgcaggtgctccgcccacatgcgtgccagcttgtttgtgagggtgtatgtttgtctttt

SEQ ID NO: 646301 - DNA, 495 bp, Homo sapiens
agatagacagccaggtaacttgagtggacctgtggacaccatcatgtcacaagcctgaaaaaaatgtttatgtctgctttttaaatatattatacttacatgtgcacatgtgtgcatatacattcaaaatttgcattgcataaattgtttatttaactaataagactactactattaagaaaatgcattcttccttcacagtgtgttacgaacttggctaattgtactaatgttgtgtcctaattgcttacatggaagtactgctgagaagaccattttgatcacttggcaggttcttcacacttgagatggggtctggcttccgagggactgtgttgcagactggtgatcaacgttttttggcaaaactggccagcttttgcctggtgcctgcttactttccctgaagttcaccccttcttctttgtggcccttcttttaccccccatttaaaaaaaaacctcgcccccaatttcttcggcctcgggggcccaa

SEQ ID NO: 646302 - DNA, 3492 bp, Homo sapiens
ctcgactttttttacacatatggagacttggagattcaggttctccttagatctctctgggtaatttattagaaatgcttacatagatttgcttcctaatctcaagctggcttcccctctccacaactcagcaactatctattctcccaggaggccatacaagcgaggggccctgaagcttaacatttattaacttcatgtaaaggtctgagcggacctttcaggccaggcagcgtgtcacttgcctgtgttccttgttagggcctaccaccgggtaggtgcttggaatgtgctgtggattaaaggcttaaatcctgcgggcccctcaatctgatctaaggacatgagtggcttagagaacggcgcaacaaggctaagcgaaagaaaacaaagcggtgtggctgggagtgggctccttccctccgctggtgagggtgcgatcttagactcttgagagaacccgacataaaggccgcgttccaatggcggccttctcccctaccggccaacctgccccgaaaagagcagaaggcaccctgcgggatctgcagatcagcttgcgtctcattctggggcaccgacacggtggaatgcaagacaccccactaccggaagtttctttgatgttaagaaaaacggcggaagtaggccgcagcgcttcctcagtatagtgcctcgagctggctcgcctactttctacggtaaagggaggtgctccacatctctatgcagctgtgcagcgccgcaggttccatgcgcaggctcggttggctaaatgcgctttccagccatctttcagccacccagtcctttcccaggttctcgagccaggacgtgacgtattcagacgtactgggggcggggcctcaaggggaaaagcgcctgagccgggatatcgcgagaacatcccgttctttcgtagctctggtgctgcggctccgctctcgtcgcaacgagatctttcgagatcttctccgcccccgctaccggcgcctcctctgcggccactgagccggagccggcctgagcagcgctctcggttgcagtacccactggaaggacttaggcgctcgcgtggacaccgcaagcccctcagtagcctcggcccaagaggcctgctttccactcgctagccccgccgggggtccgtgtcctgtctcggtggccggacccgggcccgagcccgagcagtagccggcgccatgtcggtggtgggcatagacctgggcttccagagctgctacgtcgctgtggcccgcgccggcggcatcgagactatcgctaatgagtatagcgaccgctgcacgccggcttgcatttcttttggtcctaagaatcgttcaattggagcagcagctaaaagccaggtaatttctaatgcaaagaacacagtccaaggatttaaaagattccatggccgagcattctctgatccatttgtggaggcagaaaaatctaaccttgcatatgatattgtgcagttgcctacaggattaacaggtataaaggtgacatatatggaggaagagcgaaattttaccactgagcaagtgactgccatgcttttgtccaaactgaaggagacagccgaaagtgttcttaagaagcctgtagttgactgtgttgtttcggttccttgtttctatactgatgcagaaagacgatcagtgatggatgcaacacagattgctggtcttaattgcttgcgattaatgaatgaaaccactgcagttgctcttgcatatggaatctataagcaggatcttcctgccttagaagagaaaccaagaaatgtagtttttgtagacatgggccactctgcttatcaagtttctgtatgtgcatttaatagaggaaaactgaaagttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaattgatgagtgcaaatgcttcagatctccctttgagcattgaatgttttatgaatgatgttgatgtatctggaactatgaatagaggcaaatttctggagatgtgcaatgatctcttagctagagtggagccaccacttcgtagtgttttggaacaaaccaagttaaagaaagaagatatttatgcagtggagatagttggtggtgctacacgaatccctgcggtaaaagagaagatcagcaaatttttcggtaaagaacttagtacaacattaaatgctgatgaagctgtcactcgaggctgtgcattgcagtgtgccatcttatcgcctgctttcaaagtcagagaattttctatcactgatgtagtaccatatccaatatctctgagatggaattctccagctgaagaagggtcaagtgactgtgaagtcttttccaaaaatcatgctgctcctttctctaaagttcttacattttatagaaaggaacctttcactcttgaggcctactacagctctcctcaggatttgccctatccagatcctgctatagctcagttttcagttcagaaagtcactcctcagtctgatggctccagttcaaaagtgaaagtcaaagttcgagtaaatgtccatggcattttcagtgtgtccagtgcatctttagtggaggttcacaagtctgaggaaaatgaggagccaatggaaacagatcagaatgcaaaggaggaagagaagatgcaagtggaccaggaggaaccacatgttgaagagcaacagcagcagacaccagcagaaaataaggcagagtctgaagaaatggagacctctcaagctggatccaaggataaaaagatggaccaaccaccccaagccaagaaggcaaaagtgaagaccagtactgtggacctgccaatcgagaatcagctattatggcagatagacagagagatgctcaacttgtacattgaaaatgagggtaagatgatcatgcaggataaactggagaaggagcggaatgatgctaagaacgcagtggaggaatatgtgtatgaaatgagagacaagcttagtggtgaatatgagaagtttgtgagtgaagatgatcgtaacagttttactttgaaactggaagatactgaaaattggttgtatgaggatggagaagaccagccaaagcaagtttatgttgataagttggctgaattaaaaaatctaggtcaacctattaagatacgtttccaggaatctgaagaacgaccaaaattatttgaagaactagggaaacagatccaacagtatatgaaaataatcagctctttcaaaaacaaggaggaccagtatgatcatttggatgctgctgacatgacaaaggtagaaaaaagcacaaatgaagcaatggagtggatgaataacagctaatctcagacagcgagttgcctagtccaatcctttaaccgcctaa

SEQ ID NO: 646303 - DNA, 1440 bp, Homo sapiens
  misc_feature (1)..(1): n is a, c, g, or t
  misc_feature (907)..(907): n is a, c, g, or t
  misc_feature (1235)..(1235): n is a, c, g, or t
ntttctgcagtcctcgtgtcgctcatctttcttgctcgtctttgctttctctggtcgtcgtctacttcttccatcgttgattgtctacgctgtgttctgctttggtggtgcttcgtgtgtcggtctgttcctgccctctccttcgggtttttcctcttgtgttcccccctccgcggtcgcttgtcctcttttactgcctttcccccctttttgggacttttctgtccgtgtttttctccctcgcggtaaaggtgccgcctttcacacgggtatacccttgtttgaacacgcccccagggggcccttggccgcggtatctcatccgtgggccccttccccaagttgggctgtgaaagcattgtggatgtcttcccccattctggtgttcccatttaggggggacctttcccctggtggtgatatccactccggttgggtcttttgtggaatttttgaggtgttatactcctcttgggggtacccttccctcggacccagacttttgaggaagttatctttgtagggaaccaagcgccggagtccgtgttcgcccagtattggaggttacccaaaggtcctgggttccccggttctctgtccaggataaagggcccataggtattttatgatgccctttttcgcccccccctgtacccccctaccccccggatgtccccgtcctcgttcttagtcgtatagcttgtgcctgtgccaccagagaccccgctgggctctccacgggagcactgtagcccaacttcacttctccactcttctgcgccacgctctttataaggaggttttccctcgcacgttcccgccctcgagagggctttctttcgcgcacaaattggtatgccactcggggcacccctccacgagtttttttgtttgtgttataaatggngccacttccctcttctcttctcggtccacgagaaccccccgggttccccactcgggcccccacaccgaagagactctatatgtgtggtttctctctaatggaggagatctctataaagtatatgagggcgcttataggacacacctatattttataattatattgttttataatcttattttaaatatatgttataaatatatgtggagaagctcgaggtgtataatcttatatgtataagtcactaattgtattaattgttgtttaagaaagtgatcccccctctgggaaacccactctttatatgtatattatagttttgtagaantatataatggagaagtgggctaatgcacgctttgtatatcccttgtttcacgagccacgatcacttttcttggagaagtgtaaggcttatcctccaataaaatggctaaacttaatacactatttttataagaaatatttatattgtatttatataaagtataaatggtttttatacccataaatggcctttttaaaaattccca

SEQ ID NO: 646304 - DNA, 3778 bp, Homo sapiens
  misc_feature (3613)..(3613): n is a, c, g, or t
  misc_feature (3622)..(3622): n is a, c, g, or t
ctcgactttttttacacatatggagacttggagattcaggttctccttagatctctctgggtaatttattagaaatgcttacatagatttgcttcctaatctcaagctggcttcccctctccacaactcagcaactatctattctcccaggaggccatacaagcgaggggccctgaagcttaacatttattaacttcatgtaaaggtctgagcggacctttcaggccaggcagcgtgtcacttgcctgtgttccttgttagggcctaccaccgggtaggtgcttggaatgtgctgtggattaaaggcttaaatcctgcgggcccctcaatctgatctaaggacatgagtggcttagagaacggcgcaacaaggctaagcgaaagaaaacaaagcggtgtggctgggagtgggctccttccctccgctggtgagggtgcgatcttagactcttgagagaacccgacataaaggccgcgttccaatggcggccttctcccctaccggccaacctgccccgaaaagagcagaaggcaccctgcgggatctgcagatcagcttgcgtctcattctggggcaccgacacggtggaatgcaagacaccccactaccggaagtttctttgatgttaagaaaaacggcggaagtaggccgcagcgcttcctcagtatagtgcctcgagctggctcgcctactttctacggtaaagggaggtgctccacatctctatgcagctgtgcagcgccgcaggttccatgcgcaggctcggttggctaaatgcgctttccagccatctttcagccacccagtcctttcccaggttctcgagccaggacgtgacgtattcagacgtactgggggcggggcctcaaggggaaaagcgcctgagccgggatatcgcgagaacatcccgttctttcgtagctctggtgctgcggctccgctctcgtcgcaacgagatctttcgagatcttctccgcccccgctaccggcgcctcctctgcggccactgagccggagccggcctgagcagcgctctcggttgcagtacccactggaaggacttaggcgctcgcgtggacaccgcaagcccctcagtagcctcggcccaagaggcctgctttccactcgctagccccgccgggggtccgtgtcctgtctcggtggccggacccgggcccgagcccgagcagtagccggcgccatgtcggtggtgggcatagacctgggcttccagagctgctacgtcgctgtggcccgcgccggcggcatcgagactatcgctaatgagtatagcgaccgctgcacgccggcttgcatttcttttggtcctaagaatcgttcaattggagcagcagctaaaagccaggtaatttctaatgcaaagaacacagtccaaggatttaaaagattccatggccgagcattctctgatccatttgtggaggcagaaaaatctaaccttgcatatgatattgtgcagttgcctacaggattaacaggtataaaggtgacatatatggaggaagagcgaaattttaccactgagcaagtgactgccatgcttttgtccaaactgaaggagacagccgaaagtgttcttaagaagcctgtagttgactgtgttgtttcggttccttgtttctatactgatgcagaaagacgatcagtgatggatgcaacacagattgctggtcttaattgcttgcgattaatgaatgaaaccactgcagttgctcttgcatatggaatctataagcaggatcttcctgccttagaagagaaaccaagaaatgtagtttttgtagacatgggccactctgcttatcaagtttctgtatgtgcatttaatagaggaaaactgaaagttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaattgatgagtgcaaatgcttcagatctccctttgagcattgaatgttttatgaatgatgttgatgtatctggaactatgaatagaggcaaatttctggagatgtgcaatgatctcttagctagagtggagccaccacttcgtagtgttttggaacaaaccaagttaaagaaagaagatatttatgcagtggagatagttggtggtgctacacgaatccctgcggtaaaagagaagatcagcaaatttttcggtaaagaacttagtacaacattaaatgctgatgaagctgtcactcgaggctgtgcattgcagtgtgccatcttatcgcctgctttcaaagtcagagaattttctatcactgatgtagtaccatatccaatatctctgagatggaattctccagctgaagaagggtcaagtgactgtgaagtcttttccaaaaatcatgctgctcctttctctaaagttcttacattttatagaaaggaacctttcactcttgaggcctactacagctctcctcaggatttgccctatccagatcctgctatagctcagttttcagttcagaaagtcactcctcagtctgatggctccagttcaaaagtgaaagtcaaagttcgagtaaatgtccatggcattttcagtgtgtccagtgcatctttagtggaggttcacaagtctgaggaaaatgaggagccaatggaaacagatcagaatgcaaaggaggaagagaagatgcaagtggaccaggaggaaccacatgttgaagagcaacagcagcagacaccagcagaaaataaggcagagtctgaagaaatggagacctctcaagctggatccaaggataaaaagatggaccaaccaccccaagccaagaaggcaaaagtgaagaccagtactgtggacctgccaatcgagaatcagctattatggcagatagacagagagatgctcaacttgtacattgaaaatgagggtaagatgatcatgcaggataaactggagaaggagcggaatgatgctaagaacgcagtggaggaatatgtgtatgaaatgagagacaagcttagtggtgaatatgagaagtttgtgagtgaagatgatcgtaacagttttactttgaaactggaagatactgaaaattggttgtatgaggatggagaagaccagccaaagcaagtttatgttgataagttggctgaattaaaaaatctaggtcaacctattaagatacgtttccaggaatctgaagaacgaccaaaattatttgaagaactagggaaacagatccaacagtatatgaaaataatcagctctttcaaaaacaaggaggaccagtatgatcatttggatgctgctgacatgacaaaggtagaaaaaagcacaaatgaagcaatggagtggatccaaggataaaaagatggaccaaccaccccaagccaagaaggcaaaagtgaagaccagtactgtggacctgccaatcgagaatcagctattatggcagatagacagagagatgctcaacttgtacattgaaaatgagggtaagatgatcatgcaggataaactggagaaggagcggnatgatgctnagaacgcagtgcaggagtatgtgtgcgactatctgaaaggttaatattaaacatagcatgctggcaataccctgctgtgtattggcgcactcggcaatttcaacatccgctctatcgaatacagacgatgacttactctaattttgaacatttcat

SEQ ID NO: 646305 - DNA, 342 bp, Homo sapiens
tatcatactcatcatcatcatctatcacatagctcactccagtataatataccactgctcttggggattagtacgctacagataaaaagtgaccactatcgacgatctgcagcaaaggatagcttcagcatcatcatccagatctccactctcaggaacttcaggcggggcaaaaaagtataagacagcgtcataggaaacagtatatagtcacagaacgaacagacccacgtccctatgtgtatacaagataactatgaaatagtatatcaaagtgacatatctttaccttttatccaatctatctaggaaccctgtaacaacacccataattaactaggt

SEQ ID NO: 646306 - DNA, 946 bp, Homo sapiens
ctgccgctctttcggggcgtgttccgcttttgtgcgccccctcgggggggcggtggggtgtgttcgtggcggccgggcgcgattcttctcgttcgtgtgttggcgtgttcgctcttctttgtgggggcgaccgctctgttgttgcgctgtgtccttggttgttttaatcttccgccacgtggtggggtgaaggtgcgactcagtgtgtggtggtttaacctcgttggtggttagccgttttcgcttctgtcttgtgtctctcgtggatgagtacttcgcggagaggtgcgcgggttgttgtgggggtcctccttttgtgtggtgggcgcagtgcccgcgctttggtattgtggtgcgattgcggtatgctcttggcggggggtctcgttggggttgtcggccgctcgttcgttcgtgtttctcgaggtgtgggttataacgccgttgtttttctttgtgtgtattgtctctcagtgttttactcccctgtttgttgattttgtttgtgatttatgtccgtttttctggccctcagtgggtgccgggtggtgcgcgcaccacgcgccttggtagttgtgctcgcggcccgctttgtggggtgtgccctccataggggccgcgtgtggcccccttgtgaggtgtcctgtagttttgtgtaggccttttgcccgtggctcgccctctgtgcgcctatcctccactgttgcccgcttgttgaaatattctcctctccgttttgtcgtgggggcctgtggtttgggtggggccgcccggtgaaatgcgtggcctcttttgggaggtggttgggtatcaagaaggtattctcccttgcgtcgccacgggggccacagcaggagttcctcgctgtcacttgtaggggttgttggccctacggctcgcttctccatcctcgtgggtgcccgcgctcgagcgactcccactccac

SEQ ID NO: 646307 - DNA, 383 bp, Homo sapiens
aggatccctactgtgctgctggagaagtatctttggaaggtatgtagccattaactgtaatgcttcttttcatgaccttattgaattacaccaaactggctgtagcagtaaattttggccagttagtggctctggctaaccattcccaaattatctcttagaaactggtcactggttgtcccacagtgcctaaagagtttggctataacggttgccgtatgaccatacagaattccgtactgcatcctttgtgtcttttagaatcctgaggtcctgtattattggtttcgtattaagaactgcgagatgtaactccaatagcccatttccaccaactttaaaatttttaatccatatttccaaagtcctggtcccttaaggct

SEQ ID NO: 646308 - DNA, 2559 bp, Homo sapiens
tgaggtgactagagttccccaacagaacacctgtcaagcaactgaacacccgaaagcaagaaggcaaaagtgaagaccagtactgtggacctgccaatcgagaatcagctattatggcagatagacagagagatgctcaacttgtacattgaaaatgagggtaagatgatcatgcaggataaactggagaaggagcggaatgatggatgctaagaacgcagtggaggaatatgtgtatgaaatgagagacaagcttagtggtgaatatgagaagtttgtgagtgaagatgatcgtaacagttttactttgaaactggaagatactgaaaattggttgtatgaggatggagaagaccagccaaagcaagtttatgttgataagttggctgaattaaaaaatctaggtcaacctattaagatacgtttccaggaatctgaagaacgaccaaaattatttgaagaactagggaaacagatccaacagtatatgaaaataatcagctctttcaaaaacaaggaggaccagtatgatcatttggatgctgctgacatgacaaaggtagaaaaaagcacaaatgaagcaatggagtggatgaataacaagctaaatctgcagaacaagcagagtttgaccatggatccagttgtcaagtcaaaagagattgaagctaaaattaaggagctgacaagtacttgtagccctataatttcaaagcccaaacccaaagtggaacctccaaaagaggaacaaaaaaatgcagagcagaatggaccagtggatggacaaggagacaacccaggcccccaggctgctgagcagggtacagacacagctgtgccttcggattcagacaagaagcttcctgaaatggacattgattgattccaacacttgtttctattaaaacagactattataaagctttaagttgtcaactttgttctaaatatcaactagcgcaagtgaatactgaagatttcttagtcagtttttaggggattttcggggaggggaaataggtaatgtatggagcattttcacttctaaatagttagatacagaaattaagtgcattgtatctttttcataatggtactatttagaagcccagttagtcttactgagcttatgcttcactcctttatgtttaaccatgtgtctacaagaataagtttgttttggaaagttgagctatagctacagctctagctatccagcagacttttcattatgacttacatggcaggagctctaattatgctttaaaaatctgttgtggagattgctttaaatgctccctgcctggtgtggggatggggtccccctctttgtgagggctggagcatggcacggcatggattaacacggcagaggaacaaaggtgtgctctgagcttcttcatatttcaccttcaccctcacctgtgttctcttccctctctcccaataaaagggctcccattataaatgccatgtacttctcttgggaaaatagacccccttgcctagagtaagttgttaactgagggctttaaacctggaggctcttcctgaaagtatgttcatgaataccccaagcatcaaggtctaaataattttcagaagattagaattgggtagatatactgttggatatagccatggtaaatttaactgaggaattaaatccttgttaattttggtgtaaagatttgtatcctggcctgtttattcaggtgggagatgttctgtataattttgaggtatagcttgaactcctagaacaagagttaaaagttctttttagctcattcacaatcacttgtgtgttaagtgttaatatctgtcatgaacctgccaatttgtacgtgttaagcagctgacagatgatgcaaaaaaaactaagatacactggattgtactggatgagtctgaaattagtgttaaagaagtgtggtgcctgatgttataacaacacctcattcttaactgtgtggccaatgtcaggtataccaaagcattcctctgactgctttttggggcagtgttgacaggagtgaggcattttggaaactccaagggaagcctgtgtttgaggccagagttggtacctgctttaagaaactgttacagggcttgttggtaatgttttgaatctttgtaaaaattgatattctgtataacagagtgcctctctgttacttttggcctatgttgttagaaataagatgctatcttgcatagttagaattaagcgtttgtccatctctagataacattgaaaagtttgagtgttacaggctctaaagtgcaatggagaacaattgcttaggaggaggaaggggaaagtatacttatgttggtgtgtaagcatgcatggaggcctcgaggcaccacaacaaggccaggttcttagcacatcctctgttctctacctgtcatgcttcaagagttccagctggcctgctgtgaagccagtagctattttaaaagtgctggctgcaggattaagccaaccctttacaactggcccagaccgtaatggccatttcttcttaaaaaaaaacatctgggttttta

SEQ ID NO: 646309 - DNA, 1310 bp, Homo sapiens
tggggaaaaaaaaaaaattcttttttttctatggggggggggggggccgcgctgtcccccccctccaaatatctctgggagaagcggttttgtgggggcgcgcgcggcctctctgtgtggtcctcgtggcccgtcgtgttgaacgcgcccgtgtgttgtgtgccagagagagggcgggttcccccccgcgtgtggggagcgagtgttctcccgcgcgatgtgcgggagagtctccctcctaagagcgcgaggggaacacgaggtgtgtctccagaaatgtgtgttttggggggggcacttctctctagaagagcggggtggaactgtggggagagatgtgtgatggggaagaaaatatttctcgggggaggataacaaggtgcgctcctccgggattctcttctctctctgtgtggggcccccccccacaagaagagagatatctcccccctcacagagaggggagccactatatctcccgaggagagggggggtatatattgtgtgggagagagagtagaggaggcgcgcccctctaaagagaccctctctctgtgaggggttcttttgtggaacccccaaacaagaggatttatttgtgtgtgagaacccccggggggagaaatatctcctcttgtggagcgcgagatatcactccccccgagagggaagagccccccctctgcgaggggggaggaggagaaagagtgagggcggcggggagtcaaactcggaggagagaaggacccgccctacaacaatcgggaaagaggtccgcccccaaatcctcccgcggagaaaagcagagaagacaacaccaacatctatctctctcgccgcggcgacggtttatcttcacctcagtctatcttctattacttcggaggggacgccctctaataaataacaaaatactcttcttagagggaggagggggcaccacctcgtggggtattatctctcgacacaacctctctcagtactactttaggaggaggggcgcttctatattaaaaaacactaccctccactaggtgtattgtagcaaacgtataaactagctgggctgctcgctcacccacaaaaatcttttgtttttaattaggtgcgcgccccccttacaagaaagatagataaccctcgctgtgggggggcgcgtccccaataaaaaatagagagggattgtctgcacacccccgtttcttcaggggggacggagcagtttatataatagaagcggggcgcgaaagtaatgtaccccctcctcctattgaagacaagaggtgtctcctctcatctcctctcctaaa

SEQ ID NO: 646310 - DNA, 2817 bp, Homo sapiens
  misc_feature (63)..(63): n is a, c, g, or t
cgactcttgagatcccccatgtacctcctcagtctgatgctccagttcaaaagtgaaagtcanagttcgagtaaatgtccatggcattttcaggtgccagtgcatctttagtggaggtcacaagtctgaggaaaatgaggagccaatggaaacagatcagaatgcaaaggaggaagagaagatgcaagtggaccaggaggaaccacatgttgaagagcaacagcagcagacaccagcagaaaataaggcagagtctgaagaaatggagacctctcaagctggatccaaggataaaaagatggaccaaccaccccaagccaagaaggcaaaagtgaagaccagtactgtggacctgccaatcgagaatcagctattatggcagatagacagagagatgctcaacttgtacattgaaaatgagggtaagatgatcatgcaggataaactggagaaggagcggaatgatgctaagaacgcagtggaggaatatgtgtatgaaatgagagacaagcttagtggtgaatatgagaagtttgtgagtgaagatgatcgtaacagttttactttgaaactggaagatactgaaaattggttgtatgaggatggagaagaccagccaaagcaagtttatgttgataagttggctgaattaaaaaatctaggtcaacctattaagatacgtttccaggaatctgaagaacgaccaaaattatttgaagaactagggaaacagatccaacagtatatgaaaataatcagctctttcaaaaacaaggaggaccagtatgatcatttggatgctgctgacatgacaaaggtagaaaaaagcacaaatgaagcaatggagtggatgaataacaagctaaatctgcagaacaagcagagtttgaccatggatccagttgtcaagtcaaaagagattgaagctaaaattaaggagctgacaagtacttgtagccctataatttcaaagcccaaacccaaagtggaacctccaaaagaggaacaaaaaaatgcagagcagaatggaccagtggatggacaaggagacaacccaggcccccaggctgctgagcagggtacagacacagctgtgccttcggattcagacaagaagcttcctgaaatggacattgattgattccaacacttgtttctattaaaacagactattataaagctttaagttgtcaactttgttctaaatatcaactagcgcaagtgaatactgaagatttcttagtcagtttttaggggattttcggggaggggaaataggtaatgtatggagcattttcacttctaaatagttagatacagaaattaagtgcattgtatctttttcataatggtactatttagaagcccagttagtcttactgagcttatgcttcactcctttatgtttaaccatgtgtctacaagaataagtttgttttggaaagttgagctatagctacagctctagctatccagcagacttttcattatgacttacatggcaggagctctaattatgctttaaaaatctgttgtggagattgctttaaatgctccctgcctggtgtggggatggggtccccctctttgtgagggctggagcatggcacggcatggattaacacggcagaggaacaaaggtgtgctctgagcttcttcatatttcaccttcaccctcacctgtgttctcttccctctctcccaataaaagggctcccattataaatgccatgtacttctcttgggaaaatagacccccttgcctagagtaagttgttaactgagggctttaaacctggaggctcttcctgaaagtatgttcatgaataccccaagcatcaaggtctaaataattttcagaagattagaattgggtagatatactgttggatatagccatggtaaatttaactgaggaattaaatccttgttaattttggtgtaaagatttgtatcctggcctgtttattcaggtgggagatgttctgtataattttgaggtatagcttgaactcctagaacaagagttaaaagttctttttagctcattcacaatcacttgtgtgttaagtgttaatatctgtcatgaacctgccaatttgtacgtgttaagcagctgacagatgatgcaaaaaaaactaagatacactggattgtactggatgagtctgaaattagtgttaaagaagtgtggtgcctgatgttataacaacacctcattcttaactgtgtggccaatgtcaggtataccaaagcattcctctgactgctttttggggcagtgttgacaggagtgaggcattttggaaactccaagggaagcctgtgtttgaggccagagttggtacctgctttaagaaactgttacagggcttgttggtaatgttttgaatctttgtaaaaattgatattctgtataacagagtgcctctctgttacttttggcctatgttgttagaaataagatgctatcttgcatagttagaattaagcgtttgtccatctctagataacattgaaaagtttgagtgttacaggctctaaagtgcaatggagaacaattgcttaggaggaggaaggggaaagtatacttatgttggtgtgtaagcatgcatggaggcctcgaggcaccacaacaaggccaggttcttagcacatcctctgttctctacctgtcatgcttcaagagttccagctggcctgctgtgaagccagtagctattttaaaagtgctggctgcaggattaagccaaccctttacaactggcccagaccgtaatggccatttcttcttaaaaaaaaacatctgggttttta

SEQ ID NO: 646311 - DNA, 424 bp, Homo sapiens
  misc_feature (365)..(365): n is a, c, g, or t
gtctatgctcgattggcattggatgatcgtaaacacaatcgattaaaactggtaagactcggcaggtattgcataatagttacattccacaatatatcctatcaaatatcactcttgtattggacacgagtcctcctctagacctcgaactgcagtcttgaccagacttgccctgggacactgccgatgtaagtacggcagtgacttgcaaaccactgtccgaacctatgggacagccttgggatgttccatattgtcatttctttttcaagccatacaaagttcaactttatagcaaatggcagcacataaattcatttctgagtagtaaaagtattccccatacaggtgaccagtccatctgnaccatcttaagatgggtcagatggaaccaattttgacgccatctccattacccatttgg

SEQ ID NO: 646312 - DNA, 2423 bp, Homo sapiens
aggtgttctagaggatcccgtagaggttactagaagtgtgaaaacgtaggttggattaaggcgacagcgatttctaagaacgcagtggaggaatatgtgtatgaaatgagagacaagcttagtggtgaatatgagaagtttgtgagtgaagatgatcgtaacagttttactttgaaactggaagatactgaaaattggttgtatgaggatggagaagaccagccaaagcaagtttatgttgataagttggctgaattaaaaaatctaggtcaacctattaagatacgtttccaggaatctgaagaacgaccaaaattatttgaagaactagggaaacagatccaacagtatatgaaaataatcagctctttcaaaaacaaggaggaccagtatgatcatttggatgctgctgacatgacaaaggtagaaaaaagcacaaatgaagcaatggagtggatgaataacaagctaaatctgcagaacaagcagagtttgaccatggatccagttgtcaagtcaaaagagattgaagctaaaattaaggagctgacaagtacttgtagccctataatttcaaagcccaaacccaaagtggaacctccaaaagaggaacaaaaaaatgcagagcagaatggaccagtggatggacaaggagacaacccaggcccccaggctgctgagcagggtacagacacagctgtgccttcggattcagacaagaagcttcctgaaatggacattgattgattccaacacttgtttctattaaaacagactattataaagctttaagttgtcaactttgttctaaatatcaactagcgcaagtgaatactgaagatttcttagtcagtttttaggggattttcggggaggggaaataggtaatgtatggagcattttcacttctaaatagttagatacagaaattaagtgcattgtatctttttcataatggtactatttagaagcccagttagtcttactgagcttatgcttcactcctttatgtttaaccatgtgtctacaagaataagtttgttttggaaagttgagctatagctacagctctagctatccagcagacttttcattatgacttacatggcaggagctctaattatgctttaaaaatctgttgtggagattgctttaaatgctccctgcctggtgtggggatggggtccccctctttgtgagggctggagcatggcacggcatggattaacacggcagaggaacaaaggtgtgctctgagcttcttcatatttcaccttcaccctcacctgtgttctcttccctctctcccaataaaagggctcccattataaatgccatgtacttctcttgggaaaatagacccccttgcctagagtaagttgttaactgagggctttaaacctggaggctcttcctgaaagtatgttcatgaataccccaagcatcaaggtctaaataattttcagaagattagaattgggtagatatactgttggatatagccatggtaaatttaactgaggaattaaatccttgttaattttggtgtaaagatttgtatcctggcctgtttattcaggtgggagatgttctgtataattttgaggtatagcttgaactcctagaacaagagttaaaagttctttttagctcattcacaatcacttgtgtgttaagtgttaatatctgtcatgaacctgccaatttgtacgtgttaagcagctgacagatgatgcaaaaaaaactaagatacactggattgtactggatgagtctgaaattagtgttaaagaagtgtggtgcctgatgttataacaacacctcattcttaactgtgtggccaatgtcaggtataccaaagcattcctctgactgctttttggggcagtgttgacaggagtgaggcattttggaaactccaagggaagcctgtgtttgaggccagagttggtacctgctttaagaaactgttacagggcttgttggtaatgttttgaatctttgtaaaaattgatattctgtataacagagtgcctctctgttacttttggcctatgttgttagaaataagatgctatcttgcatagttagaattaagcgtttgtccatctctagataacattgaaaagtttgagtgttacaggctctaaagtgcaatggagaacaattgcttaggaggaggaaggggaaagtatacttatgttggtgtgtaagcatgcatggaggcctcgaggcaccacaacaaggccaggttcttagcacatcctctgttctctacctgtcatgcttcaagagttccagctggcctgctgtgaagccagtagctattttaaaagtgctggctgcaggattaagccaaccctttacaactggcccagaccgtaatggccatttcttcttaaaaaaaaacatctgggttttta

SEQ ID NO: 646313 - DNA, 3325 bp, Homo sapiens
ctcgactttttttacacatatggagacttggagattcaggttctccttagatctctctgggtaatttattagaaatgcttacatagatttgcttcctaatctcaagctggcttcccctctccacaactcagcaactatctattctcccaggaggccatacaagcgaggggccctgaagcttaacatttattaacttcatgtaaaggtctgagcggacctttcaggccaggcagcgtgtcacttgcctgtgttccttgttagggcctaccaccgggtaggtgcttggaatgtgctgtggattaaaggcttaaatcctgcgggcccctcaatctgatctaaggacatgagtggcttagagaacggcgcaacaaggctaagcgaaagaaaacaaagcggtgtggctgggagtgggctccttccctccgctggtgagggtgcgatcttagactcttgagagaacccgacataaaggccgcgttccaatggcggccttctcccctaccggccaacctgccccgaaaagagcagaaggcaccctgcgggatctgcagatcagcttgcgtctcattctggggcaccgacacggtggaatgcaagacaccccactaccggaagtttctttgatgttaagaaaaacggcggaagtaggccgcagcgcttcctcagtatagtgcctcgagctggctcgcctactttctacggtaaagggaggtgctccacatctctatgcagctgtgcagcgccgcaggttccatgcgcaggctcggttggctaaatgcgctttccagccatctttcagccacccagtcctttcccaggttctcgagccaggacgtgacgtattcagacgtactgggggcggggcctcaaggggaaaagcgcctgagccgggatatcgcgagaacatcccgttctttcgtagctctggtgctgcggctccgctctcgtcgcaacgagatctttcgagatcttctccgcccccgctaccggcgcctcctctgcggccactgagccggagccggcctgagcagcgctctcggttgcagtacccactggaaggacttaggcgctcgcgtggacaccgcaagcccctcagtagcctcggcccaagaggcctgctttccactcgctagccccgccgggggtccgtgtcctgtctcggtggccggacccgggcccgagcccgagcagtagccggcgccatgtcggtggtgggcatagacctgggcttccagagctgctacgtcgctgtggcccgcgccggcggcatcgagactatcgctaatgagtatagcgaccgctgcacgccggcttgcatttcttttggtcctaagaatcgttcaattggagcagcagctaaaagccaggtaatttctaatgcaaagaacacagtccaaggatttaaaagattccatggccgagcattctctgatccatttgtggaggcagaaaaatctaaccttgcatatgatattgtgcagttgcctacaggattaacaggtataaaggtgacatatatggaggaagagcagaatggaccagtggatggacaaggagacaacccaggcccccaggctgctgagcagggtacagacacagctgtgccttcggattcagacaagaagcttcctgaaatggacattgattgattccaacacttgtttctattaaaacagactattataaagctttaagttgtcaactttgttctaaatatcaactagcgcaagtgaatactgaagatttcttagtcagtttttaggggattttcggggaggggaaataggtaatgtatggagcattttcacttctaaatagttagatacagaaattaagtgcattgtatctttttcataatggtactatttagaagcccagttagtcttactgagcttatgcttcactcctttatgtttaaccatgtgtctacaagaataagtttgttttggaaagttgagctatagctacagctctagctatccagcagacttttcattatgacttacatggcaggagctctaattatgctttaaaaatctgttgtggagattgctttaaatgctccctgcctggtgtggggatggggtccccctctttgtgagggctggagcatggcacggcatggattaacacggcagaggaacaaaggtgtgctctgagcttcttcatatttcaccttcaccctcacctgtgttctcttccctctctcccaataaaagggctcccattataaatgccatgtacttctcttgggaaaatagacccccttgcctagagtaagttgttaactgagggctttaaacctggaggctcttcctgaaagtatgttcatgaataccccaagcatcaaggtctaaataattttcagaagattagaattgggtagatatactgttggatatagccatggtaaatttaactgaggaattaaatccttgttaattttggtgtaaagatttgtatcctggcctgtttattcaggtgggagatgttctgtataattttgaggtatagcttgaactcctagaacaagagttaaaagttctttttagctcattcacaatcacttgtgtgttaagtgttaatatctgtcatgaacctgccaatttgtacgtgttaagcagctgacagatgatgcaaaaaaaactaagatacactggattgtactggatgagtctgaaattagtgttaaagaagtgtggtgcctgatgttataacaacacctcattcttaactgtgtggccaatgtcaggtataccaaagcattcctctgactgctttttggggcagtgttgacaggagtgaggcattttggaaactccaagggaagcctgtgtttgaggccagagttggtacctgctttaagaaactgttacagggcttgttggtaatgttttgaatctttgtaaaaattgatattctgtataacagagtgcctctctgttacttttggcctatgttgttagaaataagatgctatcttgcatagttagaattaagcgtttgtccatctctagataacattgaaaagtttgagtgttacaggctctaaagtgcaatggagaacaattgcttaggaggaggaaggggaaagtatacttatgttggtgtgtaagcatgcatggaggcctcgaggcaccacaacaaggccaggttcttagcacatcctctgttctctacctgtcatgcttcaagagttccagctggcctgctgtgaagccagtagctattttaaaagtgctggctgcaggattaagccaaccctttacaactggcccagaccgtaatggccatttcttcttaaaaaaaaacatctgggttttta

SEQ ID NO: 646314 - DNA, 2129 bp, Homo sapiens
ttgaaaaatggcagaaactagacagtagttgcctgggagggagggtatcacacttttagcacttgtttgactgtctcctggttgcaggaggaccagtatgatcatttggatgctgctgacatgacaaaggtagaaaaaagcacaaatgaagcaatggagtggatgaataacaagctaaatctgcagaacaagcagagtttgaccatggatccagttgtcaagtcaaaagagattgaagctaaaattaaggagctgacaagtacttgtagccctataatttcaaagcccaaacccaaagtggaacctccaaaagaggaacaaaaaaatgcagagcagaatggaccagtggatggacaaggagacaacccaggcccccaggctgctgagcagggtacagacacagctgtgccttcggattcagacaagaagcttcctgaaatggacattgattgattccaacacttgtttctattaaaacagactattataaagctttaagttgtcaactttgttctaaatatcaactagcgcaagtgaatactgaagatttcttagtcagtttttaggggattttcggggaggggaaataggtaatgtatggagcattttcacttctaaatagttagatacagaaattaagtgcattgtatctttttcataatggtactatttagaagcccagttagtcttactgagcttatgcttcactcctttatgtttaaccatgtgtctacaagaataagtttgttttggaaagttgagctatagctacagctctagctatccagcagacttttcattatgacttacatggcaggagctctaattatgctttaaaaatctgttgtggagattgctttaaatgctccctgcctggtgtggggatggggtccccctctttgtgagggctggagcatggcacggcatggattaacacggcagaggaacaaaggtgtgctctgagcttcttcatatttcaccttcaccctcacctgtgttctcttccctctctcccaataaaagggctcccattataaatgccatgtacttctcttgggaaaatagacccccttgcctagagtaagttgttaactgagggctttaaacctggaggctcttcctgaaagtatgttcatgaataccccaagcatcaaggtctaaataattttcagaagattagaattgggtagatatactgttggatatagccatggtaaatttaactgaggaattaaatccttgttaattttggtgtaaagatttgtatcctggcctgtttattcaggtgggagatgttctgtataattttgaggtatagcttgaactcctagaacaagagttaaaagttctttttagctcattcacaatcacttgtgtgttaagtgttaatatctgtcatgaacctgccaatttgtacgtgttaagcagctgacagatgatgcaaaaaaaactaagatacactggattgtactggatgagtctgaaattagtgttaaagaagtgtggtgcctgatgttataacaacacctcattcttaactgtgtggccaatgtcaggtataccaaagcattcctctgactgctttttggggcagtgttgacaggagtgaggcattttggaaactccaagggaagcctgtgtttgaggccagagttggtacctgctttaagaaactgttacagggcttgttggtaatgttttgaatctttgtaaaaattgatattctgtataacagagtgcctctctgttacttttggcctatgttgttagaaataagatgctatcttgcatagttagaattaagcgtttgtccatctctagataacattgaaaagtttgagtgttacaggctctaaagtgcaatggagaacaattgcttaggaggaggaaggggaaagtatacttatgttggtgtgtaagcatgcatggaggcctcgaggcaccacaacaaggccaggttcttagcacatcctctgttctctacctgtcatgcttcaagagttccagctggcctgctgtgaagccagtagctattttaaaagtgctggctgcaggattaagccaaccctttacaactggcccagaccgtaatggccatttcttcttaaaaaaaaacatctgggttttta

SEQ ID NO: 646315 - DNA, 3081 bp, Homo sapiens
  misc_feature (2916)..(2916): n is a, c, g, or t
  misc_feature (2925)..(2925): n is a, c, g, or t
ctcgactttttttacacatatggagacttggagattcaggttctccttagatctctctgggtaatttattagaaatgcttacatagatttgcttcctaatctcaagctggcttcccctctccacaactcagcaactatctattctcccaggaggccatacaagcgaggggccctgaagcttaacatttattaacttcatgtaaaggtctgagcggacctttcaggccaggcagcgtgtcacttgcctgtgttccttgttagggcctaccaccgggtaggtgcttggaatgtgctgtggattaaaggcttaaatcctgcgggcccctcaatctgatctaaggacatgagtggcttagagaacggcgcaacaaggctaagcgaaagaaaacaaagcggtgtggctgggagtgggctccttccctccgctggtgagggtgcgatcttagactcttgagagaacccgacataaaggccgcgttccaatggcggccttctcccctaccggccaacctgccccgaaaagagcagaaggcaccctgcgggatctgcagatcagcttgcgtctcattctggggcaccgacacggtggaatgcaagacaccccactaccggaagtttctttgatgttaagaaaaacggcggaagtaggccgcagcgcttcctcagtatagtgcctcgagctggctcgcctactttctacggtaaagggaggtgctccacatctctatgcagctgtgcagcgccgcaggttccatgcgcaggctcggttggctaaatgcgctttccagccatctttcagccacccagtcctttcccaggttctcgagccaggacgtgacgtattcagacgtactgggggcggggcctcaaggggaaaagcgcctgagccgggatatcgcgagaacatcccgttctttcgtagctctggtgctgcggctccgctctcgtcgcaacgagatctttcgagatcttctccgcccccgctaccggcgcctcctctgcggccactgagccggagccggcctgagcagcgctctcggttgcagtacccactggaaggacttaggcgctcgcgtggacaccgcaagcccctcagtagcctcggcccaagaggcctgctttccactcgctagccccgccgggggtccgtgtcctgtctcggtggccggacccgggcccgagcccgagcagtagccggcgccatgtcggtggtgggcatagacctgggcttccagagctgctacgtcgctgtggcccgcgccggcggcatcgagactatcgctaatgagtatagcgaccgctgcacgccggcttgcatttcttttggtcctaagaatcgttcaattggagcagcagctaaaagccaggtaatttctaatgcaaagaacacagtccaaggatttaaaagattccatggccgagcattctctgatccatttgtggaggcagaaaaatctaaccttgcatatgatattgtgcagttgcctacaggattaacaggtataaaggtgacatatatggaggaagagcgaaattttaccactgagcaagtgactgccatgcttttgtccaaactgaaggagacagccgaaagtgttcttaagaagcctgtagttgactgtgttgtttcggttccttgtttctatactgatgcagaaagacgatcagtgatggatgcaacacagattgctggtcttaattgcttgcgattaatgaatgaaaccactgcagttgctcttgcatatggaatctataagcaggatcttcctgccttagaagagaaaccaagaaatgtagtttttgtagacatgggccactctgcttatcaagtttctgtatgtgcatttaatagaggaaaactgaaagttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaattgatgagtgcaaatgcttcagatctccctttgagcattgaatgttttatgaatgatgttgatgtatctggaactatgaatagaggcaaatttctggagatgtgcaatgatctcttagctagagtggagccaccacttcgtagtgttttggaacaaaccaagttaaagaaagaagatatttatgcagtggagatagttggtggtgctacacgaatccctgcggtaaaagagaagatcagcaaatttttcggtaaagaacttagtacaacattaaatgctgatgaagctgtcactcgaggctgtgcattgcagtgtgccatcttatcgcctgctttcaaagtcagagaattttctatcactgatgtagtaccatatccaatatctctgagatggaattctccagctgaagaagggtcaagtgactgtgaagtcttttccaaaaatcatgctgctcctttctctaaagttcttacattttatagaaaggaacctttcactcttgaggcctactacagctctcctcaggatttgccctatccagatcctgctatagctcagttttcagttcagaaagtcactcctcagtctgatggctccagttcaaaagtgaaagtcaaagttcgagtaaatgtccatggcattttcagtgtgtccagtgcatctttagtggaggttcacaagtctgaggaaatggagacctctcaagctggatccaaggataaaaagatggaccaaccaccccaagccaagaaggcaaaagtgaagaccagtactgtggacctgccaatcgagaatcagctattatggcagatagacagagagatgctcaacttgtacattgaaaatgagggtaagatgatcatgcaggataaactggagaaggagcggnatgatgctnagaacgcagtgcaggagtatgtgtgcgactatctgaaaggttaatattaaacatagcatgctggcaataccctgctgtgtattggcgcactcggcaatttcaacatccgctctatcgaatacagacgatgacttactctaattttgaacatttcat

SEQ ID NO: 646316 - DNA, 100 bp, Homo sapiens
  misc_feature (20)..(20): n is a, c, g, or t
  misc_feature (39)..(40): n is a, c, g, or t
cagtccccgaaggcctgganttggtcgcctgtatcaatnnctcactctcggacagccagtctaaggacgagaggcccagggccgtcttccacgaggagga

SEQ ID NO: 646317 - DNA, 2661 bp, Homo sapiens
  misc_feature (2633)..(2633): n is a, c, g, or t
  misc_feature (2645)..(2645): n is a, c, g, or t
ctcgactttttttacacatatggagacttggagattcaggttctccttagatctctctgggtaatttattagaaatgcttacatagatttgcttcctaatctcaagctggcttcccctctccacaactcagcaactatctattctcccaggaggccatacaagcgaggggccctgaagcttaacatttattaacttcatgtaaaggtctgagcggacctttcaggccaggcagcgtgtcacttgcctgtgttccttgttagggcctaccaccgggtaggtgcttggaatgtgctgtggattaaaggcttaaatcctgcgggcccctcaatctgatctaaggacatgagtggcttagagaacggcgcaacaaggctaagcgaaagaaaacaaagcggtgtggctgggagtgggctccttccctccgctggtgagggtgcgatcttagactcttgagagaacccgacataaaggccgcgttccaatggcggccttctcccctaccggccaacctgccccgaaaagagcagaaggcaccctgcgggatctgcagatcagcttgcgtctcattctggggcaccgacacggtggaatgcaagacaccccactaccggaagtttctttgatgttaagaaaaacggcggaagtaggccgcagcgcttcctcagtatagtgcctcgagctggctcgcctactttctacggtaaagggaggtgctccacatctctatgcagctgtgcagcgccgcaggttccatgcgcaggctcggttggctaaatgcgctttccagccatctttcagccacccagtcctttcccaggttctcgagccaggacgtgacgtattcagacgtactgggggcggggcctcaaggggaaaagcgcctgagccgggatatcgcgagaacatcccgttctttcgtagctctggtgctgcggctccgctctcgtcgcaacgagatctttcgagatcttctccgcccccgctaccggcgcctcctctgcggccactgagccggagccggcctgagcagcgctctcggttgcagtacccactggaaggacttaggcgctcgcgtggacaccgcaagcccctcagtagcctcggcccaagaggcctgctttccactcgctagccccgccgggggtccgtgtcctgtctcggtggccggacccgggcccgagcccgagcagtagccggcgccatgtcggtggtgggcatagacctgggcttccagagctgctacgtcgctgtggcccgcgccggcggcatcgagactatcgctaatgagtatagcgaccgctgcacgccggcttgcatttcttttggtcctaagaatcgttcaattggagcagcagctaaaagccaggtaatttctaatgcaaagaacacagtccaaggatttaaaagattccatggccgagcattctctgatccatttgtggaggcagaaaaatctaaccttgcatatgatattgtgcagttgcctacaggattaacaggtataaaggtgacatatatggaggaagagcgaaattttaccactgagcaagtgactgccatgcttttgtccaaactgaaggagacagccgaaagtgttcttaagaagcctgtagttgactgtgttgtttcggttccttgtttctatactgatgcagaaagacgatcagtgatggatgcaacacagattgctggtcttaattgcttgcgattaatgaatgaaaccactgcagttgctcttgcatatggaatctataagcaggatcttcctgccttagaagagaaaccaagaaatgtagtttttgtagacatgggccactctgcttatcaagtttctgtatgtgcatttaatagaggaaaactgaaagttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaattgatgagtgcaaatgcttcagatctccctttgagcattgaatgttttatgaatgatgttgatgtatctggaactatgaatagaggcaaatttctggagatgtgcaatgatctcttagctagagtggagccaccacttcgtagtgttttggaacaaaccaagttaaagaaagaagatatttatgcagtggagatagttggtggtgctacacgaatccctgcggtaaaagagaagatcagcaaatttttcggtaaagaacttagtacaacattaaatgctgatgaagctgtcactcgaggctgtgcattgcagtgtgccatcttatcgcctgctttcaaagtcagagaattttctatcactgatgtagtaccatatccaatatctctgagatggaattctccagctgaagaagggtcaagtgactgtgaagtcttttccaaaaatcatgctgctcctttctctaaagttcttacattttatagaaaggaacctttcactcttgaggcctactacagctctcctcaggatttgccctatccagatcctgctatagctcagttttcagttcagaaagtcactcctcagtctgatgctcaccgcaatatnatggtaccgagncgatcactgcgtgttt

SEQ ID NO: 646318 - DNA, 1510 bp, Homo sapiens
gatgcacgagagcaagtacctcagtcctgaccgagtggcatctcgcgaacactacgcccgatggatgagagtcagcaagggaccgattattcacaggctaggccgtcctacgcttgtggtgtgcgcaagattgtcttggtcaccaacttggctgagacttccatcacaatcaatgacatcgtgcatgtggtggacggtgggctgctactaagggatagaacgctatgacactagacagacctacatggtgtcctgcctgagagtaccagtcgcttggcgtatcaacgcagccacatgctcgatcccacgcgccgcgggcccgggcggtgcctgctgcccgagtccaggcttgtggcccataacacatatctggtatcccccgtacgaagaccctggacatgaggaagaaaaaaagtggcacccacctttgtccgaaagctcggccgacgcaggaatacacgtagccggccatcgactcgttctttgtacaggtaacgacttggtgtctcgcgtgcgaacaggcaggaaaccaactctctgactatctgtctccgtgagagcccagaaggaacggtgtcaggaggatgtcgagagtctaatcccatgtgctcttctgagaagggggccatggatgacgcaacagaaaaatcagccatacaaccaatgtcagagactgggtcctaggatttgtgcgaccaggaaggcggccataggttggaagtaccttttcgccatttccagaaaggggcatgagaagttccgaagtggcgttttgcctttgggggcaacctccgaacgcccgttggggataaggttttacccccattaggaaaactttgaaccgccgccgttgtggccgcgggtcctaaagggccttgggccccattttgtgggacttttccaaccgaggctttccatttaccaccgaggcgccgggaaagcaaccccctcggcggggaggaactctgtgtgtgcgctcccaggagatgtgcggcccaacccaatttttgggacttcgggttatccgcgcggtgcgttgggacccccaatgtcttgtgcttcccgcgggactcattggttccacgttggagcgaaaagaccggtctaaaccttaaaaatccttcgggggggtataaggaggggtaacccgggatagatatagggcgcccttggggtctcctttggccaaacctccccacagaggggggcagtataagcacctcgctacgcggtgaaatacccaaaggcgactcaaattgccccaaaggggggcaacccttcacaaacccaaatgaggaacaaacacacccccgggcgtggggggacgccacaagggaaaggctgctgtcggggggaaaccacgaaagacggaaggttctcggacaacagagcaaccgggccaacccccttcgtgttgtgtgtgcgcacgagtccgccccgaaatgtgagggaaccagatgcccaggtagggggaagggttccgcacaacacaacagcctcttttgggagg

SEQ ID NO: 646319 - DNA, 463 bp, Homo sapiens
catcaataagaagacgatggaagcgagtttcagatagtgcggctggtggagcgggctgggatatagtctgtgtgtaggaggtacggagtagagtaatccctcgagtctgatagttcgttcgcctcggagatgcgtgggaagggtaggatcgggggcccttggtttcgtggatgtgcgagtaaggggggtagcgatccaggttgaccatttaagtgcgagttaacctgagtaggcaggtcgtggggattatttgggcgtgtacagatggaggtagaataggcgattgcagtgaggtcgggtatggtgtacctggtaagagggtagccgagtaaggttgatgtggtatttcgaaggtgggggaaagaagtgcatgcaggtgtaggaagctttagggattgaggtaggtgtgaccgggtcgagttataagcggttgctaggcattgatgtggctgcgctgataacg

SEQ ID NO: 646320 - DNA, 194 bp, Homo sapiens
gtccgggtaggagacaggcagtatgcctggtccagccggcgtcgccttggggcggtgagcagtgccaggcaggcgcgaggggccgggcagaccccgaggctttaagtgcaaagcagggcaagggtgtacgcagcacgggccgagtcagcctttggaacaattaggggcggcaaccgcatgtgaccgcagggcat

SEQ ID NO: 646321 - DNA, 222 bp, Homo sapiens
  misc_feature (3)..(3): n is a, c, g, or t
tgnccaaagctagtacccaaactaaatacacaaaattacaaaaccaacaacgtttaaattatcaacatcaaattaatctgatggagacagtttttaaaaaccagactgatgctgaaggcataaatatggtactaaaggcaccaagttaggtttttttttttttttttttttttttttttttttttttttttttttttttttttttttttttttattttttag

SEQ ID NO: 646322 - DNA, 886 bp, Homo sapiens
ggccagtgcctggtctccaagtgccttgtgaatgaccagaggcgattggtttgagtggtatgtgtgtggtggatcctgttctggtctactcgtggatgctggtcatcgggtgtgcagtattgatcaggacctgctcacccaaaacgcttatggagagctggctacgtgacgacaaaagaaaagaaagcaagcccatcatcttcgtatacggacagagcaaagcagtaactaggacgcttgggtgtggaccaggagtcagaggagggcaagaggcaaaatgaagccctgataaggctagatgcacgattcccatagggcacgagcctggcagggtctgatcaggagaacgtgaggaacatgcgagcaattccggaacattttctagcagatagcaggagatgacatggagatctgtgctgatgagctcaagaaggtccttaacacagtcgtgaacaaacacaaggacctgaagacgcacgggttcacactggagtcctgccgtaagcatgattgcgctcatggatagcagatgggtctggaaagctcaatctgcaggagttccaggcagctctggtaacaacgattaaggcctggcatgaaccctttgcaaagactatgacacagagcagtccggcgagcatcaggaggtacgagatgcgaatatgcggtcaatcggcgcaggattccacctcgaagaagcgagtctatgacatcattaccatgcggtacgcagataagacacatgaacatcgacgtttgacagtttcatctgctgcttcgttaggctggaggggcttgttcagagctttttcatgcattttgacaaggatggagatggtatcatccaagctcaacgttctggaagtggttgcagctcaccatgttg

SEQ ID NO: 646323 - DNA, 322 bp, Homo sapiens
tctctttcgtttccatcttaagcttacgatattcatcacctttagacaaatcccaagccttacagtgccgaggccttacctggtcaggtgccgagacctccagctgccgtgccaggctggagtggctcagcagcacggcggggagcggcgcgggaccgtacctctccgtggaccctgcccgccggctgaggagcgtgagcgtgggcgctgcgggagggctgctggatgagtcccggcgtcttcgacgataccgcggcatgttcgccctgcgcaacgcgggaggcgaggaggccccctggcgctggccgagggtctgcactgt

SEQ ID NO: 646324 - DNA, 819 bp, Homo sapiens
  misc_feature (389)..(389): n is a, c, g, or t
  misc_feature (427)..(427): n is a, c, g, or t
  misc_feature (472)..(472): n is a, c, g, or t
  misc_feature (607)..(607): n is a, c, g, or t
  misc_feature (613)..(613): n is a, c, g, or t
  misc_feature (632)..(632): n is a, c, g, or t
  misc_feature (639)..(639): n is a, c, g, or t
  misc_feature (647)..(647): n is a, c, g, or t
  misc_feature (661)..(661): n is a, c, g, or t
  misc_feature (749)..(749): n is a, c, g, or t
agcggggagtgacgacagaggcggagctccaactgacatgttcattaagggcagggctccgaggagagccacgctcgagagcgacaggtcgggctacccggggcgggtctgaggcaggtttgtagcgcacgatcccagggaccattgggctccgacgcgtctcgaggccctacttctcgccagggctaaggcgttgtgtaggcaggctgctgcacagtagaatcaggctggtctagctttgtccagcaatctacggcagatggatggcagtggctcgcgtgctgggtgcaacggggagacggacaaggcattcctacgagacctctcggagctccgggcatggacgaaccgtccgcggtcggccatgattccgtgcaagtgctccgcgnacacaggaactatgatacagcagccacactcgaatggnagcgatggtgtgcaatccgttacatgaagttcccacacattgctntcagcacaacaggtggcgcgaggtacacgcagcacatggtttacgaaactgcaacgtgctacgtgtctctgtcatgtgagggcatgcaaagcatgtgcattgctcgcaaaacccagcaggtggtaagcgcaatgngctggnaacgcaagaggatagccangactaanttccgtgnggcctcgagtcganacattatcgttgggacgaatcagaggagccgccaacttgggaagcaatcgctagcagcagatgtgacgactccaccatcgcttgcganagcgcatacagttggacccaaggcgtacaaattggcttacgtccatttgagacttacgaattggaggcga

SEQ ID NO: 646325 - DNA, 420 bp, Homo sapiens
cctgatcgcattgcctgtaccctcttagcctcggttcccttatctgacagcagccctttatctattctagctctctggcttgcaggggatgaggtgaagcaaccctaatcggctgaagccaaagaaaggacttcagatctcgtaactgcaaatcctggggtctagcctcataactgcaaatcctggggtctagcctccctctctggttcttgtcacctcctcgtgggcttcagtcccaagttccagatcggtgcaagacatggtcgaagcccagggcccgcatcctcccagattccagccacctgggagtgtgtctgtggtccctggtctctgacgaggtcctgtgccctgccattggttccagtggactgccggagctgatgggtcaggcctgcactggagctggttggagtttgctcc

SEQ ID NO: 646326 - DNA, 337 bp, Homo sapiens
ttggtatataaactatcgtgtacagacaaggcctacagacttatttcttcttggacacacccacggtgcggccacggcgagccagtggtacttggtgtgctggcctcggacacgaaggctccagaagtgacgcagccctctatgggcctgaatcttcttcagtcgctccaggtcttcacggagcttgttgtccagacattggctaggacctggctgtatttccatcctttacatcttctgtctgttcaagaacagtctgggatcttgtactggcgtggattctgcataatggtgatcacacgttcacgtcacctcagtggtcgacgcggcctgacat

SEQ ID NO: 646327 - DNA, 298 bp, Homo sapiens
aagcttgtcatcttgataggtaatatataggtacatagacacatcagaacgatcacttactccaatatcattggccaggatactatatgacatacgatagtgaattcggatcacatgtatccctatatcgggatagaatcaaacaggttattgatgactccctaaacgaacatcttaactcaatgattctacgtgttgatctgcatgacccaattgatacagaaaatatggataacccattctttcaacccagggttggctctggtgctatatctcgctttaccagtgcgttaaaagc

SEQ ID NO: 646328 - DNA, 126 bp, Homo sapiens
aaggggggttttttttcccccccctttttttttttcggggggggggtttcccccccccccggggttggggctcttaattagggaaaaacccccccttttttttttttgttggccggggggggggga

SEQ ID NO: 646329 - DNA, 102 bp, Homo sapiens
gcgtgaggaattctcctcctcctattaagctttggctaatactgcatatggcacaatgtttaatattggcaagttcatctcaggaggaggaggaattcgccc

SEQ ID NO: 646330 - DNA, 337 bp, Homo sapiens
  misc_feature (1)..(1): n is a, c, g, or t
ntttcacaaaagctgaacccactttaccaaaaattgagtttaccctgaagccacaaaaattgaattgtatacacaagtaaacttaaggtttaaaacgtgtaggacatggtaccaaggtagttctcagttgaagaatttttccaatgtgccttatagagagggccaaagttgtgaaatatgtaatgtagccttacagggaaccaaatggtgtcatcaggttttactgtcatctacaacaccttacacagccagaacccttggtattttaatatgtgtaggaaacacattcctcatataggcgagtagggttctcattcaacccttttgtgctgtttct

SEQ ID NO: 646331 - DNA, 154 bp, Homo sapiens
acatcgaaaccatggagccaagagccatgccaggggtgccctgctggagagtaggacatgctgtaggtgggcgagccgtacatgtaggtctgcgagctggtcatggagtcgaactgtcgggctagtcgggagggaacgagctcgaatccgaaaa

SEQ ID NO: 646332 - DNA, 784 bp, Homo sapiens
agcggatgacgtcacgcctgcggagctgccgccgcgcgccggtggggcgcgagcgtgtgcggggtgcgggcgcgggcgcgggcgcgggcgcgggcgcgtgcgggctgcgagccgggaggcggcggcggcgacggcgacggcggcggcatggcggagagcgaggcctgagacccccagcaccccgggggagtacgagagcaagtacttcgagttccatggcgtgcggctgccgcccttctgccgcgggaaagatggaggagatcgccaacttcccggtgcggccagcgacgtgtggatcgtcacctaccccctccggcaccagcttgctgccaggaaggtggtctacttggtgaagccagggcgcttgaccccgatgagatcggcttgatgaagcatcgacgagcagctcccggtcctggaagtaccccacagccgggcctggacatcatcaagggagctgaaccttctcccacggctcatcacgatgccaacttgcccctaaccgctttcgtgccctctgacctccagacgatggagaactccaagggtcatctatatggctcgcaaaccccaaggatctggtggtgtcttattatcaggttccagcgcttctctgcggaccatgaagctaccgaagggcaccttcacggaatttctgccggaggtttatgaatgataagctgggcctcggttcctggttgagcacgtgcaggagttctgggagcacccgcatggactcgcaacgttcttatcttcaacgtattgaagacatgccttcgggacc

SEQ ID NO: 646333 - DNA, 516 bp, Homo sapiens
ccagcccgcccgcattacgccgagaaccagcgaggcggaacttgcactacgagaccgcgccgtgccctccagcctgggcgacagcagtgaggctccgtctcaaaaacaaacaacaccaaaagaacacaaaaaacagaaatataataagaatatcttcaaagggtacaaatcatacgtagagcttaacaaatttctacaaagtgaacacacccatataatcagcatcaggtcaaacaggatagagaactagtaccttggaacgttcccttaggacccctcaagggaagacaatctggattatcattctgagtatgtgtatgtatgctatgggcatctagtaggcagaggccagggatgctgctaaacatcctacaatgcacaggaaagccccaataacaaagaattattcattttaaaatgtcaatagtgctaaggataaaaaattctatattacagacccagatgtgcttctccctttcactcaagtatgaacgatgatagtcagagcagctaaca

SEQ ID NO: 646334 - DNA, 124 bp, Homo sapiens
caatcgcgtgagccatcagacagaggagtgactctctgaactgaaaactgagctatagcacggatctgtgatagggcaacctccttccggagagctgtagtaatgcctcacgcagtgctaggta

SEQ ID NO: 646335 - DNA, 700 bp, Homo sapiens
  misc_feature (174)..(174): n is a, c, g, or t
  misc_feature (197)..(197): n is a, c, g, or t
  misc_feature (201)..(201): n is a, c, g, or t
  misc_feature (207)..(207): n is a, c, g, or t
  misc_feature (235)..(235): n is a, c, g, or t
  misc_feature (249)..(249): n is a, c, g, or t
  misc_feature (303)..(303): n is a, c, g, or t
  misc_feature (318)..(318): n is a, c, g, or t
  misc_feature (337)..(337): n is a, c, g, or t
  misc_feature (343)..(343): n is a, c, g, or t
  misc_feature (346)..(346): n is a, c, g, or t
  misc_feature (350)..(350): n is a, c, g, or t
  misc_feature (380)..(380): n is a, c, g, or t
  misc_feature (387)..(387): n is a, c, g, or t
  misc_feature (396)..(396): n is a, c, g, or t
  misc_feature (413)..(413): n is a, c, g, or t
  misc_feature (417)..(417): n is a, c, g, or t
  misc_feature (420)..(420): n is a, c, g, or t
  misc_feature (427)..(427): n is a, c, g, or t
  misc_feature (431)..(431): n is a, c, g, or t
  misc_feature (433)..(433): n is a, c, g, or t
  misc_feature (445)..(445): n is a, c, g, or t
  misc_feature (447)..(447): n is a, c, g, or t
  misc_feature (449)..(449): n is a, c, g, or t
  misc_feature (454)..(455): n is a, c, g, or t
  misc_feature (490)..(490): n is a, c, g, or t
  misc_feature (502)..(502): n is a, c, g, or t
  misc_feature (517)..(517): n is a, c, g, or t
  misc_feature (533)..(533): n is a, c, g, or t
  misc_feature (536)..(536): n is a, c, g, or t
  misc_feature (550)..(550): n is a, c, g, or t
  misc_feature (554)..(554): n is a, c, g, or t
  misc_feature (558)..(558): n is a, c, g, or t
  misc_feature (568)..(568): n is a, c, g, or t
  misc_feature (609)..(609): n is a, c, g, or t
gttaaaggtttaatttttgtttaaacctagacgtgcaacaaaagttttaccacagtctgcacttgcagaagaaagaaaaaaattcaaaccacatgtttatttttttttttgcctacctcattgttcttaatgcattgagaggtgatttagtttatatgtttttggaagaaaccnttaatgtttaatttaatcttaanaccnaaacgnccagattgaagtttgacttttattgtcncaaatcagcaggcncaagaactgtccatgaagatgggaaatagccttaaggctgatgcagtttacttncaagtttagaaaccngaatgctttgtttttaccngattcnccnttanaggttgatggggcaactgcagcccatgacncaagatntcattgttntcgatgtaaaggggttngtancanacaggtngttncnttagaatagtcncncnaactnntcagtgttgcaggaacctttttttgggggtggggnagttcccttttntaaaaatgcaatgcnctaaaactattttaanaangtagttaattctgnttantcanaaagtgggcntcttctgtgtttagggtgtaataatcgaggttcttggcttntccttggtttctttacttgctcttattgggctctgggttttttaaacccatttttactttataggatatttttcatgtgccttttgtgaat

SEQ ID NO: 646336 - DNA, 191 bp, Homo sapiens
aggatcctcggaatgtgtggtgttatgaacagatacttcggatcgtaataatctcgcaccccaggacccggtcatcgaaagcctatcgtgctccgagagtaacgagtggaatatatatatgtcctgcatgatccacaatttgcttgacgggcatcgccccggccggaggccacccataacaccacacaatt

SEQ ID NO: 646337 - DNA, 1014 bp, Homo sapiens
tactagcatttagccatctcacttctaggaatactagtatatcgctcacaccgttcatatcctccctactatgcctagaaggaataagtactatcgagtgttcattatagctactctcataaccctcaacacccactgccctcttagccaatattgtgcctatgccatactagtctttggccgcccggcgaagcaagcggagggccatagccggatacgtagggtctctaatctccgaagcgacatgatggcctagaacgtacgttaacgataaccatagaccctacgtccaaggcgtaaaactaatcggtccgcagacgaattatgatgtactgaccacgtgcacagtgactttccaaaaaacacgatagagtttggaatcgacgcaagcacccacaggctaagttattagcatcatcctccctactatgttctaaccaatgtcaacatagaagcctatttgagctgttcccgcaagactttggcgtccgagcccctaagaacgccgcgctcgctaatactaactacctgaggtcctacccgctcacaatcatggcggccagggcgggttatccagtgagccactatcacgagagaaagctctacctctctatactaatctccgctacgaatctccttagttataacatgccagcacagacactaatcatgatttagtagtctacttgcgaaaacccacactgaatcccctacctgtgtgtaaacattcaactcgtatgatggcaacccggtcagaaacgtctgaacggcagggcacttacttctattctacaccctagttagctcgccttcgctagtcagtcggatataggtaactccagagcccttagggtccgtaaattttactattcactctcactgccaagaatatacaaggccgggcaacattttatggggtcgttacacaacggttaggaagaaccttacggctcactttagtccatgcatcttacccccactgggatattgcgcgcaccaaaagggggagaaccc

SEQ ID NO: 646338 - DNA, 443 bp, Homo sapiens
tacttcaaattttggcatttgaaaatggctggtggatattaaaaagttggatagtgtagaactcctttgaaatataaacaactttgaagtgtaaaaaattgtaattatcactacaatatatcagggatgtgaaagattttagttgtgtgatagccttggtatataacagcaaagataagccataatttgaactttcagagtgattgggtagtattgaatttaatgagttacttttgtacaattttaatgtgtactgagttaaaatttattggataattttgaaaattacagcatattatagtatatcttaattgactatagaaacagaaaaacatgatatatgcactagtgttattggacttacgtttattgcaaaatgagtttattctggtatgccatcataattgtatgtctattcttaaattaattatggacacattttt

SEQ ID NO: 646339 - DNA, 415 bp, Homo sapiens
ggcttggtaatttttcccccctcagctcacaaaaccaggcagtgggatttggagggtcagcaactgagctagagatggtaagtgacaaagtgagggaatatcgtggatcccagttgttcctccatgtgtactggtatccagggcgaagcaagagagactgatttagaatcaagaaaaaagctactgaccacggatgttgccatttggagtggtttagcatcagagccataggagctgctcaggttcagggcttgcttgggcagctatggctgtctgaaaacttttttttttttgagatataactactttcaagtcctcggattttgggggtagtaattccacagggcttgtcatttgtgtttgaagctggtggtgaggagggcggagtgaggagaagcgagggggtggagtgggt

SEQ ID NO: 646340 - DNA, 3118 bp, Homo sapiens
  misc_feature (2953)..(2953): n is a, c, g, or t
  misc_feature (2962)..(2962): n is a, c, g, or t
ctcgactttttttacacatatggagacttggagattcaggttctccttagatctctctgggtaatttattagaaatgcttacatagatttgcttcctaatctcaagctggcttcccctctccacaactcagcaactatctattctcccaggaggccatacaagcgaggggccctgaagcttaacatttattaacttcatgtaaaggtctgagcggacctttcaggccaggcagcgtgtcacttgcctgtgttccttgttagggcctaccaccgggtaggtgcttggaatgtgctgtggattaaaggcttaaatcctgcgggcccctcaatctgatctaaggacatgagtggcttagagaacggcgcaacaaggctaagcgaaagaaaacaaagcggtgtggctgggagtgggctccttccctccgctggtgagggtgcgatcttagactcttgagagaacccgacataaaggccgcgttccaatggcggccttctcccctaccggccaacctgccccgaaaagagcagaaggcaccctgcgggatctgcagatcagcttgcgtctcattctggggcaccgacacggtggaatgcaagacaccccactaccggaagtttctttgatgttaagaaaaacggcggaagtaggccgcagcgcttcctcagtatagtgcctcgagctggctcgcctactttctacggtaaagggaggtgctccacatctctatgcagctgtgcagcgccgcaggttccatgcgcaggctcggttggctaaatgcgctttccagccatctttcagccacccagtcctttcccaggttctcgagccaggacgtgacgtattcagacgtactgggggcggggcctcaaggggaaaagcgcctgagccgggatatcgcgagaacatcccgttctttcgtagctctggtgctgcggctccgctctcgtcgcaacgagatctttcgagatcttctccgcccccgctaccggcgcctcctctgcggccactgagccggagccggcctgagcagcgctctcggttgcagtacccactggaaggacttaggcgctcgcgtggacaccgcaagcccctcagtagcctcggcccaagaggcctgctttccactcgctagccccgccgggggtccgtgtcctgtctcggtggccggacccgggcccgagcccgagcagtagccggcgccatgtcggtggtgggcatagacctgggcttccagagctgctacgtcgctgtggcccgcgccggcggcatcgagactatcgctaatgagtatagcgaccgctgcacgccggcttgcatttcttttggtcctaagaatcgttcaattggagcagcagctaaaagccaggtaatttctaatgcaaagaacacagtccaaggatttaaaagattccatggccgagcattctctgatccatttgtggaggcagaaaaatctaaccttgcatatgatattgtgcagttgcctacaggattaacaggtataaaggtgacatatatggaggaagagcgaaattttaccactgagcaagtgactgccatgcttttgtccaaactgaaggagacagccgaaagtgttcttaagaagcctgtagttgactgtgttgtttcggttccttgtttctatactgatgcagaaagacgatcagtgatggatgcaacacagattgctggtcttaattgcttgcgattaatgaatgaaaccactgcagttgctcttgcatatggaatctataagcaggatcttcctgccttagaagagaaaccaagaaatgtagtttttgtagacatgggccactctgcttatcaagtttctgtatgtgcatttaatagaggaaaactgaaagttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaattgatgagtgcaaatgcttcagatctccctttgagcattgaatgttttatgaatgatgttgatgtatctggaactatgaatagaggcaaatttctggagatgtgcaatgatctcttagctagagtggagccaccacttcgtagtgttttggaacaaaccaagttaaagaaagaagatatttatgcagtggagatagttggtggtgctacacgaatccctgcggtaaaagagaagatcagcaaatttttcggtaaagaacttagtacaacattaaatgctgatgaagctgtcactcgaggctgtgcattgcagtgtgccatcttatcgcctgctttcaaagtcagagaattttctatcactgatgctaagaacgcagtggaggaatatgtgtatgaaatgagagacaagcttagtggtgaatatgagaagtttgtgagtgaagatgatcgtaacagttttactttgaaactggaagatactgaaaattggttgtatgaggatggagaagaccagccaaagcaagtttatgttgataagttggctgaattaaaaaatctaggtcaacctattaagatacgtttccaggaatctgaagaacgaccaaaattatttgaagaactagggaaacagatccaacagtatatgaaaataatcagctctttcaaaaacaaggaggaccagtatgatcatttggatgctgctgacatgacaaaggtagaaaaaagcacaaatgaagcaatggagtggatccaaggataaaaagatggaccaaccaccccaagccaagaaggcaaaagtgaagaccagtactgtggacctgccaatcgagaatcagctattatggcagatagacagagagatgctcaacttgtacattgaaaatgagggtaagatgatcatgcaggataaactggagaaggagcggnatgatgctnagaacgcagtgcaggagtatgtgtgcgactatctgaaaggttaatattaaacatagcatgctggcaataccctgctgtgtattggcgcactcggcaatttcaacatccgctctatcgaatacagacgatgacttactctaattttgaacatttcat

SEQ ID NO: 646341 - DNA, 749 bp, Homo sapiens
tgagaccagttgaataaaagtgcacaccttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaatttgggcccctttggcccaagcaaatttaaaattagaaaaatttaaaaatgggggccaaatttgggccaaattggcaaaattccccaaaaggggggggaaaaaaaaataaaggggcggggtttaaaaaacgtggaaatggaaaaaacctggggttaaccaaataaaaacccttggaaaaaaaaccctttttaaaaagtggggaaaaaacaaaaaagccccacacaaagggcttttcaaaaaagtggccaacctaaatgggaaaagaaaaattgaagggttaaaattttggaaaaaatccgggaaaaattttgtgaaaacaagcaattttttaaacaaataggccaaaatgggaaaaaccctataaaaataaaaagaaatcacccaaaaaagggtagaaggtttctcaatttaaaaaagaaccctctttaaaaaaaggggcctcacacgtaaagggaaaaaaccgttttaagagcaaaggccacattggaaacaaaccctaaaaatttttggggcaagggccaaaacaaaaatggaccctaaggccctttttatggggaccccacggg

SEQ ID NO: 646342 - DNA, 1194 bp, Homo sapiens
  misc_feature (63)..(63): n is a, c, g, or t
  misc_feature (1029)..(1029): n is a, c, g, or t
  misc_feature (1038)..(1038): n is a, c, g, or t
cgactcttgagatcccccatgtacctcctcagtctgatgctccagttcaaaagtgaaagtcanagttcgagtaaatgtccatggcattttcaggtgccagtgcatctttagtggaggtcacaagtctgaggaaaatgaggagccaatggaaacagatcagaatgcaaaggaggaagagaagatgcaagtggaccaggaggaaccacatgttgaagagcaacagcagcagacaccagcagaaaataaggcagagtctgaagaaatggagacctctcaagctggatccaaggataaaaagatggaccaaccaccccaagccaagaaggcaaaagtgaagaccagtactgtggacctgccaatcgagaatcagctattatggcagatagacagagagatgctcaacttgtacattgaaaatgagggtaagatgatcatgcaggataaactggagaaggagcggaatgatgctaagaacgcagtggaggaatatgtgtatgaaatgagagacaagcttagtggtgaatatgagaagtttgtgagtgaagatgatcgtaacagttttactttgaaactggaagatactgaaaattggttgtatgaggatggagaagaccagccaaagcaagtttatgttgataagttggctgaattaaaaaatctaggtcaacctattaagatacgtttccaggaatctgaagaacgaccaaaattatttgaagaactagggaaacagatccaacagtatatgaaaataatcagctctttcaaaaacaaggaggaccagtatgatcatttggatgctgctgacatgacaaaggtagaaaaaagcacaaatgaagcaatggagtggatccaaggataaaaagatggaccaaccaccccaagccaagaaggcaaaagtgaagaccagtactgtggacctgccaatcgagaatcagctattatggcagatagacagagagatgctcaacttgtacattgaaaatgagggtaagatgatcatgcaggataaactggagaaggagcggnatgatgctnagaacgcagtgcaggagtatgtgtgcgactatctgaaaggttaatattaaacatagcatgctggcaataccctgctgtgtattggcgcactcggcaatttcaacatccgctctatcgaatacagacgatgacttactctaattttgaacatttcat

SEQ ID NO: 646343 - DNA, 132 bp, Homo sapiens
ccttcttctggtggtatcctccccaggcgctgatagcggtattgaagcccagctggtgatgtgcgagctgatagatgagcggcaaatcaggagtaccagcggctcatggacatcaatgttgcggctggagca

SEQ ID NO: 646344 - DNA, 160 bp, Homo sapiens
agactgtgctcactcgctgtcatcgcgccatcattggtatatggttagtgtgttggttatgtaggcctagttatgaggagcgttatggagtggaagtgaaatcacatgtgctaggccggaggtcattagtgagggctagagcgggcccctgtttaggggt

SEQ ID NO: 646345 - DNA, 285 bp, Homo sapiens
ttgggatgaggaacgtcactggggaaaggggacactgggccaacccttgcttctcccccactgctgtgaggctcagtgaaaggcagacttttgagtctcttccttctttgctgcaggggttggggctgccagagtggtacctgctactctctcaggagcagcactgaagcatgtccatgttttagcagaagctcaaacaggaagtcgctagcctttccttgcacttgtttcttgcagacggttgccttggtaggcgtgtgacttccaactccttgatgcccaaga

SEQ ID NO: 646346 - DNA, 390 bp, Homo sapiens
  misc_feature (7)..(7): n is a, c, g, or t
  misc_feature (94)..(94): n is a, c, g, or t
  misc_feature (371)..(371): n is a, c, g, or t
tgaaagncctgccccggcatgtaataaaaaaaagccaccccctccatataaactggggtttggccaccccccgggaatacctgtatttttgganccctcatttgggacctcgggcagttcaaacctcactcatgttggttccagggtcaactgtatttcccatataacttaactcagttccttctgaatactttaagtcatctctaggttatttataatacgatttaatgctatgtaaatagttgttatgctgtattgcttagggaataatgacaaaaaaagtctgtacatgtttatacagatgcagtttttttccaaatattttcaatctgtgattgtttgaatctacagatgcagaacccatggatacnggtgggccaatcgtatatt

SEQ ID NO: 646347 - DNA, 86 bp, Homo sapiens
  misc_feature (52)..(52): n is a, c, g, or t
  misc_feature (61)..(61): n is a, c, g, or t
  misc_feature (63)..(64): n is a, c, g, or t
  misc_feature (75)..(75): n is a, c, g, or t
gaggagtactcatttgcttgcaaaggccataatctgttctttgaatggaganactgcattnanngcctgcaagcnccacgtcctga

SEQ ID NO: 646348 - DNA, 692 bp, Homo sapiens
attcggccattatggtctctgtggctcacgcctgtaattttagcactttgggaggccgaggcaggcagatcacaaggtcaggagattgagaccatcctggctaacactgtgccctgtctctactaacataatataattagctgggcgtggtggcgcacgcctgtagtcccagctactcgccaggctgaggcaggagactgccgtgaacctgggaggcgccgctctcagcgagcgcccaccaccccacctgcctccagccttgccgacagagagagcctccgcctcaccgatcaccacctcccccaccccctccaccccccccgtccccccctccgctcacccgcccttagactccaccacccttacgcctgccccccgcacttcccctcctacctgccaacccccccctcaccaccgcgcccccccaccactcactcgactctcctcctcccccttcacacccgccccccccccctcttgtccccccccttctccccctcctccctctccccccttcccctacccctcccctctcactcccctcccctcccccgctccccctttccccccacccccccccgccccccctccccccccctacccgctcccccccacactctcgcaccctcacccctccttcccccccacccctgccgccctgcccctccctccctcgtccccccgccgctccg

SEQ ID NO: 646349 - DNA, 347 bp, Homo sapiens
gggtgaccgcgtggaaatcaggtgtgtggctgatggcaaccctccaccacacttcagcatcagcaagcagaaccccagcaccagggaggcagaggaagagacaaccaacgacaacgtgggtacctgtgtagctatggagcctgcccggaaggaacacatgtggagcgctatagaatgtcagggcctggacttggacaccaatgatatacgctcgtcttagtgaaccacaggaactactggtgaactatgtgtctagacgtacgagatagagtacccgaagcccctgagagacaggaaggcaggacagcctcgaacctgacctgtgaggcagagagtagaccaggaac

SEQ ID NO: 646350 - DNA, 1140 bp, Homo sapiens
  misc_feature (734)..(734): n is a, c, g, or t
cttcagtagtctaccttaccatatatacccttttatctttccattacacaaggtggtttatttaagtctgtacatcttggttaatatctggtacaatcttccattcactgacggtgattttctgtgtcccccaagattcttacagaccattttattaagtggcttcgagcatcatcatacagaccaccatatgttctttgactataattatcggacaatatcttcactgttgtgggataggattggtgcgcctctattcaatcagatccttcatgcctttgaggtggaagggaccgctcagttatgtgaaggagatgcatcagagggcacatacgcgcaggtagtccattcacggcaatatggctgtaataatgaccgattattcaatgggagagtttcacgaatgactgtaatatgattatggcccagattacttcttcacagtaaggcacaagagaaggaaatatcatcgtatctcatagctagaataaggaacaactaatctccatacacgtcaagatacatagtacatggtatcatttggaaatcagtgtcgtggagcactgctgaggaatgatcctagtggtaggtccagacgaagatgctgtgaacatcagtgactttaatcttatgcgttcataatggcgcagatgtttgtttcgggcgactaactgtatctttctagcagcgatcttgtagttgactaggctcgaaaagaattttaaataagaccnggactaactcgaggggggacaaggaaaaggttagcttatccacccaggttttagaaaaacccgggggtgaacataacacagctagaagcctaacccgagaattatggcgcaacgatgcgcacacacggaggccccaaccggtgagaaaaccaacatttgagaaaaaacaccacgggggcacacacacacaacaccacaccgacaaaacacaacaacaacgcggagacatatgggagcgcacccaataagtaaatgggcactgtcgcgcaccaacaagaagttgcccttgtccctcactgctgccatatttcgtctcttttctcttctctctctctctactcttactacaaaataaaaataacagaatacaacaacataaaaaacactcgagacagcaaagacagac

SEQ ID NO: 646351 - DNA, 491 bp, Homo sapiens
  misc_feature (332)..(332): n is a, c, g, or t
  misc_feature (393)..(393): n is a, c, g, or t
  misc_feature (410)..(410): n is a, c, g, or t
gttttcagaatgtaaaaacacagaccacattaaaaagaaaaataacccaattaaaatgggaaaagcatttgaatagacagttctccagaaaagttgtataattaccaataaacacaagaaaactgctcaacatcattagtcattatggaaatgcaaatacgaactacaatgagatacctcttcccactcctaggataaccaaaattaaaagtcagacagaaataagtgttggcaagaatgtggaggaattagaatcctcatgcgttgctggcagaattgtaaaatggtacagacactttgggaaaacacatacagttctttaaaatgtgaancagagtaactcaggaattttatttctagggaaaatttttatatacctaaggaaattttttnaaaaacacatgtttccntgttaaaacttttacctaatttttaccgctgccttattttatattggtgttaaaagtgggggccacctggaattgttcctt

SEQ ID NO: 646352 - DNA, 790 bp, Homo sapiens
accctccggtgtcccgacccagtgctaagcttgagcatggcttgagcagtgagcccacagcctgagctgctgtgcccagattgcagctggagaacgaggagtgatgagcactctggtcaactacaatgcccccgtgcccagaatgagcatccagtgagatccatgtgagctgtgacaatggactgactgatgagcctgctgaaatgtacaatggatgtgccctgcttgggcctgctgtggcctgttacctgcagaccccaactgtccccaacgtctgtggttgacttggcctgacccatgtgtgtgcatgctcgtgccccggtgccccctgggatgctagtgacgctgacgtgtgctgaccttgtgatgagctatcacagcaatgcaagtctggttttgttgcttgaaatcggagtgtgttgttgtgagtacctgggataaaaatctctttcctgggttaacctgagagatagttgtcctggcatgaatgtacatccatgcatactgtatcatggaaatggcgtacaagattgacaagactgactacattggtaggcatgctatggtgccccggggcctgatggagtaacgagtatcctgaccccccgtgttatagagtgcacccaagggggtattgcttggccctggggcagcatacagcatcatgtcccgctttcacatgactgacgacaatacctgaacacctgtcctgggagttgaatctcaccatcatgacggacttggaaggactgacccagccataagcggctgtgcaactgacggccggcag

SEQ ID NO: 646353 - DNA, 110 bp, Homo sapiens
gcttggaaagagaactcagggagcatcaagagagacaccttgagcagagagatgagcctcaagaaccttctaataaggtccctgaacagcagagacagatcacattgaaa

SEQ ID NO: 646354 - DNA, 153 bp, Homo sapiens
  misc_feature (6)..(6): n is a, c, g, or t
aggggnactgccctgctacaaagtgatgaacatccacctttttgtctaccctctgtacttcacttttgtgcgccccaccgagatcatcgcgttcagcaaccgtgcagaggacattcgtaagctgcgctgtgaagtgctagactgtgtcgaagt

SEQ ID NO: 646355 - DNA, 206 bp, Homo sapiens
catcagaacaacccaccctacattacacgcccagcaggtgctctgagtgtggcaagcatttccgatgcgactcccatctagccagccatcagagcgtgcatgcagcaggcaactcctgcacaggccaagaggctggagagagccctggggctaggaaacggcagcgtgctgtgccagtgccaaagtgccacgtgtgcaccgagtgt

SEQ ID NO: 646356 - DNA, 941 bp, Homo sapiens
cgtggttccccgacgccgacgaagtcccccgcacagttgggtgtgttaccgccacattgcccccggtgggctccttcttcagtggtgtggttcccgccacgcacaccagtagtttggtgcgcgggagagacacctctcgctcactagcggctttctccgctctctctcacggaggggtgtctccctccctctcccccttcagagagagagaggtgtgtttcacacgcccccggcgccaccgctgctctctcgccgcgggagatattcttgtgaggagacaagagatgatgccatgtgggagggtaaacacgacgcacacagcgcgacccaactcccggggtggtacatctatatagagagagcgaggggcacgtcttttgtggtgggggtaagagagagcccccccccgcggggggtgtgtcccaccacccgcccgactgatcagtggggcggcgaaacagagcagcgcgctccacaaagagagaaccccgctctctctccctccccccctcgcgcgagggcggtgagatagaaaagagacacacatctcgctggtggtcaccacacacgcaaagaacggttggtgtgtagcacacgacacgatatctcctgctgcttatagagagggagaggctacccaccacacacgaccaccagaagagtgagggccccaaccacccctttcttatcagggagtcaaaacattatttacaaagcaagggaaacgaaacacattctccacacgagtgccaccgcaccggctgcatcgatgacgatgtggatgagaggagcgtgcccacacactgaatataggacacgaccagcgcggccccccccccggggagagacccacgaagggttttgtgtgtttttttttcccccccccgttttaatgtttgggggaaggattttaaccccctttttaaaaaaaatttttttta

SEQ ID NO: 646357 - DNA, 81 bp, Homo sapiens
  misc_feature (42)..(42): n is a, c, g, or t
ctagaagattcagcaaagtacttttgtgctcttggggagtcncccatcctactgggtcacgctatcaccgataaactcact

SEQ ID NO: 646358 - DNA, 954 bp, Homo sapiens
taactggtggggtgagagcccccatcatatgcgggggtcatgttgttggtcaattccggccgcacgaagtcagtgtgtgttggcgaaaacagatgattggtcctttgtggggcgaggaacagcttggtgggtagcacgcgacctcggatgctcgctggtggcgacgcgcccgaccagcgtggttggttggggcccactccttccactcacacggtggtgaccagagccccccctcgaggtgtgtgttgccacaacacactgtgtgtcgactaagcaccctcgccgccgcatgacctcttgcgtgactctccgcgcgagtcgagaatgtaggaaagtgtgcgtgtcttggttctccacacagtcgaccacaggttctgagagggcgcacctaaggcgccgaaggagataattctctgtggagcacaagcgggttctatcaaataaatcgctggcgacagtagattgatagcgttataaacagtaaaacagccactacgctttctgcagccaactgattacttgaggaacaccctttggggcgtcttatgaggggatatacatcacgctgagaccacctacttcccggatttctggggcgatataccccacataaatggacacgcccacacacactctggtgagattttttcatccgccacgctgagagcgttttaaacatacttggtgcacgttggtagtgatatacgcccacgtgtttcacaccttgcccgtgcacaccatttgcccgactaactcacctaccactcttggtgccctacacgcagcagtctcctccacaacagtgatggcccctcagcaccatgatttcccaccaccagaagtatatataggaggttcataccttccctcgcacctcattaattctcccgcttcttccactgccccaaacagccatataagaagacatttccatgaaacattctggtacataac

SEQ ID NO: 646359 - DNA, 548 bp, Homo sapiens
tggtaagtagtaatatagcggcacgcatgactggttcattcttgtgcattaaattgtaatagtaactagatagtccaaatatgaagcaaagatgatcacggtaggatacagaaatctcagagtaacaagcaatagtagcatgtagcagaaattaaactgagatggagcaaagaaaggtgaaggtaacacgataccaaaagtacccccatgccatcactaactgaagaaaagcttcgcacagtagaactaatatcagacactgcgtacagcaggaggtgagcgatgatagaggaagagaggcctctcataaccacccaaaggccaagtcaccaggtagataaaccaattatcattacgagagcaatccacttcatataatatcaaagtatgtgaaccaaaaagttacagaacctaagagacaggactcatccacaagcgcagactctcaggggccgctgacccagcgttcctacttctggatctgtactcaccagaagtgtgaatacatgcacagcccaaggagaaaagacgcttacattgtaaaagcc

SEQ ID NO: 646360 - DNA, 563 bp, Homo sapiens
  misc_feature (30)..(30): n is a, c, g, or t
  misc_feature (92)..(92): n is a, c, g, or t
  misc_feature (116)..(116): n is a, c, g, or t
ctattaggcatttacccttgaatcacggtntcatctcaagtcactcctgacttgcaggtctcagaaccccaaatgggaccggatccctcagnagcagatagtgtccagctttgtgnagccgacatttaagatgtggagcacttggggtcgtttgaaacccgctatcttcagtagggacttttacttctagagaacatgtgcattttgattttatctgtcctcaaactgaacttttgctcattttaatagtaaaaacacattcctaggtggagacttaagatgctaacgagacatgcaatgtatgcacaaatatgtacagttagtgcacatgtgcacccagaagaccactcaaaacatgcttacactaacacttctttccaccttcttatgaataatcgtgcaaaacccccagaaggagggtttctccagtaacaattaatggtgtctcactcttatgagcagcctgccctggaatctctttctcagaatgtaccgtctattctgcacttaattttcaaagtagtcttttctttttttgtgtgcaataaattactctatgctgt

SEQ ID NO: 646361 - DNA, 284 bp, Homo sapiens
  misc_feature (160)..(160): n is a, c, g, or t
gtcgacatcatcgcggatccacgccgacgatagctgcgccccgcccacgcaggacaggatcaacatgctcaagccgatgcccaatacccagcggcaatcgacccaacgcaggttgcacagcgccgccaccaacggcagcgcgatcaactgcggcacgccnatgatcagcatcaccggggcagtttgcagcgggcggtcgttgctacctgagccaggtagctggacggaatgatggtcaccgccagcagcacgatcagcacgccggcgagcacaatcagcgcgaa

SEQ ID NO: 646362 - DNA, 139 bp, Homo sapiens
ttagctgacggagtaatgtggtgataccagtaggggtgctgatagtgagtcggagaagaatgttacggaaaaataaaggctgttacgcctagttggtttagtagggatagactgatcaggctaatgaggagactatgta

SEQ ID NO: 646363 - DNA, 374 bp, Homo sapiens
  misc_feature (149)..(149): n is a, c, g, or t
  misc_feature (151)..(151): n is a, c, g, or t
  misc_feature (162)..(162): n is a, c, g, or t
  misc_feature (263)..(263): n is a, c, g, or t
  misc_feature (272)..(272): n is a, c, g, or t
  misc_feature (277)..(277): n is a, c, g, or t
  misc_feature (295)..(295): n is a, c, g, or t
  misc_feature (305)..(305): n is a, c, g, or t
  misc_feature (324)..(324): n is a, c, g, or t
  misc_feature (350)..(350): n is a, c, g, or t
  misc_feature (361)..(361): n is a, c, g, or t
taagctttaaaaatttttattttttcattttatttcacacattgacattaaatttttatggacacataataactgtacatatatatggggtagaatgtgatgttttaatacatgtactcaatgtgtaatgatcaaatcagggtaatttncntaatgattttnctgtagggagaaaattcaaaatctactcttctggctattttcaaatatataatatgttattgttaactatactcatcctactatgcaatagggcacccgancttattccnggggntctacatccgttaaggcnaacccagggnttgggaaatattggggaanaaaaattgcggtctggtactggaacnatggtaccggncttttttcttggt

SEQ ID NO: 646364 - DNA, 381 bp, Homo sapiens
cgctcctctgcctctgggccgtccggttgtggcaggttgtcgcagacttgccctcaatctcgttccaggccgctgtggcgacgcatttgtgtttctcgcgctcgtcgtacacatggggccgcacagccacccagtccgactcgagcgtctcctccagcgcgatcgacatggtgggcgtgccttctcgccgcggggaatagcaccggcccggcccgcccgaggacatgccacctgtgcgcgcgcaccccgctcaacctcgccgggcgccttcagccatcttagatgcccgccggctctcccagctcgttcgcctgtccctccgcgccccgaacgccgagctcctttgtggcgcggatcgagagaaggacaataagcgtcccg

SEQ ID NO: 646365 - DNA, 194 bp, Homo sapiens
gctcgaccacaggatcactacacatcattggtagggcgtacaaaaattagctgggcatgggccaggcatagtggctcacacctgtaatcccagcagtattgggaggccgaggcggatggatcacgaggtcaggagattgagaccatcctggctaacacagtgaaaccccttctctactaaaaattcagtcgacg

SEQ ID NO: 646366 - DNA, 242 bp, Homo sapiens
tatgcccgtgtccgtgtagtaggggcactctgccgccattaatgagagtgataacgctgatatcatagtcaatgcccggctccagtccctgtgactgtgttgtatcctactgaggagtccacgaaaatcttcaagatatagggagtgccttctcctgtccgtaactactgtgagtgcggtacccaagtaattggtggaacgagtttagccggggttccacactcagtgcctgagtgcttgaa

SEQ ID NO: 646367 - DNA, 369 bp, Homo sapiens
  misc_feature (218)..(218): n is a, c, g, or t
aaaaaccccggtcctaaaaaccggttttttcctcgtcattttgggggtcctccccccccccccctgggttgggggtcagggtttcctgctttatatgagcccccctcccttcccccccccccttatggtggggggcccgggcttccaacccaaagcctttgcccctgccataccttgtttgtccccccctcccgggtccccttgtcccccagcctgantcctgcctgataggtcctgggtcccccagctggtccccctggccccggctgccggagcccgggtggggggccccccccccccccccctgggggtggggaattgtgttttgggggaaagtgggggattttattaatttttggggctctggga

SEQ ID NO: 646368 - DNA, 243 bp, Homo sapiens
tgacctgcccgcctctgcctctcaaagtgctgggattacacgcgtgagccactgcgcctggccaactaaagcctcttcctatgttgatttcccctctggtaaatttcctcttttgctcacgtaacattggaatgaccactgggcctttttttttttttttgaattccactaaggggaagaacggccaggatcttttcaatttgggagagaggaatatttttgcgggtcacacacattgtcctt

SEQ ID NO: 646369 - DNA, 366 bp, Homo sapiens
aggttgtacgtaaagaaaaagaaaaaaaccttaagcgggatggtactgaaaggattaaggcactagaggggtccggaattcacctggagaaagacccaaagggccagtcaggggggtggggggaactcagctaaatagacctagttacggcccggctaggccaggcggtacggggagcccctcctcactctctaccaaccctaaaccctgaggacaggggaggaacccacagcttccttctccggccagcggcagatggttggcctggcttttccaccccctaatggtcaaccacaaaaatgagaaattcctcttctagctcagccttgagtccatggccaaatttccagtacaaccggccggggg

SEQ ID NO: 646370 - DNA, 109 bp, Homo sapiens
ggggggtttaggcaggaaaatggcattaaacccggagggggggctttcagtgagccaaaatcaaacccctgccccccagcctgggggccaaagtgagcctttgtttcca

SEQ ID NO: 646371 - DNA, 1070 bp, Homo sapiens
  misc_feature (4)..(4): n is a, c, g, or t
  misc_feature (23)..(23): n is a, c, g, or t
  misc_feature (39)..(39): n is a, c, g, or t
  misc_feature (41)..(41): n is a, c, g, or t
  misc_feature (45)..(45): n is a, c, g, or t
  misc_feature (47)..(47): n is a, c, g, or t
  misc_feature (743)..(743): n is a, c, g, or t
  misc_feature (1031)..(1031): n is a, c, g, or t
cccnaccggaaataatgaaaggnccccataaagcccggntnacancntatccagtgtacattttaacaggtggcaacatcaccacaggtagctttgattatgtaatcaacacttttaactttccctacacatgtacatcaaatgtgaatggtggaatatacaagttaaccgtcctccttcaaactagctgaaaaactactctctcttatttcattttgcattttctaggcagtatttttccatgctctttaaaaacagacgcaggagctttggaagagcagaaatgcaattacttacatacaatatgatgagaagtgtttcatgatatacaaattgacataggacaagttattaacatagtacaagtttttactgtgtagaaaaaataaacttacagtgaataaataaacagctttctatatcaagttatgtatggagtataaaaagtagttactatatatatatacatatacatatatatataaatgtgcatgttctagagtataaatatactatatacttaaatatttcacgtgacagaacattatttcatctggtttcagttttgtacattaaaatatatctggcagttggggtctcccctgatctctggagacccagggatcctcttcccattccaagggtagacgcaccagcagagtcccgcctctccatccatggatgtctcacactgtctgctgtgataaaatccattcttgttgcagtttggcaggtaaaatttnggaaatttcttctcctgatgtctcctgtgccttggctaaactctctacgactctgtagagttctattcggcagggctccttccattttttgatgttggtgacatggagagccttcgagccatcataggtactgatggcgtcccaaaggatggaatgatcctcttcagaaggggccatcagatggaaattatccaggagctcctcctcagttatctccgtgctctctgggctttcagggctcctgcctctgcagcatgggggagcggaggcgtcagactcctgcacgcnggcgccttggccgcgggtgagggcgtgcagagggtgctg

SEQ ID NO: 646372 - DNA, 406 bp, Homo sapiens
  misc_feature (15)..(15): n is a, c, g, or t
  misc_feature (298)..(298): n is a, c, g, or t
  misc_feature (324)..(324): n is a, c, g, or t
  misc_feature (363)..(363): n is a, c, g, or t
  misc_feature (377)..(377): n is a, c, g, or t
  misc_feature (399)..(399): n is a, c, g, or t
tcaattgtgtttttnactgtgactgtctaaagacatcttgtgattcacagacaatcgtagtcttgttttgatcctcttcaaaaggtggtttataatcagctgtagaacttaggtgctcttaaatgcatatttccaatatctttagattgtgatattaggaataaaggaaaaacattcagggactcatgaagagctgaaatattcatggaatatcaagcagagcaaggagttaactgaatggggctggaactaatagaaggacatgtaatctgtttaactttttgcttaaaactttgcnggagttttgtttttcggggtcagggnaaacttttattttggggcctatttacggcttttaaccantggggtaggggggnttcccccgtggggaccaaattnggggggt

SEQ ID NO: 646373 - DNA, 1069 bp, Homo sapiens
  misc_feature (4)..(4): n is a, c, g, or t
  misc_feature (23)..(23): n is a, c, g, or t
  misc_feature (39)..(39): n is a, c, g, or t
  misc_feature (41)..(41): n is a, c, g, or t
  misc_feature (45)..(45): n is a, c, g, or t
  misc_feature (47)..(47): n is a, c, g, or t
  misc_feature (436)..(436): n is a, c, g, or t
  misc_feature (443)..(443): n is a, c, g, or t
  misc_feature (445)..(445): n is a, c, g, or t
  misc_feature (461)..(461): n is a, c, g, or t
  misc_feature (463)..(463): n is a, c, g, or t
  misc_feature (466)..(466): n is a, c, g, or t
  misc_feature (495)..(495): n is a, c, g, or t
  misc_feature (503)..(503): n is a, c, g, or t
  misc_feature (512)..(512): n is a, c, g, or t
  misc_feature (519)..(519): n is a, c, g, or t
  misc_feature (538)..(538): n is a, c, g, or t
  misc_feature (742)..(742): n is a, c, g, or t
  misc_feature (1030)..(1030): n is a, c, g, or t
cccnaccggaaataatgaaaggnccccataaagcccggntnacancntatccagtgtacattttaacaggtggcaacatcaccacaggtagctttgattatgtaatcaacacttttaactttccctacacatgtacatcaaatgtgaatggtggaatatacaagttaaccgtcctccttcaaactagctgaaaaactactctctcttatttcattttgcattttctaggcagtatttttccatgctctttaaaaacagacgcaggagctttggaagagcagaaatgcaattacttacatacaatatgatgagaagtgtttcatgatatacaaattgacataggacaagttattaacatagtacaagtttttactgtgtagaaaaaataaacttacagtgaataaataacagctttctttttcaagttatgtttggngtttttntngttgtttctttttttntntgngtgtgcgtttttgtgtgggtgtgcgtgtncttgggtntgggtgttntttttgnttgggtgtttggggtgtgnggggattatttcatctggtttcagttttgtacattaaaatatatctggcagttggggtctcccctgatctctggagacccagggatcctcttcccattccaagggtagacgcaccagcagagtcccgcctctccatccatggatgtctcacactgtctgctgtgataaaatccattcttgttgcagtttggcaggtaaaatttnggaaatttcttctcctgatgtctcctgtgccttggctaaactctctacgactctgtagagttctattcggcagggctccttccattttttgatgttggtgacatggagagccttcgagccatcataggtactgatggcgtcccaaaggatggaatgatcctcttcagaaggggccatcagatggaaattatccaggagctcctcctcagttatctccgtgctctctgggctttcagggctcctgcctctgcagcatgggggagcggaggcgtcagactcctgcacgcnggcgccttggccgcgggtgagggcgtgcagagggtgctg

SEQ ID NO: 646374 - DNA, 268 bp, Homo sapiens
  misc_feature (2)..(3): n is a, c, g, or t
  misc_feature (184)..(184): n is a, c, g, or t
  misc_feature (228)..(228): n is a, c, g, or t
  misc_feature (264)..(264): n is a, c, g, or t
annctccaccatgttgaccctgcattgccttatatcagcgacacagggacaatacctcctgaaagatgcctctttggagtaatgctaaatatcgctgcagttttaggcattgctaccatgtatgttcgttacaagcaagttcatgcactgaaccctgaagagaaccttatcatcaaattaaacnaaggctgggccttgtacttgggatactgaagttgtttaaggacntttcccttgtggcaaatttccaggaaatcaacaccngtta

SEQ ID NO: 646375 - DNA, 581 bp, Homo sapiens
  misc_feature (4)..(4): n is a, c, g, or t
  misc_feature (23)..(23): n is a, c, g, or t
  misc_feature (39)..(39): n is a, c, g, or t
  misc_feature (41)..(41): n is a, c, g, or t
  misc_feature (45)..(45): n is a, c, g, or t
  misc_feature (47)..(47): n is a, c, g, or t
  misc_feature (409)..(409): n is a, c, g, or t
  misc_feature (414)..(414): n is a, c, g, or t
  misc_feature (419)..(419): n is a, c, g, or t
  misc_feature (427)..(427): n is a, c, g, or t
  misc_feature (441)..(441): n is a, c, g, or t
  misc_feature (445)..(445): n is a, c, g, or t
  misc_feature (449)..(449): n is a, c, g, or t
  misc_feature (476)..(476): n is a, c, g, or t
  misc_feature (491)..(491): n is a, c, g, or t
  misc_feature (500)..(500): n is a, c, g, or t
  misc_feature (572)..(572): n is a, c, g, or t
cccnaccggaaataatgaaaggnccccataaagcccggntnacancntatccagtgtacattttaacaggtggcaacatcaccacaggtagctttgattatgtaatcaacacttttaactttccctacacatgtacatcaaatgtgaatggtggaatatacaagttaaccgtcctccttcaaactagctgaaaaactactctctcttatttcattttgcattttctaggcagtatttttccatgctctttaaaaacagacgcaggagctttggaagagcagaaatgcaattacttacatacaatatgatgagaagtgtttcatgatatacaaattgacataggacaagttattaacatagtacaagtttttactgtgtagaaaaaataaacttacagtgaataaataanaaaanttgtntatgaaantctgtctagcgtanaccnaatngttcatctatatatctcgatatcgatntactatatacacctntaactagtnatctcgtcaacacacatactcgtctctcgttccctactattcgctgttataccgaagcccgcttcttttgcntgttaagtt

SEQ ID NO: 646376 - DNA, 424 bp, Homo sapiens
  misc_feature (10)..(10): n is a, c, g, or t
  misc_feature (39)..(39): n is a, c, g, or t
  misc_feature (121)..(121): n is a, c, g, or t
  misc_feature (213)..(213): n is a, c, g, or t
  misc_feature (224)..(224): n is a, c, g, or t
  misc_feature (274)..(274): n is a, c, g, or t
cgtgaaagcngccgtcggactggtgctgcccgccaagcntgcggcacctgtcgcgggagaacgtcctcatcaccggcggcgggagaggcatcgggcgtcagtcgcccgcgagttcggaagncggcgccagaaagattgttctcgtggggccggactgagaaatgcctgaaggagacgacagaggagatccggcagatgggcactgagtcagtntaccttcatcntgtgatgtgggcaaccgggacgacggtgtaccagacggccaaggctcagnggagaaggtgggtgacatcaccatcctggtgaacaatgccgccgtggtccatgggaagagcctaattggacagtgatgatgatgccctcctcaagtcccaacacatcaacacccttgggccagttctggaccaccaaggccttcctgccg

SEQ ID NO: 646377 - DNA, 845 bp, Homo sapiens
gtcataatcaggcaactcaggtagaactagaccagttaggggagtataacccagctgtctataagaagccaccgaagagcaggggcctcagtgcttgggccaggctgcgggcatctttaacaccgtggttccagtagatacaggcgagtgagctagaagcatgtctctgactcacccagcgcgatatacgcagcagaggcatattagcctcgtactcggagtggttcttttagctcattagctgttacctactcctgtttcccaaagcttatgtaagagcttttccttctaaacttaaactgtgtgtggttcacttaggaagccacgtgccactatcctggctgctgtcttaactcgtcgtcttgggcacaggatacatattgtccccgtcccactgaggacctcagtttgggagtgcccttgagtccccttttccttagcctgcaggtgcttcaagtggatcatggggcaaagcaggacgatgatcgtgtggggctcttcctgctgtcacctcccatcatcccactctctacaccaggactcaaggggtacgttaacaacgaatgagcatacaggagcaatggcctgtcagaatgccaggcatgtagtgttgacacaaggagagcccttcattggatctttccccttgcctgtcttagtcgacagacgacgaccatcaagaaggacgggtgtatgcatcccacaaaggcctccgtgactaagtttgggtcgagacctcacaatttccctgggcacagggtggccctggtgtgggactttagtcactcaacgcgcggtcttacccttcgaaatcagggaaggtagaccacatggagcaacattct

SEQ ID NO: 646378 - DNA, 141 bp, Homo sapiens
gtcttcccaagggtataagatgaataggaacagacagaaaaccaaggaggggctttcaggaaactctccctctccatcgccatcctgcaagctccacagacctcgggctggcagacatgatggcactgtcctcgagtgtgt

SEQ ID NO: 646379 - DNA, 476 bp, Homo sapiens
  misc_feature (146)..(146): n is a, c, g, or t
cggcccgcttcttgggccccagggtttttttaatatgggtgggcttttttaaaaaatttttttgggcccccccggggggccccctttggggggggggggcccccccttttgggttttcccccgccgggggggcccggggggggggnttttttttttttttccaaacccccccccgggtttttttttggaaccccccgggggggtttttttgggggggccccccctttttttcccccccggggggggttttggggccccgggacccccccccccgggggccccccccggggaaatttttttttttaaaaaaaaacccgggggttttttttttttccccccccccccaacccccccccggggggggggggggggggtggggggggaggggggggcccccccgggggggggggtttttttttggggggcccccctccccccccttttaaaaaaaaaccgggttttttttttttttttta

SEQ ID NO: 646380 - DNA, 222 bp, Homo sapiens
ttaaagtatgttgcgcacgtgcttgaattacagtaggagttgtgttttcagtgttaccctgacctgctttaggagatattgtgatttgagaattaagtttaattgtattagccgaaaatacaactttaccattatactgattgaactcgacataatttgggttattatttatcggccatttgccggtggtatttttagtaatagggaatgaattttgtgttt

SEQ ID NO: 646381 - DNA, 318 bp, Homo sapiens
  misc_feature (106)..(106): n is a, c, g, or t
  misc_feature (126)..(126): n is a, c, g, or t
  misc_feature (179)..(179): n is a, c, g, or t
  misc_feature (205)..(205): n is a, c, g, or t
  misc_feature (289)..(289): n is a, c, g, or t
ttgagggaagactataaggcgggataagaaagattactataggagccgggcacaggggctcatgcctgtaattccagcactttgggaggctgaggcaggcagatcncctaaggtcgggagtttganaccagcctgaccaacatggagaaaccccgtttcaactgaaaatacaaaattanccgggcgtgtggcacatgcctgtaancccagctactcaggaggctgaggcaggagaattgcttgaacccgggaggttgcaatgggccaagatcatgccatttcactccancctgggcaacaagagtgaaactccgtctc

SEQ ID NO: 646382 - DNA, 359 bp, Homo sapiens
  misc_feature (73)..(74): n is a, c, g, or t
  misc_feature (94)..(94): n is a, c, g, or t
atgagccggaaggtctgtttgtcatttattgacagcagtttatacacatttgtttccttcccagtgcaggtannttgcctgggagattggcagnctctgaacgagggggccaggaatgtatgtcggacacgtctttggcaggcatgcccagccccagcaggatgcaatccttcaagttggaattccactgggtatctgagagggaccaaggtggggggtagagaggaagtcttcaacaggactcacatttacggccaggcctcctctctcactatacaagtccatccaagttttaaggaccctcgggggcaacagcgaggcccaccctcctcgacagggggcagattcttcactctcgt

SEQ ID NO: 646383 - DNA, 107 bp, Homo sapiens
tctcaatggcagctaaaattgagtcaccagctctacatggtttagcgcagggggtgtgtgtgtgtgtgtagtcgagtatcgtctgtggtgtgttgtgcgctgctggt

SEQ ID NO: 646384 - DNA, 173 bp, Homo sapiens
cgaaattgctctggattaaatgatgaaatcttatggctagcaaagagggcaaaccgtgcattattataaagctcacacgagttctaggcttcaaacctaagcctcccaagaatgagtccttggagacttacccagtgatgcagtataacccacatgtccttcccgttcactgg

SEQ ID NO: 646385 - DNA, 401 bp, Homo sapiens
  misc_feature (125)..(126): n is a, c, g, or t
  misc_feature (130)..(130): n is a, c, g, or t
  misc_feature (247)..(247): n is a, c, g, or t
  misc_feature (259)..(259): n is a, c, g, or t
  misc_feature (284)..(284): n is a, c, g, or t
  misc_feature (377)..(377): n is a, c, g, or t
gagatggagtctttttctgtcacccaggcttgagtgcagtggtgcaatctcggctcactccaacctgggcaagtgagacttcatctagcaggggtggggagtggtccttatagccataattcaannaaanttcaagaaggctatctgaaaggttgttcagtgaaacatttaggatttatcactgttgagcacttttcatcttcaaattcctgacttgtagtcctgtgttgtcctggatgtggccaangtctctcctcangcgggaactgcacgtccttctccangtgacacaaattttaaaggtcttgttaccatgcaaggaaccgcactttccggctgccactgtcctgtgggcgcgctggggtcgccggccggtngagctcgtgcgcgccacggtgcgg

SEQ ID NO: 646386 - DNA, 833 bp, Homo sapiens
gccccaacccggcgccgccataaatggcggcgccgggttgggtaggagagggcggccccagtgcagttgggtgaactaccgtgcacactggagctctggtgtcttgcttggaactgaccatagctcgtggcagggggaacctcggctagcggcccacgagcccctgctgactcaaaacaagtgagtgtcaggaggtcatcgccggttatccttgagtaaagaatggaaactctggaagcccagccgaggacaatgcaaccttcacagagattcgtgcactaatctgagtgaagggtctaaggtgggaatctccccctcatggagagaaagcttgtgtatggcgtgtcatgcttagacagtgattcctgcaactttgaccttcaggctgggagacggtggagagcatgctgtactccttccttgtgctatggaatttgtgacacaaatatcttcccgcctgtgcttgggcatatcctaagaacttacaatttcctgtataatccgtgtgtgagcagctgtcacttatggggggaaaaatgctgaaaatgaggggggcacttccaagtagatagcttctatttcctatattggtctatatataggtatggttttatcaaaatattcccataagcatttagagtacaaaaacaaagaacaaaaaaatgtgtgggggcgtgtggcagaaaagttttaacactttggtggggcgggcacgggtgtaaggaacggggaaaggtgccaaggaactggcagagaggtgtgtttccacaaaaagggggacggcggtgaacacagagggttgggtagggttaagggcagctataagcgggggc

SEQ ID NO: 646387 - DNA, 253 bp, Homo sapiens
tgcactgacaagtacatcgccctggatgagtgggcggtgcttcggctcgaagcgagaaggatatcgacaaggatctggtgatctaaatccactccttccacacgtaccggattctctctttaaccctccccttcgtgtttcccccaagtgtttaaaatagtttggactggtttgtatgttctgccgtggagtagcaaggtggctaaccatacgatttacagtgacatacacttaagcggatgctaacaaatga

SEQ ID NO: 646388 - DNA, 917 bp, Homo sapiens
  misc_feature (52)..(52): n is a, c, g, or t
  misc_feature (76)..(76): n is a, c, g, or t
  misc_feature (82)..(82): n is a, c, g, or t
  misc_feature (131)..(131): n is a, c, g, or t
  misc_feature (135)..(135): n is a, c, g, or t
  misc_feature (160)..(160): n is a, c, g, or t
  misc_feature (188)..(188): n is a, c, g, or t
  misc_feature (191)..(191): n is a, c, g, or t
  misc_feature (198)..(198): n is a, c, g, or t
  misc_feature (245)..(245): n is a, c, g, or t
  misc_feature (283)..(284): n is a, c, g, or t
  misc_feature (296)..(296): n is a, c, g, or t
  misc_feature (299)..(303): n is a, c, g, or t
  misc_feature (307)..(307): n is a, c, g, or t
  misc_feature (346)..(346): n is a, c, g, or t
  misc_feature (432)..(434): n is a, c, g, or t
  misc_feature (462)..(462): n is a, c, g, or t
  misc_feature (558)..(558): n is a, c, g, or t
  misc_feature (662)..(662): n is a, c, g, or t
  misc_feature (770)..(770): n is a, c, g, or t
  misc_feature (910)..(910): n is a, c, g, or t
cccccaccccaacccccacccaggttttgctacagaatctagctagttcacnccctccctccccccaaaaaacacnaattanaacaagacattttgctagtctaaaaacgaccaaggtccaagttataatncaanaatagagtcgcatctaatgcactgncacacaaaaatgtgtatcgtggggccgngtncatctcncgagacgcggagagacgacacgtagcatgtgttgtgtcaggcaaatnagaggcacaccccgcaagggtaagcagccttaggagtnncgctgcccgccntgnnnnnttcngggaaggcggtgtgtgtgagggggtggggcttaggagtngaccccacttgggctgttggaaagagctacccctatagccactcccaggcattttaaattttcttttagaaggagctgcctccatnnncacccccaccgccatagccgcctctgtnaggtccactattactgcgaccgccccagctactgcctccaccgccgccgccgccgccgctcttcatgggcccataggaggactgatgctggctgtngctgccgaagccgccgaagccgttaccgtagtcgctcccaccgtagaacgaaccgccgccgccgcctccgtagcattgtagccgccgcctccgccgccgccgtnaccaccgtagctgttgtcaccgccgccgccgcccttggaaaggccgttctggtctcgaccaccgccgcgcccccggccgcctcggcgccccggggaggatcgggagcngcctccaccccaccggagtagatatcctccttggggactgcttcttcactccacgcgatggccctgaatcggatggacttgaccaccgcggccttgtctgcgcgtcgtgattctggaaaaaacgagccgaatcacgcctntcgccgg

SEQ ID NO: 646389 - DNA, 1506 bp, Homo sapiens
gaaggcattgaggcagccagcgccaggggcttctgcctgagggggccaggcggagcttgcaggcaacaccgcagataagttttctctctcttttgaaagctcagcagcattcacataccaactcactataacacaacacatcagtccaataggttcagtcaagcatcattgcttcagcgttcaagtttctcaacgctaattttcaatcacgcttaagcattttacagcagcacaaatcatcgacagcacttcagcaagagccagcaatgcaggcaaggcacaacagatcaaacaggtttcctaaaacaaatgcacggaggtatgagaatgcaagctatccttccatggcagtcacaacaacatgtcatctctaaaagaaaaattgcagcagcaacaggactaccagcagaccccgcaattcaataacccacatcagcacaggggccacattgtcttttcaggattcacccaatgcacaggtagaattatgaacaccaggctttcacaaggtcttcagcttctcacaagagctctgtcaagggtagcatctcaccaaatcaaactattggcaacgggcgcatcattctctacacacaaccgacgcatttcaacaccggaagggttgaatttcacacacagaaccctttgaaacactaccgcatggaccggcaaggggcacgcacattctgccgctacactccctaaccaggcacttaaagattacacgaccatcataacataaccatcgcatcgaccggcacaaacttgggcaccacgcactctacattggcgccgagctcgggccccccgcctgcaacaacaccaacgctaggggcaagacaaacaatcaggcaaccggtacgggcaacgacggcgcaaccaacttggggcaacagcaaacgagaacagagtcaccgcggagaacggagcgcaccaccacgaacagcatcaccacaccaagacgcagatacacacaccacctcacctctccatgcgctcgacagccaggagaacctcgagacaagcaacataactcacgacaaaacacacacactccacagacctgcagcagcagcgcggacccacccacactgatcgtataccagctagcacaaacgcagttaacactccacaaggtggtatctgcccatcgagacagaacccgtggcgaatacgacctacgagcgagcgaccaaaccaccccgcaacaacagactagagcgagccgggaaatgacaaaccccgcaagcgagcttacagacacacaacacgaagaatgatataaagcgaaacgtcacgctgcgatcacacgacgacaacaaccgcaggaaacacgcaacgacgcgcaggagacagacgaccgtaagcaaagccagggagaagcgacgcaagatcgacacaccgagcagcacaaaggacgacgacaaaaaaaaaaagcgagacaaaacaagacaccaccggcgaccactcccactcgagtgccaccgacgtccagagacacaatta

SEQ ID NO: 646390 - DNA, 155 bp, Homo sapiens
gcatccaagggggttgcagcagcaatcactggtgagctgccagaggtcaaggggtgaaggggttggcactgaagaaatccctgacatcatattggcgctgctgtcgggctagtcggggactgtcgggctagtcggggactgtcgggctagtcggg

SEQ ID NO: 646391 - DNA, 224 bp, Homo sapiens
agaaagtcatccctatgctcatctgagacaaatgcgtacctcattgcttcctctgccctatttatgtaaaagtgcagtttcactgagccagattaaattgtgtattcagtgaaaggctgatgagggattcaaaagatgcaaccttttgcttttacctacttatgacctggacccaccctatcagaccatgacatgttacacatactgatgctctgatctcgtaa

SEQ ID NO: 646392 - DNA, 747 bp, Homo sapiens
  misc_feature (53)..(53): n is a, c, g, or t
  misc_feature (70)..(70): n is a, c, g, or t
  misc_feature (97)..(97): n is a, c, g, or t
  misc_feature (100)..(100): n is a, c, g, or t
  misc_feature (104)..(104): n is a, c, g, or t
  misc_feature (128)..(128): n is a, c, g, or t
  misc_feature (135)..(135): n is a, c, g, or t
  misc_feature (138)..(139): n is a, c, g, or t
  misc_feature (143)..(143): n is a, c, g, or t
  misc_feature (147)..(147): n is a, c, g, or t
  misc_feature (172)..(172): n is a, c, g, or t
  misc_feature (206)..(206): n is a, c, g, or t
  misc_feature (244)..(245): n is a, c, g, or t
  misc_feature (252)..(252): n is a, c, g, or t
  misc_feature (255)..(255): n is a, c, g, or t
  misc_feature (260)..(260): n is a, c, g, or t
  misc_feature (292)..(292): n is a, c, g, or t
  misc_feature (295)..(295): n is a, c, g, or t
  misc_feature (318)..(318): n is a, c, g, or t
  misc_feature (321)..(321): n is a, c, g, or t
  misc_feature (329)..(329): n is a, c, g, or t
  misc_feature (331)..(331): n is a, c, g, or t
  misc_feature (334)..(334): n is a, c, g, or t
  misc_feature (339)..(339): n is a, c, g, or t
  misc_feature (341)..(341): n is a, c, g, or t
  misc_feature (344)..(346): n is a, c, g, or t
  misc_feature (365)..(365): n is a, c, g, or t
  misc_feature (380)..(380): n is a, c, g, or t
  misc_feature (385)..(386): n is a, c, g, or t
  misc_feature (390)..(390): n is a, c, g, or t
  misc_feature (411)..(411): n is a, c, g, or t
  misc_feature (414)..(414): n is a, c, g, or t
  misc_feature (420)..(420): n is a, c, g, or t
  misc_feature (422)..(423): n is a, c, g, or t
  misc_feature (467)..(467): n is a, c, g, or t
  misc_feature (472)..(472): n is a, c, g, or t
  misc_feature (529)..(529): n is a, c, g, or t
ggtttttgttggggtttgttcttgttctttttttggttggtttgcgcctttcntccccgtccttggtctntggcctgtccatgtgtgtgggtgtgtntgntccngttctcctggtggccactgccttnttcctcntcnntgtncttngctttggtgttcactattccaggtngcccgggtttagactctatcattttcctcgctgntggcggcgagatgactgcttctgttgtgtgctgctggnnttctttngcncaaantgcttcatagtttaaacggccatatacttttnaantactttgaaaaatattttttttngtntgtttacnangtngtttncnaannngcttcgctacgggggttgnttcttttttccgggngcganngtgngggattttacttgggggggtntangtttangnnaccacttttttttttcttattgctgggtgggggggcttgggctnctaanttctggttttctgtttttttttcaaaaagaacttgtttttgctggcggagttttttncccctttctcaggcttcttttttcggttcttgatgggtttggacggctgttcctctttccaatttctgtttaatttcagctgtgtatttcccattggttctttcggctttcttgttggttttggcattcctttcattattgtggtcgatatctgcatcatcattataaggacgtctccggctatatttgtctcgtttttcaatctgtttttccagatc

SEQ ID NO: 646393 - DNA, 875 bp, Homo sapiens
gactttagccattatccaagcgaagacattgaacattactctcttccgtggggaaaatgggcaatatagattgcagattttgaaaatattactagaaatcaagatcttaccaccatcgctttgcagaaagttaaacggccatcagagacatgcaatgcaccacttgccaacgtcattctaagacaagttcgggtcaagcgtgggaaacctggagctctacgtcgagcaggagtcagttccttccacgtggtatttactgattgtgctccctgtcttgctagtgataagtcatttatgcggccgtgggggtgaccaggcacaaatcgaaggagctgagtcgcaaacagagtcaacaactagaattgctggaaagcgagctccggaacagagatacgtgacggcttggctgagctgcagatggatacaattggatgtggttgatacgttatcggcactgtaccctatccatatgactacaaacataagctctgagaacttcattccctgagtcaggtggctatcacaccagatcttcactgcagcatatgcataacagagacgcaacgacaagactgacagtctcacagacttaggatgccctaatctgtactaaaagcttaccaggagactggcatccaacccttgaaaagacagaagaacaacgctgtgaaggacaggtgactggaagacaacagcataaacaatggccagaagaccaacacggcaaaacagagaaacatccaacggaagaacaaggacagacgcacacaagaaaaacaagcaaagaaagaagcaaaagaagagccacaagaaaaacaaaagaaaggaaacacagaacagaaacgagaaagaaaacacaaagagaacaacgaaag

SEQ ID NO: 646394 - DNA, 1320 bp, Homo sapiens
  misc_feature (136)..(136): n is a, c, g, or t
  misc_feature (208)..(208): n is a, c, g, or t
  misc_feature (311)..(311): n is a, c, g, or t
  misc_feature (381)..(381): n is a, c, g, or t
  misc_feature (875)..(875): n is a, c, g, or t
taaaaacggggaatacttttttcaaaacccttcccaaaattggccactttttggttcttgtaacaaagctattctatggtttaaaacgctataggtcaagtatcttggttattatgagacgctataccactggctnactatacaatattaactggatcagcaccacaatctttctcaattgtttaaacacaaaataacgctcccctgntaaaacgcagccaccctttgtgtgtacacgtttataacactttataggttaatctccctctctcgcttctcttctcctctcacaccctctctctctcttctanaacagaaaaactctccaaccacgcaaaaccctctcctctcaaaataaactcccttctctctcaagagggnccagacccgagtgtcgtccttctcacacggtgcaccctctctgtgaaaaaaactctctccaccctctttctctctctcacatctccgctctctcgccacaaacgcgtattcccgcagcgtgtatgaaaccccacagagggggccacgcgtttgtgtgcggaccatactacacacttcttcagctggtctcaacacacctgttgtggtgtggtgtcctcaacagcagagtgcagaatgcccacagagggctctcttcagccacagtagtggtggtgttgtgtgcgtgtgtattgtcgctctccccaagcctcgtgttgttcgccaccacacaagaagactcttctcttctgttgtgtccacccctgttgtgtgcgccccgagttgtcttctctccctccaagccagagaggcccaccacccacagagtgtgggagaagagcgctcgtgtgttccactgttgtggtagtggcccccacactctttggtgatatagngcgccccgctgtgtgggcgggacacacacaatatctcacacacaacaaacccttgtgcgtactgtgtggtctcccccgactttgtggggcctcctctgtgaagcgtcgggcgtggggcacaactgtggtggcacgcacatgttttggcgccctcttcttttgttgtgggaggaaaccccacaaccgtgttgtccacaccccccggcgcgtgtttcacaaaccagctgtggccccagctccctagcagcccccccgctggttttttttttcgtccccccctgttgtgcgcgagaggggggtctccccccctttttttctcccaccccacatcctctgggtgctggtgggcgccttgcggcttctctccaaacgaggcgctcacggccccttttggggggcggggcaaactccctgcgtgggtctcaaccggtgaaacaagagcgtt

SEQ ID NO: 646395 - DNA, 170 bp, Homo sapiens
ggggttttttcccctttggggcccaaaaagtttttattttaaggggcataaggtgggccccccctgggttttgggagggcctttggggttggttttaaaggttgcccccacgggttaaattttgggggtttttcctaagggatttattaaaaaggttattggtcctttta

SEQ ID NO: 646396 - DNA, 818 bp, Homo sapiens
ccttgattagcgggcgttttatgcccccccgttttgttggtcccctcgcggaaataatgggtccccctcttggtgtggtactccccctggggcgcgctattttcacccgcctgctgtgcgtgctgggcacacagggtccttatgtgctgccttgtggagatatctgtttgtactgcccgccaccttccccgtcggtggggggcccccccctgtttgttcccccaccccccctggtggtttttccgcggcgccccatctgtttttttatgatgtcccccccggggtgtatatcctcccactatattattttttgcgcgcggtcgccgagccgccgcaacttgcgggcggcgccttcccgtctgcgctcggtattgatactcactctttctctcagaggggacgcccgcaacgcctgattcccccccccacaagatagtcgtgtttgtaggggacttttttcccaccacctcgctctataacacccctcgccgtcatccccccccttttactcactctggggagacaatttttgtgttgattgcaccacacgattttgttcttgtctccaataatcatcatttttcttatttaatcgaggagctgctaccaatatgtttgccgccgcccaattacacctcttccttcaaaatttttcccaccaaacaacaacagtgggggctcccctcactccaccccccccgctgcacacacaacattaacacccccctctctcccccgcacccccccttttttaccacccccccccccttttttcccttccccccccccccccccccctcccgggtttttttttttta

SEQ ID NO: 646397 - DNA, 965 bp, Homo sapiens
  misc_feature (156)..(156): n is a, c, g, or t
  misc_feature (159)..(159): n is a, c, g, or t
  misc_feature (163)..(163): n is a, c, g, or t
  misc_feature (210)..(210): n is a, c, g, or t
ggttttattgagggggggggagggggaaaaaaaaaaaaaaaaaccttatacattaaccagtgaccccttgttgggtgcctactactgaggaggaatacttgcactttggggagaaggctgactctgagagggagaggggcggagagtacatgaacncantacnaaagcggaaggggctttatgtggaagaaaagattgtggagcatgcanaaaagcagaggacactcagcaaaaataaggaactacctactactgggggggattcttttccttatagggaatttaaaattatggggcgaggggttaaaatttgggaaatttctttttaccacattatctgtgtttattcactttgaataaaggggggtccttgtgagtgtttgtagaaggaggggagtgaggagtagaggtggggtgagcaggtgagggagtataggtggggacgttttgtgtgagaaggggaggggaagcgactggttaggggtgtggattgtgtgatgtgggggaggttggggtgcgtgagggggagaggctgctggcacgaaggcgggttggggaggagggatggtgagtaggtgcatggacaagcaccgggcgcgtcaatgggagaggggggtgggggagtgtgggtgtgtaataggggtgaggggtgattcggcgtagtggcgcgagagtggagggtagcgtggagggaagggaagggagcgcctgggggcagggcgtgagcggggatgcgagcggggtggagagcggtgagaggggaggcgagaaggggcggggacgggcgcgagtggaatgtgggtgtgaaggggtgggagaggcgagcggtggtgagcgtggtgtgggtgcagaggagggtgagtggagggggacagcggagggggaggagagatggcgcaaggagggagcggcatggcgaacgtgaggactgagtgatgctgtgcggagtgcgcgaggcggaggat

SEQ ID NO: 646398 - DNA, 171 bp, Homo sapiens
cccaggtgatcagtgtcccaggtgatcagagtcccaggtgatccagtgtccaggtgatccagtgtcccaggtgatccagtgtccccaggtgatccagtgtccccaggtgaaccagtgtccccaggtgatccagtgtccccaggtgatccagtgtccccaggtgatccagtg

SEQ ID NO: 646399 - DNA, 347 bp, Homo sapiens
  misc_feature (249)..(249): n is a, c, g, or t
gtggagcttgcagtgagtggagatcacgccactgcactccagcctgggcaacacagcaagactctgtctcaaaaaaaaaaaaaatttatgaaaaaaaaaaaaatatgctttcatgtgatgtagttctcttttagtaattaacctttaaaaattatatttcatttaatctaaatcaccattcatttaaaaatgtaccattattttatacattacagtatttaacattattttatatgttatgtatatatnttaggagacaaatgaacatttgtctgtatctgaatcaactgtaccacccaaaaagtgtgtgccacactgcattggcctgggacataaaactggaagct

SEQ ID NO: 646400 - DNA, 292 bp, Homo sapiens
  misc_feature (5)..(5): n is a, c, g, or t
  misc_feature (12)..(12): n is a, c, g, or t
gattnctagaancccaggagttcgagaccagccctgggtaacatagctagaccacatctcttaaaataaaatagttaatttagcccaggcatgatgatatatgcctatagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctacttcttcagtgctgttttttatttaa

SEQ ID NO: 646401 - DNA, 218 bp, Homo sapiens
taaaattgcatcttattgaaaagaatttttcaaaaatgtttcttgtacacaatgaatggaatatgcaccagtagctgccctgtagtgacaccagtgtagtggcctgattccacaactggtgacctggctgactatctggggatccgtactacgagtctgaccttgcagtgcgatgcaatgcttagtgcactggcctgtcagtttatacaaactgtctg

SEQ ID NO: 646402 - DNA, 223 bp, Homo sapiens
  misc_feature (67)..(67): n is a, c, g, or t
cgcgatggcacgcgggtacgtgaaagcttgggagtcctcctaagaagcgggcccgccctactactantctaatacgggctgcggaagaaagacgacacgaaagggagaaagaggggatggtgaaaaggagacccacatcttagaaataagaagggtcttctatgataaggagtccaggagttctccctgagaattcttgattaaaaactacccacgcccacga

SEQ ID NO: 646403 - DNA, 184 bp, Homo sapiens
  misc_feature (138)..(138): n is a, c, g, or t
tcccgggcgggcttgatgacttttaatctgtatgaagaatggacacaagtgcaagtgtgcaggatcaagacaaaaaacttcaagactgtggagaacatgtcagaagtgccacacaaaatttgttaactttagttattngatcaagttccttgcaaagcttgctcagaccagcacgaactccctt

SEQ ID NO: 646404 - DNA, 490 bp, Homo sapiens
gggccaacatggcgaattcccgttctctactaaaaatacaaaaaatgtgtggggtgtggtggcaggagcctgtaatcctagctactcaggaggctgaggcaggagaatcgcttgagcccaggaggcggagattgcagtgagccgagatcgtgtcactgcactccagcctgggtgacaagaggtgagactccgtctccaaaaaaaaaaaaaaagaattttatttaacctgtggtgggcttaattaaattgggtggtggttcccttggcccggcgttggttggcttcacgcctgtgtaatcccagcacttttggggaggccgaggcggggcagatcacgaggtcaggagatcggagaccatcctgggctaacacgggtgaaacccccgtcttctactaaaaatacaaaaaattagccaaggcgtggtgggcggggcaccttgtagttccagctactgggggaggcttgaggcaggacgaatgggcgtgaacc

SEQ ID NO: 646405 - DNA, 861 bp, Homo sapiens
  misc_feature (1)..(1): n is a, c, g, or t
  misc_feature (128)..(128): n is a, c, g, or t
  misc_feature (154)..(154): n is a, c, g, or t
  misc_feature (178)..(178): n is a, c, g, or t
  misc_feature (186)..(186): n is a, c, g, or t
  misc_feature (202)..(202): n is a, c, g, or t
  misc_feature (239)..(239): n is a, c, g, or t
  misc_feature (293)..(293): n is a, c, g, or t
  misc_feature (372)..(372): n is a, c, g, or t
  misc_feature (567)..(567): n is a, c, g, or t
  misc_feature (749)..(749): n is a, c, g, or t
  misc_feature (751)..(751): n is a, c, g, or t
  misc_feature (772)..(772): n is a, c, g, or t
  misc_feature (787)..(787): n is a, c, g, or t
  misc_feature (818)..(818): n is a, c, g, or t
  misc_feature (830)..(830): n is a, c, g, or t
  misc_feature (856)..(856): n is a, c, g, or t
naggtcagatgggctaagcctagctgtttggggtgctgtggtggtggtagattggctaaacaaactgttgctgctgctgctgcttcttggtggccgccttgctggcgaggcccttggccttctctgtngctgcaagtcccgtttcctttgcctnctccttggcttccttggctgtttnaacaagtnttttggaaggggcctngccttgcagcttagccaagaaaaattcaaaacccttnaaagttttggtcacgttgcttttgaaccgggcaagaacaaatccctggacagcnctggagaaaccaaaaaagcaagaggagacccaggcttcccggcggatttcagtccagcaacttttgtaagatttcacanagtaaacacatcgttcctccaccaccatcagcagggcgtggttaaggttccaggtgaaggtagtaatggtctgattttgtgggtccacaaaagagtcctccaggacgtacaccgagtaagcaacattggcaggaaaaagtggctcggcccagcgtggcaccctgttggtcttggtcaggagtggccgggacagcngtttctggtcaggggtaacctcccggtgtactatgttttccgtaaagacaagtttgctatagggattcgggttccgctgcaagaaggcggcgaacacttggtcccaggaactccggagcacgctctggcccaggaaatactttaccatcgtcccggccgaagcgggctcagcacccgcgcananacagagggtgcggagctgtgnaggtacgcgaggtcngggccgggccggggctcggcgcacacccgcngccaggtctgtngcttagttaccaccgcaccgcgcccnagccg

SEQ ID NO: 646406 - DNA, 398 bp, Homo sapiens
atccctgattttttagaaggggcagcaattgctttttagggcctgaaagacatagtgagccagtgctgactgaaaccctgactaatgacttagggccagtaagtgcttgggtttcccctcaaagatttgtcaaatgaggtagagaactgcaaaaaagcagcccctgctattttcaggattggcctgcccatttggggttaaatggtttccaatttgggggtttgggcaaatgcccccttgagactgtttgactcccctgggttctttgaggagctgtttaatccccaaagggaaatagttttcaaaaaagaaagggaacttgaaattttttaatctttaagggttgatgtggtttgcctcccctgccctctccctgaaataaagaacagcttggcaga

SEQ ID NO: 646407 - DNA, 815 bp, Homo sapiens
ggtggtctgtaggtgagctcgcacgacatgagtgagatgccaggtcgccccatgacctgggtgcgcgctccctgggctcagtgactgtcctcggagctgcctggctcatggcccaacccctttcccggatccccccatctgctctctgaagttggcgcactagagctgccatttgtcatccagccccttggaatacccaagttcttgcatcaagggcctggacgtaaaggacaacagggcagcaaacattgagaaggcagttcctcatggagagatgagacgggatcctagccgttcatagtggggtgcattattgaggtgatccgtccccaacgacgattgacatgtgggaggcagaaactggtccagaagccctgaaatggaactcggagctgagcggactccgcagcaggagcttgggaagggcccatggatcccaactgggccccagcaagagccaccaggaacagtcattcctctcccgcaagcactcccatcccaggaggcccctgggccctccagatgccttcccccgtggaataagcggtgtgtcctgagaaaatcaacagaaagcagaaattaaagaagaaaggccgagagggatattaaattttcggtggccgaataaaccagacgtctaagcagacctcggcacattgaggtaatacgcgagtcccgagagcaggtgattcttgcgacacgtgatacgcattggccggtaccacatatagtgtatcgttgtaattcccagaaacacagtttcaccgtgttatggagacggaaggtcttacggcggaccgcgagcgataccgggg

SEQ ID NO: 646408 - DNA, 446 bp, Homo sapiens
  misc_feature (281)..(281): n is a, c, g, or t
  misc_feature (295)..(295): n is a, c, g, or t
  misc_feature (410)..(410): n is a, c, g, or t
cagcctgggcaatgtaacaatacctcatctctaccaaaaaaaaaaaagaaagaaagaaagaaagaaaaaaaacccagggcatggtgatgtgtacctgtggtctcagccactcaggaggctgagaggggagaatcacttgagcccaagagctcaaggttgcagtgagctatgatcgcaccactgcactccagcctgggccacaaagcaaagccctgtctctaaaaaacaaacaaacaaacctccaaaacttctttcccttccttggtctgccctaggccctnctgagtatagatancctctcttaggaggcagctgggcaaggcggttcaggagcccaaatggggaaaaagatttaactgggagaccacgtagggggttgagttcctctttacacacagggccatttattnacacaggacaaaatttagtttattggggcaggggag

SEQ ID NO: 646409 - DNA, 482 bp, Homo sapiens
  misc_feature (23)..(23): n is a, c, g, or t
  misc_feature (50)..(50): n is a, c, g, or t
  misc_feature (66)..(66): n is a, c, g, or t
  misc_feature (93)..(93): n is a, c, g, or t
  misc_feature (181)..(181): n is a, c, g, or t
  misc_feature (219)..(219): n is a, c, g, or t
  misc_feature (223)..(223): n is a, c, g, or t
ggcatcttttccaaatagatgtnggttgaccccagaataaatggttaacntcctagaaagcaaaancgataccctgaaatgattcaaactganctttaaaaaaaattttttgaaataggaatgagtgtaaactcctagacagtatttctagttgcatatatgagtattttcccctgggtanagcaccctttgggaatgagtgggccaatcaaaaaatgnccanaggccgggcacagtggctcatgcctataatcccagcattttgggaggccagagcaggtggattgcttgagctcaggagttcaggaccagcctgggcaaaatggcaaaaccccatctctactaaaaatacaaaaattagccatgcatggtggtgtgcacctgtaatcccagatacttgggaggctgagacacaagaatcacttgaacccatgtggtggaggttgcagtgagccaaagatcatgccaccgcactccaagcc

SEQ ID NO: 646410 - DNA, 121 bp, Homo sapiens
gcatgtcagttggcatgcggagaaacatgataaacaagcatggccttacgtctatgagaaacattaagtcaggcatggtggctcacacctgtaatctcagcagtttaggaggccgaggtgg

SEQ ID NO: 646411 - DNA, 215 bp, Homo sapiens
cggttgggaatgtgcttggagcggtgacgctgcgggcatcggactggtctaccagctcaggaagatagaatttgaaagagggatagcgtgaaggggaatcaaggaggaggtgtgatatggtcgaaggtgcctggtttagtgctgtaatggtgttattattgctactgctatatactatagttttctgcgaggtaaacacttttacagtagagaag

SEQ ID NO: 646412 - DNA, 323 bp, Homo sapiens
tataactcgcatcagggagtatcaatcaccggagctcaccatagtctattaagaaaacaaccggaaaccaaataattcaagcacggtttattacaatttcagggggtctctatttacccctcctacaagcctcagagtacttcgagtctcccttcaccatttcggagggcatctagggctcaacatttttgggtagccacgggcttccagggacttcaggtcataaggggctcaattttcctcactatcggcttcatcggccaactaatatttccttttacttccaaacatcacttgggcttcgaagccgccgccggatacgg

SEQ ID NO: 646413 - DNA, 81 bp, Homo sapiens
ccatctcaaaccttttctctgcctgggaaattattttatgtttgtttttgaaataaaggatttagtttaagattctaaaaa

SEQ ID NO: 646414 - DNA, 369 bp, Homo sapiens
tgtatagttgaactagacacatgtaaatattataacatgagcagacatattagaggcacgtagcaattgaggctcaagacctctgctataccttcgagctatccaaacccagaggtgctacttcctgcaaagtggcagaatccaccgaatctacccataacatgcttttgatttttgtactcaaggacatctagggctagaaattgctaaagtacgcataataacatggcttagtatagaaaccaggagctgcagcccaagatctcggcagtaccatgtataggttatatgactctgagttctctctttttattagagatggagcctcgctctgtcgcccaggctggagtgcagtggcttgatctcagt

SEQ ID NO: 646415 - DNA, 157 bp, Homo sapiens
atgattgctcacgctcccaacactgtattcctcatgctgcacatgcctagtgctgagccaggatgcccgcacaccggtacagtcgtggccacctacacactccataggagatcctatttattacctcagaagtttttttcttcggagcggtggagca

SEQ ID NO: 646416 - DNA, 110 bp, Homo sapiens
catctcccactcactcactccactctgtccactccatcccccgtcactcactccactctgtccactccatcccgtcgacgcggccgcgaatttagtagtagtagtagacc

SEQ ID NO: 646417 - DNA, 590 bp, Homo sapiens
  misc_feature (103)..(103): n is a, c, g, or t
  misc_feature (435)..(435): n is a, c, g, or t
tctacacacacacgcacacatgtgtatacacacgcggggcacacgcacatctccactatctcgcgatatcgacagcagcggatatcgtctcgcacgaggcgcncacacacgtcgcacgagagcaccacagcggcgcctcgtgtctatatctctctacagcgcgcccgcagagagagatgctgcgtctgtgcacacagggctcgtgcccacgagagagtgtgtgtgtgtgctacagggcgctctagatatcgtgtcgcactagtgtcgctgtgcgcacaccagacgctgtgtcgcctttctcacacaccacgagacaccacacgtgcgagcacagagcctctgtgatcacgcgcgcctgtgcgctctctttgtagacacagagtgtgaatatcacacagcgtgtagagagcctatagggggccctttcgtgtctcncctgtgatatacgctgcgctcgtgtctctacacgagacgcgggagagcccctttcagagggcacgagaagacgcatcactcttctcacgatgtcactcatctgcagcatcgtcgctgtcgtggccgattattcgctacgaagcgccgggagtgat

SEQ ID NO: 646418 - DNA, 111 bp, Homo sapiens
  misc_feature (2)..(2): n is a, c, g, or t
  misc_feature (14)..(15): n is a, c, g, or t
  misc_feature (17)..(17): n is a, c, g, or t
  misc_feature (20)..(21): n is a, c, g, or t
  misc_feature (47)..(47): n is a, c, g, or t
gnaatccaagattnngnttnnaataacactgctgtagaacagtttancagctcttcagcatatgtccattttccttgaaggatgagcctttagaaacctctgacaataaag

SEQ ID NO: 646419 - DNA, 519 bp, Homo sapiens
  misc_feature (20)..(21): n is a, c, g, or t
agctcgcaccctcaatgganncttttaaagctcattatcaaaaagcactatcatagccagatgcggtggctcatgcctgtaatcccagcactttgggaggccaaggtgggcagatcccttgaggtcaggagttcgcgatcagcctggccaacatggtgaaaccccgtctctactgaaaatacaaaacttagctgggcgtagtggtgggtgcctgtagtcccagctactcaggaggctgaggcaggagaatggcttgaacctgggaggcggaggttgcagtgagccaagatcactccattgcactccagcctgggtgacaagagcgaaactccgtctcaaaaacaacaacaacaaaaaatgtatgcaatcttttcactgaagatttctctcctcatttcttgtatcattttttgaattttttaaaagttggacttcacccttctctggtgcctccttgattagcttaataatcacccttctgaattattttcaggtaaatcagggatttcttcttggttt

SEQ ID NO: 646420 - DNA, 253 bp, Homo sapiens
ttagttgtactgaacactagttcatactcgctgtcataaacgacctgtgtgtgatatttgttcccaaaaaacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 646421 - DNA, 1000 bp, Homo sapiens
actctgtattacgtccgtgttgccgggaagaaggaggactattacccggtagtcgttaagagctacatcgcaacaattcgcattgtagaccaatagcttggccgaccaagtagcccaagcaatcaccatgatgcttgagcacggaaggcagggaggggttcgtggtgaaggtcaggggcctacgcctggtcctgttcacccgagtcgagagtgactcgcgcttctttcttctcgattgcaaagatccgatttgatggccacgatcgaggtcattcgttctctagtcgtacgacccagagaacggccagaaccaagtggtgaatgcgatttgcttgaatgtatgaatcgtgaagcgaggaagtgaagattgggctcttgaagaaagggacaggagtcaaacctatgggacacagatacggtagagagtattcaatgtcgtaaccagtagtcgaaaatggcgattgggtgtgtggaagacattccaggtccgaataacgtcctagcatcactggtccaactgattggcttctgtcgcggcttcatagcgactcccaatgttcggctgtaagcaaacggaagcatgattagtgtccagtgtacttattcaagggtatggataattgtgcccagacattgggattgacaactagtcgagatgtgacgtttcaggggaggcgaagccaagagggtgaagccatcttgtgcacgtttgcttcacaggagatatgctgataaggccttatcagaaagctacaggtacccgaataggggcagcggtaccttgcagactcttccatgagtagtccgagcctggagttcgaacgaagtaattattaccccttggaaaaggttcatggataagaaacgggcaagttccctatgaaaaggcgggggactggtcaagggtctatggacacttggccacgggctgggtttgcaacaattcagggtaagcgatagagcgggattgagcgcaacaacccgggggcataagtgccat

SEQ ID NO: 646422 - DNA, 398 bp, Homo sapiens
taaattcgcggccgctcgaccatttaaaaaccttttattttacaccagctgcagtggctcacatctgtaatcccagtgctttgggaggctgaggtaggcagatcacctgaggttgggagttcaagaccagcctggccaacatggtgaaaccctgtctctaccaaaaatacaagaattagccagatgtgatggctcatgcctgtaatcccagctactctggaggctgaggcacaagatttgtgtgaacttgggaggtgcaggttgcagtgagccaagatcgtgccacagcacaccagcctggcacagagtgagactctgtttcgaacaaaaagaaaagtctgggcaaggtggctcatgcctgtaatcccagcactttgggaggctgaggtgagtggatc

SEQ ID NO: 646423 - DNA, 774 bp, Homo sapiens
gagctgagactgttaggagttgactctgatataccatatctcaaaagctgcacaggaggaaagcactgacaaagaaagaagtggtcattctttgcacgaaactggatggcttctacaggggagccaggcctctgatatagacgagatttttggattcttacaacgatggcgaacctcccaccaaaaagacccaggaagctgcttccaagcttaaaaactaagaagcctcgagaactagtgctagtgattggaacaggcattagtgctagcagtacgaagccccaagttccagccctcaaatcctggaaggggttaatatcaggccttacatggatgctgccattgattttgatcttaatagaagatgaggagagcaaaaagtttcagaaatgtctccatgaagacaagaacctggtccatgttgcccatgacacttatccagaaactctactcctcgtaccagtaatgttcgatccacattctcaaggactgttatatgaagtatatgatgacttggagtcacacgatggaagattctggaaaacagctaatatcagatcagttctcccacctgatggcaaaatggagccctacgtaataaaatacaaattttgctaagtctcttgggaactgtatgcagcagatcaggggaaacagcttgaatcccttgaacttactgatgaaaaccaggtctcgatggctcagaacagcgtcagcggccgtgtagatatacaggagattaacaagctacggcaagcttaaacggcggcaaac

SEQ ID NO: 646424 - DNA, 351 bp, Homo sapiens
  misc_feature (20)..(20): n is a, c, g, or t
gagagtctcactgtgtcacncaggatggagtgtagtggcaccatctcggttcactgcagcttccacctcctgggttcaatcagttatcctgcctcagtctcccaaggagctgaggattacaggcgcgtgcctaatcctggctaatttttgtagttttagtagagatgaggtttcgccacgttagccagcctggtctcgctcgaactcccaacctcaggtaatccacctgcctcggcctcccaaagtgctgggattagaggcatgagccaccatgcctggcaccaggtctcttttcattgtatactagaaaatgttgtttggacagaaccctccgagatgatagagtcaccg

SEQ ID NO: 646425 - DNA, 178 bp, Homo sapiens
tacgatgtagttcatccattgtggaaaacagtgtggtaattcttgaaagacctagaactttcattttcttatattgggttttttttgttgttgttgttgttttgagacaaggtttcactctgttgcctaggctggaatgcagatcacgggtcactgcagtctcgacttccagtgctca

SEQ ID NO: 646426 - DNA, 91 bp, Homo sapiens
gttcctgtttgggggttgtgagggaaaatcagcgcggattttaaaaagatggctgtgcctgcccggcgtggtgggaggggagctggtttcc

SEQ ID NO: 646427 - DNA, 254 bp, Homo sapiens
gtggagccgggtgagggcgccgagaggctcggtgggcgcgggcggcgagatatgccacacttctgcctgctgatggcaaccctcctggactaggctgctcttgataatcacatggatgttgctgattactctgagtgctaaccttttcactgttccagagaggcgcctgtcatcctcattctccttctcatgatttatgagttcggtccgaccagctcacttggtcagcttgctgctcctctgactcgctctcg

SEQ ID NO: 646428 - DNA, 159 bp, Homo sapiens
tggccgctcggcgccgccgccacctcgttagcagcttccgcgacttgggagctagaggcgagcagctatgttctgcaaggccaccctcgatcacgcccatggggagtccgtcgttctcgcggggaaagaacttcgaggtgtggtctacacacgcaccag

SEQ ID NO: 646429 - DNA, 1227 bp, Homo sapiens
caggcctcctggcagcacctgcgcagtgaacaggctggctgaggtgcacgggagcccgcccgcctctctctgcccgtgtcagtccgtgaaattccggccggggctccctgagatggccctcctgacagctttggacgacaccctccccgaggaagcccagggaccgggaaggcgaatgatactcctttcgaccccgagtcaaagtgatgccctgcgagcctgctttgagcggaacctgtacccgggcattgccaccaaagaagagctggcccagggcatcgacattccggagcccagggtccagatttggtttcagaatgagagatcatgccagttgaggcagcaccggcggcaatctcggccctggcccgggagacgtgacccgcaaaaaggcagacgaaagcggactgccatcaccggatcccaaaccgccctgctcctccgagcctttgagaaggatcgctttccaggcattgctgccagggaagagctggccagagagacgggcctcccggagtccaggattcagatctggtttcagaatcgaagagccaggcaccggggacagtctggcagggcgcccacgcaggcaagcatccggtgcaatgcagccccaattgggtgacaccctgctctctcgtgggtcgcctttgcccacactggcgcatggggaaaggggcttcctgcaccacacatgctctcccacagtgggctttcgtgagccatggattgagggccgtccctgtgctcctgcccagccaggccgcgcaggcagaagggatctcccaacctgccccagcacatggggattttgcctacaccgcccaggctcctccagaaggggcgctctcccacactcacactcctaggtggcatccacacaagggcaaaatccggaaggactgggacgcgcagcgcgacggccttccgggcacttgcgcggtgggacagcctgggccctctcaagcggggccacagggccaaggtgtgcttgcgccacccgcgtcccagggaagtccgtggtgggggtggagcaggggtacccaggtcgccggtgtggcgtggaacctcaagcaggggcaattccacctcaccagcccacgcccccagaggcctccacacggcaggggcagatgcaaggcatctcagcaccctcccaggcgctcctggagccagggtgctcgtctgcactccactccatcctgctgctggatgagctcctggcga

SEQ ID NO: 646430 - DNA, 233 bp, Homo sapiens
catttgtacttagtagagatgggttgccatgtgcaggctactcttgaactcctgagctcaggcgatccacccgcttcagcctcccaaagtgctgggattacaggcgtgatccactgcacctggcctcaggtatgttttctatctacacacaaaaagtttattttccttcctcttatctgatatcagaagaatgacaggaatgaatacttctggtccctttgcgatataggttt

SEQ ID NO: 646431 - DNA, 431 bp, Homo sapiens
tgaaacagagtctcactctgttgcccaggcgggagtgcaagggcgcgatctcagctcactgcaaccttcaccttcggggttcaagcgatcctcctgcctcagcctcctgagtagctggaataacaggcatccatcaccatgcccggctaattttggtattttaagtagagacggggtttcaccatgtgggccgggcgggtctcaaactcctgacctcaggtgatccactcacctcggcctcccaaagtgctaggattacgggcgtgagccaccatgcccagcctagaattgtttcactaattagtaatgtagtcttctaaagggaactattactttgtcatatggtgtttccagacagtattttttcagttaaagccaagggaataacttcaggatcctctgcctggggacccctctcgttcagctgaaaa

SEQ ID NO: 646432 - DNA, 247 bp, Homo sapiens
tccttaccaggtgtggccaaagtcagatattcttcttttgcagggattgttaccccttcctgccttcttcatgctgttatttgttattcttgatacattgatgttatgtgttgtggcgactgtccctgatagttctcattttcccagaaaccctgttactgatataactgtgcagccttggtgaccttaaatgttcacgcattggcactaatttctgcatgggtcatggtgcccaacggagctgtca

SEQ ID NO: 646433 - DNA, 1472 bp, Homo sapiens
  misc_feature (1326)..(1326): n is a, c, g, or t
gggttcgtctgtggtgtgtgtggttgtttgtggtggtgtgtttgggtgcggtggggtggtgtcgctacctttaatcagagtggtcggcgaggcgagcgaggaggacgagagcaggcgggcgagcgagcggagggaccgccggcagcaagaaaaaaacattgtcagactctctctatatactggctggttgagtcgatggaggtgtcgtgcttgctctgtcgcgtgttgaggtgatgaccagccccccgcctgtcctttgttgtttgtagtagtaagcgctgtcgtttttgtgtgttgtctcacccccttctttctgctcgctcgcccggtagaagtgattattgctgctcgtccgccgggcccgcgcccctcatagtgtgtgtgtccaagaaagtgtcctgcggtgcgcccccgaagagtttgtcgcccacgaaagtgcgggggcgcgcgcaaaaaaaaagactaccgagggtgtgggtgcgtccagacccacacggagtggtgtgtcttgcgcgcccccttctctttttgtgttggcggccccacaaaaaatatatgtggtgatgataaacaaaaggccggtccccgccacaaaatataatatgtgggggataaaatatagggggagagaagcttgtctgccacctctgtgggaaagactctcgtgttttaagtaagggtagctgctcggtgggtaccccccccaaagggggggaccctgggggagcacacacagtttgcgtaacacgtcgggtggtcgttataacacgacgggttggttcccacaaaggagacgcctgtttttgtgtgtgaagacaactgttggtgtggcccgcctctccctctggatggtgttccctctagagaaatggtgagaaatacttctgcgtgatggaaatagagatgtcgctagaaatgtcatactccccgtcgtttggcgacacagagtttggcggaaaagttgggggcacccgccctttgtttaaccctggaggcgcgatatatatttctcccacagagagcacctggttatataaattttttatctcttggggagtaacctacttttgtgaaaagatgtgatgagatgagatgagcttatatgagatgagaagaaaggttgttaaaaaccccggcgatgtaaggagaaggggcggaaaaaaaaaagtgagaaaatgtgaggaaaatatgagatcccacagcctattgtgcgcccacacgaaagggagagccacaaccccccccacagagggggcgcacagcacccacacgtgtgaaccaccggagaggggtcgaacaccttctctgcgctctctcccgctgganaaagagataggaatttaacacaccacctttttccacacagcctctctttttcacacaatatatattgtttgtgtttttttgtgcctgtgtttttgtgtttttggccacccttaaaatataaaaatttccaacttccccacaaaaaa

SEQ ID NO: 646434 - DNA, 544 bp, Homo sapiens
  misc_feature (27)..(27): n is a, c, g, or t
  misc_feature (110)..(110): n is a, c, g, or t
  misc_feature (118)..(118): n is a, c, g, or t
  misc_feature (120)..(120): n is a, c, g, or t
  misc_feature (134)..(134): n is a, c, g, or t
  misc_feature (137)..(137): n is a, c, g, or t
  misc_feature (140)..(140): n is a, c, g, or t
  misc_feature (145)..(145): n is a, c, g, or t
  misc_feature (149)..(150): n is a, c, g, or t
  misc_feature (171)..(171): n is a, c, g, or t
  misc_feature (174)..(174): n is a, c, g, or t
  misc_feature (182)..(182): n is a, c, g, or t
  misc_feature (201)..(201): n is a, c, g, or t
  misc_feature (204)..(204): n is a, c, g, or t
  misc_feature (209)..(209): n is a, c, g, or t
  misc_feature (215)..(215): n is a, c, g, or t
  misc_feature (221)..(221): n is a, c, g, or t
  misc_feature (224)..(224): n is a, c, g, or t
  misc_feature (229)..(229): n is a, c, g, or t
  misc_feature (231)..(231): n is a, c, g, or t
  misc_feature (359)..(360): n is a, c, g, or t
  misc_feature (386)..(386): n is a, c, g, or t
  misc_feature (412)..(412): n is a, c, g, or t
  misc_feature (462)..(462): n is a, c, g, or t
  misc_feature (483)..(483): n is a, c, g, or t
  misc_feature (509)..(509): n is a, c, g, or t
aagaaaaaaaggaccaattgttctttnatcacacagccaaaaacagagagagagagggcagaccccacaatttccaggggcattctggaatggttgagatatggggtttngggggggngnaatgtattgtgttnaanatngaagnggannatgagatgtaaagaaaacaanaanggcaatancttatattcaaatctgtantantgttnctttancaagtnaanctgcngnggaccttttgtctaagattcagtagtgttttaaggttctgatatcgaattaatgaagtaaagttgttgatggtggtgaaacaccgtagggcatgtggttcaaagagaagcaggagggcaagggaaagnnaccctgatcttagtttgtagcttatnacttatttaatgaatggatgcccagncaagctcagagtaggcgcccaaagcatgtggattattttcctgttttgtnctttttttttttttttttttnagaccataacattcccagaagagganagtgaatgactacgctaggtcggctcttatagtgt

SEQ ID NO: 646435 - DNA, 933 bp, Homo sapiens
aaggagccctcaccagtgaaacaagtcaacccctagctaagcgtctagatcatttgcagcggtgctcgtacgaacactttataaactacttaactcagtgccattgctatcatgtggcacgcagtttgagctgcgccaaaaccatgaagcaactctgcatgaaaatcacactgccaacttcctccatggcttatcctagtctcgttgctatggcatcctcagaagtactagtgctaagacatacacgagtatacaagctagaatgaagcgagttggagcataggttgtcttgcaactgaaatctgctgtgcgcaagtgtggtcaagcagatgatcgagcgtgttcgccgaatattatcttcttcaccttcagcaggtggattcgcactcatccagcgttacgatacgatgattgcagagcattgaccagcgaaagtaaagatcctgagagaaagagactcttcaacgagaggcatcaacttctaactcatctcgccaggagaggcctccatgtgaaacccttcagttctcagctcggaacatggctcagatgccaaagtatttggagctggttatccaaggtctgtccaagctatgacggtgagtgactgtgtatgagcaacatcgcgaaatatggatgcattaccgtaatccgggacactagccaacggcagcgaccagaggaattctgaaaagcagctcagcaacaggaagaacaagaagcaaaaggaggaagcaggatgactgaacataaatccacagagcccgggagtgggatgactggaaaggacacccatcctaggggctatgggaaccgacagaacatgggctgatcttcccacaattaccacaggactgcagggtgcacgaattcccctgccaaggaaaaccatgcagtccttccctccctggtctcctgcttccagtctgtaca

SEQ ID NO: 646436 - DNA, 233 bp, Homo sapiens
gggactagaaggcctcgcacaggccaggcaagcagtggctcacgcctgtaatcccagcatttggggaggccaaggcgggcagaccaagagttcaagagatcaagatcatcctaaccaacatggtgaaaccccatctttactaaaaatacaaaaattagcggatgggagaagatgcgccaatcttcgtcccatcagtacctaagtgatggggagtataaggcatgaagggtgtt

SEQ ID NO: 646437 - DNA, 504 bp, Homo sapiens
  misc_feature (94)..(94): n is a, c, g, or t
  misc_feature (97)..(97): n is a, c, g, or t
  misc_feature (100)..(100): n is a, c, g, or t
  misc_feature (105)..(105): n is a, c, g, or t
  misc_feature (109)..(110): n is a, c, g, or t
  misc_feature (131)..(131): n is a, c, g, or t
  misc_feature (134)..(134): n is a, c, g, or t
  misc_feature (142)..(142): n is a, c, g, or t
  misc_feature (161)..(161): n is a, c, g, or t
  misc_feature (164)..(164): n is a, c, g, or t
  misc_feature (169)..(169): n is a, c, g, or t
  misc_feature (175)..(175): n is a, c, g, or t
  misc_feature (181)..(181): n is a, c, g, or t
  misc_feature (184)..(184): n is a, c, g, or t
  misc_feature (189)..(189): n is a, c, g, or t
  misc_feature (191)..(191): n is a, c, g, or t
  misc_feature (319)..(320): n is a, c, g, or t
  misc_feature (346)..(346): n is a, c, g, or t
  misc_feature (372)..(372): n is a, c, g, or t
  misc_feature (422)..(422): n is a, c, g, or t
  misc_feature (443)..(443): n is a, c, g, or t
  misc_feature (469)..(469): n is a, c, g, or t
gttcttatccagccaatactgggagtgctgtctccacaatttcaggccatctgaatgtatgatgtggttatgtgtgtgtgtatgatatgtgttnaanatngaagnggannatgagatgtaaagaaaacaanaanggcaatancttatattcaaatctgtantantgttnctttancaagtnaanctgcngnggaccttttgtctaagattcagtagtgttttaaggttctgatatcgaattaatgaagtaaagttgttgatggtggtgaaacaccgtagggcatgtggttcaaagagaagcaggagggcaagggaaagnnaccctgatcttagtttgtagcttatnacttatttaatgaatggatgcccagncaagctcagagtaggcgcccaaagcatgtggattattttcctgttttgtnctttttttttttttttttttnagaccataacattcccagaagagganagtgaatgactacgctaggtcggctcttatagtgt

SEQ ID NO: 646438 - DNA, 407 bp, Homo sapiens
  misc_feature (61)..(61): n is a, c, g, or t
tgaaaaatccttctggaaatggcaggcctctgggtaacccaccctgaaacatggcacctanaatgtaaaaaaacaacacataggcctccccaagacatgcacccctcatgggattcccagacccccctgtatgatgccttaagtagtagtggccctacaaatctgtgggtgaacagaacaggagacttctggactgacagcccctgtcacaagggggcattatctgagatattggccagggcatatcgtgtccctggtcttttgaaactccatttgtcggccaggtgtggtggcttacgactgtaatcccagcactttgggaggctgaggcaggtagatgatgaggtcaggagttcaagactagcctggacaatatggtgaaaccccgtctgtactaataatacaaa

SEQ ID NO: 646439 - DNA, 827 bp, Homo sapiens
cttggtggctcatgcttgtaaccccagcactccgggaggctgaggtgggtggatcacctgacatcaggagtttaagaccagaccggccaacatggtgaaaccccacctccactaaaaatatgaaaaattagccaggcatggtagcgcacgcctgtaaccccagctacttgggaggctgaggcaggagaatcgcttgaacccgggaagcagaggttgcagggagccgaggtcacaccactgcactccagcctgggcaacaagagcgcgactccatctcaaaaaaaaaaaaaaaaaaaggtttgggccattttcttcccattacggctaattgagaaggctggtttgggccaattcttggtgcgcagattttgtgggtattaaccggggaacgctctcccacggattggtcttagaaaaagggcgccttggcctcgtttaaccaaaagaggggctggcgcaaggcgttaaacttggccattactcgggccccctggtagggacgtttctaaacttgtggcgtcagttaaaccccaggaagggggactcggcggtgtccctacccatggaagggaggaagggcttcttaactaaccaggggcaggtcctatgtctcctctaccacaggactgcgatcatttatggtaactgtttccagcgcctaacattgagggacgttcttcctaatcgtggctacactatgggcaatttttaaaatactcttaaactcggaaaaccctcttttgtgtgtccatttccataaaatccaagcgcctaaattttaatggctcaccattttaggaagcccttttgaaaagtccctgtgcagg

SEQ ID NO: 646440 - DNA, 341 bp, Homo sapiens
  misc_feature (49)..(49): n is a, c, g, or t
  misc_feature (68)..(69): n is a, c, g, or t
  misc_feature (230)..(230): n is a, c, g, or t
  misc_feature (301)..(301): n is a, c, g, or t
gatgtactagaagatgaagtgtatgacccagaagatgaagtgacaaggnccattagcgaggaactggnncaacgcactcaatgacatcacctaccctgctgagccccacgccaacgtgaccacctcagctctcttctctcctctcctttccattctctgctatggggaggggagcaggcaggaggagcagaaattggccaacattgcacagccaggctggggagcagccnagggagagcccccatgcatgcccaccacccactctggcactggcttgcatacctttaacctatgccccttnccaccctcctttggctgctttaataaattctgaacttgga

SEQ ID NO: 646441 - DNA, 252 bp, Homo sapiens
agtgtggtgttatgcatataatgtcagatcatttatgttttgctattgagttgcatacattccttatatggttttagtactaactccttatcaggttgtgatttacaaatattttctcccattcagggtgttgccttttcattttgtcctttctttggctgtacaggagctttttaatctaatgtaatctcacttgttgatttttgcttttgcctttgttttttgtacattcattcataacaccacacaatt

SEQ ID NO: 646442 - DNA, 1005 bp, Homo sapiens
  misc_feature (519)..(519): n is a, c, g, or t
gagcgggttctcagcgccgcgttggaattcggggaggagcggaacggtgctggagtgctctgctcgcgatcgccaggtctgcagtcgtccagtgttcgcggagcactgagatgctgcaggtgactgcagggcacagcgtggcagcgggcaccggtcgatcctggaaagaagccggggtcccggtgagttggcatgctcccggagctcctgtgcgagcggacatccaccgtgccgagaagagatcccggaggctcctaggtaggaccctacgacagccacggccggtagcctagtgtgcaggtggactcgacttgtattctgtggacataaggcggcgtgctctctaggcccaaggatggcgtgtacagaagtactccgtcggtgaacgcagggacctagcgcaacggggagggctgggtctcctgcgtgtgcctagaaggaatctaggtgacaccgttaacgttcattcgtaggacttggctttgcgaatggcccgtcacctcgaagaaggggcaggtnacgaactcgttgcgcaacttgggacatagtgattcgcagttgtcaaaccctgggaaaggacattcggctcgctccaaccacaacgtacagcgatacggataaagtgattttcacatacagaggtgtatggtacatacgagaagtgaatcaaacatggagagatctccatgtgttggtttcgcgatggaagttggattgtgggtaagggcgtacttggaccttcgagccagaggaagggagatcgtcctactctgtagtggcaagtccgttggaccatccatacggacgacgtgaggagtagagaaggcggccctggaactattgcacggtcgctttggaggcggccgccagggagtaggcgttaacccgttaccagcggtggaacagttggtggtagcttggaggggtgtgtggccgaaaatgaccgcgtgtgcgacccggagatagcgccggaagttgttagtgtacaatacggaaagacccgtc

SEQ ID NO: 646443 - DNA, 119 bp, Homo sapiens
gcatggttctgttcacaccctcagccttcctgagagcacactgctgcaggctgtcgacgcaacactcaggtcattgatggctttttttgtgcagctgcacagcatgacacttaatggag

SEQ ID NO: 646444 - DNA, 203 bp, Homo sapiens
tcatctcgctcagaaccaaattcctcctcactgtcctcttttaatcttcacaacaatcctgtgatagtaactaattttttatctcctttttttttggggagggggttttgggctgtgcccccggtgggggtgggcgggggggggtgctcggtttgctgcgggttcccccccccgggtgggtgcctgccttttgcctcactctc

SEQ ID NO: 646445 - DNA, 1002 bp, Homo sapiens
tccccccttttttttcctttgtgcctcctctctcctcttttttcctctcccggggggggggggcccggggggccccctgggggggggtccccaagggtgtccccccttctttaaagaaaaaccccacccgagagtaccctcaaaaaaaagagggggggtcgcacaaaagagcacgggaaagaaacgacttcccacgaccctgaggcattccccacaccccctctcttatagggagacagggaagaccgaacagaaacggagaacttacgagcgagtagatcaggggcagagagagaagaaaacgggttcgccaacaacacaaccggagaacaccaacacgcaatgtaccgcaaaacaaaagaacgcccacgaacatcacacaaacagagtggggggtccacaccacgaatggaggcgacgagatgtaacccggccgcataagagaaataaccgacaagcaagcaagatcacctacaagacaaacatatcaccccagaaggaaaacataccaatgtgacgcatacgcggaaatacacaacctaccaacgcgaacgacccacgacgcccctatatgtgcgggacccacggaaaaaccccgccgagagttaggagacactcacccccccacaaaggggagcattctgtggcacgcacatcacctacacacaaacagccccctcacatcaaaagacaagcggggagacaagaaacaccccacacgtggggcgacgtccacacagaccaccttcactcatgagaacgacaacgacggcaccgactggggggacaaatacgacgcaggacaaactgggacaatacataaaactaccccctacgacgacgagcagggaccccgccccgttagcaccccctttgggagcgacagcacgaaaaacaaaacagaacgacacagcacctaccaaaacacttattgactccgccgccgcagggagtgaactaacacccgcggacaacacgcgggacatagaacttaagaaaccc

SEQ ID NO: 646446 - DNA, 123 bp, Homo sapiens
tggcgatcatggcttgggccttcggcgtgtgcagtgtggtgcctcggcgtgtgcatgcacacgccgatcttcacgtgcacacgccgaaaaaccatacgccatttcagggagtcaccgagctcg

SEQ ID NO: 646447 - DNA, 706 bp, Homo sapiens
acttgtgttacacagttgtcactgttcctagatgcacacagcttgtcatggaacagcacgctcagaacgatgtgacgtagagtactgctgctcacctttggtgacctgatcaatcccaggccttttttaaattcgtaatcccacaatgcagcacatgatgccagaaatagcactgaatcaagaaaatagccattgcggagctgccctcttgagtctttctgtccatcccattctattctgtactgtgacttcagttcaggaagtttggtaaggtgtattaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatatcacaaaacagcacaatttcagaagagatcgagggcacaggcccctcatttttcttcttttgacgcatcatcctgtgatgttgaaatgtcacttgcaggatgctattgttgtgcacgtatatcacgggcactgatactctagaacagtcgactggaactgctttccttgaatctttgggtgcccaggattcgtaggccggattaaaggttttcccactaggaaaccttaacaagaggatggaaaaaaccctttttaaaaggcaaggtatagtca

SEQ ID NO: 646448 - DNA, 1668 bp, Homo sapiens
ggcgaggcgctagtgtgggaacgctggcctctgaaactagctctgggaccggggtctgctggccgtgccctagactggcacccgtctcccatccccagaagggatactcagatggggattcatgagcctattggataatcaagatattacacaagacacgagtgattcccatttcgtacagaatgcgtggaggacatggacatgcatactcactactcaatggatgatggcaaggagcagacgcaatccgtggccagcacctgcacagcaacacaccacttgcgcacttggtcagcgcagcacacacagggtcacacagcaagtcaaagcagcaacagcagttggcgtctcagtcgcacagccaggcctcgcacacgcccactgggagaaacatacaaccagcatgtgagaagaagacaccatgactggtggcccagagcgcatgccagcccaaccaataccactcatcaccaactcattcaagcgggctgtgacaccggcgacaagcatgagccacacaccacccaacgtctcatcgagtggacacagggcacctcgcgcacgccacaccactcccacccaaacacacgatcaccaccgcgccaccgcgacagacacacgacggcccacagcgagcacgaccatcacacccgccacacaccacaccccactccaccacacaccgcgccaccagcccccaccccgcgactccccccgcccccgccacacccccgacccccgagccgcggacgaccctcacgactcacttgcccccggagaacaacacagcaggaacaacgcgccaaacaacagcccagcccgcgccgcacaagcagcaagagcaagacgaaaaaccaccaacgcggcaacacaccacgaacaccagaccaccacaccacaagaacgagcacacacaacaccgcaacacacccaccacagaagacgcacaggcacacgaggcacacggaacgagacgacacaaagccgccgacaccaaaacggcaaaaccgaacccaccaacacaggaagacaaaagacggaccacagaacacacgcgcaagagccacaagggtacacagagcccgagaaggacaacgaacacccacaccaccaacaccagcaagccggatccacaagaccgcaacaacaacgagacaccacgcacaccacacgacgacaccacacactgagcactctgacaagacacacccaacgcgccgacgaccgagaacacacgaaaacaccacacaacacaaaccccgccggcaccgcgacccacgcaggggagagcggagcaccgacagcgcacaatgacgagccgccaccgccagacgcccgtcagcgccggcaagcgccacgagcgcgacgagcaccggctgccgcgcgacacctgagcggacgaaggacaggagacagtccagagaggagagagcgcgggcccgcccagcctgagaccgcggagcggcccatgaaccagacgcacggagaggcacggacgccaccgagacgacgagacgggcagaagcagacaagccgagagaacggcccccaccgcaggcccaacacagcacgcgagcggcaccgggcagacgagcacgacacggaacccacagacccagcgacgaccgacgacacggacgagaccagaccgacaagagagcgagagaa

SEQ ID NO: 646449 - DNA, 123 bp, Homo sapiens
attacgaacacaaacttgtgtaacctagcaacataaagaataaaataggaataagcttcatcacctagttggaagccttgtaccattgaaaattataaaacactgcttaagtaacttcaaaca

SEQ ID NO: 646450 - DNA, 145 bp, Homo sapiens
  misc_feature (95)..(95): n is a, c, g, or t
  misc_feature (143)..(143): n is a, c, g, or t
taattgtggtataagatggtttcagttgactggcttcatttttggaagatttcaggggccagggctcagcccaaacactcctggactggtgtganttaatgctaaaaggctggtactgggccccaagtctatctggctccctnga

SEQ ID NO: 646451 - DNA, 416 bp, Homo sapiens
  misc_feature (75)..(75): n is a, c, g, or t
  misc_feature (101)..(102): n is a, c, g, or t
  misc_feature (145)..(146): n is a, c, g, or t
  misc_feature (243)..(243): n is a, c, g, or t
  misc_feature (318)..(318): n is a, c, g, or t
gaaacactacagcaacccaggttgtcctgaaacagacttttatacttgaacatggagactgcacatggactttangcggtttgtgctgttggcgactaaanncggaagcctaccaagtgagaaccataagggccagtcccaaaanngacaatttccaacacgaaaaacatggacaagctaaacgattttaagcttggggcaaggttaaggtttcctttttcttgggaaccaaagggttggggntttttaaactttctttgcggaaattaacctttggttcttcctcaaagagtttgcgaaacgcgagattggtacaangctcattaagccggctcaggattagccttttaaaaacggtttgctaggaaaccctttcctttggttaaccaattggaaagtccttttccttaagggcc

SEQ ID NO: 646452 - DNA, 420 bp, Homo sapiens
catacgtcgacgagtcgaggccagctatgtcggtgtctatgcgtgcttgcttagcacagccctcatcactgcaatgctatttgctttcatgatgatgacgggcctgggttctctcggaagcaaggtaggtagcgcggtcggtctatcaccttcatatgcggcgtgcaaagcgcagtatcagaaatcaatcgagactggatcagatgtaaatccgaagtgccaagaagttatggaaaaggcgggtgaactatgatgcccaccatattccaagttctgagcgttctcggaaaaattccggggttgaagcgatttgttgatgttgaagcgtcaatacaagagcgcaccaatgaagtaattcatgaagtggtcggcgcattcgatgacttcgttaaagtcccagtcgacgcggccgcgaattta

SEQ ID NO: 646453 - DNA, 520 bp, Homo sapiens
ctgtcctatcaagacagtgtggtagtcatgtcatgatggacaaacagatgaagggaaaaaaataagagagctagataacagacccacacataggtggacagctgatttttgacagaagtgcaaaggtaatttagtggaaatagtcttttccaaaatgagtgctggaataattggatatccataatcaaaaaatgaactgcaagccatactttgcaccaaatacaaaaattatctcaaaatgagtcatagacctaaatgtaaaacctgaaactataaaacttccagaagaaaacataggagaaaacctctgtgacctatgattagtccaagatttcttggctccaaaagcatgctccataagagaatgaatcgataaattgaacttcacaattaaaaatttacattaaaaaatactctttagagactgaaaagacaagcaaaatactaagagaaaatatttgcaaataatgtatttaatgaatgacttgtattcagaatatatagagaattctcaaagctc

SEQ ID NO: 646454 - DNA, 498 bp, Homo sapiens
atcccagatcacgagcgtcttaaaccccgaacgaccaaaagatagtaatgtacctgtgcccaggtcctgaatcactcgcagaattatggaggcttactgtggcctcacaccactttagaattgggtctggaaatcaaacttaagaaacaagagattgtaagccattttatactatcgacctaaattccagtctaacagttcctttacaaagttgcgtaaagcccccttatatgctagttgtaggaaatatagttattaaaccagactcccagactataacctgtgaaaattgtagattgcttagttgcattgattcaacttttaattggcaacaccgtattctgctggtgagagcaagagagggcgtgtggatccctgtgtccatggaccgaccatgggaggcctcaccatccgtccatattttgactgaagtattaaaaggtgttttaaatagatcccaaagattcatttttactttaattgcagcgattatgggct

SEQ ID NO: 646455 - DNA, 549 bp, Homo sapiens
tggggcgggatttcttcctccccgcttcttccccctctcagtccagttcatgtggttggtggtcagcaggcttggagagtggttctgtgctttttggatacattatctgttgtggtggccccaatgggacgggtcttgtggagccaccttgagccccaaaggctgggaaattcctcacgagctgctcatgtcaggagccgttctcgacttgctgcgggcgtgtccaggttgcgtccctgcaccacaaagcctctggaaggtgcctatggcctcttcggtggtgcggggggttacattgtatacctgcagcgcctcattgtccaccatgtcagctaggtattcctcctcgagatagaggatgtggtcgagggcttcctccacattctctggggagccccgtcacagtgaaccgcagttggggtctcggggctccggctcgtgtgggaagggaatgtcccagcttgatttcggccaatgatttatggacaatgggtttgcggtggccaccattgattcgggtgtagacgcgggtggtcccagcgggacgtc

SEQ ID NO: 646456 - DNA, 422 bp, Homo sapiens
  misc_feature (377)..(377): n is a, c, g, or t
taataactttaaatatttaaagattaagttaattaagggtaaaaaaaaaaaaaaaaaaagaaaaaaaagaatgtttaaggatggtaaatgaatatgtcaggtgtggtggggcatgcttgtaatttcaacactttgagaggcttaggtaggaggattgattgagtctaggagtttgagataaggtggggaaaataggggaaatctctatttttatccaccctttagaaaaaaaaaaaaaaaaaaaagaattagctggtgtgttggtgtgcacctttggtcccagctcttcaggaggctgaggcgggaggatcactttagtttcagcctgggaggttgaggctacagtgagccataatccgtgatcacatcactgcacnccaccttgagtgacagagtaagaaagaccctgtctcaaaaaaaaa

SEQ ID NO: 646457 - DNA, 219 bp, Homo sapiens
tagaggactccccctgtgaggctgcagtgcagctagaaaaagcaggcagaaaaatgtggaatgagaaggcttgctgagtcttctggtcttcatctttctcgcatactggatgcttcctgccctcaaacatcggactccaagttcttcagcttttggactcttggacttacaccagtggtttaccaggggctctcaggccttccatgacagactgaagac

SEQ ID NO: 646458 - DNA, 162 bp, Homo sapiens
gatggctgatggtgatatcgtgataatgatgatagtgatgatgatggtgatgacgacattgatggtgaatggtgatgacagcaatgacggtggtgatggtgatgatgatggggatgaggatgatatgatgatgatgatgatggtgatggagaaaggtgatgg

SEQ ID NO: 646459 - DNA, 1792 bp, Homo sapiens
gaaggcctgtgatcagagaccgtggcatgtagtaacgagtgatgcatacgggatataaagggaaatcctggtattgctggccaagtggagtgtgagtacactagagcccatgctaggacaacagtgcgagtatgcacaaaacataactcaggcacaacgaaaccgctagacacgcgatgcctgcgaatgatgtctccatagtagacacggttgtggtgtccttggatcgagtacactcgtgtcgataacgctaaacttgcgttcgcactctcggtatgcatgagtaatgtaagagtaatctaagtatctcatctaaatccataggtttgttattaagagagatagtagctaggaaaagtttattagatatgtttgatcctttttcttgtttatctcttttatgtaatataaaagcagacatatctttgtgtgtgatctattaggcatacacgctaagcagaatacatttttttcgacatggggagcttgtatctaatgagagtgagagaattagtgtgtgctgataactgagatatatttatatacttaatgacaaatggagttacctacccccaggatgagtatgcgttgttttatgggacatgatgattctgagtgacgaaacacagttcattgctccttttttcttcccttcctaatcacagataagatatcactgagataagagaaccacggttgttttctctgatccttcagtagcagcatcatcaaccaccacaatagagagaggacgcagactgtgacgaatatattacccatctgttgagacgtccttgttgtgtagaaacacagcaccacaccatatttggggcataatcctcctgcttgttgtgggacaacagacgaaacaatgaacgacccctgatgtgatggtgaagcctacatgttaatggaacacaacagcagctacaacatcttgtagggggagttctaccactactaacgtggtggtgcgcccctcccaatataacaatttcgccactgtttatttcccccacagataacatttattctacaaaggacacgcatcatttatggcacaccactattagagactgttcccccccctttatgaagaatgtcgccccccaagaaaagcctacttttccatggtctcagtgcggacaggagaaccaccattggaacaaaccggccccctctaaggctctgctcaatcgtggaggtcttacaaacctgcccaacggcttggagtttggctcacccaggtggtgcacaacaaatttcccgtagtggagacatgcttatttgtgccgaccaaggagttagaacaattgggtgcgccgacacacgttgtgatacagatcagttggtgtgtccacacccgtcgtaggtgtttcaccaaacaccataagaaacaacggcgcacagtagatgtgaggtgattccccacacttattcttcattcaaacacagtttgcgtgctgggcggcaactcctttcttcacatggacaacttaagacaacgttaatcaccatgtcgcccaccacaatttttctgtccgaacatttagatccacgctgattttccccgctgtgcagaaacgccaccaacagcggtggacagcgggacgccactactgtgtggtcgacaacccactacagctgtctgtgggtctatacacacccacacacaagcagtcagttgtgcctaatacacgtgggtaaactcagtcgtgatgctacgttacaaatacacacagctcatagcaagcatatccattaatgaaaatttattttcccccacctgatg

SEQ ID NO: 646460 - DNA, 204 bp, Homo sapiens
agtgtaaaaaccaacagtgatgaactatgacaacccaaatgtccagtcagtgaacaaatggatgagccaaactgtggtctatctatacagcagaatacacttaagccaaagaaaggaacaaggcactggtacatgccaccatgtggagtgagcctggaaaacatgctgctgagctggaagaagccagactatagcaaggccact

SEQ ID NO: 646461 - DNA, 389 bp, Homo sapiens
tcgacggaggccacagttgggcccaggacggacctcagatctatccacaaagagctctgccttagggatccatcccatatagaatcacaaacccaggaaacttttgtggatgtcaacaagtgcttgctgacattagcctgaaatagctgtcttctgagaggctctaccagtgcctgacaaatacagaggtggatgttcacagccatccattggactgagcacagggtccccaatgaaggagctagagaaaggacccaaggagctgaaggggtttgcagcccactaggaggaacaacaatatgaactaaccagtacccccagagctcccagggactaaaccaccaaagagtacacattgtgggactcatggctccagctgcagtcgacgc

SEQ ID NO: 646462 - DNA, 108 bp, Homo sapiens
tgtggtgtagagtctagaggatcccacttcggtccggtcggacacagcgcataaatggaaggggctcctggtcacagcatcacttttaaacttctgaagggagccacg

SEQ ID NO: 646463 - DNA, 701 bp, Homo sapiens
agcgatgacgctctgtggaacccacgtttgtggtgggagggctaggtgctagcggtggggttgacctgggtctttaaccaggacggcttattcgcagccctctacggactgagcagcaaggcacccaacaccgagagacgacaaagtgcaggggacactctacctactcagcgaggggacctagcaaggctcaagacaggctagccgcaagcaccgagatgaagtggcagccccagttgctagagaccagcccagctagacctgttttggggtaccagggtgtggctcgccctctgccacttactcgaatattctgtggtggctgctttttaggacccaacaccaggggcccagcagcctggtgaccaggggacaggtgcctgcacagagtccaagaggatgcctgccacaacccagtggcaaccaacagctttcctgttcctgagtccccagaagttccgaggcccagacattaccccatgttatgccagattttagggtccagttgcccatttaaagacacagtcagagtcacgggcatgaaccagcccgtgacacgggcacccggagtaacttctagtgggaggtcttagggtacagcccgaccacgcagcacgtgcgcacacggtgacatggcaagcaaccagcacctgagccaagtgcacaacctcagactgactacgcaacacgaggaaccagta

SEQ ID NO: 646464 - DNA, 1139 bp, Homo sapiens
tcgttttttcttggcgttgcctcccgctctgctgacgtgctcttccctccttgtgtggtcgtctgtcctctcgtgttgtctcttgcttctgtctcctctgttcgtcccctcgtgtttgtcttctctcttgtggtctcgctcgtggtgtccccctctgtcctttgtctctctgctattgtgagcttgccttgtggttgtatcctcctttatattactcccttctatgtctgcttcttttcttctgttgcgtctgtggccttccattgcggttattgtgtttttttttgtgctggtggtctcctcttgggcgtgcctcgttttgttttagttttcttctctctctcatttctctctcgtgttccttcctctgtctttttgggtgtgttcttgtcttccgttgctcatctatgtttgtggtctatgtcctatgtgtccctcttcatatcggtttgtttttcttcctcgctgttgtctccccccctctttcgctccagtcgtgttttcgcgtctgtgccctactgtttgttggccctctcctattgtgatggtcgctgttgcgttttgatctttagcccctttggcgtggaaactgactggttaatcgctttcactcgagtgctagagtgtcctccctttgctgcattgatggtcgtcggtggacactctagccacgtttgccttgctcggtatctctattctctgtgatttggctcccttgggttcgcggtattgtctttgcgcgctcctgtgtctctaccttgctaattcctcaattgtccgttgggcgtccatcacctggcctctctctccatggggtttggtcagttcctccgctgccgagagtgttcactcgccaagtagcgatggcaagtcacgattccttgtggaccggccattggcggacccgtgatccacacgtgatgtatgcttgctattattatctcagtccttgatctcagacaatttcaaccttaatctatttagtacagtatattctatacaagctgtttttaagccattttaccatttgaaatgcatgtcgttgtgcgcgatgtgggagtgggaggacgggggctgacggagcggactcagtgtcaccatcccacagtccaccggacctgacccttaatccagacaca

SEQ ID NO: 646465 - DNA, 818 bp, Homo sapiens
gggtttcggagttgtcttctttgatacgggagttcctccttgctctcgcccctactctttctggtgttagatcgagctaccctctaaaagcagtttagagtggtaaaaaaaacaaaaaaaaccccccaaaggctcgaagccacaaaagggatgaaatttcttctggacatcctcctggttctcccggcacttgatcgtcctggtccctaagaagtccttcgtgaagctttaaatccctaagcaggagaacattcagtcaccggcgaaatcgtgctgcatcacaggacctgggcttggcaattggggagactgattggcctatgaattcggctaaacttaaaagcaagcgggtactcggggatataacataagcttggacctggacggaaacagttgccaaatgcacagggcactgggttgcccagcgttcataccttgacggtacaactgcacgcaaccgagaaagatattttcacagctctgccaacccacggtcgcacggccgaactctggcgactgtcagcatatttccaggtacacacactgccagggatgtagctctatacagtcacaattggatcggcctacccaaggacccttcgaattgcaccagacctttcgaacctcactggtacctcggcaccattattcttggggacctagcacaagggacatttcataccgtcgcaattgcgaagtgaataaccccatgtggccaatattttgccctctgtagcgtttccggcactctgcacctagtctcggagcccccttcttcaacagcgatactggtccacagaacattcgtggattagggg

SEQ ID NO: 646466 - DNA, 360 bp, Homo sapiens
tctagaggatcgtggctcccacttggttgctaaggagggatgaatggccaggttgcaacggagcagggcagcactcccttgctgatcagcagtagtgtagtgctgtgaataggcactgcactctagcctgggcaatacagcgagacctgtctaaaaataacaaaaaagattggcatcagacagataggatgatgaacaaagggagttggactgtgtcttctgacctggtagtttttatgatttctagcatgaagaaaactggtgtaaatatttcagagtataccacttctttaatgttgtactcttgcaactttccctttcttcactttagcggtgaagtcgaacacggcatcacccgtg

SEQ ID NO: 646467 - DNA, 443 bp, Homo sapiens
  misc_feature (356)..(356): n is a, c, g, or t
  misc_feature (429)..(429): n is a, c, g, or t
  misc_feature (439)..(439): n is a, c, g, or t
attcggcacaggtctgggctcaagtgatcctcccatctcagcctcctgagtagctgggactacaggtgtgcagcacattacctgactaattttttttcatattttttgtagagatgaggtttcatcatgttgcccaggctggccttgaactcctgacctcaagcagtccacccctctctgcctcccagagtgctgggattacaggggtgagccaccgcgcccggacagatttttttatttttgagacagggtctcactgtcgcccaggctggagtgtagtgccactatcctagctcacagcatccttgacctcgtgggctcaagcgattctcctgcctcagcctctcgagtaactnggaactgacaggcaagcgaaccatgcccagccaaaaaactttctttttgtagagacgagatctccctgtgttngcctagccangtgg

SEQ ID NO: 646468 - DNA, 1476 bp, Homo sapiens
gttttcgtccgccttcccccgtggtttttatccagctgtttgggtggaagtgttttgtcttctcgtgttgtttatctgtgttgttccgccgtgtgtgtccccttcctcgccggtcgtactattgctcgtcgtcggtgttctcattgctggggtcgattaccctcttgtaatcaggtggctctttgttatcccagcggtgttttcccccggtggggtgttctttctgctgaaaaggtcccccctgttggctcgccgggttttactcttgggggaaaaactttggtgcatagaaaagttgttgtaaacgacgtcacttgtcgcactgggagtaattcctacatgggtatattttgggggggataatatgaatgtctcgtcctacccaggtggtgcctcccatcccgcccgatatagtgtgcgtttttctccccccaaatggctgctcggtgtaatctgaacggataatgttcctctttgctaatcgttgccattcatcttttgccgttcatacacagggtgtaacacgcccaacgagctttggggcgcttcccgctgtgtaacccgcaggtgttcttcttgtttacacagggcctgtgtccacaatactttgggcctccccacggggccccccaatttgcgctttgtggcggacgtgtttcacttcgagtgggtttcttccacatgtcacgtctatcgcggggggaacagcactcttcgttaagatataccccgtgtctatgtctcgccgtgaccccctcgtgttttgttctgcgggcggttgttcgccacacttgggggccaaggatgtctctaagagcctttgtggtggcacaccctctatgcgctcgagatctttgtagcggcgccgctctctgggccgcccaataggatcgcagtccctcatgcggtctctctctcacgaatatgtgagacagacagtgagtgctctggcgcacacacacataggcgtttataggttttttgcccgcgcacaggaacatctttcaccgaataccctcctttggccacacagtaacagctggtgtgcgcacagcgcacaacccccttcttgggtcaccctcgtgtgcgctatacaccacgagcccctgtcccctgtcgtggtcacagcttcacaggcactgcttcgagggcctcccgagccaaacacacttgcacggggtgccctcggctatagtgtatagcgccccaccccccctgggagagtgttagtaccgcttctcttagaaacattttaccagaaaaccctagacttcctggagcccctgttggccagactcttagcctttgccagatcgtgtaattggcccaagatccattgtttttttctcgcctccacatggcccaccacagatgtttagagattatgtgagccttgtgtcattctccggggtggcccccagctagatccccggtggttttgtgctccaaaattaaaagcctcagtgacccctgaga

SEQ ID NO: 646469 - DNA, 142 bp, Homo sapiens
ggtgcagggaccttacctgctccaaggccagaggggacctgctaaacggggccaaacagaatcacagatgaacgggagagagccaggcatggggtcagaaagactaaaattacggtccggttcacttactctgcctgggctg

SEQ ID NO: 646470 - DNA, 167 bp, Homo sapiens
cgttctagcccacgactcgggaggctgaagtgggagatcacttgaactgagaggtggaggtcttgcagtgaaccaagatcacaccactgtactccagcctgggcaacagagtgagactgtctcaaaaagaaaaaaagactgtctagaaaaaggtaatctctcagaat

SEQ ID NO: 646471 - DNA, 424 bp, Homo sapiens
  misc_feature (424)..(424): n is a, c, g, or t
ccttgaactctactgtaattggtggctagctatcaggcctactatgggtgtaaaataccttactctctctacaaggtatataccatactgtccaaagagctgtgcctctttggactaacagttcaaatttacacggggatctcgagggttctgtgggcgaattcaaagttaaactaagattctatcttggacaaccagctatcaccaggctcggtaggtttgtcgtgtctaccaataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttctcatcattcacn

SEQ ID NO: 646472 - DNA, 193 bp, Homo sapiens
  misc_feature (25)..(25): n is a, c, g, or t
  misc_feature (31)..(31): n is a, c, g, or t
  misc_feature (170)..(170): n is a, c, g, or t
caatatagtgacaccccatctctanaaaaanatttaaaaatgagctggatgtgtgggcgagcacctgtagtctcagttacttgggaggctgggtgggaggattgcttgagcctgggagattgaagctgcagtgagctctgatcacaccactgcactccagcctgggaaanaaagccagattctgtcttaaatt

SEQ ID NO: 646473 - DNA, 162 bp, Homo sapiens
gccagaggaccgggttccttgtctaagtgattataagatctgtcttcaagctccaagatctttcctggctggactattctgttgttatgcttcaaaatgtattaggtaatttttgtagtaattttttcaattccagaagttccatttggttctttcttaaag

SEQ ID NO: 646474 - DNA, 315 bp, Homo sapiens
  misc_feature (175)..(175): n is a, c, g, or t
gccccatgcccttttttccccccaaatatgccaagggaaaaacatagtaggccttttgtataacctgttttgaaaaagaaggggtaaagcccccatatttttttttcccctcaaacggggtttactggttcagatttacccgggttggggttttaccggaggcattttcctttgncgatttttttgtgggcttccccccaaaggaggggcaggttctgggtccccttccaaaaaatttttacaaggatgtggtggtggggaactaaaacaccccagggtccctggggaataaaagccttttttggggccctggga

SEQ ID NO: 646475 - DNA, 434 bp, Homo sapiens
cccagcacacaccagtagtaggaggaagttaaatggtggtgaaaaaataggtactgtttatccttttgtctgtaaaataaattctgaaagctttttgaataatttaactttggatttgttgttgcttcaggatctaaggaataatactaattgtacaaatctgtgcagtgaggtgtagttgcttccatgttatttgagcctgaatgtgcgtgcataattggagagattattggagagagagtgttttgctgtggtagatgtggtttaaatcctagcactgagcatagcatttactttctcagcttacccacaaaatctgtgactaatttagtgaatgtgaagatttttgtccagatggttaggtttaattgtaaaaactggaaagatttcaaagtaccctttgggggagtgtgggaaacaacaagtaaacaaca

SEQ ID NO: 646476 - DNA, 200 bp, Homo sapiens
ctccagctctccctatgccttgatccctgccagtttgtgcactagccttcccggttccttaaggagggaatggagggggaaagtttgtggtgttcctacttgttgggaagtaaggggaacgttgcatgatgagattggtgtgaccacccaagagaaacgattgttaactggaagaaaaagtgtgtatataaatctcttga

SEQ ID NO: 646477 - DNA, 253 bp, Homo sapiens
atagtctctataattttttaggatatgctgaatcgaataacaatatggtagaaacaactagtgggtaccagtcttaatacctcggctgattaaataatctgtacaacaaaatcctgtgatataagtatacctatgtaacaaacctgcactgatacctaggagattaaaagttaaaacacaacaatatagtgaaaacagattcttccctgagtctttaatataccaacatgacaagtgttctggggagtttgca

SEQ ID NO: 646478 - DNA, 335 bp, Homo sapiens
  misc_feature (174)..(174): n is a, c, g, or t
tcccctttccccctttcctataacccaaatagacagggaatggaagattctccctcggggcctgaaagcttgcgggatgaataactcctcctcctcaggcccagtcccaaggtacaaacttgcaccagcagcaagatagcagaggcaggaagagagctggctggaagacacgtnccccctgaagatcaagagggaggtcgccctggtactacatagcagtcacgttaggctgggacaattcctgtttacagaggactataaaacccctgccccatcctcacttgggctgatgccattttaggcctcagcctgtctgcatgcaggcgctcattaaa

SEQ ID NO: 646479 - DNA, 1027 bp, Homo sapiens
  misc_feature (246)..(246): n is a, c, g, or t
  misc_feature (428)..(428): n is a, c, g, or t
  misc_feature (836)..(836): n is a, c, g, or t
attattttttatttatttaacagatataatcttattgtacaattttcctatttatgtttgttatatccatatttattctatgacactataattactttttccatagagccaacaactctgctcatacccaagcatcattatagatccctactgtttaaacatgcatgctcgtacataccactactcgttcgcacacgcatggtgactttcgtatatctctacattgtcattcttcctaatggcagntgcaatacattctatgtcgcacgcggccacaattacacagcgctgctgatgtactcagtgaacctctcacttgtactgtgtctcccagtgatgggacagctcacttactctacctgatcggtctaccagactacatggtaatcacgaccacatagggagtgattcatctcatatccttgacntaggattcacaagcatcgataacgtcagtgaacataacttcccacatcaactacttgtatattcatgtcatgtctgcgtcattccattactactattctggtactccactgaccacaatataatcacgctcacactcttgcgaccaccatctgcccccacacttcttgagctgtattcttctgatcaggcgacacatgatcgacttctgcaatacctgacgccatatccccattcactgtctcctccatttcggttgttctcacgtacgcattctcttcatcctcaatccttcactcatgtcatttatcatcgcgtaatcatcacatgcacatcgtcactatttatcctttatcggtcattcctttttatccgtttcatatctatcaaatgtgtttatcgcatcgganttcgcattagatccttatatcacatcgtgcaatcgtatccattacgcttcatgtacatacgtccctattccccccgtctcgtgattatccacacctgattcaatatttccctattgttcagtgacctttgatagttgaccatatttacttctttcatcatattctttcatctatctccacatcatctcatg

SEQ ID NO: 646480 - DNA, 110 bp, Homo sapiens
atccctggttcatcttgtctacacactacacaacgattataaataagaaaagttagccaggcatggtggcagtgcacctgtggtctcagctgcccactactcaggaggct

SEQ ID NO: 646481 - DNA, 536 bp, Homo sapiens
  misc_feature (292)..(292): n is a, c, g, or t
ctctagaggatcctggcaggctctctacctcaagatgtcagcgcttatgtataacagttcaaatccggtgctcaagattatgtggccggagggcaaacggagcatacagaggcgaccaagcgacctcggacggcggctacctggtaaaagaattctatgatggctctagtagacaaccttgcatcaaaggaaccatatgacgtgcgtggcatcaaacccaaggacaagaaatctccagggatattggacgatgaaggcggccggcaccaagtagaatatctgggactacggnaaaaggtgagagtgcgtcgggcaggattggccttccgccagacatacgagaagttccttcacaggtataagatgatctctgaattcaccgggcccaaccatgaccttccttcagacaaggaggcggtcaagaaactaatggagggggggggtccccaggatgatgtagcttaggggaagaccaaaattttcattcgaacaccccgaacatggtttaccttgaaagaactccgtgcccagatgct

SEQ ID NO: 646482 - DNA, 228 bp, Homo sapiens
  misc_feature (68)..(68): n is a, c, g, or t
gagagggggtccccctattttgtcccgggtaaggggccggggttttttcccaatgggaatattggacntttgggccccccccttcttacccccaagggttccccctttttcccccccccaaggggggtttcaagggggggccggggtggccccaaatcccaaatttttttttttcttttcccccccccccttgttttggaaacggatttttttttccccccgaaccca

SEQ ID NO: 646483 - DNA, 487 bp, Homo sapiens
ttgcctggcccctttgtgttagcgctcagcacacatgtgtccagtttaaattccacccaagattagccagggcatggtagctgccgcctgtaatcccagcttctcaggagtctgaggcaggagaattgcttgaacctgggaggcggaggttgtagtgagccaagatcgtgccactgcactccagcctgggcgacagagtgagactccatctcaaaaaaaaaaaagtccgtcgagagagcaggtggcggatgcagctgagagctccaggaatgggagggccacgtggtagccactggcagccttgactgaaagatgaaggagtccatggtgctaggaggaggagttgcatcccagcaggctcagctcctggagctgcctctctgcactctgaagggaggcccagtggctgcaatattcttctttgggaagtacaatgccaagtaaataaagatatttggggtcattctagttacaacgtatcataaac

SEQ ID NO: 646484 - DNA, 109 bp, Homo sapiens
tgctaaaaatgcatcagctttctttccattccctctctgcaaaagtcattcccaacggtgcatattccttgcaagtagcatgtggcatgcatgtcaggcatgtggcttc

SEQ ID NO: 646485 - DNA, 914 bp, Homo sapiens
  misc_feature (310)..(311): n is a, c, g, or t
  misc_feature (325)..(325): n is a, c, g, or t
  misc_feature (336)..(336): n is a, c, g, or t
  misc_feature (389)..(389): n is a, c, g, or t
  misc_feature (436)..(436): n is a, c, g, or t
  misc_feature (533)..(533): n is a, c, g, or t
catctgccagtaagtgtggacgtgctgagtgaattcgtacaggaatatgactgaaccaatctggacacgtctgggaggatattaaggtgaaatttagctgaccctgggagcagcctatgtctgttgtgttagagttccattttgatacccagcgattacatttaccaactcaggtcgctgacaagaaagcgtacaagatgaaatggagaagccagataaggggtgatcccctttgccttgaaggtcctgagatgtggactgtgacagggtgtactatggactggaagaagggaaagaatgtactgtcaannaccatcaagaaaangcagaagcatnagggtcgaggcactgttagaacaattacgaaacaagtacccaatgagtccttnttcaacttcttcaatccattgaaagcatccggggatggagaatcacntggatgaagattctgaattcagcattagcctctgattttgaaattggacactttttccgtgagcggatagtcccggggtgtgctgtacttcactggnggaggccatagaagatgatgacaattttgaagaaggtgaagaaggtgaagaggaggagcttagaaggtgacgagaagggagaagacgagggatgatgctcaaatgaagcccaaggtgtaattttgtctgttaatcattccatacgtctctagaagggaacccagcagccggcggaatgcacgccagaaggaggacgcgacccagggtggctggcacagcggctgcggaatccggctggggcgaggctcggtcgtgccgaggaaatccgggacggagtacaccaccaacggagaggcagcaacacttcacttcttactaatgggtatgacagcatgaagcgtacaagggtcgacgacccgacggggacgaaccggcccggaa

SEQ ID NO: 646486 - DNA, 117 bp, Homo sapiens
atgattctgttccaacaccccaagtacgacatctcaaacatgacttctattgccagtgatgttcaagtgcgcagggacatgagtggagaactcgataagtgtgccccgttatgctcc

SEQ ID NO: 646487 - DNA, 424 bp, Homo sapiens
ttacaagcgcgcataaggaggaacttctgtcattttgccatttttttctatgtgctttgtagctattttgtccttatttcctgcattactgtctcatttctttttgtgtgtattctataagctattttctttggttactgtgatgattacacttaatatttaaaaattacaatatttataccagcttaatttcagtaacataaaaaaattatgcttctttacaattccatccccaccacttattgatgttgcagaattatatctttatacattgtatgtcaaaaaatataaactaattttttaatgtgttagtctcaagttatgtaaaaaacaaaatgtggagttccaaagttacaataatactagaatttataattgcctatgtatttactgtcactgcaatttttgttttttcatatagcta

SEQ ID NO: 646488 - DNA, 262 bp, Homo sapiens
atctgcccacctcggcctcccaaagtgctgggattacagacgtgagccaccatgcctggccggatttcttaaataactcaaagttgatctaccattcgatccagcaatcccactactgggtatctactcaaaggaaaagaagtgattatgtcaaaaaggtaccttgaatggtaatacaaaaaggtatgtttattgcagcacagttcacaatcgcaaagacatggaaccaaccaaagtacccgctgaccagtgagtggataaa

SEQ ID NO: 646489 - DNA, 989 bp, Homo sapiens
gaatttctgtgaactcgtgcaaattggtgtagccaccgtcttgctgtaccaagaataccatcaccctccttagaatatgtcacgtacttgagacgcgaagctgtgctgtccagtcgactacatggttgtcaaaagagcgccgtgctaccacttaactcgagccagtacgcgtcatgcatattagtcaactgtgggcctcgtataaaataacgggacgatgactttgaacaatgtgcgtacgcagccctagcgagttacgatttggtcatgctttcacatgtccacaccttagatcgtacaatttggtcatcgtcaccgcgaagcatgtgccgaacacctgaacgcccaattatacgaaaggagcacaataccgcatactggcagactcaaagttcaattgaatagctaagggagcgtagaccataaagaaaggccccgtggaggctgcgcttacttggtgagcctagagagcactggcgattacatgtggatttttgcgggatgccgcgtgcgactgcacttctgcgtggagttcgccaaaggcacacccccccttccatattgcaagctcaacactaggccttaacatacttctcataccagcgctaaaattactggaaacttatgtacctaatctcagagattgactcacctaggtgagacttctgtacgatcctggaatacagataagtcaaatccccttagggtgacttactaagggcaatgcccgaaggctgccagtgttcaataattacccaaataagggttccaccgaagtctcggattggcgccacgcgggtacctcggacccgatgaccgtccgccaggcaggcgtgcggaaaggtggacgagtcaggctggcgaggatcaagagttcaaatcggtgaccacgaccaaagacgggtaaacctaactaacaaataactccgcggcgagaagcacacaaaagaaataaggccaccctcaaaggggcgtccccgaagggaacg

SEQ ID NO: 646490 - DNA, 184 bp, Homo sapiens
attcgcggacgtgtcgacatagagtttacctcttactgcacaggctggagtgccgtctcccaagctcaagcgattctcctgcctcagcctcccgagtagctgggattacaggcacccgccaccacacccagctaattgtgtacctttagtagagacggggtttcatcatgttggataagctctt

SEQ ID NO: 646491 - DNA, 863 bp, Homo sapiens
ccctgtttaatgggctcccccttcctgagttccctcctggggggaacccccccattctcaaccgctgtgtttgtcgccccccccccatagggacgccccccgggggctcgagtcccagcgccttcgcggagtctcttatacccttatggcctccgcggggagccggagatacaccatgttcacacacacacggggaacaccgccttattggcccccctctaggcccccatattttaggggggaccacctatatatgaacacacaccttgtgtgtaccacaaaaaaacacacacgctctggggataccgcgttcccgcgaaattctccccgcggagatatatctggtggaacccacaccgggttccgcaggagaactctcacaccacaattttctcctctgagaaagaagaggcgtgcgcacgaaacgccacaaggcgcacatattttttcacacactggtgggagaagaaaagagactcacacaggtgagcgcgaaataatttttttcctcggtgtttacacacactaaatgggctggaggtgtaaaaagcttgaaaaactccacagaactctttcgtgttctttggtgtttgccaccccactctgggtattgagaggagggcccccagaggcacacgggataggtcacacctctcctggcctctaacttttcctgagatgggtaaaatcgggaattatcttcccacggtatgcctggccacgctatataagaccccccgcccgctaagagataccacacctatatgagggaacacttcccactgaggtgtgggatttttagttttaactggtaaatttgttttttttacggggcagatttttaataaagggcttggttttta

SEQ ID NO: 646492 - DNA, 131 bp, Homo sapiens
acaaaactattgtataaaacagctgggttacctagcttatgattaataaccaaaggaaaagatataaactgggaaatgttaacataatagctcattcaattttcctgattttctactatagctctttacgt

SEQ ID NO: 646493 - DNA, 257 bp, Homo sapiens
caagaatacactagggcctcagtcttacacttcttgaccacacctcgaatgcttaaagcgacactttgaagtctacatcctacgttaaaaggatctacttgccagcattttagggcgttaaacaattttctgtttgggggagaaacaatgggatttggcagcttaaagggttttaaatggtacaaaagttaccaaagcaaaaaactttaccttctacctgcctatatctcacagagcctcagcagctaggcagtctc

SEQ ID NO: 646494 - DNA, 401 bp, Homo sapiens
taggggagggacacccaggttatagcaactacttaagcgcctatgtgtaaagctctcctacttcaaagaactacccagcaagtagttcctcccctcatctctctaaggtggtagtcacccaaggaaggtacagggtcagcactctgaggcctggtggaaaagagctgatgggggcagaacgacctgtgggtgagagatccattccctagaactaatgagaggaacagataaattaaggtcaccattggaatctcctcacattgtaggcatccctgcccaggcctgggacccagaaaacatgattcttgagaataagtgggttctggcagcctccattgtgaaagccagacatacacatgactagcagtactgcatgggtgtgtgaagacttggggaacttg

SEQ ID NO: 646495 - DNA, 114 bp, Homo sapiens
cccttagtgtcactgttcatcaataggcacgtctcccattacgccatctgttgagctcattttcaagccactgaatagtgttccgcaggatcttatttttttctttttattttc

SEQ ID NO: 646496 - DNA, 914 bp, Homo sapiens
attctagaggccgaggcgggtggatcaactgtggtcaggagtttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctgggcaacagagtgagattccgtctcaaaaaaaaaaacagaaagggaaaaaaaaatagctttatacctcttcctgtgtctcaaacccgccatgaaatttctgaacgcctccaaatttcagtggaataatccaaacacaaacattttatacgtataaaaatagtttttcctttcttatagtaatagtatactctagaaaaagcctcagggtatatacatcttctaaagcagctacaattccagtgcagctacattaaccaactatgtcctctagttgagaacacctaggcctattttcacggctgtgtagcctcagtgcctaacaatgggtgccacataaatatcgtaaaatcaccctgattgtaaaaccattcgtttttgttacaatgtgccaaaaatcttcaacaagggcctgtgttaatgtaactccttggaacgattaataatttaagtggatttctcagatatggacctggctgggtgttgacttagtcataggtcctcaattttttaaaactcaactatgcgtgatttcaccaaaatctccccttctcacgtaatttcaaacaagtggggacccaaaggtatcacaggtctaaacagtcaaatcgtcttacgcaatgttacttccccgttagatcacaatttgggattgcaggcgaccaagtgtaaattgcgcgacagtaggcgcagaa

SEQ ID NO: 646497 - DNA, 81 bp, Homo sapiens
cccgaggacacggctgtgtattattgtgcaagagaagttccaacaccagtgcctggtaattttgactactggggccaggga

SEQ ID NO: 646498 - DNA, 112 bp, Homo sapiens
gaacctgcgcctcctagagaaaatggtatgtttacaggagaatgtatattttgcattagaaatacaagctatatgttcaaatcgaatttgcctcctccccccaattcctcat

SEQ ID NO: 646499 - DNA, 322 bp, Homo sapiens
cccctgtgttagcacaacctagggtcacttttgcatgtgtaaagccatttaccaagatagttgtaggtaagaagggcagatttattagagaaattatgaaaatatgttgcagtgggcagctcagcagagaaggggctacctgcaaagaggcaggggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 646500 - DNA, 479 bp, Homo sapiens
cccgggctgcgggcattccttggcccggtggccagatttccaaaacttgtagcaagctcctgggggaggaggttctggaggaacccctggcagctgcggttcaggcgtttggagttcttgtgttctggagatgtggctggggtttgtctcacggtggaggcaaggaattgcaactcagaaatacattgctacgtggctgcttctacttttaatattggaccaccttgaaggcgaggttaattaagtcctgttgtggggtatgagggccggaatttaatttttggagctttatttaatgtcaggagcagattgggtaataaaataaaatgcattttgagaataagacggcattgtgacctttcagggtctagggctgtaaaacatctcaggattgctgccaaatgggccatgaactgggctgggttttatatttgatgaaaaagagcctaaacgctaactgatctgggagaggtcggata

SEQ ID NO: 646501 - DNA, 1225 bp, Homo sapiens
gcgcactctgtacttaccgtcgctccgccgtcgcgtttctctgccgttcgcactggaacgaagagatcgccgagctggtcattgacagatggctccggcatgtgcaaagcttggttttagctggagtgacgacgctcctcctgagcacgtcagtatctctttgccatctgttcgtgtgcgccccaagatcagccaggcggcgtcattggtaggagcatgtgagtccatgagacggactcctaacgtaggcgtcgatcgatgagctccataagtcaacgcgttggcatgtctcgagccctgaacttaccccacttgatgcactggcaagtctgctcagcgcagagctggggactgacactggtacgtaaggcactcgtggtcgactcatagccatatactatcgaactgagcgtgcggcgtgagcctccgggaggacgacaacccagatgcttgcttgacccgaagggcccttccccttgaactcgccacaggaccacacacagaagacgcaatgcactgcatcttcatgaattcaatgcttctgaggatcgctctcaagcaccctcacgcgagcaattgtttagctgctgggctcattcccaggtccgttggcttagttcgcacgtcataagcgcccttctagagagtctgccaactcagctttgggctatttagtccattggagcttcgtgggaagacagggggtacaccccaacacggatgctccattctacctgagtggctacgacctctcccgccatcggccattcctagtcgtctggaccttggtcgtggtcctgggaccttgtagccgactagcctcatgacagatcctcactgagcgaggcgtacagcttcaccagcacggtgcagtcgggaaatcgtgcgcgacatcaagtgagaagctgtggctacgtcgccctggactttcgagcaggagatgggcaccgccgcatcctcctctttctctgggagaacaagctacggagcctgccggatgggccaggtcatcaccattggcaatggagcggttccggttgtcccggatgcgctgttccaggcttccttccctgggtctggaacttgcggattccacgatacccccttaactcctcctgacgtgtgacttgacatcgaacacctgtagccacacgtctgtggcggacccccagtattccggcttgccacggaatccgagggaacccgccctgcccgccttaataca

SEQ ID NO: 646502 - DNA, 741 bp, Homo sapiens
agcggagccggcgcgcccgcagtcccggaggaaatggaaatgtacatctaacagtatacaagaagcgtacagaagaagaaaataacttttctggatcaaattaggaagtactagtatgatattagatggtctccagattcaaatatattcagaaagcaggcgtggagacaaccatctttattcagggcgagatacctaaagcgcggctcatggcattagagctacagacaaaccctgatgcgacctctcgcagaatgtcccaagtcgagttgattgcccagctactattgtggccgtgaaggccatccagagattcagacagacgcaccaggattggcactgaaacatgggctcgggccaatgtgtcaagttatggcagcatcatcagagaagcttattttgcaaaagagacaagagcgacagtagatcagtcagtcttcacggatgcttggctgatgaggtcgcagtcagaaggtggttgataccagaatcattctagcacgagacgctggacggatatcattggcagaacgcatggcaccagaccgcaggtacctctggacgaagtcaaccctagggcaccttaatgcaccgaggaacaccagtaaccgcgggtagtaggagaaagtaactagaccaactgaccgaggggaggagggtaacataggcggcagacaaaggagccccacaagtccggcgacacccgacgacaaataaaagccgaaagtgtagaagaacccg

SEQ ID NO: 646503 - DNA, 378 bp, Homo sapiens
taaaagaatatcatagtccaaacagatcacacgaggcgaacccaggacaaatgctgactttggcattatctaggtcacccctattttctgtcatatctgtctctcctgttagaactattgttgcaaaaccagtcaaaatcctaccaaattaaaaagaagtccctcattgacttgttgggtgtaggtggtaccccatgtcctcccacaccaaaagagatcagttctggcaagaaagctccaacgtgccttgatggtgctgttggtaggatgccttaggccaggcacgtcccagcgatgttctgctggctgaggtacaaggtgggaggagaatatgcctcattcattactcaatcaatttcttggccttgccatatgcaa

SEQ ID NO: 646504 - DNA, 1334 bp, Homo sapiens
gcggtctcagagctccggcagcagctgcgcctgcgtgggcctcccagtgtcggggaccaagtctatgctcctggagctgcatgctgcggcggctgcgccgaccctgacgagcggccgaagcctgcggcgcgaggacagtcccgcgggtgctccctggccgagcctcaagcccaaggaccctggcagccgcccggcgtacagggctcggtacaagcccagcgcagcatactcacagtgccacgctacttaccacgacgccgacggataccccggggacggctaccggataccaacatccacactaccgacatcctgctgcagatccaagccctgaccccttcctacagaggccgtggactcagctggctctgactactaggcagggacggagctgcagggaagcgcatcctggagcggcgcagttagcttcctaaccggggacatcgaatgacattcctgggaggatcagggtggaaggcctgatgaacccccactggcaccactaatatccaacttggaattatagccatgagaaaccctatcggacaaatgacatgaaaccaaacatacaccaggaacatagatgcaacagggcctactacgaacagaagaagaagcaatcccaccatagaaaatcaccacggaacaaacgccaaacgaaaaagttcggtcgcaacaccgagaaacataaccacaaagagaaaccacaagagggaacaatcagcaatgagaacatggagcagaggaaatgggccgcctagaagcacgcgcggtggatacaatacccaaacaggagagagaacaaagagtaacacgcacaaagcgagcacagaagcgaagagaaaacaacaggaaagaacaacaacaaatctgagcacacaccacagaaggggaagacacagcgaaacgcaggacagaacacaggcaaaggaaagagagacacaacggcacgcaacgcgaaaacaacaggaatagaagagggaaagaacaggagaagacacatgaccagagagggatggaccgaaaagaacaaccatagaagagcaaggcaacagcgcaaacaaagcgagaaggaacgcacagacgacgagggaagagaaaggggaccgaggcaagacgaagaccaacacgcagggcaggacgacgcagcagatagcggagaagcgaaaagccggcagaaaaatcggagaaaaccgggacacaacaaagaacacgaagcggggagaagagagaagagagacaaaaggaaggcggcgggccaccccatgcccgcgactcgccagcgcccatcgagaaaacgcgcgcggagcaggagaggaacgcgagagaggcgg

SEQ ID NO: 646505 - DNA, 135 bp, Homo sapiens
gatcactgtgcattgtggaatgtggtatgaggagaaaaagggagggtgatgtagaaccaaaagcatgtctgggcgtgtacagagctggtgttacatgtccaaggggtatatccctcttaaaaaacccctctctct

SEQ ID NO: 646506 - DNA, 631 bp, Homo sapiens
taaaaacctattttgttagcccacaaaacacttcattgttgttttggggggaaggggcatttgtcctaataaaatgtctccaaagcgggtttgttttggaaaaaaaccttcccttttattttggaaaaattcctctgggctcccaggaggagggattccctgacttggaaaccaacatggccaccttggtgcacaaaacagcctgggggtatacaacaaaacaaattggtttttatatgtcctcttctccctttccatcttatcacgcatagacttaactcccttaagccacagacatctgtggagacctgacccctagtcactgggtctaccagtgtgtccggccatcgtgactatcccagtgatgccactgagagtggcaccgtttcaaaagagcgggggtccattcactaaatggggggccctatcaaataaattcggccattatcaattacacaattcctgaaagtcacgggccggttgtgaaaaagttgtacacaacactgtgctaacaggtcaacatgtcaccctcaactcataaacttcccgtgtgtaagagcatcacatgacagcactcatggcgtttaaagggccaccagattacgggacgccattgacaacggggtttgac

SEQ ID NO: 646507 - DNA, 440 bp, Homo sapiens
tcagcgtgaagcagagcttcatcaggaagaaacaaataaacaaagatagacaaattggacatagatcacaagtcaaaccttaagtctcaaaagacaccatcaagaaagcaaaaagaggctgagtgtggtggctcacgtctgtaatcctagctctttgggaggcccaggcggacggatcacgaggtcaagagatcgagactatcctggccaacatggtgaaaccccgtctctactaaaaatacaaaaattagccagtcatggtggcacacacctgtaatcccggctacttgggaggctgaggcatgagaatcacttgaacctgggctgcggaggttgtagtaagctgagatcatgccactgtactccagcctgggtgacagggagacattctctctcaaaaaaaagagaaaaaaaaacccacacgacaaaacgaaaaaaag

SEQ ID NO: 646508 - DNA, 269 bp, Homo sapiens
  misc_feature (243)..(243): n is a, c, g, or t
ttagagatcccgtctcacacccagcatagagtcagtgatgtcacactgagtatcaggtctcaagagagcagttctgtagagcagagaaggatgcaggtgtgctgtgataacactattctagcggatttggagttgtaaggagggaaggagctggatggagatgtgctggttctgggatgaagtccagtgatagaggactggggtcttggcttctcgtggtgatttgcctaagcgaggctgtgnggcatttgggggtgggtggggagcgg

SEQ ID NO: 646509 - DNA, 351 bp, Homo sapiens
gatgagggatccatacggaaagtcagtgctgaagtataacctggggtggtcccctcggtatgtttcgaagggtttggggtctcttttggcttcggtattcccttaaactgtttttccactcccactggggcatttgggaagcgggtcagctagcaggttttcggggatgtcgggagacctagatgaccttatcgggtgcaatactagctaaggtaaagctagaaacctacagggtgcactttcacggagatttctggagtatacttttccattatggccttaaatggtgagcagtaatgtggtttatcgctattggtttctatggcaccagacttttgggtgcaaattatt

SEQ ID NO: 646510 - DNA, 396 bp, Homo sapiens
  misc_feature (54)..(54): n is a, c, g, or t
  misc_feature (119)..(119): n is a, c, g, or t
  misc_feature (247)..(247): n is a, c, g, or t
  misc_feature (307)..(307): n is a, c, g, or t
gccccagcggctgagggcgggcgggcgggcgcccgggggaagggacggggggcncggtccggcgacgactccccgtgacggtgcggtttctcctccgtagctggctgcctgtgtttctngtgcttggtgggtgggctggtgtgttacaggcccctccaatttcccattgaccaaaatggtgctgaaacaatgaaatgaaagccctgaacccaagtgcccaagataaggaacaatgcctgataacccntgccctgccaagtactgcatagggcgctctcatataggagaagaacattctgggcttaanggcccggggattttccctttgggccataaacccaccaatttttttccaaaggggacaaaaacaaccaacaccccacaaggcgccctatg

SEQ ID NO: 646511 - DNA, 116 bp, Homo sapiens
tggagacagggtttggcctggtcatccaggctagagtacaggggcacaataatagctcacggcagcctccaacggctaggctctagccatcctccggcctcagccgggatctccag

SEQ ID NO: 646512 - DNA, 1591 bp, Homo sapiens
  misc_feature (238)..(238): n is a, c, g, or t
  misc_feature (864)..(864): n is a, c, g, or t
  misc_feature (883)..(883): n is a, c, g, or t
  misc_feature (1032)..(1032): n is a, c, g, or t
gtgtataagatgtcgcccccggcgccacagccttctgtggtgaatcacctccctcccccctcaccgcatcggagtagtgcaccacaacatgtgtgtggcaaacaaagcggaaagtttcttgctaatgtttaagtagccgcctccctattcttaaagtgtgctggtagaaaatataaatttggagcacagagggtttctttcgttgttgagaagaaccccccctcacgctgcgtttgcnttaacagcccagcgacgaggggggggtagcgagtctgctcccacaccttagggttgcgtaggtgtgttttttaagaatagtagatacggacgcagttttgtagataatttgtgcgtacgcccccgcgtctttttaatgtgtcccccacgctggtagaggggctctctttgaaaagaagaagttgtggggtgtgtgcagacccactagtggtgtgcggttaatgaaagaatattcttgtcgtcgagaagtacccgcccccccccttgtgggagggtgatgataagttgtcgcgcccccctctcgatgttgttttaggtgctgccccccccccgcttgtattgtatcccccttaggctgtccacagaaaaaattgttgatggttggggatttgatgccgcgaacacatttctgttggtgtagaaaaacaggggggccacccaccttcgggtgaagacaagagaaagttgtgtgtctcccccagctcttccccacggaaatgagtgaatacccacaccaatccttcgtgtgagaggctctttacagaaacaacacatgtgtgtggccatacacataggtctcacacaattatgagaggaccaccaacattctgatatgtgggggttttntctccacaaaactttgtgnttaaataaacccggtgaatttttctccagagaagacccccggttgtctctgaggcaaaatttgttgttcctccctcaagatatcgtaaacgttctctctcctctatttgtgggaaagaacacacacgcggtttacaggcagagaggggnggtatatttctgttgggcccgcccccgagcgaacacattgttatgtgggtctttctcctcaaagagagagtttctttgtgataagagagagagttgtgacacactttgtagaagagacagctgcgccacttttttcgtcacacagaagatactccagagggcacacgatgagagaggtatctctattttccagagagaggacgccactatcttgtgaaacgcatctttcgtccggagacgcacacagtggtgatctccgagtgttacgacacctgggccacgatatataagctgttgtgattagccgactttcacacaggcatatttaaagatctggaaatgccctcttgggtagaacagaccgcggcattttaggaagaataggccccccagcggcacttgatagagacccctcgctcttcagtaagagatagacttcatcttggaaccccttaaggaggataaacaaaaagtggggtgaaaaatccttttttttggaaaaaaagtttttgtttttttaaaaaaggggaaattataaaccaccatggggcaccgggga

SEQ ID NO: 646513 - DNA, 149 bp, Homo sapiens
ccgctggagctcatggcatctgccagtgttaagtgacatgccctgtaacacagcctcagtgtgctcctgacaacatgtgcccaaggtggtcagtgcacagcctggttttatacattttagggagacctgagacaatccaattcatttat

SEQ ID NO: 646514 - DNA, 341 bp, Homo sapiens
  misc_feature (1)..(1): n is a, c, g, or t
naccacatgggttagctcaggtggtcctgtggaagccaattgttccgtggatgctgcggaggagtcgcagaacggtatctttccgtcaggattgcggcagtagttttcatccaaattttagcagcggaagtcttatggtgtcctgttatgtgtgttagcggtctgtgcactccagtgcttacaggtgtgcccgcacacggtaacagccacattccagcgatagttttcacctgttcccttcagacaatggtaggtgggaccagaagatggtgtaggtgttgtccagcggcggatgtcacaaagttaccagcgcatgttagggtcggtggtgaaacagcaag

SEQ ID NO: 646515 - DNA, 303 bp, Homo sapiens
cacgagggtgatctgcgtggacgtgtgggtcatcaacatccggcacttcgccgacccggcccacggtggatcctggatgcgtggcgctgtctactacttcaagatcgccgtggccctgctggtggcggacatccccgatggcctcccggatgtcatcactacatggctggcactgggcacgcggtgcatggcatccaataacgtcatcgtgcgaagccttgcgtccgtggagaccctgggctgcaccgcagtcatctgccccgactcagacgggcacgctcaccaccaatcagatgtctgtct

SEQ ID NO: 646516 - DNA, 119 bp, Homo sapiens
attacgctcctagacggaaagtgttgatattacaggtgtgagccacttgcacttggcaataacttttttaaaaaagtaaccatggccaggcacggtggctcacacctgtaatcccagca

SEQ ID NO: 646517 - DNA, 85 bp, Homo sapiens
tttttgggttttccaagggaatgggcttgcaggatggagtgtttgtaaaatcaccaggaaataaaactgtgtatgagccccggca

SEQ ID NO: 646518 - DNA, 522 bp, Homo sapiens
ctttgtatagtctgcagatatggatcctgactcctgcaagaaatagctcaccgtgacaaagctgcccttgcttttatcgatttgcaaatcaaagaagggggacatgttgggagcaggccccccacccccccaaaatctggccataatctctgcagcactatgacatgttcatgacggccataatgcccacactggaagattgtgggtttatgggaatgagggcaaggaacacctggcccacccagggcggaaaactgcttaaaggcattcttaagccacaaacaatagcatgaacgatctgtgccttaaggacatactcctgctgcagttaactagcccaacctattcctttaattcagcccatcccttcttttcccataagggatacttctagttaatttaatatctatagaaacaatgctaatgactggcttgctgttaataaatacgtgggtaaatctctgtttggggctctcagctctgaaggctgtgagacccctgatttcccacttcacacctcta

SEQ ID NO: 646519 - DNA, 169 bp, Homo sapiens
gctctaggttatagggaatatctagttttttactttttgacgctcgttaaaaccactgacgaatacctagcaaattccgcgtcatgtggcatcgtgtactcgcactgtgacgttggaaatcttgtgattcctccctgtccagccggccctagaacacggaatttgctag

SEQ ID NO: 646520 - DNA, 636 bp, Homo sapiens
  misc_feature (138)..(138): n is a, c, g, or t
ggcacggggtccttgggtcggtaggcgcgctgagaattcctgagggccgtggccctcggctacatgcatgccatgcgcgcatactgccgtctggcgggcgctgtggctgcagcccaccgttctggggcccaagtccanccgttcgcaaaaggcgggaccccggctcattcaccggaaaatttgcttttacaccgggccaaagggggctggggccccccaccggccccaatttttgggcttgggaagccggtgataatggggttccgggacccccccccccccagaaggggggggtgaaatccccccccaattcctccagccccggagtcggcccaaacctggtgtttacggggtgcccaattcttaatcggggggggggaccccccgtttgggccgggggaccttttttttaaaaattttcccaaaaaacccttgtggttggtttggtacaaaacaccggaggtttctcaggccccttaataaaactaaaaaagggggtaaaacaaaatccgagggacaccttggggggctttttcacccttttgctgggggccccgttgcccccccaggagtgggggggttttcccccttttttttaccgggaacctttttttggttctttcacggggctttttt

SEQ ID NO: 646521 - DNA, 432 bp, Homo sapiens
  misc_feature (33)..(33): n is a, c, g, or t
ccggatatccccaaaattctggaaaaaatcccnaaaattcaaaaatgccttcctggcccccaagcatttcaaaataatgatattcaaccctgtaatataccttaaagggccccacaggaaggcatcattaaacaaaaacaagttgagggcccaggcgcagtggctcacacatcaaaacttcaggatgcctaaggtgggagtacccacttgaggcccaggagtttgagatcagccctgggtaacataaagagaccccatcccctacaaaatgtacagaaattagccctggtatgatgacatgtgtctgtagtcctagctactgaggaggctgaggcagaaggattgcttgagtctagaagttccagactgtagtgagctgtgatcgcaccaccgcactccagcctgggcaacagagtgagatcctgtctataa

SEQ ID NO: 646522 - DNA, 476 bp, Homo sapiens
  misc_feature (436)..(436): n is a, c, g, or t
  misc_feature (452)..(452): n is a, c, g, or t
  misc_feature (475)..(475): n is a, c, g, or t
tgagctggaggtatctgagcgtttgagtcaacctggagtggcaatagggttagcatggactcccttgggtggcaaaatcatgtttgtggaagcaagtagaatggacggtgaaggccaactaacactgaccggccagcttggggacgtcatgaaggagtctgcccatctcgccattagctggcttcgaagcaatgcaaagaaataccacctgactaatgcttttggaagttttgatcttcttgacaacacagacatccatcttgcacttcccagctggagcctgtcacaaaagatggaccatctgctggtgttaccatagtaacttgtctcgcctcacttttcagtgggcggcttgttgcgctcaagatgtagccattgactggggaaattacgctgagagggctttgttcttccagtgggtggaattaaagacaangtcctagcagcacacngagcaggactgaagcaggtcatng

SEQ ID NO: 646523 - DNA, 178 bp, Homo sapiens
ggtgtctcgggaccccaagatgagtggtgcccgtgcgccgcgaccccagcccagcgtagcccagcccatcggttggcttattcagggcttggggacccagttgcgttcgtcatctctctcaaccttccttcccctgtctaaaaaggccatcggggagttcaatttgtgtgtgacacag

SEQ ID NO: 646524 - DNA, 126 bp, Homo sapiens
acatatcggaaggacgtggacagagtgacctgtctcaagcaggaagctggggatggggagcaccccaggatgcatcgacataacaagcagtggagaagtcgggattcgaactgactatcagggcac

SEQ ID NO: 646525 - DNA, 84 bp, Homo sapiens
  misc_feature (61)..(61): n is a, c, g, or t
tctaagagatgcaagaaacagtctttttacaggtgatacacttggggctggccaattcagnttccagaggcccttattagtcct

SEQ ID NO: 646526 - DNA, 163 bp, Homo sapiens
ggtagacgattatatcccactatgtagccatgactggtcttgaactcctgggctcggtgatcatcctgccgtggatacccaaagtactgggattatatgcttgagccagcgtgcctggcctgtgatcagatttctcatttttttagtcactaaacatgctggt

SEQ ID NO: 646527 - DNA, 116 bp, Homo sapiens
  misc_feature (31)..(31): n is a, c, g, or t
  misc_feature (82)..(82): n is a, c, g, or t
  misc_feature (91)..(91): n is a, c, g, or t
ggcactcgcacctgcgctgtccgcgcgcctnttttcgcgccgcagccctgccaagctgcatgagctctacgagaaggttttntccaggcgngcggaccggcacagcgacttctccc

SEQ ID NO: 646528 - DNA, 482 bp, Homo sapiens
  misc_feature (347)..(347): n is a, c, g, or t
  misc_feature (459)..(459): n is a, c, g, or t
agcgccgagcattatacataaaacatagctcagtatatcagatgagaaaagggcttaatactgggtaatcatccacaccgttatagagtacataaatccggggaaagacatcagttccaaaaattaaaaggtaatgaatgacagtgacataaatttatctgtaaataatagtaaaattttcttataaaaatcaaataaccggacaggcgtggtggctcatgcctgtaatcccagcacttttccaggtcaggggaggcagatcacttgaggtcaggagtccgagaccagctgggccaacagggtgaagtcccgtctctacggaaaatacaaaaattagcctggcgtgntggtgggcgccggtaatcccagctactcgggagggtgaggcaggagaatcacttgaaccggggaggcagaggtggcagtgagctgagatctggccacggcactccagccggngcgatagagtgagaccctgtctt

SEQ ID NO: 646529 - DNA, 103 bp, Homo sapiens
tgtcgcccctcttcctctgccttgccctaaaatgtgggcatgtcccatgcaagggtcttgagccctcctcattctcttatccacactctctccttctcgcagt

SEQ ID NO: 646530 - DNA, 1000 bp, Homo sapiens
gaggagttctccaaacccgcgctgcggaggtgagtgaccaagttccggccagttcgacctcgaggatccagaggtggagactggtactagctcccagctctgttttcacataccccttcaggtccttcctcgtggaggctggctgaagtgctggtccacactcgtgctgcgtgatcctgttatgacctcggaccacctgtctgccctccctcctgtgggtggaacttcacacaccatcacctgaccaggacttaagactgaggatcgtttggatctctggcaggggtgcagaactgagcccaggaccatcagtaccctattcacagctcctgtgctatgattgcccaatggtgggcaaattggcggcattccatgttgttctacgtggcacactggggcagaacgactgcctctgaatctggttctgtggtaccatgtgcaaggaagtggaggccctgggttcaagtgtaaccaaggcaggatgtctacaagtatgcccttatgcgtaggctaccagacaaacattggattgttgctgctatacatacggcaatgagcgctgagataggggaggccctgaaggaggacagtgggaccaggccaaggctgcgatgcctacggggacggagacatgaaaccggagaacagtcacaagcctggcgcgacacaccaaaagaaaccaagccccgcagggcacagtgagagccgtgcccatcgccggaaagcactactgggcctgacgcaccaagcgcgggacgacatcgtggaagcccagtaccctgcatgccaacagagcccacaaagaacctaacgaacacgcagggcagaaccaaacccccctaacacccccaaaagaaatggctggaccagggaacaaaacgacgcaacgcatccggacccacaacacagggaagaccaccgcgccaagcggccctcggcaggaccactgggaggcgctcaagggggactagtgccaagcagcccgaggacacggagcaaa

SEQ ID NO: 646531 - DNA, 130 bp, Homo sapiens
cggtggctctgcgccgccaggccttccaggtgcgcctggtgctcgtgcgtctgtgttcgggccggtactcgcgcatgcggaccgccctgccgccgctagagctgctgcggtgttcagctggtccgtgtag

SEQ ID NO: 646532 - DNA, 250 bp, Homo sapiens
ttctcagtgagttaaaccattaccctgttaaatggagtttgcaagaagccgtttggagctagagcaggacttgctatagacgccaagcagattccaaatggcatctcctcaaaatgagaggagaaacacagagctagagaaaggctatccctggggaagtaggagagaccaagcccatgttctacgggaggaggcaggtaggtctgtgctgcgtctctctccatctcagctgtggatgaagatgcagcca

SEQ ID NO: 646533 - DNA, 414 bp, Homo sapiens
ttcgcttgtggtcgatctctagcacggatcccccagcaagaatggcatatcagtggcttgctgaataaaaattcggataatatgtttgttaaaaagacaataaagaataacgcggtggaaaatccttagggtattactcgtgaacctaccacgttcaaaagcagattggtgacctttgattaattccatttacttatgtagtgagctaaaaggaggctccaagacagagtttggttcccaacatgtgtccgttgcccacagggcacactcagaaggtctcctcctctcgtagtaactgtaacacggatgacatagtgaagcctggctctggatctcagggcttcctgtggtgagtgactatcatatgtttaaataggtcggtaatggtcattgggtttgagaactgtgggtttc

SEQ ID NO: 646534 - DNA, 108 bp, Homo sapiens
atggaattcaatggaatggaatcatccggaatggaatggaatggaatggaatggaatggaatggaatcaacccgagtgcaatggaatggagaggaacggaatggaatg

SEQ ID NO: 646535 - DNA, 223 bp, Homo sapiens
catgagcccagactttacagtcttcatgatcaagtatctcatgacgctgattgtgggcatcacatcgggcttctggatctggtccggcaagacactgaattcctggaggaagttctacacgaggcttaccaacagcaaacagggggagactaccgtctgaaacccagactcttaccgttacccgttttttggcccgatccgtagccatcgccctgggaaaggg

SEQ ID NO: 646536 - DNA, 655 bp, Homo sapiens
cgtcgagctgttctagagtatccctggtgtacgcaactggatgacttgatgttgaggcgggcagaatgtcttccacggtctcattgccttctgagatgatgcccacacctttggcaatagcatttagcgtgtgatttggatggtctccttgtgaccatgcatgacctataattccatgcacttctgacattttgcccacgtgaatcagtgaacggcctgccctgtgaaggggtcaactcaatggatgatgcatgcccaacaaatgcacatgattatctgatacgggaaattcacattcgtcatgtgtcaacactggaacccttatcaggaaaacttgttcatcttggcagaacagaggtggcagaaaacctaggactcgttctcctgtggccccccagctccaaataggcgtcctgaagggcgtctttcagctcctcatccaggggctgctccttgccgtggaggaggatagagctgcaacggtcctaggatccttttctggggcgcccttcatcaccaacaggtgttggggctcagatgtgttggggttcttatgaatagacaactggtacttgttggtggagttgaagggtatctcgacgatttggggaatcttctctcatctccttcagggaacacagcaagtctatgcact

SEQ ID NO: 646537 - DNA, 316 bp, Homo sapiens
  misc_feature (44)..(44): n is a, c, g, or t
  misc_feature (52)..(52): n is a, c, g, or t
  misc_feature (96)..(96): n is a, c, g, or t
  misc_feature (215)..(215): n is a, c, g, or t
  misc_feature (221)..(221): n is a, c, g, or t
  misc_feature (259)..(259): n is a, c, g, or t
  misc_feature (290)..(290): n is a, c, g, or t
  misc_feature (313)..(313): n is a, c, g, or t
aagggagttcctaggattaaccatctttctaatggctgggagcnatgactcntgcctgtaatcccagcactttgggaggctgaggcaggtggatcncctgaggtcaggagtttgagaccagcctggccaacatggtgaaactccatctctactaaaaatacataacttagctgggtatggtggcaggtgcctgtagtctcagctactcgggaggntgaggnaggagaatcgcttggacccaggggggagaggttggagngaaccaagtttggggcaatggaatccaggcnggggtaacaagggaaaatcttgnctt

SEQ ID NO: 646538 - DNA, 199 bp, Homo sapiens
  misc_feature (15)..(15): n is a, c, g, or t
  misc_feature (57)..(57): n is a, c, g, or t
acaggatctcgtgtnatgcacttggacaccagtcgataatagagtaggagtcgtacnaaatatgcaattttttttaatggtactttctgtgtcgaagttggaggatggtatctttattggtcctctccttggtgcaatgcaccaaggaggtccttggccaatcttgccatccactttgtagtggatgtcaagatttgga

SEQ ID NO: 646539 - DNA, 573 bp, Homo sapiens
agctggtgtagccgtggacgccgatgtccagttgtttaactgcacgagccaagtcctgagggctgtgtacagcgatcagtgttagcggtcccactttctgtagtcttcctcatggtactccttataggggccctcaaacacccgctggatctcttccaactggtactcacagatggccgacaggttacatgtcaccgccactgtgcttgaaaaaccccaaagaaggtggtgttgttgccagagcatgtgtcctggcatggtgtgcttcgcctgcagctggttgaagtaaatctgtcagtgcggggcagagcatgccaaccgcgccttcaggaacgtggtccacttcctctgcaggttccgtgcgccccccatatcgcccttgcagacacgggccacactgagccgatcacctgctcggcatagcagtcggactccactgcccgctccctgaagaaaaagtagaccttatcgtcgtcccccgtgaagctgtccaaactctcaggtacattggcagagcctacatcgtgaggttcgttgacccagaaggccatgttctctgtcttcatggagtga

SEQ ID NO: 646540 - DNA, 711 bp, Homo sapiens
tgtacttactcatcacccaagcttcaacatttatcaacatcttgccaatcttactgaatctatccttccttagcttttataaaaatgtttcctagaggtgtgtcaaagctcatcccagaatgtcctaatgtatctagtaaatgcttctgcacaattctaaaagacaaggatgtttttaaacccagccccgacactatcatacctcacaagattcatgctaattcctcagtgtcttctagatcccaagtccatgctcaagtgtccccccctgtccaggcaccctcttcaggggtcctccatgtttcatagcgagaaggggccctgagagattgggcaccccgggcaggctggctggagggggctttggaaaggaacggctttggccagcgtgtgatgggctgcaggtctcaccagcatccatgttcggatctgttatcacgcgaacaaatgtggttatactaggcggctgcgcggtgctgacgaacatggaaactgtaagtcggctacgaggccaaggcaggcgtaggctaagggtggcgggctgggggtaggagatgaggtccaggaactcaggctccatctctcacatcctagtcccagagtagcccctgggctctgggaaagccctgagcgatttgtgggaactcatgcgggcctgagtgcccagacccctgcggagtacaccaggctcacccacaatcatgggcaccg

SEQ ID NO: 646541 - DNA, 117 bp, Homo sapiens
  misc_feature (1)..(1): n is a, c, g, or t
ngtagaaataattttcttttttggcgacacgggcttgttctatgacccaggtatgagtgcagtggcgtgatcacagctcactgccgtcttgacctcccaggctcaagcgatcctcca

SEQ ID NO: 646542 - DNA, 216 bp, Homo sapiens
agcagactagtgctgtgggaggaatgggggattgggaggtgatggctaaggggttatggggtttgggggaggtaatagaaatgttttaaaattggttgtgaaggtggatgcccaactctgcgaatacactaaaaggcatcgaattgtatactttaaataggtgaattgtatgctatgtgaattatatctcaataaaggtattttttccctgctgtt

SEQ ID NO: 646543 - DNA, 100 bp, Homo sapiens
gagacatctattgcttctccatcccagtataatcactattaacaatttctcatccttaaggatgagaaattgggggctccgtgaagtcagaaacagtaac

SEQ ID NO: 646544 - DNA, 490 bp, Homo sapiens
tcattagtaactacataagatgcatccaagatgagaatctataacatgcatctcagaatgggtactatgctgatgttttcaattagtcttcaatgccattttccaattacagtgttttctactgaagtttgaaaccccccataaaggcagaaatgagcctctcttcccctgaaacctcccattatggcaggaatgagcctctctttccctgaattcctagagttctacaatggaaaggctaaatctgtggtagctccattcattttaactttgcctctggggagatggtgaacctttcctaatggactttgcttgtactacctttgtgatctatcatattctgttgtttctggtaaccatttacacgtatgacaatagatttttaagttcatcaatggcaggaatggtattttatacattcccaagttttaagatgtgcttttaaaaaagatgggaccaggtgcagaggctcatgcctgtaatcccagca

SEQ ID NO: 646545 - DNA, 572 bp, Homo sapiens
tgttgtcgtgcaggtagaggcttactagaaagtgtgaaaacgtaggcttggattaaggcgacagcgatttctaggatagtcagtaaaattaaaattgtgaaaatgataaggtgtaaagggaaggttaagtggttgatattgcttaggggtggcgcttccaatttagggtgcagtgagttagggtggccgtgcagtaagtgttagcggtttaggcgttacggccagggctatatgtggtttagaattgagtatagcgctgtgagtggtttccgatataatatacacatagttatgtggggcattaagggggtgttaggtgtgtgtgcctttggtggttaaaaagtgtgggcttagggcatttttaaactctctttaaacagcgcaaacctctattaatccatctgcgccccgcctccataaaagggagattggccatgggtctaacggtgttatataaaataagttgggtgtgggttcgtggtgtaatatggattggaggcaggagtccgagaggaagtgttaatgtatggtggcgacatcaaacatatggattcaagcgatcactaatgttt

SEQ ID NO: 646546 - DNA, 726 bp, Homo sapiens
  misc_feature (169)..(169): n is a, c, g, or t
  misc_feature (180)..(180): n is a, c, g, or t
  misc_feature (189)..(189): n is a, c, g, or t
  misc_feature (211)..(211): n is a, c, g, or t
  misc_feature (281)..(281): n is a, c, g, or t
  misc_feature (286)..(286): n is a, c, g, or t
  misc_feature (607)..(607): n is a, c, g, or t
  misc_feature (681)..(681): n is a, c, g, or t
cggaagtcccgtctcacggttgccctggcagcgcgcgaggctggtgagtcggcagccctgtggcagccggcgggctggtttccatggttgcacgattaggaaccaccagctgctgcatcccatggccagtggtggcgtccaggtggcagagcagctaggaacgcaaggnctgaacctggngccagacancctgctctcccggccatggtcnacgaccctccagtacctgccttactgtgggcccaggaggtgggccaagtcttggcaggccgtgcccgcangctgntgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcattgagctgccagagtcccctgtgaatcaagatttgggcatgttcttggtcaccatttcctgctacacnagaggtggccgaatcatctccacttcttcgcgtcgtgatgctgcattaccgctcagacctgctccagatgctgnacacactggtcttctctagcctcctgctggtaccgagctgatata

SEQ ID NO: 646547 - DNA, 164 bp, Homo sapiens
cttcgagataatcccgtgtatagaagaggccgtccctcagtgagtcgctgacgtaacttgggagtttcttgtagaagggggaatctgcgtatgcggtcagtgacaccgaggcttgatctccagccttcgcatgaatttcatttactgcgtcagccttcgcgggg

SEQ ID NO: 646548 - DNA, 1596 bp, Homo sapiens
gctcctgtatgcctgccgcctgccgctgacctgccgtccctctgccagcagctccgtgctgccacctctgtggcctggctgtcttcctgtgctgggctgtggagccagtgctgctagactgtgtgctgctggcgtggtgtgctggcctgagctgctccatgctgtgcttgcgacctcagtgctcctggcagtctgctgtcttcccacatggtggcttggaccatgcctgagaagccattggagcacgctcgtgaagactttgtcaacttgacttgttcccacatgtgtgccaacacctgcacgaacgcgtcgactcttctggcaaactctcgctaggacgacggtatatgcacaattatgtaggacgcacatgctaggaccacatatactcctttgtcacatgttccaaatcctcgttataagactttatcacacactcatgggaagaaccatatcaacgcaacacacttccatttgcaacccacacctcttgggctcaacttgcacatagacagtatggaactttgaccaagccttaccccatccgcaattgacaccagcggctctacccaccttcgtccccaaaggcgcaccacatctcctgcgcaagcccaaggaagacacactttacacattggacacgctaaatccatatacctttcctttgacattcgcactcaacgctgcaaattccccccatatactcaacttggctggcgagccaaggaaacccattgggtggcacgccaaccaatttttccgttaaacgacgcaaagccaatcaatttcctatggacgacggctggaagattaacagacaagggccatcctttaccccccttcggctaggttacaagcccacagcagattatcatcacaattgcgcggcgttccagacacatgggtacaactaggaataaagagacaaaacaagagccaaattacggatcgacacgcaaacccccctttgggcctttggcaataaaccctggcggagaaccacaggcgaacatactgagaaccattgagtagacctaaacccacaatagaaaactttgcgacaacattcacccaacgcatctggtgattggccaacaaacggtactttggagactacgcggttggacccttcccacaatcaaagacagcacgacacttcacactctacacttgcccacaaccaatccccttttggtaagcacaacacaaacgagataatttctttccacaacacgtaaaaacgctatcattgccactagcccaacaccctaaaagtggggacaagtctccccagcaacattgaattgcaacatctactgcagaaaccgtatcgcaacaacagtcaacctccaaactcaaaccacctgagaaaagaaaacccaaagattatccccataatatacacaaaaactaggacaacgacatgccacatatttacacccgatcacacatcattatccaacccacaccacctgagagacacaacaacgagagatcacaaacatgcgaaaccatacaactcacaaaataccacacacatcgatcaacatatcacaaccatcgtccaacaaacagctccgatctccacacgtatca

SEQ ID NO: 646549 - DNA, 2465 bp, Homo sapiens
ctgccccctcctcgggggcaaaggctttgtgaccaagcagacgacgaagcatgtccaccaccactacatccaccaccatgccgtccccaagaccaaggaggagatcgaggcggaggccacgcagcgggtgcactgcttctgccctgggggcagcgagtattactgctactcgaaatgcaaaagccactccaaggctccggaaaccatgcccagcgagcagtttggcggcagcagaggcagtaccttgcccaaacgcaatgggaaaggcacggagccgggcctggccctgcccgccagggaaggaggggcccccggcggagctggggccctgcagcttccccgggaggaaggagacaggtcgcaggatgtctggcagtggatgctggagagtgagcggcagagcaagcccaagccccatagtgcccaaagcacaaaaaaggcctaccccttggagtctgcccgctcgtctccaggcgaacgagccagccggcaccatctgtgggggggcaacagcgggcacccccgcaccaccccccgtgcccacctgttcacccaggaccctgcgatgcctcccctgaccccacccaacacgctggctcagctggaggaggcctgtcgcaggctagctgaggtgtcgaagcccccaaagcagcggtgctgtgtggccagtcagcagagggacaggaatcattcggccactgttcagacgggagccacacccttctccaatccaagcctggctccagaagatcacaaagagccaaagaaactggcaggtgtccacgcgctccaggccagtgagttggttgtcacttactttttctgtggggaagaaattccataccggaggatgctgaaggctcagagcttgaccctgggccactttaaagagcagctcagcaaaaagggaaattataggtattacttcaaaaaagcaagcgatgagtttgcctgtggagcggtgtttgaggagatctgggaggatgagacggtgctcccgatgtatgaaggccggattctgggcaaagtggagcggatcgattgagccctggggtctggctttggtgaactgttggagcccgaagctcttgtgaactgtcttggctgtgagcaactgcgacaaaacattttgaaggaaaattaaaccaatgaagaagacaaagtctaaggaagaatcggccagtgggccttcgggagggcggggggaggttgattttcatgattcatgagctgggtactgactgagataagaaaagcctgaactatttattaaaaacatgaccactcttggctattgaagatgctgcctgtatttgagagactgccatacataatatatgacttcctagggatctgaaatccataaactaagagaaactgtgtatagcttacctgaacaggaatccttactgatatttatagaacagttgatttcccccatccccagtttatggatatgctgctttaaacttggaagggggagacaggaagttttaattgttctgactaaacttaggagttgagctaggagtgcgttcatggtttcttcactaacagaggaattatgctttgcactacgtccctccaagtgaagacagactgttttagacagactttttaaaatggtgccctaccattgacacatgcagaaattggtgcgtttgttttttttttttcctatgctgctctgttttgtcttaaaggtcttgagggttgaccatgttgcgtcatcatcaacatttggggggttgtgttggatgggatgatctgttgcagagggagaggcagggaaccctgctccttcgggccccaggttgatcctgtgactgaggctccccctcatgtagcctccccaggcccagggccctgaggcctgctagaatcactgccgctgtgctttcgtggaaatgacagttccttgttttttttgtttctgtttttgttttacattagtcattggaccacagccattcaggaactaccccctgccccacaaagaaatgaacagttgtagggagacccagcagcacctttcctccacacaccttcattttgaagttcgggtttttgtgttaagttaatctgtacattctgtttgccattgttacttgtactatacatctgtatatagtgtacggcaaaagagtattaatccactatctctagtgcttgactttaaatcagtacagtacctgtacctgcacggtcacccgctccgtgtgtcgccctatattgagggctcaagctttcccttgttttttgaaaggggtttatgtataaatatattttatgcctttttattacaagtcttgtactcaatgacttttgtcatgacattttgttctacttatactgtaaattatgcattataaagagttcatttaaggaaaattacttggtacaataattattgtaattaagagatgtagcctttattaaaattttatatttttcaaaaaaaaaaa

SEQ ID NO: 646550 - DNA, 2270 bp, Homo sapiens
ctgccccctcctcgggggcaaaggctttgtgaccaagcagacgacgaagcatgtccaccaccactacatccaccaccatgccgtccccaagaccaaggaggagatcgaggcggaggccacgcagcgggtgcactgcttctgccctgggggcagcgagtattactgctactcgaaatgcaaaagccactccaaggctccggaaaccatgcccagcgagcagtttggtgcccaaagcacaaaaaaggcctaccccttggagtctgcccgctcgtctccaggcgaacgagccagccggcaccatctgtgggggggcaacagcgggcacccccgcaccaccccccgtgcccacctgttcacccaggaccctgcgatgcctcccctgaccccacccaacacgctggctcagctggaggaggcctgtcgcaggctagctgaggtgtcgaagcccccaaagcagcggtgctgtgtggccagtcagcagagggacaggaatcattcggccactgttcagacgggagccacacccttctccaatccaagcctggctccagaagatcacaaagagccaaagaaactggcaggtgtccacgcgctccaggccagtgagttggttgtcacttactttttctgtggggaagaaattccataccggaggatgctgaaggctcagagcttgaccctgggccactttaaagagcagctcagcaaaaagggaaattataggtattacttcaaaaaagcaagcgatgagtttgcctgtggagcggtgtttgaggagatctgggaggatgagacggtgctcccgatgtatgaaggccggattctgggcaaagtggagcggatcgattgagccctggggtctggctttggtgaactgttggagcccgaagctcttgtgaactgtcttggctgtgagcaactgcgacaaaacattttgaaggaaaattaaaccaatgaagaagacaaagtctaaggaagaatcggccagtgggccttcgggagggcggggggaggttgattttcatgattcatgagctgggtactgactgagataagaaaagcctgaactatttattaaaaacatgaccactcttggctattgaagatgctgcctgtatttgagagactgccatacataatatatgacttcctagggatctgaaatccataaactaagagaaactgtgtatagcttacctgaacaggaatccttactgatatttatagaacagttgatttcccccatccccagtttatggatatgctgctttaaacttggaagggggagacaggaagttttaattgttctgactaaacttaggagttgagctaggagtgcgttcatggtttcttcactaacagaggaattatgctttgcactacgtccctccaagtgaagacagactgttttagacagactttttaaaatggtgccctaccattgacacatgcagaaattggtgcgtttgttttttttttttcctatgctgctctgttttgtcttaaaggtcttgagggttgaccatgttgcgtcatcatcaacatttggggggttgtgttggatgggatgatctgttgcagagggagaggcagggaaccctgctccttcgggccccaggttgatcctgtgactgaggctccccctcatgtagcctccccaggcccagggccctgaggcctgctagaatcactgccgctgtgctttcgtggaaatgacagttccttgttttttttgtttctgtttttgttttacattagtcattggaccacagccattcaggaactaccccctgccccacaaagaaatgaacagttgtagggagacccagcagcacctttcctccacacaccttcattttgaagttcgggtttttgtgttaagttaatctgtacattctgtttgccattgttacttgtactatacatctgtatatagtgtacggcaaaagagtattaatccactatctctagtgcttgactttaaatcagtacagtacctgtacctgcacggtcacccgctccgtgtgtcgccctatattgagggctcaagctttcccttgttttttgaaaggggtttatgtataaatatattttatgcctttttattacaagtcttgtactcaatgacttttgtcatgacattttgttctacttatactgtaaattatgcattataaagagttcatttaaggaaaattacttggtacaataattattgtaattaagagatgtagcctttattaaaattttatatttttcaaaaaaaaaaa

SEQ ID NO: 646551 - DNA, 455 bp, Homo sapiens
agctatatccctttcttaaggtgtataatattaaagcagctgtgacggagtggaaaaaaaagaggatccgcacactccgcgatgaggtgaaaataggagcacatgggacaccagtgacccttgtccattctaaagactgtggtggaggccttgtggaactggagcaagcttgaattatatttgcaagcaactaaattaattgacctgaaaaagcctatcaaatactatcaaaatgtactatgacattgagtccttcactgtttccatcatgtaaaagatcacagttcaagactgagttacagaaagagtaagatatatacatatatcaatacataaagatgtatattatgtagattaacaaacatatttgttaattcgaatttgaagaaaatcttgattactaattacttagggaacattattaaaatcatattgaaataaattattcctcttct

SEQ ID NO: 646552 - DNA, 2337 bp, Homo sapiens
ctgccccctcctcgggggcaaaggctttgtgaccaagcagacgacgaagcatgtccaccaccactacatccaccaccatgccgtccccaagaccaaggaggagatcgaggcggaggccacgcagcgggtgcactgcttctgccctgggggcagcgagtattactgctactcgaaatgcaaaagccactccaaggctccggaaaccatgcccagcgagcagtttggcggcagcagaggcagtaccttgcccaaacgcaatgggaaaggcacggagccgggcctggccctgcccgccagggaaggaggggcccccggcggagctggggccctgcagcttccccgggaggaaggagacaggtcgcaggatgtctggcagtggatgctggagagtgagcggcagagcaagcccaagccccatagtgcccaaagcacaaaaaaggcctaccccttggagtctgcccgctcgtctccaggcgaacgagccagccggcaccatctgtgggggggcaacagcgggcacccccgcaccaccccccgtgcccacctgttcacccaggaccctgcgatgcctcccctgaccccacccaacacgctggctcagctggaggaggcctgtcgcaggctagctgaggtgtcgaagcccccaaagcagcggtgctgtgtggccagtcagcagagggacaggaatcattcggccactgttcagacgggagccacacccttctccaatccaagcctggctccagaagatcacaaagagccaaagaaactggcaggtgtccacgcgctccaggccagtgagttggttgtcacttactttttctgtggggaagaaattccataccggaggatgctgaaggctcagagcttgaccctgggccactttaaagagcagctcagcaaaaagggaaattataggtattacttcaaaaaagcaagcgatgagtttgcctgtggagcggtgtttgaggagatctgggaggatgagacggtgctcccgatgtatgaaggccggattctgggcaaagtggagcggatcgattgagccctggggtctggctttggtgaactgttggagcccgaagctcttgtgaactgtcttggctgtgagcaactgcgacaaaacattttgaaggaaaattaaaccaatgaagaagacaaagtctaaggaagaatcggccagtgggccttcgggagggcggggggaggttgattttcatgattcatgagctgggtactgactgagataagaaaagcctgaactatttattaaaaacatgaccactcttggctattgaagatgctgcctgtatttgagagactgccatacataatatatgacttcctagggatctgaaatccataaactaagagaaactgtgtatagcttacctgaacaggaatccttactgatatttatagaacagttgatttcccccatccccagtttatggatatgctgctttaaacttggaagggggagacaggaagttttaattgttctgactaaacttaggagttgagctaggagtgcgttcatggtttcttcactaacagaggaattatgctttgcactacgtccctccaagtgaagacagactgttttagacagactttttaaaatggtgccctaccattgacacatgcagaaattggtgcgtttgttttttttttttcctatgctgctctgttttgtcttaaaggtcttgagggttgaccatgttgcgtcatcatcaacatttggggggttgtgttggatgggatgatctgttgcagagggagaggcagggaaccctgctccttcgggccccaggttgatcctgtgactgaggctccccctcatgtagcctccccaggcccagggccctgaggcctgctagaatcactgccgctgtgctttcgtggaaatgacagttccttgttttttttgtttctgtttttgtgttaagttaatctgtacattctgtttgccattgttacttgtactatacatctgtatatagtgtacggcaaaagagtattaatccactatctctagtgcttgactttaaatcagtacagtacctgtacctgcacggtcacccgctccgtgtgtcgccctatattgagggctcaagctttcccttgttttttgaaaggggtttatgtataaatatattttatgcctttttattacaagtcttgtactcaatgacttttgtcatgacattttgttctacttatactgtaaattatgcattataaagagttcatttaaggaaaattacttggtacaataattattgtaattaagagatgtagcctttattaaaattttatatttttcaaaaaaaaaaa

SEQ ID NO: 646553 - DNA, 380 bp, Homo sapiens
  misc_feature (189)..(189): n is a, c, g, or t
  misc_feature (209)..(209): n is a, c, g, or t
  misc_feature (275)..(275): n is a, c, g, or t
tactcctcaatcgctttgccgatggtcggcgtgtaaacgattgcaagcatctcctcaatatgctcggcaaggaggcggaaatacagcacctcattgcggtcatgcatgtggttgaggtacaggtacttggctaggtcatcaggctgcgccgaatactgtgcgtagacccgcttgagctgatcagtgatngtcatgacacccgacggcancaggccggtgagaccaagcgcctttcgctgctcgatagtgaaggcagtgccccgattggccagagngttcgtcaacacctcctggccacgggccgcaatccttagaaggcctccgtcgtcatcatgcgcatactgaaagggaactgacatatcccttagcttatgcggtca

SEQ ID NO: 646554 - DNA, 573 bp, Homo sapiens
  misc_feature (24)..(24): n is a, c, g, or t
  misc_feature (174)..(174): n is a, c, g, or t
cggcacgaggaccgcatcaacatntacgactggggagatgatgtgagattccacagcagccccagccagccgaggccccagtgcttctgtgttcctgagggctgatccctgcggctataaaagagcacacgcgaggtgtggggtgcgggtacaggtgtcagaaccggcctcggntacagccgagagcaccctcctctgtccaggagaccaccccaggttcttgaccgtctggcctctgggcagtgtggcggcccctctccctccctctgacctgtccagcgtagttgcagcttgcagtggggctcccagggctcatgctgagcatcaggaggtgaatctcggctccaacagccctcgtggccttgggagatgctgccctttctaaacctgaactttttcaagtgtaaaaatgaggatatttaattttctgagatgtttcaggtactaaatatgaaataattaaaggaattttggaaaaggacaaagctttatgcagtataaggaatgtcctgaagttgaaacttatgtacatattttgatcaaaggtgaaataaaattgcatttaaatctgca

SEQ ID NO: 646555 - DNA, 201 bp, Homo sapiens
atgatctaaggatctttggcgaatcctcctcctcctgggcgtaatacttgagcccgggagtcgagaccagtctggccaacatggtgaaaccttgtctctactaaaaaatacagaaaatttgccaggtgtggtggtgtgcactctgtaacccctagctactccagtaggctgagtgcagcgagaatcacgtggaacccgatg

SEQ ID NO: 646556 - DNA, 185 bp, Homo sapiens
taaatgaaaggttttcctggcgggtgtggggggcccacttttgggccggggggggttccaaaaaaaggaccctggtttcttttcccaataggttgactgggctttcccctgcccaacatttgtgctggaatccacagagggttggccttgcagggccctgctttgaggggcccctggcttttgct

SEQ ID NO: 646557 - DNA, 641 bp, Homo sapiens
gatctccctgagcatcaggctgccaggtgcgcgtctctggtgagcctctcacgttggcgatagctgcgtcgtaggagacaatgatgtctaaaggtcggattggctgcccatggctaaaaatcgaagagttgagcagagacacgtatcgagtaaatccggagggggatcatgatgctgcattactggtgtgctctaacggttacgtgaggaaccgaagaccagcaacgctctctgaagtttacgaccgcacgcgtgtgagacgcactgcaggcaggcgcttctcaatttgaaacgagcgcagccaagttgaagaggaaatatggtggaagaattgcaagatgtgggcaatcgggattactgttctggttatcttcatcatcatcatcatcgtgtgggttgtctcttcatgaagaaccagcggaactcaaaactgctgtctcaagaaacctcttcaagactttgacttagaacctgctatattatcaagcttacctactgttatctctaaaattataaggtgtcaactgtaagagttgacattctctaggaaacgtgccttggtatattaattatgcaactccaaattagaaggcggcccgttccacattttgcaccagggccttacaggaattcacgtatgg

SEQ ID NO: 646558 - DNA, 551 bp, Homo sapiens
aaaaaaaaaaaaaaaaaaacaaaaaaaacaaatcttaaaattaaccacacaaaaaaaaaaaaacaaaaaaagggcgataaataaataaaaaatcgcaaaaaacaaaacaaataaaataaaaataccctttttccgccctttcccccacatcatttttaaatctcaccaacttatcccatccgccccaattccaccctcattggccaattcccccttataggaagcgttttaaaattcaatcgcccggtttttaacaccgtgcacctggaaaaacccttgctttcccaaaattaaatccttttgaaaaaaattccccttttccacattggcttaaaacaaaaaaagccccacccaatcccccttcccaaaattttgcccacctctaattgcaaaacgaaaaatttaaacccttaaattttttttaaaaatccccgctaaattttttgtaaaaaccaactatttttaaacccaaatggcccaaaatatggaacaaattcttttataaatacaaaaatacaccccatgggtttggttttctctccccattttcc

SEQ ID NO: 646559 - DNA, 250 bp, Homo sapiens
  misc_feature (237)..(237): n is a, c, g, or t
aagcggatcttccccggggagcaccgttcgatctgcaggtactcgaaaccttcggggtctcgccccagcttgccgcccgctacgtggagagtggctggctggtgcgcatcggccatggaatctatgcatttcccaatgacaacttcgatgtcaccggtgcgctgcggttccttcaacagcgtgttgctggcttgcacgtgggcggtaagagtgctctagcgacgcaaggtgtgcggnacaccttgagcaa

SEQ ID NO: 646560 - DNA, 186 bp, Homo sapiens
tgtacctaggatcaaggaaagaaccagtcaaacccaggacagtatcgatatatcaaagcaaatggatggctcttagcttcttcgcggatattagtgactggagattccaatataagggcatgttctgcccaaagcatcagggaatcacaggtcagtcacagccatttagggagggcatgtcaccca

SEQ ID NO: 646561 - DNA, 660 bp, Homo sapiens
atgcagacaattaagtgtgttgtcgtgggcgatggtgctgttggtaaaacatgtctcctgatatcctacacaacaaacaaatttccatcggaatatgtacgggctgtttttgacaactatgcagtcacagttatgattggtggagaaccatatactcttggactttttgatactgcagggcaagaggattatgacagattacgaccgctgagttatccacaaacagatgtatttatagtctgtttttcagtggtctctccatcttcatttgaaaacgtgaaagaaaagtgggtgcctgagataactcaccactgtccaaagactcctttcttgcttgttgggactcaaattgatctcagagatgacccctctactattcagaaattggccaagagcaatctgaagcgtatcgctccagatagtgtttaaaagatgggcggtcccttcaaggatgtcgagtatgtggagtgttacgcgcttacagagcaaggcataaaaaatgaattgggcgaagcgacagtgggtgcagtggagcgtggtgaacgaaaggagtgtcgccggtgtgcgtccatataggggtctctccatagccagttgaggtgagggggtggcggcatcattctaagaacaaggttaaaatcaatctacagattaggaatc

SEQ ID NO: 646562 - DNA, 1179 bp, Homo sapiens
taacagaggaggggctcttaatggtgggaggtgtctggaactgcgaggaaggtcagcagcgcagggggtgcgcgaccccagccagcgtggcagtgttagggctgggctgtgggcgccattccgcccgcgatttcccattctccctcgggagcattccctgggggagccgccattcacctcggaagatttccgcattcaaacctaggggctccgtggagaacctcgcgtgattcgccatcacaggggttataatataccattcattttcacacgcgtgcgtgcatctccgatacaggcgtcctcgcgtgtccccgacacagcatcgtgggcgttcttccagtacaacgtgacagaaagggcccacgcggtgcccaagccggcgtcgtgacctccagtctccgtgacacggcgtgcgcccacggtgtgcccgcgcgaagacaaggcggtgtgcctggcgaaggcccgccacagcgtcgtggcattccaccgaccgagccaccttccgcgggaagagtcggccggccgaaaggccctgggttacacccccggtgcaccgtgggcactccccgggatacgccgccgcagaaacgtcgcggaaaccgctcagggggcccaagaatcgcagcaaaggtgtacttgagggcggggaggagccatacatggcggagccatatttgtggggagaccctcttagaagcgcccagcagacccacaccaggggcgctccatccagggggccccatggaaaaccgcgcggcgaggcccaacaccacaagtattcccttccacagagatcctcgggcgcggaaaaaaacgccccacgtggcgtagtccggccggcactacaccgcactttggcaacgcccatggggatgggaaaactgcacgcccgtggacccaccacacacaccgttgacacaacaacagtatacttgcacaccacagaagccctcgattggaaagaacccacgacaatgatgtgacacgcgcaacacacttcggtgggatgccgcgtctgcccaattatcacgtggggccccccaccaagcaagagtacgcattaggggcactaacccacggcacgtgcaggagtaacgtggaactaccacgtgtctcaataaattgtccccccaccagtcacatatgagaaacccccccaaacgccttcccccaaagcta

SEQ ID NO: 646563 - DNA, 147 bp, Homo sapiens
ctactcatgtacacagcatactagaggcctgcactactgcacaaaccagctactatctagcgtggaaggaagcaggatatcctgtcaggaccgtttgaaaagtggagcatattaacaaggtcaaaatgtgggtggggataccagggg

SEQ ID NO: 646564 - DNA, 536 bp, Homo sapiens
catatgcccagcatttcttcatgagctcatacagaggggcagggcaggccacaggaggggggcaccggtacccatcctcaatgctcttcataaccacctgattgctcatctccccatgtggcttgtccgcatagctcagacacctcccagatcacaatcccaaagctccatagatcgctggctgtggtgaagaatccgatgggcaatggattctaggggatgctccaacggatagggatcttttctccctgtgtttctgtatgtgccatcagagtcatccaggaggcgagtcaggccacagtcagacaccttgcagcacaggtttcgattcaccaagatgtttctggcaggcaggtcccggtgaacataattgtgattactgaggtagtccatgccatgtgctatgcctgcagcatggccactagctgcccagggaccagctggtcctcccgctccctcaggaaggcatccagggctccattctccataaattctgtgatgatcatgatcggctttcgctttgtgacgacgccttc

SEQ ID NO: 646565 - DNA, 109 bp, Homo sapiens
acgctaagagggccgagacgccgagcgtgacgtcatcggcgcgcgcgctctcgctctctctcgcgcgcgcgggggctcgcgctccctcccttagtctctctcgttttat

SEQ ID NO: 646566 - DNA, 90 bp, Homo sapiens
gtttttttttacccccccccccccccccccccggggttttattttgctttttggggggggggggtgtaaataaaatggtttttttttcca

SEQ ID NO: 646567 - DNA, 588 bp, Homo sapiens
aattggcttagacctactgtttaaaagttcgtagtagcatagacacaacagtgataagagaatcttactaggagctgtgttgttaataggctctttaggctgctctctagtggaaatgctgtgaggctgtggcctgcactggctcatttggagttgacagtgatggggagcttggtaagggattgatgcttacaatggccgtaccttcatactgggattctttggaaaataaaaagccttgttgcttcatatcacattgttcatagtaatctcactctctgggagagtcattttcttgaagcaccaggaagtagctatcacaaatccagaagaggatttgaattcaacccccactccccaatttcttctccactctctttcacactttagctggccacactggccttttgtttcagtttcagtctccctgatgtaaactgccttcttgattgcttctttacttttaaccacctctgctgtgatttgtattgttgaaataacttctacccactccaatagaatgctaaatgttagattaataagaggaatgcctgtttctggctcaaagaattagtggttagtgcaaaa

SEQ ID NO: 646568 - DNA, 236 bp, Homo sapiens
ctgtaatcccagcacttttggaggctgaagcaggcagatcacaaggtcaggagatcaagaccatcctggactaacacggtgaaaccccgtctctactaaaaaaaaaaaaaaaaaaaaaaaaaagatctcatctacaaaaaatgaaaaatttccccaaatgtggggccaactgccccaattccaagctacttacaggggtgggggagggggtttcctgggatccagggagtctaagg

SEQ ID NO: 646569 - DNA, 395 bp, Homo sapiens
ctcaccacaacctctgcctcccgggctcatatgattctcctgcctcagcctcccgagtagctgagactacaggcatgcaccaccacgcccagccaattccgtatttttagtagaggcggggtttctccatgttggtcaggctggtcctgaactccggacctcaggtgatccacccacctcagcctcccaaaatactgggattataggtgtgagccaccgtgcgtggatgcattattaattttgttaaaatacttataacaaaatgttccatgttaacagttatttagtttgtaattcagtggtgttaattacattcacagtgttgtgcagccatcacctctatctactttttcatgaccctgagcagaaactccgtagccatgaaaaaataactc

SEQ ID NO: 646570 - DNA, 196 bp, Homo sapiens
aacgggcattgcagcttgctgctgcaggtcgttgctaagatccccactgaaattaactaattatcctaagtctctatctacagacagtgctttgcccctattaagtgacactttacaaattagaaaaacgctagaacaatgaagtacccataaagtggccaaatcttttcatgaatggaggaaacacatttgtatg

SEQ ID NO: 646571 - DNA, 698 bp, Homo sapiens
gctgcgctggctccgctgctgcccatctgtcccgccccttgactggggccggctgcggtggaagcacacgctcctccctgaaggtggccaacgagcccgtcttaggcttcactgcaggacatgcctgagctgagatgccctgcaaaaggccttgaagtgacctgaagggcctggatgtgaatgccatcccatgcgtggttggggtgatgaggagtgtgttggactgtcgtgacgtgcagtaccaagtgtacgccttttaaccatggacataagtgtggccaagttctgttatgcagacaagagcctgctcaacaaagccattgaggctgccctggctgcccggaaagagtgggacctgaagcctattgcagaccggtgcccaggatcttcctgaaggcggcagacatgctgagtgggccgtgcatgtctgagatcctcggccatgaccatggtgggacagggtaagacctgtgatccaagcggagatatgacgctgcagctggaactcatcgacttcttcaggttcaatgccaaagtatgctggtggagcttgtgaggtcaagcgaggcccatcagcgtgccccgagacacaacagcctgtgtaccgggtctgatggcatcgtggaggcatccgcccttaatttactgcaatctgggcacctgctgaggaccggcctgtggcaacgtgcctatgagca

SEQ ID NO: 646572 - DNA, 248 bp, Homo sapiens
gatgagttttctttcttctgttctggctgaggctcactcaaatggagattaaagatgcctattgcttctgggagaaagcgtctgagggggcagaactgaaaaatagaacatggagagggactgcaatcagcctgttccgtcttcagatttttggagagaacagtaaagacaatccttgacggctctattttgtctgtcttagctcagtagggtagaaaacctaaaaacaatttaggcaaaatctatag

SEQ ID NO: 646573 - DNA, 826 bp, Homo sapiens
aagcatattggagatggtaaacgctactgtctgcgatgtagtaggcagatgtggtaggataaagatggaatgcgctaggtcgaatttgcgaagaggaaaaatgaggtagagagatgctaacgctacaaaatcgatatagtgtgcttgcaacggtgtcatgtccatcaggtaaactagaatagatggagaatgaatagacggtctggtgggatgattcggatactatagtttgtcgggtgaatgacattagtcataaaagatacatagagacatctgatttccaaagtgggtatactatgaagttacattcggactatggatcgatcgatctaatctttgtgagatcatcattattaatatctatgttggctcataggttcggggtacttctccatggccactgggaatttctgagggatcattttacttaggtgtttattttatctgttactaataattatcgatgagacagttatgtttaactgactattcataatagatcaccatacatttcggggtgtcaaagtcttggaagaaattgatattttgcaccggagaatatgattcccaaaagttggaataaaaatgacaaaacaacgagggaaagaagtgaaaccagaccttagtggcacatatttgtggctctaggggtcgtaaggtagtctcctgtttccagaagagtttatggatatttcacttatagagcgcgattttctggtgtaaaagtcattaatgtgtcatgctgaaggtgttagcctaaaaagccaaaagaaagtgcgtcctcgtgcgaacatattcaggagtttaacagagacggaccaaattg

SEQ ID NO: 646574 - DNA, 158 bp, Homo sapiens
  misc_feature (117)..(117): n is a, c, g, or t
  misc_feature (131)..(131): n is a, c, g, or t
cagtgtgcgagcgatgtagcgcaagatggcatagtctgggtgatcttgttcttcccatccaggaggtagggcagattaggaaagtccaggtctagcttgaatttcacatccagccantggcttcgatcatngtcaggagcacccagcacgaattacct

SEQ ID NO: 646575 - DNA, 299 bp, Homo sapiens
gagaaatgcaaatcaagaccacaataagacaccatctcacactagtcagactggccattttttaagattgggagaaaaattattttggccaacgttccagagaaaaaggggaaacttatacactctggtggggatcgaattagttcagccactttggaagcagcttagagatttctcagatgcaattgaaacagactctatttgatccaccgatcccattactgggtatatacacgaggcatatagatcgtctatcagaagcacatgtactcgtctctcatcacacactatcacatatc

SEQ ID NO: 646576 - DNA, 218 bp, Homo sapiens
ggcgtgtctgcgagtaccccttgagaaggtcttgaagggatccccgagggctgagccatgcgagagagaggtgggcatggccctggatagctccacagtggaatcacgcctccggaagggaagtggagaaggttttcaccggacttagcaacatggggagccacaccggccaggagttggaccaaggcgtccaggcgctccaccacggcatagaccag

SEQ ID NO: 646577 - DNA, 838 bp, Homo sapiens
gaatgcgtcaccctgcttcggtcgcgcacggtgcgtgcacccatgacctggaccactgttggcactccctagtgagatgaaccctgtacctcagatggaaatgcgaaatcacccatcttctgcgtcgtcatgctgggagctgtacggatcgggagctgtacctattcggccatcgtgtggctcttcccccgttggacaatttaagggtaaagaccttcacaatcgggaacccgtagatgggcatcttctgaaaaccaatcagagagaagactatctttgacatccacactacagtaaaactttgtggagccttgaacctttggatttataatctcacaagtgagaagggtccctccatactcctgggactgtacacccatgagaacgtcttaaggtaaaactaacgcaggaaagtttctccccagaaaaaagagtggcatccttgagtgtgaacagcttttttcccaagatcacaggtcaagaagttctactatcatgagactcttacctttgaatattttaaccgttgtttatgcctctatgagcaaacagaaatgaaaagtgggtctataaatggtgcacttaataggggtataactttcatttgtgaagggattttgcgggaagccaggcttatacataaaattaacttattactttaattagatataaagatgagggcccaggtgggtagaaacttagtggctcatatgttgattcaataataggcaaattctttaaccaattagggttaaggaagactggcagggcgtaacttaaagagaaatggaggccctcagggcaacaacagggaataaaagtccctaagggggacaaa

SEQ ID NO: 646578 - DNA, 669 bp, Homo sapiens
  misc_feature (33)..(33): n is a, c, g, or t
  misc_feature (35)..(35): n is a, c, g, or t
  misc_feature (70)..(70): n is a, c, g, or t
  misc_feature (76)..(76): n is a, c, g, or t
  misc_feature (78)..(80): n is a, c, g, or t
  misc_feature (91)..(91): n is a, c, g, or t
  misc_feature (102)..(102): n is a, c, g, or t
  misc_feature (135)..(135): n is a, c, g, or t
  misc_feature (138)..(138): n is a, c, g, or t
  misc_feature (145)..(145): n is a, c, g, or t
  misc_feature (158)..(158): n is a, c, g, or t
  misc_feature (162)..(162): n is a, c, g, or t
  misc_feature (169)..(169): n is a, c, g, or t
  misc_feature (191)..(191): n is a, c, g, or t
  misc_feature (194)..(194): n is a, c, g, or t
  misc_feature (197)..(198): n is a, c, g, or t
  misc_feature (200)..(200): n is a, c, g, or t
  misc_feature (203)..(203): n is a, c, g, or t
  misc_feature (205)..(205): n is a, c, g, or t
  misc_feature (207)..(208): n is a, c, g, or t
  misc_feature (211)..(211): n is a, c, g, or t
  misc_feature (213)..(213): n is a, c, g, or t
  misc_feature (215)..(215): n is a, c, g, or t
  misc_feature (234)..(234): n is a, c, g, or t
  misc_feature (236)..(236): n is a, c, g, or t
  misc_feature (247)..(247): n is a, c, g, or t
  misc_feature (257)..(257): n is a, c, g, or t
  misc_feature (259)..(259): n is a, c, g, or t
  misc_feature (261)..(263): n is a, c, g, or t
  misc_feature (272)..(272): n is a, c, g, or t
  misc_feature (274)..(274): n is a, c, g, or t
  misc_feature (281)..(281): n is a, c, g, or t
  misc_feature (285)..(285): n is a, c, g, or t
  misc_feature (289)..(289): n is a, c, g, or t
  misc_feature (297)..(297): n is a, c, g, or t
  misc_feature (305)..(305): n is a, c, g, or t
  misc_feature (308)..(309): n is a, c, g, or t
  misc_feature (311)..(312): n is a, c, g, or t
  misc_feature (317)..(317): n is a, c, g, or t
  misc_feature (323)..(323): n is a, c, g, or t
  misc_feature (327)..(328): n is a, c, g, or t
  misc_feature (330)..(330): n is a, c, g, or t
  misc_feature (342)..(342): n is a, c, g, or t
  misc_feature (344)..(344): n is a, c, g, or t
  misc_feature (349)..(349): n is a, c, g, or t
  misc_feature (353)..(353): n is a, c, g, or t
  misc_feature (361)..(361): n is a, c, g, or t
  misc_feature (365)..(365): n is a, c, g, or t
  misc_feature (367)..(367): n is a, c, g, or t
  misc_feature (369)..(369): n is a, c, g, or t
  misc_feature (375)..(375): n is a, c, g, or t
  misc_feature (379)..(380): n is a, c, g, or t
  misc_feature (383)..(383): n is a, c, g, or t
  misc_feature (386)..(386): n is a, c, g, or t
  misc_feature (388)..(388): n is a, c, g, or t
  misc_feature (392)..(392): n is a, c, g, or t
  misc_feature (432)..(433): n is a, c, g, or t
  misc_feature (462)..(466): n is a, c, g, or t
  misc_feature (475)..(475): n is a, c, g, or t
  misc_feature (482)..(482): n is a, c, g, or t
  misc_feature (485)..(485): n is a, c, g, or t
  misc_feature (488)..(488): n is a, c, g, or t
  misc_feature (494)..(494): n is a, c, g, or t
  misc_feature (497)..(498): n is a, c, g, or t
  misc_feature (502)..(502): n is a, c, g, or t
  misc_feature (506)..(506): n is a, c, g, or t
  misc_feature (517)..(518): n is a, c, g, or t
  misc_feature (523)..(523): n is a, c, g, or t
  misc_feature (538)..(538): n is a, c, g, or t
  misc_feature (547)..(547): n is a, c, g, or t
  misc_feature (558)..(559): n is a, c, g, or t
  misc_feature (576)..(576): n is a, c, g, or t
  misc_feature (585)..(585): n is a, c, g, or t
  misc_feature (600)..(600): n is a, c, g, or t
  misc_feature (615)..(615): n is a, c, g, or t
  misc_feature (617)..(617): n is a, c, g, or t
  misc_feature (620)..(620): n is a, c, g, or t
  misc_feature (622)..(622): n is a, c, g, or t
  misc_feature (630)..(631): n is a, c, g, or t
  misc_feature (635)..(635): n is a, c, g, or t
  misc_feature (637)..(637): n is a, c, g, or t
  misc_feature (656)..(656): n is a, c, g, or t
  misc_feature (660)..(660): n is a, c, g, or t
  misc_feature (667)..(668): n is a, c, g, or t
ccgcgttcgcagcatggccgccctggggcgcgngngctcggggccgcgcgctgcggtgcccgcttggaancgtganannntggagcggaancgagccaagcnagccgcgctgggcgggggcgcggggcccggggnggnggacaanagcagcgggtgcnggcngaaagcntgggcccgctgcgcgaaaaaangtncanncngcngnannccnancngcggcgcggcgggggcacngngggggcacggntgcagaaacngnannnccgcgtgcntngcgtgcncgcnctcngcgccganagcgtccncannannaaaanagtgcncggnntnacgcccacacancncgcancggnggaaacanaaananangcaacnaaannacnaananacanaacacaactaaaaaaaataaaagcctactggagaggttcnncccgcccgccgcgccgcgccgccgcgggnnnnncgagccccnccccacngcnccncccccncgnnaaangggngaggaaggaanngggcnggaaaaaaaaaaaanaaggaaagnaaaaaaaaagnnaggaagaaaaaaagagnaaaaaaggngaagaagagaaaaanaagaaaagagaaaananganangcagaganngaanangaggggaaagagagagaanaaanggggaanng

SEQ ID NO: 646579 - DNA, 110 bp, Homo sapiens
  misc_feature (17)..(17): n is a, c, g, or t
  misc_feature (21)..(21): n is a, c, g, or t
  misc_feature (30)..(30): n is a, c, g, or t
ttataacctcttctagnttcnttggagtcnagttttctcaattgtaagcaaagactagccttgataagtgatggggtccattcctagcctaacatttaacaggctctgat

SEQ ID NO: 646580 - DNA, 884 bp, Homo sapiens
caagggccatggatgactccagcgtacggagcatcacgaaggtggagcgtgctgcggaaggcgtgcaggccaccgaggactacgaccgaccgggcatccgcggggaggccgttatgatcgacaccatgctggtgctagaaggctgcaggcccatcgaggacctggtgatgcgagtgtccgacatcttcatgtgacacctcctacgctatcgccactgcacttgcagctctcgactcaggcaggtctctgagcaaggacgagactgtgtctatgttcttgcgggcgccggtggtcggccgtaggctacggatgatatgcatataacaccacgatgggaggggcgccagcatttcgaagctttcttccgctggtccgagtccgtagcgaagcgagcgtggcaacgaatagaaaccaatagcgcccagtcacgcacgttgtgacggccactatagccgtagggtatgagagggaccggctccacgtgggacgtttgcctgttgcccacttggcttggcaagcaaagcttgacaccctgtgggctccataggtcctcgaagcaccacctatagttgaactcaagagcgtctggctcaaattttgcgaactaggaacgcaagaggctcaatcgccatgtgcgattgggggccgcaacggctaggccaagggccatcaaagccatccctattgagtttgctccctgactaacccttattgagtatcacccgtacattgcctcgtagggttcccccgctaaaaagtcgtaaacttgcaagcccacggggagaccggcagtacacttccaagggagggtcaatgagaggggcgcccaacggcgaaatttgccataactgtagggaatcattgcgcaagacttggaccaagag

SEQ ID NO: 646581 - DNA, 735 bp, Homo sapiens
  misc_feature (53)..(53): n is a, c, g, or t
  misc_feature (68)..(69): n is a, c, g, or t
  misc_feature (72)..(72): n is a, c, g, or t
  misc_feature (81)..(81): n is a, c, g, or t
  misc_feature (104)..(104): n is a, c, g, or t
  misc_feature (133)..(133): n is a, c, g, or t
  misc_feature (163)..(163): n is a, c, g, or t
  misc_feature (236)..(236): n is a, c, g, or t
  misc_feature (249)..(249): n is a, c, g, or t
  misc_feature (270)..(270): n is a, c, g, or t
  misc_feature (273)..(273): n is a, c, g, or t
  misc_feature (299)..(299): n is a, c, g, or t
  misc_feature (316)..(316): n is a, c, g, or t
  misc_feature (319)..(319): n is a, c, g, or t
  misc_feature (324)..(324): n is a, c, g, or t
  misc_feature (331)..(331): n is a, c, g, or t
  misc_feature (344)..(344): n is a, c, g, or t
  misc_feature (349)..(349): n is a, c, g, or t
  misc_feature (351)..(351): n is a, c, g, or t
  misc_feature (381)..(381): n is a, c, g, or t
  misc_feature (393)..(393): n is a, c, g, or t
  misc_feature (395)..(395): n is a, c, g, or t
  misc_feature (399)..(399): n is a, c, g, or t
  misc_feature (443)..(443): n is a, c, g, or t
  misc_feature (454)..(454): n is a, c, g, or t
  misc_feature (456)..(456): n is a, c, g, or t
  misc_feature (463)..(463): n is a, c, g, or t
  misc_feature (490)..(490): n is a, c, g, or t
  misc_feature (507)..(507): n is a, c, g, or t
  misc_feature (525)..(526): n is a, c, g, or t
  misc_feature (545)..(545): n is a, c, g, or t
  misc_feature (549)..(549): n is a, c, g, or t
  misc_feature (552)..(553): n is a, c, g, or t
  misc_feature (555)..(556): n is a, c, g, or t
  misc_feature (562)..(562): n is a, c, g, or t
  misc_feature (564)..(564): n is a, c, g, or t
  misc_feature (581)..(581): n is a, c, g, or t
  misc_feature (656)..(656): n is a, c, g, or t
  misc_feature (724)..(724): n is a, c, g, or t
tcccacctgtgcataacctttggtccatctgtgctatctctcatatctgcaanaaaaacctaaaaaannaanatttgaatnttaagtatttacatctttttgtnttggtttttaaatgcacaagtacccctgnatggctcaaagggatgggataatgctagcnacactaacttgcaataaagtgcagttttcatgcaaacttagccatcagttttcttcttttagataggtatccnccgtccatatggnctttttttctgatctattttnggnggtcttgggggtgcctcttctgtggnggcttttgctgattttngtnttggntttgctncagaattttttgngctanangctttgcttctttgctgggtatagtttttnattgggatttcntnttcnatcttctgttaccttttccgacagctagtcaggttaagtataangtgtaattttnanacacatncccttggtttctatatcctatattaanaaatagcctaattgtgnacaaaattttgctgtagnnaaaaaaataaaattgggtnttanagnntnngtgaangnaattttgggtttgtaanattaaaaaaaatgatttaatattaggattaagaaaatattaaaataattattttaattaaatgatggaaaatttnaaataattttttaataagttttataaggttgaataaagttaaattttgaaatgtaaagaaaaataagnaaataagtttt

SEQ ID NO: 646582 - DNA, 335 bp, Homo sapiens
gtcgactacaatacaccacaacaaataccatacactaccgtccatttaccacaacaaatacaatacaccaccatacatttaccacaacaaatacaatactccaccatacatttaccacaacaaatacaatacaccacaacaaatacatgggatcagtatgttcccatagcaatacaaacacatgggatcagtatgttcctaatgcaatacaaacacatgagatcagtatgttcccatagcaatacaaacacatgggatcagtatgttcccatagcaatacaaacacatgggatcagtatgttcccatagcaatacaatcacatggtagcagtctg

SEQ ID NO: 646583 - DNA, 389 bp, Homo sapiens
aattaaccttactgcttctctctccattatcttgaatcaagaatatactttttaaaacgaccacctctctttctttaagcaagtatctaaaatagcaatggcaatagaaagcctcagtgaggccttctctgactacactattgaaagtagatttccatctcccagtcattcagtatcccaaagccctcctttatttcctttttttggagacacagtctcactctgttgcccaggttggagtgcagtgggatgatcacagttcactgggctgaagcaatcctcttgcctcagccccctgagtagctgggactataggtgtgtgccactaagcctggctaattttttttttttttttaaacgaggtactgctaagttgcccgccaatcgaa

SEQ ID NO: 646584 - DNA, 274 bp, Homo sapiens
cggggggctgggggactcctcccaagatcccattttagcatctttttttcctcccccctttaaaaaaataagtaacaggtgaaatgtggtttcagtgttaacgggataattttgctcccggctcccccctgatgattttgaaatacactactgaacgagctttggctggtcctttctatcctggatggggtttttttgggtagcaattccttgatgtccagtttggaaaaatggacttttttcaacaaaaaaaacttaaatccgtggggcccca

SEQ ID NO: 646585 - DNA, 554 bp, Homo sapiens
  misc_feature (247)..(247): n is a, c, g, or t
  misc_feature (514)..(515): n is a, c, g, or t
aattcggcacgagggtgttggctgatgctccctcttgccggctcctgctcttgaaacacacccaagtgcaatgttcaatcatctacttgtttccaaagttatttgggtcagcattttcctccacccaccacttaaaactgatttgtttcatacatttgaaatgtatgaaaagccagaaatccaggacccaccctggcctgctccctttttctcacctactgtgttaaggataagtcaattgagcttncttctctattgaaatcaccgtgctgatggagtctgtctgtggaaatgaaaggtggctaccataatctgttgggagttgaattaatcctctgggagtgaggctgacctaattactcagaaatactgggcttgctttcattctgtggaatacagccatgagaaagaggccagcatgccatttcctaatcttttcttgaattgcctgaaactcacctaacatgaaactgagaagccttttcatttgaaagtggtatttcttatgtttttnntctttttgcttgaaagtattcttaaactaaagaaaggag

SEQ ID NO: 646586 - DNA, 453 bp, Homo sapiens
  misc_feature (8)..(8): n is a, c, g, or t
gacttaangggcgggagggagcccatcccgcttgccccaacgaacgcgggcgcggggctttcctcgcaggttacataaggcagccgcgggtggaggcagcagaggcgagcgcacgtccgtcgagggggaaaggggcgtggggaggcggccggggcggccggtatcccccgggcgtgagtgcgccgccgctgcccgaggtggggcgcagcgcgcgggggagcgcagggcgcggcggagtcgggtttcagagcgcgggtgactcggggcgcgggccgggagccgggattctgcccgccgccgccgctgccgagcgccgcctttgttccctgcaggaagggcgagcgcggcggccagcgctcagcgacccttcgtcctccgctaagctccaacgctctgctcgactagccgcgcgccttccggggctccgcagacccgcgagatggcaccaaggag

SEQ ID NO: 646587 - DNA, 137 bp, Homo sapiens
gacttcccacacctgcacctgggctaatggctttacttggctggcagtctcatcggattgggtgcagcttctgggcccccaatgctggccccgcgactcgaagggtgactagggatggtgatctcgtatggacctgc

SEQ ID NO: 646588 - DNA, 374 bp, Homo sapiens
  misc_feature (67)..(67): n is a, c, g, or t
  misc_feature (334)..(335): n is a, c, g, or t
cccataactctctttttcatattcctttccctccaacacaatcacctgctttaaatcattgagcttncttctctattgaaatcaccgtgctgatggagtctgtctgtggaaatgaaaggtggctaccataatctgttgggagttgaattaatcctctgggagtgaggctgacctaattactcagaaatactgggcttgctttcattctgtggaatacagccatgagaaagaggccagcatgccatttcctaatcttttcttgaattgcctgaaactcacctaacatgaaactgagaagccttttcatttgaaagtggtatttcttatgtttttnntctttttgcttgaaagtattcttaaactaaagaaaggag

SEQ ID NO: 646589 - DNA, 735 bp, Homo sapiens
cgcggtggctcacgtctgtaatcccagcactttgggaggccgagggggggcggatcacttgaggtcaggggttcgagaccagcctgagtgacatggaaaaaccccgcgtctattaaaaatagaaaattcgccgggcatggtggcgcatgtctgtaatcccagctactcgcgggaggctgaggcaggagaatcgcttgaacccgggaggtggaggttgcggtgagcggagatcgtaccattgcattccagcccgggcaataagagtgaaactctgtctcaaaaaaaaaaaaccctgagttctctcaaaattggtaggtaaattatggttcacatgtggtcacggttggaaaattatttgggggggagtataacggtagaactacagagatctcctggctaatagctcctacggttatcggggaaacaaccccttgagggctgaaaacgtgatggattctggatggatagtggggatccatctatcggtatcggcagttatggcctgtgcggtgtataaaaagcttctttcaattcatttccccgaaatttttaatagtgctcaacggaacagtgcggggggaactggcagcaggtggggcacttgagctattgggacgcaacgcggtgattaactggattttgagtgagccacagatctggagtagcgccctcgtattagttagtaccaggggtggggggttcaatcttcttaacgaaagggttggtcccttggaa

SEQ ID NO: 646590 - DNA, 309 bp, Homo sapiens
  misc_feature (80)..(80): n is a, c, g, or t
  misc_feature (143)..(143): n is a, c, g, or t
  misc_feature (299)..(299): n is a, c, g, or t
tgaaagaacatttttgaaattattactccttatttagaaatggataactatatcttaaagaacagaggtgggtgtatttntttttgcgcagtgttcagtatagtcagtaccatagaagaatggtaggatttttattataagantcattgtaactcaaaggtttgttttatgactttaaaataactttcttttgtttagtggcttggtgccccttcataatgcctgtccatatggacactatgaggtggctgagcttttagtaaggcatggggcttctgtcaatgtggcggacttatggnaatttacccc

SEQ ID NO: 646591 - DNA, 107 bp, Homo sapiens
tactcggtcagaatctcccaggtcaggccgtgggagattctgaccgagtaggtctggaataggagaagtaggaatttatttagggggctgttatgtctttctaatct

SEQ ID NO: 646592 - DNA, 190 bp, Homo sapiens
ctctctcctgagagtgcttacgtctatgcagtatactattgagtgggcttgcgctgtctgagacatgttcagcctcgtcatggtatggattgtcggatcatgaacaattacatagatgatgagtgtgagatgatatcggaagacctgtatgcagaaatgtttgtttggaggacactattagcctgtattc

SEQ ID NO: 646593 - DNA, 860 bp, Homo sapiens
tgtatattgtcctggtttggtggattctacttcgctatccccaagtattcagaaagcttctccaagtacttctttcaattggaaaagagctgatatagagcatgcatcaaccctgatgaggctgttgcttatggtgcaggtgtccaggcagccatcttgtctggagacaacgtctgacgagaatgttcagaggatttgcatgctcttgggatgtcgactccatctattccctatggatatgtgaaacgttgcaatggatggcagatcagtagacgtagttcacttcgattcaaatgtcagtaactaccaatcgcaatttcgcgtacccaagcaggacaactagacgcttcatcaatacgcctattcgtgtacgaaccagcactggtgtgtcttattcatggttgatgataggcgcagcgtgcccatgacgaaaggataacgaacctgaacgtgggacaggctattgacagctgcaacaggggtcactagcgctactccttgacaaacaccacgcgcaagggatggtctccgctacaagaagtatggaaagtttcagctttaatatgatcactctgcagtgaccaactgggttatagcttccaaattggttcctctgccctggtgcgagcgagagtgagcggggaaacacgatgacacatctgattgactatcactaatagatcgcatggtgccggttagacgccaaggacatacatagatacgtatgggtccccgcgaagctagacgtaagtacgaagtggttgaagatcgatgaagcatagggaccaggtgtccatccgatgaatactacttgagtcctattgccttcgacatgatgggcacctgttgacgatgagaag

SEQ ID NO: 646594 - DNA, 159 bp, Homo sapiens
  misc_feature (13)..(13): n is a, c, g, or t
accacaacattgnctcgaccttctctgattgaggtgagcgtccctcatctcatggactcgagcgcgcagtgctccggcgagggatgctccctggtcatcgagtcgcaatacctcaacgagttcggcaagttctggcagatcaagttcatctgacaactc

SEQ ID NO: 646595 - DNA, 1046 bp, Homo sapiens
gcggaccaggaggggtggcagtatgccagcgacttccctgcctcataccatgggtccaaaacgatgaaggatttgtgaggaggaggtgctgggccagaaaatgcaagctggtgaccagtgggccctggctggaggtgccccccatcgccctcagggacgtgtcatcatcccggagagcccgggtgccgaggggagtgggcacagcatcgccctctgggccgtcagcgacaagggggatgtgcatgtgccagacttgggcagtgtcggagcatcaaacctgcgggactcctcctggactgcacgttggcaccgaaccaagccactatcgaccatccaatctccatcggggacctgcctaccaggatgtgggccgatggcaaggagaccggctccggacattctacacggggatccgtgtaccccgtcggcagaacagaccggtgactgcatggtaccacataccgtaacccaccgagacagaggctgaagcaggtgtccgcggggacagacagacaggagtaatgccctggatgagaatggaaacctgagactatcgccaagggatacacgccacagctaacacgcagggactccagccgggagcacagagtccaacaaaagtgtgccgaggaggtccgggggcccctggaccaacgcctggcgtgaaaccgcaacaaacgagcaggggaaggcaaaaagccctagggcccggaggggcacaagcggtgacaagcgcaaaccgagagatagcagcaccaagaaacacaacacgggcacaagaaaggagaaaacgcggacatcacgagggcacggctggcgacactaacaataaggacagggcccaaagcgaaccaatggacaccaagagaacctaagacagccacgagcaaggaaccagaggtgcaccaacacgagcaggaccatgaccccaggaaatgcagagacaacaccgcgcaagacaactaacacaacgaaagaagccacgacgaaggaaccaagcgaaacaacacaggtgctagaggaagacaagagagaccaaacgaaaa

SEQ ID NO: 646596 - DNA, 145 bp, Homo sapiens
ctcgagtgatctagaggtccccagctccgagtagctgggactacaggcaccgcacacgccagctaatttttgtattttttagtagagattgagaccatcctggctaacatggtgagtgtgactgtggttgtccattcctaaaaca

SEQ ID NO: 646597 - DNA, 449 bp, Homo sapiens
gatcaagggtgttccctgggcttccgttacaaaaaagggtctgtgtatgctccctccccacccaacgttgttatccaggagaatgggtcttttgttgaaatcccaaattttttgggggaaaaaaacaccccagggttcggataaaaccaggggttgcttgttcagttttccaagccccaaaaaatgaattaatccttgaaggaaaagcccttgagcttgtttcaaattcagcggctttgattcagcaagccccccccgttaaaaacaaggatatcaggaaaatttttggaggggatttatgtttttgaaaaaggaactgttcccccgggtgatgaataagatttaaaagttccctgggtccaaaaaaaaaatgcccgatgccccttaagccccccttgtgatttttaaatgatgcaataaaagcccttttgttttggccctttttttta

SEQ ID NO: 646598 - DNA, 189 bp, Homo sapiens
tattatctgattagggttagaatgtgacagaaagctctcatccatcattttgccaaggcttctttccttcattaaattctctgttgttttcctaaaagtcttctacattgaatgttttcattacgtttttttctcgcattatttcctacgcacacgactgaggcaaacacattttacgtgaaaaccctc

SEQ ID NO: 646599 - DNA, 1017 bp, Homo sapiens
gaaagccgactgttgcctggtcagcagataagtcctttcaagttctctatgactgtactcttcctaaggaagtcctgggaaaaggaagcgtcctcactatgtgggtctaccttgcggcgggcccttctggtgggccatgtagcatagcctttcttgcaatcgtgtgatcaccgggaaaaggcaaggtgagtgaagcctacgcctccaaaaacgaagtatatatcatgaatcgacggggcatcgtagactcagagagccttctgggaacctagatctgaggccaagacatgtatgtgatagctagtggaaaggcatttgaatggaggttgcctgggacatagtggttgtcgtagactgggagcaaaggggaggccaggacgtcagacgtggaagaggtgccacgaattgttcattgaacaaagagctgtggaagtacgggatgattcccatgagaagtggttacgcaaaaattggagatgccaaaagtgtgcaagaatactacaatgtggggtgagagggagctagtgtagagagtgacaatccaggatatcgtggggggacgtggttgaactcacctgataatgcaattctttacgatggaaattagcctgtaatgttggaaaatgcgtctgtaaacacactgtaagggtgacgtgcatatgaagattaatgtgcttcaacaggctgtaaggccacttcagtaggatgtggtaacttaccatgagcctgaaccttatgaagtactgttggcttactcttctgtgtggtgaatgggtagatggcatcggggggaatgcacatttgtagaaggtgtcttcacaggcaatgtgccttggtggaacgatgttttgggaactactttttgttaagagaagttgcttcaacttggtggtcgtcctcgaaagttatagagatgagtggcgagaggcctttttggcagaattatactctggaatgcggtgaggaaatcaagcgattgtaggggggtgaaaaatccaggattaggtgggaaagctg

SEQ ID NO: 646600 - DNA, 860 bp, Homo sapiens
  misc_feature (338)..(338): n is a, c, g, or t
tgggaatataaagcaccgccaggccctttgattttaaacctgtggctcgtattgttctggcaaccagttttgttagattttaactgttgaggttaagggtctaagcttagtggggttatctaatccccagtttggggttcttaagctatattggttgttgttccagtattattggttaaacccatctttccgtcagtcttattttggttgtacaactggaaggttttttaacaatctcagtgtgatgtttaagtcttatatgggggaggggtgtagatctaaaacactactttacccccgggcttctcttattgtgactatgttgggttttaacctcnggtgttgcacccgcggtgtggccatgcgcacgaaaattgtgcacccacaccctgtgggtgttatagtatattacgcttatagttataacacttcttcggttatatgtgctataaaagggtataaactccaccgtgctgtgttttccccagtgtgcggcggtgtgtgtgggctataggcgctataaaccgtatttgtagacgcgtgcaattatgctttgcgtgtgcttgtagaatgtgctgttggctcccctttttgagaactcggtggcgtgattcttacaaggggggtgaccttccccgtggaaaacgcggggcgagtgctctgcgctttgtttgataattctttaactaaagaaagctactatagcaacggcgtctggaagttcctgttgtgtttatttgtgaaccagtggttcgtctgtcggtcttttcctggggcccaatcatttaatggcttgctttaccaaagtcagaaaaaaagcccatgggacaaaggggaagcccctatattcattatccttt

SEQ ID NO: 646601 - DNA, 188 bp, Homo sapiens
  misc_feature (71)..(71): n is a, c, g, or t
  misc_feature (144)..(144): n is a, c, g, or t
  misc_feature (154)..(155): n is a, c, g, or t
attcttaacctgggtgggcgtcagcactttgcccagctcgtcgcgagcgcgccccggcgtaggtgacgatnagcgggtgctgcggctgctcgtccacttcttgcaggctcaagggcccggaccacttgctgaggtccaccggcnatgcgaggcnnaagcagagcgtgctagccggggggagcggtcgc

SEQ ID NO: 646602 - DNA, 308 bp, Homo sapiens
gaccagggattgacagggtagaatgggaaaactcacacagctaggggctagaaccatttggcatgtttttttgtttgtttgtttgtttgtttgtttgaagcagaagtcgaactctgctgcccaggcaggagtgcagtggcgtgattttggctcactgcaatctctgcctcccaggttcaagcgattctccctgctcgggaggctgaggcgggagaatcgcttgaacctgggaagtggagtttgcagtgagacgagatcacaccattgcgctccagcctgggtaacagagcaagactccatctcaaaaa

SEQ ID NO: 646603 - DNA, 223 bp, Homo sapiens
ggtatgaagggaaggacatacgtagccaggttatggagtgacgttggtcaggtccagacaagcaggaatgctgaagaaggggatgctgagtagaaccatagtgcgggcagtcctaccgagatgatgtaggcggaggcagatgccgtcggctagttgcatcacgtgcgggtgttgggggtttacttcggcggtcttctacacctttagaggcctgcagcgagat

SEQ ID NO: 646604 - DNA, 624 bp, Homo sapiens
ggaggcgccgagtcaagatggcggcgcgagtgctgcgcgcccgcggagacggcctgggccggcggcctcctgcagcgggcggcccctgaagcctcatgcccaggctccaggacatgttgacatcttccgagcgaactagatctcgagaatgacacgctggataaaatcctaattagtccgggaaatgttgatccaagaaaagatgcccacgtccaatctcctatggccaagagaagggagaacaaagcaaatctatacaaattcacaggttatcacacctgttaaaccgagaatgcctatgagagcatacaactagaatccgtcaagaggtgttgccatagattcccgacgataaacacgtagccttgtacctatggtggggacttggaaccacgtggtatgcgcgagcaggaccaagctgtccatctctggaggtatgaacggaggctatccgagccctcacagaaggtcactgacttagaactcacgagacaaatacacggagatctttggacattccgtaaggcatgaagtgtacatgctcctctccaggaagaatcggctacctgttggagcttcagttctggactgagcctgtgcccagatccggaccgtagtctctat

SEQ ID NO: 646605 - DNA, 114 bp, Homo sapiens
ggatttgctggtgcagtacaactaggcttaatagggacatgtccctattaagcctcgaatttaagcttctaacgttagaagcttgaattcgagcagtagtagtagtaggcggcc

SEQ ID NO: 646606 - DNA, 141 bp, Homo sapiens
  misc_feature (33)..(33): n is a, c, g, or t
cggtatctaagatccgcagtgtgtggtagtttntcatggcttatgacctcctctctcagctagtcagctttagatgcagccagaaggacccagaagccttagaagtccaggctccatccatgcaccgtgatccctgcagga

SEQ ID NO: 646607 - DNA, 128 bp, Homo sapiens
ctgctttgacactagtggttgctacccactggacaccccctctactggcctgaagccgtgaactattcaaccagtaaataaaatactggggaaaaaaatacataagtaaaaagtacacaccacaaggg

SEQ ID NO: 646608 - DNA, 785 bp, Homo sapiens
tggtgtctttaacattttttgacggggtttcccacagggtccgcagtcaaaaaatcgctgaaccgcgtttcctcgagagacggttgtgtggcttgggcgccttgctgctgccccagtcccagagcttctcctgtaggggtgtcggctacaggaacctttatcccagctccaaactggacgccatcactattatcctgtcacctgttcttgtactccccatggggacgcagtaattaatgttcccaaccgagcgattgttgccaagcctgaggacaatcccggccccgtacgaccagcggatgcactcagccagtcttacgatattatgagtctttggggccctccccatatgttgagtgttgcaagaggttccctgctgttgaaaaagaagttgttgtccggaaaagttctccaaagccaccctggcctggccggaaaggtaatgggggttgtcacagaggtcgcagtgccgccggccctagtacgtctttctccactctaggtagttctccttcgctctctggggcccgatgctgtgctatgctgaatccggggacggcttgtggggtcccccggaggtaaaacctatcagcaatgtcttgaacggtcttatcaccaatgggtcaccaactattccgccccagaaaagacgtctgaaaaactctgattcaaatttgagttgcttgttcactctgaatgttcaaaatcttcttggatagaagtctcattccccgccagtgtagccttgccagttccgggtaaactttcagcaaagcacctttctg

SEQ ID NO: 646609 - DNA, 367 bp, Homo sapiens
  misc_feature (9)..(9): n is a, c, g, or t
cagtcaaanatgaaacaagaaatatgctaataaaaccgggtgcggtggctcacgcctgtaatcccagcactttgggacaccgaggcaggcggatcacgaggtcaagagattgaaaccatcctggccaacacggtgaaaccccgtctctactaaaaaatagaaaaaattagccaggcgtggtggcgtgtacctataatcccagctacttgggaggctggggcagaatggcttgaacctgggaggttgaggttgcagtgagccgagattgcgccattgcactccagtttgggcaacaagagcgaaactctgtctcaaaaaaaataaaaattggtatttggcttcaaaattagaacaagtgatcttccca

SEQ ID NO: 646610 - DNA, 257 bp, Homo sapiens
tcctttatcaagcagatcgaccgtgggctacgtggacacacgctgtacgtgcggtcgacaggacgccagaatacagagaaaggagcctgagggagaccatggatagagcaggaggggccggagtattgggaccgggagacacagatctccaagaccaacacacagacttaccgagagagcctgcggaaccatgcgcggatactacaaccagagcagaggccgggatctcacacttggcaagatggatgtatggctgc

SEQ ID NO: 646611 - DNA, 132 bp, Homo sapiens
gatggtttcttgtgaagagctactggcagttggtggcttagatggaggaagagtcactctttttggacactggacacgagcaatggaaggttgtctgtgcccccagtggatggtcctgcacccatgtgaata

SEQ ID NO: 646612 - DNA, 814 bp, Homo sapiens
  misc_feature (706)..(706): n is a, c, g, or t
  misc_feature (732)..(732): n is a, c, g, or t
acagcgctaaaaaggcctggaggttcggactgggtggagctcaacacagtgtggcaaagtggctgcagccagactgcctctctagattcctcttcactgggaagggcatctctgaaagaaaggcaccagccccagtcaaggggttatagataaaactcccatctcactggaccagcgtatctgggggaaggggcggctgtgggcacaacttcagcggactttaaacgttcctgcctgctgactctgaagagagcagcagatcctgacaaggagggctctcccagcacagcgcttgagctctgctaagggacagactgcctcctcaactgggtccctgacctccatacctcctgatggggagagacctcccaacagcgattgtcagacacctcatgcaggagagctctggctggcatcagcctggtgcccctctgggacaaagcttccagaagaaggagcaacagcaatctttgctgttctgcagcctacactagtaatacccaggcacataaggtctggaatggacctccagcaaactgcagcagacctgcagaagacgggcatgactgttagaagaaaaagtaacaaacagaaagcagtaacatcatcaacataaggaacccccatacagaaacaccatccaaagatcaaaggtaggtaaatccataaagatgaggacaaaccagcacaaaaacgctgaaaattncaaaaaccagaatgcctcttctcctncaaatgattgcaacttctctctacaagggcacaaaactagacagagaatgagtttgatgatttgacagacgtaggctttaaa

SEQ ID NO: 646613 - DNA, 571 bp, Homo sapiens
  misc_feature (162)..(162): n is a, c, g, or t
  misc_feature (169)..(169): n is a, c, g, or t
  misc_feature (228)..(228): n is a, c, g, or t
catcacattgtcactccccagctcaggtcacgtcaagggtttccggttaccttcccagtgaagcctgggactcctcaattttggatgtctaagacccgcctcaattgagatccatccgtgtggaggacacatgttttggggaaatgggatctaatttttttnttctgtntgggtacattcccctttctttcctctctcaatcaaggatcaggaacagggtcctttatntggcattggatctaggcagagacggggtatggacctggcaaaggcagcagaactaagccttacaaatggatcctggactaaagcctaaagcacagatggggaaatgggttctcatggtgtcagagcacagtaaccgtgctaccagaaactaccagagttccacctagaactagaacagagaccgtgcagacaagcgaggacggcagaagacgatggggtgtctggagttcacacagcagagctgctggggacagggacacagaccccaacaagggaagggtggttggcgctggagctgggcaggcagcagcctcacaaagcttcccacacagcacagagccca

SEQ ID NO: 646614 - DNA, 208 bp, Homo sapiens
tacttttcagggaggagattagaagtagatagaaagccgatctggtattactcgcggtctgaactcgagatctactgtaggactgtaattcggttgaacgaaacgatgctttaataggcggttgcgccatcgggatgtcctgatccaagatcgaggtcgtaaagcctatggttgatatggactctagaataggattgcgctgtgatca

SEQ ID NO: 646615 - DNA, 570 bp, Homo sapiens
  misc_feature (232)..(232): n is a, c, g, or t
  misc_feature (530)..(530): n is a, c, g, or t
ctggcatctagagatccggctgctacgggatgcatcagctacaggcactgatatgactacacggggattgtgctggagacatgccatgctgccagatagaagaactcagcccattcaggtaaaactcgcaaaacctccggctcactcagttaagggaacacgacagacacagaaatgcctttgtcctttgtataatcagcaggctccgaggaaaaagtttcttcttttgtgngcatgaacacagtgggcttcagtaggttcaggttggcactttcttttgtggaaaaggaagagcccagcctctgtaaatcatcacttcagctcctgattggtcccaggccaagctgaatagcccttaggaataatcacttcaactcctgattggtcccgggccatgctgaatagcccttatgaatcatcacttcggttcctgattggtcccgggccaaggtcccagaccaagctgaatcacgctttctccaagacagcccgcaggctaagtgcattccttccccttcccagtccataanaagcccggaccccagactcgtactgagacacttatttgga

SEQ ID NO: 646616 - DNA, 523 bp, Homo sapiens
ttggaactatgaaaatcctagaagcaaactgggaaaactcttccggacataggcctaggcaaatactttatgaccaagttctcaaaagcaaaagcgacaaaactaaaaatagacaaataggatttaattaaactaaaaagcttctgcacaacaaaaggaacaatcaacagagtaaacagacagtctatagaatgggaaaaaaatatttgcatttgacaaagggctaatatccagaacctacaacgaactcaaacaactctacaagatacaaaaaaattaaaaagtgagcaaaggaatgaacatttaccaaaagacgtacaagcagccaacaaacacacacaaaaaaatgctcaaaatcactaatcatcagagaaatgcaaattaaacccacaatgagataccattttacaccagtcagaatgactattaaaaagtctaaaaacactgtaatacgggctatacaggtggctgagtagctgggatcacaggcgtgagccactgcgcccggccacgtgtgatatat

SEQ ID NO: 646617 - DNA, 1048 bp, Homo sapiens
actcccagtatgaagaggaccaccaccaatgaagtgggggtccgttctcctaagagatctgcaccttcaggcactagttcggcagcagcagtggaatgggaggaagagctcctctatcacgtggaagagatagtgatggaggtccacctcgaagggaaccgctccccctcgtcgtatagagtgtgagtatggtccccaaggagatgcatgggatattcgtactagaagacagctattcaagcagagagttacccgaggttctgcgtgatacaagagattatgcacgcagcaccacgagattatacttaccgtgagttatggtcacttccaggttcaccgtgaatgactagtccattcaatgaggctatggcgatagagatggactactgggtcggtgactcggtgcagctacttcaggattcagtccaacggtggaggcttgtccgtacagaagcattcagtgatgacgagttatggtgagagctacacgtaggtgctcacagcttacagcggagggacaccccgcacgatctgtatggttggaacatgacagtgctgctatggatgatatataggcgaggctcacgtgatcggatatggtggcacagtccgaagaacaagtgaacttcaaatgcgcggccgagagctgcatcgtctacctcaatgttgtgacatgggtttgggcagcacccagatacagaggggccttgcagccctttcttgtacgcaagaggggggggtacccacattacttttcaccggtgatctacctaacaagccaagtatacaaaagggcccggtgggaagcccaaccccgaaggacagggtcgggcttgggggccccacggggcagggaaaaaaggcccggacaatctggaccaaggaaggggcagcggaccggcaggaaaacggcagcatcaacgcaaggcaaacgcacgaagcccagtaagcgtcatgaggaccgcataattatcaccgcaggcttgcaacaccgcacaaatgacgacccaacaaacgagacgttgggagaccacgtatttctcactcg

SEQ ID NO: 646618 - DNA, 317 bp, Homo sapiens
ctctacgtcgagggtctccgcgttaagtccagagataaggacttcattttacaatggtcgtcgtactaggaactcctcttccgtcttctgtcgcaggcagtgaaccatgacagcagaggtggtggttttgcacccagcagtgatagcaatttgctcagccaagggcttgacatcacctttcttcaccagaacagaagtgagggccacgccactctcagaaatggcccggtggaagaggttcttggccaatggagacaaaacaagaacagagacactttctcctccctgctgactctccacaagatggtcacagatga

SEQ ID NO: 646619 - DNA, 99 bp, Homo sapiens
tacgccgctgggggggcctgtgtcctggtggcttgatgccacatggagggagtttcattaaatgctaactactttttgacaatttaaagaggaagaggg

SEQ ID NO: 646620 - DNA, 274 bp, Homo sapiens
  misc_feature (21)..(21): n is a, c, g, or t
ggtggccattctgcagtctgntggagctgctggactctccgtgccatctactgtcatcgtgggctctgcagggtctgccgttgtggccagtgtcatgaacatctgtgagagtttctacccttttctcatgggatcagaggtggcagacatggcgacagaggtggcagatatggcgatagaggtggcagacatttcaacagaagagcactgcccaacttgtctaacacagagaaggattaattacccccaggcgacaatctcctaacacatattg

SEQ ID NO: 646621 - DNA, 660 bp, Homo sapiens
aatgatgctgaagagacgcctgaaagctgatgaagacagtagcgagagataggaggccaaacagaaggagctcagtgagaaacagataagccaggcactgctggtgacaccaagccactaccagctgataatggtgtgtggtcctgaggaagagagcgtggacccgagatcaatactacaaagagtccgcagtcaagcaattcatcagctgaaggtcaatggggaagacccatacccacacaagttccatgtagacatctcactcacgtgacttcatccaaaaatatagtcacctgcagcctggggatcacctgactgacatcaccttaaaggtggcaggtaggatccatgccaaaagagcttctgggggaaagcgtcatcttctatgatcttcgaggagagggggtgaagttgcaagtcatggccaatttccagaagattataagagtcagatagaagacatttattcagtattaaatagacaaactgctgtcggggagacagtaatttggagttcagggtgaatcctgtgtaaaagcacagaagggtgagcttgagcatcagttccgtgatgcagatcacacttgctgtctcccgtgcttgcactatgtgaccgtcatcttcacttctgagactcaaagacataggaaacaaggtatc

SEQ ID NO: 646622 - DNA, 209 bp, Homo sapiens
gtcgactctttaacaacctgtatgtgtgttaggcagagcaccccatgctctttaacaactctgtatgtgtgttaggcagagcaccccatgctctttaacaacctgtatgtgtgttaggcagagcaccccatgctctttaacaacctgtatgtgtgttaggcagagcaccccatgctctttaacaacctgtatgtgtggtcgacgcggcc

SEQ ID NO: 646623 - DNA, 113 bp, Homo sapiens
atcaaggtaggcactctgtaatagatctatgggatagacatataggtggaaaagttactacagaaaagcttgtagatacatacataccccttgctataactagtagtaactat

SEQ ID NO: 646624 - DNA, 411 bp, Homo sapiens
aaagcttccctgaccccgcctcctgtagggcagccaagcgagcctgtggaggtaccatatgactgtaggcctctggggacagggagctgcatttgcttttcaaggccagggacacagccatttctgccagcatctgttgatcagtgagtgagtgagtgggcaggtaaaccaggagccagttaaaagcaggccctggatgggtggggatgccccatgtccccaggctgcagctgcaggcagccccccccattgttggaaaagcctttgccccagctcagccccctccttactccccttgtgccctggggaccctttgcaaaggggccctttgcagtttgtcccccccatcgctggacttttggacatggcctccagatttgccccttttaaataaaactgcagtggatgtca

SEQ ID NO: 646625 - DNA, 280 bp, Homo sapiens
agtggagagagaatgggagtggagagagaatgggagagcattagggcaaagtatctaatgcatgcaggttttaaaacctagatgacaggttgataggtgcagcaaaccacctatggcacatgtatacctacgttaacaagatctgtgcattctcgcacatcgtatcccagcaacctacaagtagaatacaaaataaaataaatatttatttagtgtatctcttccactagaaggtaagctccttaagaacagagattgagacctcgttctgctctccagt

SEQ ID NO: 646626 - DNA, 370 bp, Homo sapiens
  misc_feature (58)..(58): n is a, c, g, or t
  misc_feature (83)..(83): n is a, c, g, or t
  misc_feature (86)..(86): n is a, c, g, or t
  misc_feature (217)..(217): n is a, c, g, or t
  misc_feature (249)..(249): n is a, c, g, or t
  misc_feature (284)..(284): n is a, c, g, or t
  misc_feature (308)..(308): n is a, c, g, or t
  misc_feature (312)..(312): n is a, c, g, or t
  misc_feature (343)..(343): n is a, c, g, or t
ctgcactctagcctgggagacagccaggctccatctcaaaaaaaaaaaaacacaaaanttatccgggcgtgatggcacatgtntgngatcccaggtactagaaaggctaaggtaggattatcgcctgggcctgggaggcaatggttgcagtgagccgagagtgcagtgacacgatctcggttcactgtaacctccacctctggggttcaggcggttntcctgcctcggcctcccaagtggctgggactncagtcacatgccaccatgcccggctaatttttgtntttttggtggagacagggtttcancgtnttggccaggctgtgtttgaactcctgacttnaggtgatccacctgcctggggcttcca

SEQ ID NO: 646627 - DNA, 285 bp, Homo sapiens
caaccccttaaaaagttttagttgttcaaggcccatttaaaaccaatttttccctttgcccccaaccaggtggcccgggggggggacccccccctaatatttttttgtttttttgggtgcccccccccccccgggtttttggccttggcccaattccccatccttggggcccccccggttggcctgggctttttttggttcccccctggggccctttggggggggctccggttttttgggggggtttttcccttttaaggttataccccccggggggccttccca

SEQ ID NO: 646628 - DNA, 211 bp, Homo sapiens
ttcggttatcccatacgtattctctcttacatcagaattgtagtatacccaagagtgcaggggtggcaaatgttaataaaataagttagtacatgtgggaggttcttatatccttggtagggtaagctgatagtgtatagatttctgttcccattattccagtagtgttttaaattatttaagataaataattactgtaatgttagagata

SEQ ID NO: 646629 - DNA, 175 bp, Homo sapiens
ttggtcccccctttgggccccccgggttttccctttttggtttcgggttgttttttgggggggattgtgggggggaaaccattttcccccgggaaccgctttttcctttttttggatttttttcgccccccctttggggatttgggcccccgggcccaaaatttgggccggggga

SEQ ID NO: 646630 - DNA, 269 bp, Homo sapiens
tttttaattaatttatttttatgagacggggtctctgtctgtcacccaggctggagtgcagtggtgcaatcatggttcgctgctgcctcaacctccagggctcaagcagtcctcccacctcagcctcctgagtgcctgtaatcccaactacttgggaggctgcagcaggagaactgcttgaacccgggaggcggaggttgcagtgagccaaaattagcactgctgcactcctacctggaaaaaagagaaaggctcattctcaaaaataa

SEQ ID NO: 646631 - DNA, 637 bp, Homo sapiens
caccacccaacccctagcgaggcgcacaggataaccgatgtatatgtaatgtacctaagcacagtatctacttctcctatatccatcctgcaagcaactcaaaatataaaaaataaagtatacatggtagtaatatacaaatctttgcttgataagtattaagaaatatagggacttgctagccgtaatttaaacgctctagttgatttatgcttcccgttatggatataatggaggggagcgggagcactagtagatttatgcctggaaataatgaacagtctaagaaccattccgatgactgggaaacaccacaagaagttgcttgaaacgctatgaacaagccaggactgacgccatgatcctctgaatgcctattggtataccatatcctttgacgccaatcagctacgagtcccgtagagacaaatcaaaccaagtattataaccaaaagaacgacgcaactcccctagggggaatccttctaagaagtcggaccctgcatgcgcatagccacgctttgcgcaacttgggccggccgttataaccaactatacatagactgagggaaaaccgctgaagagggacccccccatgaccaggtccccccaccaccaccctgccgcaccagcaccg

SEQ ID NO: 646632 - DNA, 117 bp, Homo sapiens
  misc_feature (77)..(77): n is a, c, g, or t
  misc_feature (88)..(88): n is a, c, g, or t
gggagtacaagttgcaaggtctgcaacaaaggtcttccgttcttccattcgggaaagccatcttcctaaggcctgtnaggcagccccncagagccacaggtgttacaccccttcccc

SEQ ID NO: 646633 - DNA, 240 bp, Homo sapiens
  misc_feature (8)..(8): n is a, c, g, or t
  misc_feature (17)..(17): n is a, c, g, or t
  misc_feature (21)..(21): n is a, c, g, or t
  misc_feature (34)..(34): n is a, c, g, or t
  misc_feature (63)..(63): n is a, c, g, or t
  misc_feature (66)..(67): n is a, c, g, or t
  misc_feature (120)..(120): n is a, c, g, or t
  misc_feature (128)..(128): n is a, c, g, or t
  misc_feature (144)..(144): n is a, c, g, or t
  misc_feature (150)..(150): n is a, c, g, or t
  misc_feature (156)..(157): n is a, c, g, or t
gaaatatnaaagaagancatnttgagaaaatgcnaggaataaatagaaccatgttgtgcaaanaannggtttaacaggagattttgaggcatagggtgtgtttcatttcagaacattttnggaatgtntggaacatttcatttnctgttntgttanntgtgcctctgtaaatctacttttgcaattttaagtaataattttatgaataaaaatgggaaatgcttcctaattccacatagt

SEQ ID NO: 646634 - DNA, 150 bp, Homo sapiens
ccaggtcatcagccggtaccgaatctcgacagtggtgcaccacaccagcttatccccagcccgcgaacatgacaaactatgtgcatttgagtgccgcactatacaacgtgtgaatataaccgtgcttttaagcattgactttaatgtctg

SEQ ID NO: 646635 - DNA, 290 bp, Homo sapiens
gccaaacgtcatggataagtacatcgttggacagcatcacgagtccagataggtttcggggccgtccactccaagaagagtttgcgtgcagaggatcttgttctcattctcacaagtggctaaactcctgcacttgcgtccgtccacggtctcctcctcaaagccttctccgaccttgaagttgctcacagtagtgcgcgcgccaccccccttcttccaaatcatgtcagactcttacgcatacctaaacttgaatcactcctcctaacgtatgtactggttggccggta

SEQ ID NO: 646636 - DNA, 885 bp, Homo sapiens
caagatgcaccacggcacgctagcctgggtgacacagcaagactccatctcaaaaaaaaaaaaaaaattatcttcaaaaaggcatatagtctctggaatatatttgtatactattacattggtacaggaatctggtacttatggtcgggtggtgtaatataccaataagttttatataatatcctcataagctatcctaattttggagagaaacacaaaaagttatagatggatagtctggtataatattagacaaaatagtaagctttataaaaaagttatttcgggcaaatgggtaagggaattgggggtgggaatggtgctgaagattaaaatggtagcttggggtataacttcatggtgtttttcaaaatatactggaaggtccaacatggattggaaataaagaaaatggtattttctactggaaccattaacattggttatttaaaacagttttcggagtctataaacatttcctcaacattttttaaaaagtcttagttaaaggtactctgatatacagtagtgttctcaagtatagtcatgaatcttggtcaataataactagatgctcttaaaatgtgaggattcaggagacccacttctaaacagggattacctcttgaggtaagatggctgtgtgaactaaaattggttggttgccttttgggcggtgcaatatttagaccagtagggtttcgatattaagggggaagttaacaggcggtaaaggccaattttgacatttaggatatttggttgaaatggtgtaaaaaggggttatgagcgcaaaatgtatggtggtggaagacccatattttttgaggtatgtaacacgatgtttgaaaggatgataaaaaagcgggtggggtgagtgagaga

SEQ ID NO: 646637 - DNA, 245 bp, Homo sapiens
  misc_feature (24)..(24): n is a, c, g, or t
  misc_feature (168)..(168): n is a, c, g, or t
  misc_feature (204)..(204): n is a, c, g, or t
ggctattcttaggaacgccacaangaacccgatgcagcataagacaaaaatgcgcgcactcataaggtaaccggtcgcttaatttcgctatagcgcatacgaaacaaatcgccgtatcccactaattccccgcgaaaaaccagacatcggataagataagcgcaatanatatccggcaggtttccccaccgtttacatcgcgantctcttgagggtgtctaattggtgctacccaccactctatc

SEQ ID NO: 646638 - DNA, 1335 bp, Homo sapiens
gtgccgagagtcgtcggtggtttcctgcttcaacagtgcttggacgtgaacccggcgctcgttccccacccctggcctggcctgcccatagccagccctccgtcacctctatcaccgcacccatcggacatgccccaacggcccaccgaccgacgatccagcgaccgcgcagacaaccgccgcacgacgaacagcctctacctatagtcgccgaccatgacgacccgcgatccaccatcgcaggatgcgccagaacataaccaaacagggactacaagacggccgccatcaaacccgcacagatcaacactggaagctcaacggcctcctaactgattaaccctgtcccatgtcataacctaccatatggacccggcgaatgactggtggcatatgcgaaagaaaacttggcacaaaaatacataacttacacacacatcatcattgacggacgacgggaccacattgactgagaccaacatgacatgcacgccatgacacgaaaccccaacgcgacggctggggcccgcacatacaacccatatacagagaaataatcacaagacaacacaagacccgtgatgaatggcacccagggagacgacgcgagagccatgacaaccgccacacggagacagatgatagccataaacccactacaaggggaagaacacacccagtggtacgacacgaccaaggagcaaccataacctgaggcaacacaggccaaacgacgacggggacgcacacgacagccaacaacatgcaaccccacaaatacggtgataacaagcgccacatcgcgcagacccacaacaaacacctcgacgatgacgccacgagatgcgcaagcccatcaaaaaacaattgaagaccgcaccacgatacaacgcaaaatagcagcacggaaagggcagaccaccgcgacacataggacattcgcaggaaaatacactacatagaagcaaagacaaaagcagcgagaaaacacgcgccaacaataaaaagacgagacacagcagcccaacacttgcccaaatacccggacaggagaagaacaaggctaccccgggccaggcatgagagagagcgagaacaaactcacaagaccaagagagtaaccaaacaataccagaggcaagaagagacacacaagaaagaaacggaacaagacacacagacaaaaagagacagcacaaaggagagaaagaaagagggagagagcaaaagaaaagacagagacaagagacaacacaaaaagcgcagaaagaaagagagaagaaagcgaggagacgcggccctataacacacacaaacagacaccaagacacagaa

SEQ ID NO: 646639 - DNA, 319 bp, Homo sapiens
cattttcttccattacttaggaaagagtggcaaactccactaaaatttctctgtgttgtcacagtcttagaggttgcagtaactatattgtaagctttggtgtacgtctaacttagcaatagggatggtaggattcaaatgtgtgtcataaagaagtggaagctattaacaccaatgacataaatacatacaagacacagaactaaactgtcatgttattaacagttattaggttgtcatttaacactcaagttcctttatatttctgtcccatcaggcaaactgaaggatatggggaatcattggttatcttccattg

SEQ ID NO: 646640 - DNA, 103 bp, Homo sapiens
gcggccgcctactactactactgctcgaattcaagcttctaacgatgtacggggacatgttggagatctctacatcatctctattggagattacaatgattaa

SEQ ID NO: 646641 - DNA, 436 bp, Homo sapiens
caacgatggtcctacagctatgttattgctttgctttgtttcttttcttttctttgagatggagttccctcttgtgcccgagccagagtacagtggtgtgacctcggttcactgcaacctctgcctcccaggttcaagcgattcccctgcctcagcctcccgagtggctgggattacaggtacacaccaccacgcctggctaattttttgtatttttagtagaaacggggtttcaccatgttagccaggctggtctcgaactcctgacctcagatgatccgcctgcctcggcctcccaaagtgctgggattacaggcgtgagccacggcgcccagctttttttttcttttttttttctttggagatgggatcccacttggtggctcagggtggagggcaggggtgctatcatagctcacggtagtctccaactccg

SEQ ID NO: 646642 - DNA, 870 bp, Homo sapiens
  misc_feature (448)..(448): n is a, c, g, or t
gactctgggtccatcttcaagacattgggtctgtggatcaacccaaccgaccactcctcttccaagaatcatttggacaggttctttcggaggaattccttctcttttataacccgcggacccttttggaaaaacataagagatgggctcacgagtagtagagatgcacgtgcaaagtagaattactgtgtgcggctggctgtgacgggtggcacccagggtcgcagcaaacacggatatcatgtcacctggtaccgcatggtacgcacagttacgaaaaccacagaaggcaaatgaataaacaaatcgtgcacgttctactgtcacattcatacggatcagagtctctctcagagggatacaaggatgtgatgaacttgcaaccatgcggacggcatcttcctaccgtgttggcgactagtagacaagtgtaggacttggcctagangagtcgacttcttgaaaagcccaatggagtgcagtgtcgattcgttcctttcgacgactcggtgagggctagcgaactgcaccaacgcaatgggtagtatggtccaggacacgttcctgggagaaatcccggtagtaatgagagagcgtgattggcgctaagtaaaacactcgaggatctctcgagatactagtttcttctgccatatttgagatgctaggctcatgtccatacaatagagaggggacctaagggtcaccctggaatgatacgcacttatgtctgaggggctcatgcgccgttcgtaatcgaccaaccggacaggcgcaaaatgtgccacttgtcactgagtcttgttttgacactcgcggcgattgtttctaagctcaacttggggttgaacacggatgatccggcggaaa

SEQ ID NO: 646643 - DNA, 915 bp, Homo sapiens
  misc_feature (31)..(31): n is a, c, g, or t
  misc_feature (132)..(132): n is a, c, g, or t
  misc_feature (135)..(136): n is a, c, g, or t
  misc_feature (154)..(154): n is a, c, g, or t
  misc_feature (167)..(167): n is a, c, g, or t
  misc_feature (266)..(266): n is a, c, g, or t
  misc_feature (291)..(291): n is a, c, g, or t
  misc_feature (303)..(303): n is a, c, g, or t
  misc_feature (331)..(331): n is a, c, g, or t
  misc_feature (334)..(334): n is a, c, g, or t
  misc_feature (342)..(342): n is a, c, g, or t
  misc_feature (363)..(364): n is a, c, g, or t
  misc_feature (377)..(377): n is a, c, g, or t
  misc_feature (453)..(453): n is a, c, g, or t
  misc_feature (463)..(463): n is a, c, g, or t
  misc_feature (515)..(515): n is a, c, g, or t
  misc_feature (644)..(644): n is a, c, g, or t
  misc_feature (726)..(726): n is a, c, g, or t
  misc_feature (728)..(733): n is a, c, g, or t
  misc_feature (740)..(740): n is a, c, g, or t
  misc_feature (760)..(760): n is a, c, g, or t
  misc_feature (765)..(765): n is a, c, g, or t
  misc_feature (825)..(825): n is a, c, g, or t
  misc_feature (876)..(876): n is a, c, g, or t
aaacccggggcaggaagaaccaaacaagaangacaaaaaaaaagaaaaaaaacaatttcaaagacaaaaaaacaacaaaacaaacttcctttccaattaattataaaaaggagtagcaattaccatttaaanagnnacaaagaacaataaaacncttatttaactcnagaaagaaaaaaacacaatcaacacacaaaagaagaaacacacaagaggcgcaaaacaacactcagaagcattaaaatcaacacacatacaatggaacnaccttcaccaacccccccattaggncatcacaaagangagtcatccgacgtcctaaaagcaatanggnaatatganagtcagaaggctagcgaaaanncggccgaaacagnaataaatgaaaatggaatggaaaacaaagggcttaaagagaacagaaggcggggcacgggggcgcacgcctgtgancccagcacgnagggaggccgagaggggcggagcacgagggcaggaaatcgagaccatccggncgaacacggggaaaccccgcctctacgaaaaatacaaaaaaaattggccgggcgggggggcgggcgcctggaggcccagctactcgggaggctgaggcaggagaatggcgtggaccccggaggcgagtnagctgagatcccaccactgcactccagcctgggcgacagagcgagactccgtctcaaaaaaaagaaaaaaaaaagtacaaancnnnnnntcatttntcaagtatatattatgttanattanaaacctattattatcacagaaatgttaggcatgccagaattttcttcttcaagttgagtntcagtatcacagataaacataaccaaaactatatatatatatatatatatntatatatatatatatatatatatatatatatacacacac

SEQ ID NO: 646644 - DNA, 173 bp, Homo sapiens
actcttatggctttatgtgaatatatctttgcccattttggtttgagtggggatggtttatcttgtaatgagcatgtgtttaatgctggggaggagtgacagacagtggcccagaaacaaccaagtcatcttctgtattcacaggggcagaaagggcatgctttcagtgttta

SEQ ID NO: 646645 - DNA, 166 bp, Homo sapiens
cttactcttagcttgtgtttgagcgtggagttgatgagacaacagcagatgacaggaaggtcaagtccatagtgacactggatggagggaaacttgtccactgcagaaatgggacgggcaagagaccacactatgtgcgggacgctaattgataggaaaactcatc

SEQ ID NO: 646646 - DNA, 631 bp, Homo sapiens
aatgcgtggcctgtaacaatgtaataaaaagcctctttctttttaaaaaaaaaaaaaaaaaaaaaaaaaaaaaaaaaaaaaaaaaaaaaaaaaaaaaaaaaaaaaaaaaaaggaaagaagaaagaaaaaaaagaagataaaaaaagaaaaaaagataggaaaaaagagagaaaaaaaggtaagaaacaaacacagaccaaaacggaagggagacgcgctgcagagcggcacgcacctgtggcgggagagagggaacgacggcaacccaggcacgacgtcacgggtagcagacgagggagctacgggcggtaggagcggcggtagctaaaacagagaagcaggagaacaagcgacagtaaacgacccaacacgaggaagcaacaaacaacacaaccgcacaagcagacaagcagagaaaagagaacgacaaaccagcggcgccgagagacagcgataagcaacagcaaagcccaaagcgagcagcaaaggaacaagagtgcgaacgagcagcacaaatgaaacatgcaagatgcgcgcgcagaccagccaccaaggacgagcggcggagcgagaggggagaccaagaagcagacgagggccaggacgccggcagcgggaggacaagcggggg

SEQ ID NO: 646647 - DNA, 137 bp, Homo sapiens
cggaggcgttgaatggcctctttaacccagctcctgcctcccagccttctctccaggcccctccgggccattcaacgcctccgggccattcaccgcctccgggccattcaacgcctccgggccattcaacgcctccg

SEQ ID NO: 646648 - DNA, 201 bp, Homo sapiens
tttaaaaaccccccccccccccctccccccttccttggggtggggggtgtttttctttttttccccaggcccccccccccctgggggggggttttttttttttccccccccttggcccttcccgggggggggggggcccccccccccccccccggtgttttgtttggggggccaaaaaagtttttttttttttttgggcca

SEQ ID NO: 646649 - DNA, 767 bp, Homo sapiens
gccgggtgttaatcggacgaggctgtatacgggctagggaatgttagttgagaatctagaataaggaatatcattacagtttgtgaataattaacatagctctgaggcaattaggtctaagagagaatcatgctgggtaacaaagaaatgtgtgtgtaacattttattaagcagtctaaatctttcttggcatctttaggaattttcttatatgaaaatgttatgacaaaaaataaaaatgaggccaggtatgttggctcatgcctataatcccagcactttgggaggctgaagcaggtggatcacttgaggccagaagattgagaccagcctggccagcatgatgaaagcaggtctttactaagtaaacaaaaattagccaggcatggtggcacacactggtagtcccagctactcaggaggctgagacgtgagaatctcgaacctgggagatggaggttgcagtgagccaagattgtgccactgcactctcgcctgggtgacagcaagactctgtctcaaaaagcaaaaaaaaaaaaccaacaaaacaaaaacaacaacaaaaaagaaaaaacctccggagggacctctatatgccgcggggggcgcgcgaacaaaaggacgtcatcacaaaggggccccatgtggtccatcaactggttttcctcggaccccacttttcgtggtcacacagggggaaaatatcgccgggtcccccctaaaaggggagcccattaatttccgaaaccccgttaacccgcctaaac

SEQ ID NO: 646650 - DNA, 588 bp, Homo sapiens
aaatggcgacgatatgtgtattcactataaacatcggaggttgtcagacggccctatcctctccaaatgaaatcttcgggtccaccttcttactttattaaaagggaatcgtggggctggacggactttctaatgaacccaatggttttgatgatggttcttcctttattgatatttgtgcttctgcctaaagtggtcaacacaagtgatcctgacatgagacgggaaatggagcagtcaatgaatatgctgaattccaaccattagttgcctgatgtttctgagttcatgaccagactcttctcttcaaaatcatctggccaatctagcagccgcagccgtaaaacaggcaaaagtggggctggccaaaggaggtagtcaggccgtccagagctggcatttgcacaaacacggcaacactgggtggcatccaagtcttgggaaaccgtgtgacgccactactataaacttgagtcatcccgacgttgatctcttacaactgtgtatgttaactttttagcacattttttgtacttggtccccgagaaaaccagcttcatcttttgtctgtttaagtccattcctcga

SEQ ID NO: 646651 - DNA, 1078 bp, Homo sapiens
gcagaactccatgtgcacggagcgccctgggctggctcagctgtctcactacgtgtcggcaagtacaagaagacagataaaaacatgatgatcaacctgatggacattctggcatagtgaataccggagataagcagcattgtcctctgtggcacgcccttgagagcatccatgcgggcctaggtgactgggcctgcctgtactctccatgtgtgctggcactctcccacgccgatcgctctgaaacttgattacctcacactgctgggcttgatcatggcgacacacgggcatctgagatcatcatacaccagcaaactacaggcttcgtgtttccaatgagcatctgacagctgcattaccgagactgggtcctgagactagatagacaagcctatgatggcgaggcactccggcccgaaaactcatgactcgtgttactatggcacgtacccctggtcctagtaggcaacttgctgggttgacctggtggttcgctgacgatcacgaattatcgcctgagcaagaaaatacgctcaagcggcgttcgcagagcccagtgacggtggcctgcgcaggcgtatctgtgcgcaagttcaccctacgatgtcctacgtggaaggagaatcacttagtgcatgggctaggtctacttccctgaatgagagcctgtcattcatgacagggggtcatgaccgatgtacgcatagcccaaggagatgtcatgacatgagagatcactaggcaacggggtgctcacaaccggggcgaaataattgtagaaccactgaaagccggcatgattccgagagacacggacccacgcagagggcgatctactcctgggacaaggaagataatccatgggaagcgggatcggcacgtgagaggagaacacaagacactacagcactgacgctagttgaacctagtaaatccaatagagcgtcaccactagtatactgctgcgctgcgtgtgcccctatagtgtaaaaaaaagaagacaaaagaaaaaaacaaccaaaaagtgaacccgaacaagccaaaaaagaacaaaaagaaaaacagaaagaaaaat

SEQ ID NO: 646652 - DNA, 113 bp, Homo sapiens
tctaagcgatgttggggtacatgatctgtcaccaggtattgagcgtagtaaccaatagtttttcaacccttgccctcttcctccctctcccctctagtacaacctgccggtgg

SEQ ID NO: 646653 - DNA, 823 bp, Homo sapiens
  misc_feature (37)..(37): n is a, c, g, or t
  misc_feature (45)..(46): n is a, c, g, or t
  misc_feature (53)..(53): n is a, c, g, or t
  misc_feature (55)..(56): n is a, c, g, or t
  misc_feature (71)..(71): n is a, c, g, or t
  misc_feature (84)..(84): n is a, c, g, or t
  misc_feature (99)..(99): n is a, c, g, or t
  misc_feature (102)..(103): n is a, c, g, or t
  misc_feature (107)..(108): n is a, c, g, or t
  misc_feature (110)..(111): n is a, c, g, or t
  misc_feature (113)..(115): n is a, c, g, or t
  misc_feature (117)..(117): n is a, c, g, or t
  misc_feature (122)..(122): n is a, c, g, or t
  misc_feature (144)..(144): n is a, c, g, or t
  misc_feature (149)..(149): n is a, c, g, or t
  misc_feature (154)..(154): n is a, c, g, or t
  misc_feature (157)..(157): n is a, c, g, or t
  misc_feature (159)..(159): n is a, c, g, or t
  misc_feature (161)..(161): n is a, c, g, or t
  misc_feature (163)..(163): n is a, c, g, or t
  misc_feature (169)..(169): n is a, c, g, or t
  misc_feature (174)..(174): n is a, c, g, or t
  misc_feature (176)..(177): n is a, c, g, or t
  misc_feature (214)..(214): n is a, c, g, or t
  misc_feature (264)..(264): n is a, c, g, or t
  misc_feature (267)..(267): n is a, c, g, or t
  misc_feature (291)..(291): n is a, c, g, or t
  misc_feature (299)..(299): n is a, c, g, or t
  misc_feature (356)..(356): n is a, c, g, or t
  misc_feature (358)..(358): n is a, c, g, or t
  misc_feature (371)..(371): n is a, c, g, or t
  misc_feature (373)..(373): n is a, c, g, or t
  misc_feature (375)..(375): n is a, c, g, or t
  misc_feature (377)..(377): n is a, c, g, or t
  misc_feature (389)..(389): n is a, c, g, or t
  misc_feature (399)..(399): n is a, c, g, or t
  misc_feature (483)..(483): n is a, c, g, or t
  misc_feature (541)..(541): n is a, c, g, or t
  misc_feature (545)..(545): n is a, c, g, or t
  misc_feature (693)..(693): n is a, c, g, or t
  misc_feature (723)..(723): n is a, c, g, or t
  misc_feature (730)..(730): n is a, c, g, or t
  misc_feature (742)..(742): n is a, c, g, or t
  misc_feature (820)..(820): n is a, c, g, or t
tccctttaagtagcagaaactccctcagaggtagatntttgagtnngatattntnntccaccgagcgattnttttggtttaagntgatttgcgtatgangtnntttnncnntnnngnggggngggggtggggatgcgtgggggngtggnccatnttntntntntagaanttatntnnccatttttggcatctctgattgggcagggctggcgtntccacagattccagagcatacaagtggggtggggaagggaaagtgggggngcncaggagagaaacagaatagttgcnagtgggantttttgtgtgtgaggtgtgggagagggagagagaaagacagaggagaaaaaggggtntnagaaataggtttntngntntttttttttttntttttgaganagaaagcgagagaggaaaaagatggaaaaaagggagagacagaccccacactccccttagaggccccattcttcctgccatgtnattagcacccccagcacagagagtttcgttagggaggggatgaccccattggcccttntctnttttgtgcttctcctgtattggggtttgtcctctggaagcctgcgtcctcttcaagtcgccttgtgagagcccccacccctgtgaccctgaggggcaagatcagttggaggtatcagagtgaacactccctggtccctccgttggggntttcactgaagaggggggtcacagcctctngccagcngccatttgcccncattttcccgtgggctgtacatctgggctcccccgaggttatccccatagcccctggccccatcgagtgttggagtgnttc

SEQ ID NO: 646654 - DNA, 435 bp, Homo sapiens
agacttattctgtcatttcttcgattttgttaaagatgattatctatttaaagcataactagtgacaatatattttgggattataacatctgtagaagttaatagcacgaatataacagcacaaaggcatggaataaaatagtactatactgctatatgccttgtttttttttttaagacggggtcttgctctgtcacaaaaaacaaacaacaaaaagcccaaattaaatggaagcagactttattactcacgccttataatcctagtatttggggagaccagggccagaggatttgcctgaagccaggatttcaggattagcctgggcaacatagggaggtcccgtctctgtcaagaattacgcgagcttcacactttcttaagccacctcctcataaatgggtccagtcctgaggaggtggcgtcgataaaca

SEQ ID NO: 646655 - DNA, 203 bp, Homo sapiens
aagggtgaagcagcggaaacagtggaatgccagacacaggctcgctgctgctggaatggcggggtggagacttccattcctctgtccggagaggcacaggtgtcaccagtcccagccaaaggctcctcacaggcgctgtgaattttggtacaagtcttgtatttatcgaactcaacaacttgttgcaattttaattaaaattg

SEQ ID NO: 646656 - DNA, 121 bp, Homo sapiens
tcgagtcggtaccggcacgagcgcccaagtccacttgtagctgagaaacttgaaagaacccaaaacagtcaatgttgttcagtttgaacccagtaagggagcaatggtaaggcatataaga

SEQ ID NO: 646657 - DNA, 285 bp, Homo sapiens
gggaagcgaggctgtaccatggtagcttcctcataagactgagcggcatatgagcattacatggccggactacagtgtggcaggggctcataccctgttatcccagctactttagggaggccaaggctgttggatcacttgaggtcaggagttcgagaccagcctgaccaacatggtgaagccccatctctactaaaaatacaaaacttagccaggtgtgtaggcaggtacctgttatcccagctactcgggaggctgaggcaggagaatcgcttaaacccggga

SEQ ID NO: 646658 - DNA, 794 bp, Homo sapiens
ctgttttggagtcaggtatgatcacacatgtcagtttctctttctgttcatgacgtatatgatgtgacatatttttccaccagatattatggagataagaaggatgaaaagcacacactcccatggtccacttgacctgttgcaggtggaacctccgggcatgggcccaggattctgtatttttagtaaaagccagtggaatcccgtggtcttcaagctctccccccaccaaccccatgtgcggaaatgcctgggacctcccttgggtggcgctgccggtccagcgttggggtgagatggcgcccaccgagttagcggagctgcgtgcctgctactgctcctgggccacccctcctgctggacctcgggtctgtctccctgccttccctgcccttggcgccttgagcaggatgacaatctctgaggtactaacgtagttctgcatctgggagtgtccaccactgggatcttccagaagcccaggggtttcgggccccgattcctggcatgctgaccctaggtttgggctgtgtcatggccgacccaggtcctgcgctgtgtggcctcgggcgcgtcgtttaacctctctgacgtggcagtcatcagccatcctgcgtgggacttcagacttgagcctgtgccagggcccctagctgtgtgggcctccgtggaggtgatgggagggtagggatgggctgggtcgctgggagcgctggttcatgcccttcagatgccccgctggcggggtgtgcgtggcgagcagtggatgctcatcgatgcccacagcccctgga

SEQ ID NO: 646659 - DNA, 825 bp, Homo sapiens
  misc_feature (48)..(48): n is a, c, g, or t
  misc_feature (74)..(74): n is a, c, g, or t
  misc_feature (100)..(100): n is a, c, g, or t
  misc_feature (121)..(121): n is a, c, g, or t
  misc_feature (137)..(137): n is a, c, g, or t
  misc_feature (148)..(148): n is a, c, g, or t
  misc_feature (152)..(152): n is a, c, g, or t
  misc_feature (205)..(205): n is a, c, g, or t
  misc_feature (224)..(224): n is a, c, g, or t
  misc_feature (232)..(232): n is a, c, g, or t
  misc_feature (235)..(235): n is a, c, g, or t
  misc_feature (241)..(241): n is a, c, g, or t
  misc_feature (284)..(284): n is a, c, g, or t
  misc_feature (312)..(312): n is a, c, g, or t
  misc_feature (365)..(365): n is a, c, g, or t
  misc_feature (367)..(367): n is a, c, g, or t
  misc_feature (405)..(405): n is a, c, g, or t
  misc_feature (807)..(807): n is a, c, g, or t
ggtttgttgtgtggtttactgtgtgggtaatattcgagtgaaaacganggccataaacctgggtgacgggcgangctgcttggtcccaaacacaaattancccgacctttctgggttcttnctttggtctgtcttcngcccccgtcgntccnggggagaggctgcagagctcagccctgggaaccgggcccaggcccggccctgncccccaatgtgggccggcncgtccggngcngctggngccttctggctttctctggctttggggtcggggggtttgtgtngcggagggtgccccttcttcttccctgntccgcctggctgcgtgtgggctgggggcgctcgtgtgtactgggttgggagtngntctggcagcggtggggggtggggtgggtggtagctacngctctctgggttacagtgagcgcggggtcgctttgtgctgtctgatgttgctcctcgctagtcatagggccaccctgagttcttggcagaagcccagaggcctggatcctaggagacaagtggctttggggccctcagcctttggggccatccgtggaccctggggcctaagtggatctgcagctgctgcccctctggcagagctccctacagagctggttgctgagggccctagatctcagtagcagtgatctcctccaggcagatgcagggggcctgctcggccaggcccaggtcagcgagctcccgggcctccagctccaggctgagctgctgcagctcctgctctagctgccggttgcgccggtacatctggatgtagttgtgctgcagctgcttctngtagcggatcacctgctc

SEQ ID NO: 646660 - DNA, 774 bp, Homo sapiens
gcctgaagaggtgcagaatatacagaccaacgttgaccagtaggataatagcaaacatttctaactctattaatgaggtctttaaacccttcatacctcttaaaggctggaatgctttcatcatgatccttgcgcctcttacacttacactttccgacatctggcatcagatcctcttgcgcctgggtctgcacatgcacttggcactcctgtgctgccttccgtctacgctaacttgttgaccccttgcctcaaattggatgcgttacccccatttcaaccctttcataacacccgtcttatctcccacgccttccacctcgttatctactccgcgccgaccactcgcgcttccccctccttgaccagccctcgctcttctattgctacccctccgaaagagtcttcgtcgacttgacttcgatttgctttctactgacaccttgcttcagccacctgcccgtctccctcgtcgacccatatctatgccaccccctccgcttgtatcgtcttcccttgttttcgctacatcccttgagcctcgcttccctctcctctcatcttcatccttacccgctcttgagccgcgcgatgtgttcctgcctcgctccgcttcgcgctcgcctccattcacaggactgcccttctgtatctcccaccttggtcatcaccttctgcgcttccctccgtatctctggcctctgcccatgcgcctcgcgaggacccctttacctcctcttagtcctctatcctactcggaacgtgtctcgtacg

SEQ ID NO: 646661 - DNA, 559 bp, Homo sapiens
  misc_feature (78)..(78): n is a, c, g, or t
caagaggagaaacttgagaggactccgccttcctgcccagatgcggggtggacgctccccaaatactccacagtgtgnaagtcaaaaatgaagccgcagcggtgctggtctcccaggaaaatggagggcagcttcagccgggctcggaagaatgacgttgttgatgtcctcctgtgggttttgcagacaatttaacagaagtccaacgaaaagggaagttgcctgaaagagccggctcccaatcctttcaaatgaggttctgagaatcacaacggggactgacctgtggaagccatgattgaccaaccacatcagcattagaaagggttctcttggctgggcgagtgcaaggtggagctcagagagacgcctggaggatgaggcggcacagacaaacctcagggcatcgtgggctcagttccagaggccgcagcacagtggtgatcacaacgaatgcagccacacacactttttggtttcctagtgcatgtcaaatgtatgtttacactacactgcggcctaataaagtgtgatagtgatagcattatgtctaaaaaaa

SEQ ID NO: 646662 - DNA, 149 bp, Homo sapiens
tcgagctcggtaccgggaatgtagtgatctcggtcttcaatgacttttttgcgatgttatttttactgtaagggtcacacaggccattgttgtcctggggctggagctctaagcctcgaatcaatgtaaatcctaactgtgcatggtgg

SEQ ID NO: 646663 - DNA, 541 bp, Homo sapiens
  misc_feature (35)..(35): n is a, c, g, or t
  misc_feature (49)..(49): n is a, c, g, or t
  misc_feature (59)..(59): n is a, c, g, or t
  misc_feature (64)..(64): n is a, c, g, or t
  misc_feature (70)..(70): n is a, c, g, or t
  misc_feature (79)..(79): n is a, c, g, or t
  misc_feature (95)..(95): n is a, c, g, or t
  misc_feature (145)..(145): n is a, c, g, or t
ggttggtaaaaattatgaatttgattgttacccangtaggggtagtctnggtttaaaanttccnaaaggntaaaggttnttaaaaggtgggccanttatgatgggaatccacccagtaatgcttctcttcttccccaattatcgnggaaagattcaccccatctgggaaccaaagggctctttaaccacatattagagtcacccaggagagctctttaaggaattacacatatctgtaccttgtctaagactggtataagccaggcacagtggttcacacttgtaatcccaacactttcggaggctgaggtgggaggagtgcttgagcccaggagttcaagactagcctgggcaacatggcaaaactgcatctcttcaaaacatataaaaattagccaggcatagtggtgcacacctgtggttccagctactcaggaggctgaggtgggagcatcacttgagcccaggaggtcaagactccagtgagccataatcacaacactgcactccagcctgagcaaccggaatgagacggtgtctc

SEQ ID NO: 646664 - DNA, 197 bp, Homo sapiens
tgtgaacaacacttttacttgcagattatctcagtgctgcggtaattcagtagactccattcaattcctttctcccttcttttcaacgtctcactcatcccccaccacccccactccaaacttcctgttccttggctgtataattaacagtctataccaactaaggtaacaataacctccacttccaatccttttcg

SEQ ID NO: 646665 - DNA, 340 bp, Homo sapiens
ccatgttcgcaggatggtctcgatctcctcacctcgtgaatccacctgcctcggctcccaaagtgctgggattacaggtgtgagccactgcgcccggcccaattttttgtatttttaatagagatggggtttcatcatgttggccaggctggtcttgaactcctgacctcaagtgatcctcccacctcagcctcctaaagtgctgggattacaggcgtgagccaccatgcctggtggcattagcttttttataaagttcaattctctagtttgagacctttatccaagttgctttgcctccaatgcaaaacttatttctatacattttcccgtctccaca

SEQ ID NO: 646666 - DNA, 109 bp, Homo sapiens
gatccttcatgctgatgctgagaggcaaccgaagcacccggcgtctctccttcataaattattcagcttcctacactattaaagtttaccacaatcaccaccccaccac

SEQ ID NO: 646667 - DNA, 1473 bp, Homo sapiens
gatacagcgctgacactacaaggctctggaactctagcactctctatgacaggtcatgagctatgcgatccttgcatccccctggaattgaatttctctacttgctatgcgtctttaatttctctctttcaagcattgtagtacggcaatatcgtaaagctaccaagaagacaacctcgtcctgcactcttaggatgcaagcgattcaggttagtttattgtccgaccattaccatgtgggatcattgcaagcattttccttagtcatcacttatcacttcaattccaacaaagtattactcatggcgcagtcgtcacaacggcatctctgtgaaacgcacattcgttaccatctaccagtttgcatcaatctattaaattcaagcaatggtctgggctagttggcataattaagcacatatgcgcaaattctagcacctcttactatatttccccttgtacttgaaagttcacctcagaaagagcttccaacactaaatggagttaagcagcggtctcgtgctaacccttttctcggaggacgcttgcacatgtggcataatacctttcgcttatatgaacaccgaaaaagttttcattgtaaagactcattttcgaatacggtcacttccggaattttcttttaacgtaagcgacttggaacctatctagagcttacatttccccgtaatataaattctctggcctaaagggtaaaccattattaattatttacaggtctcctaaagagtttgattaatcctgacacaaaacgcaattaggttttcaaaaccccgttggaacagtacgcacggcaattgggttctatgacacccccaagccgcttttgagaaaaaggcctacacaaagtgtgggccccagggggataatatccggcagattggactgtaaagataggaaaacaacccggggattggggccacaaagattccccattttgcaacttaattgcacccttcgagttggcaaacacgcaattttgggtcccacagcggaaatcaattttcggccgcgaaccctttaaatgtgcggtgggcaccgcccttatatacaatggaacgtccgagtggacttttcttaaccttttatcaattgtcaaaacgccactttctttggaaaaacgggtccttatagaccccaatgacaaacattctccctttttagagacttcccttcataccattggcgtgcacagctcatctcccggcagtgagcgggggttcctttgggacaacaactttgggcgcacttcggggacctctggggtggtctagtcccgcggcacagccgaaggaacctttcggcatctgggcgccaaaggcttcgctacagcacactctctccagcaggccaggagagggcgctcggggtacatctcccgacagttcatcataatcaggtaaacagggggacatcttcggagcaacgcgttgcacgggttctgtcccttaa

SEQ ID NO: 646668 - DNA, 142 bp, Homo sapiens
cgactctcgagagatcccccatcccatgcttacacagcaagtacagcaatccacccatcaactatcacacatcaactgcaacaccaaagccacgggtaccgacgctcgaacttcgataactcactggatcatacgctgattt

SEQ ID NO: 646669 - DNA, 351 bp, Homo sapiens
  misc_feature (199)..(199): n is a, c, g, or t
attaaagtcttctcctgctctgttttgccattatacatgctttcaaagtctctttgaaagtttgaccatttccttaggcaggtatctggtataatgtaactttacgacatatgtttcttgaacagaaactttacaccactgtcattatgttacctatagactatactactaacacaagtcatatgtgcttacgattatnacataaacctgtgatatggcatgatataaactatattttgattgcctgctttctattattaccactactactgtctgctcaccatttctgtgcccctttcacttgagatgggcgccgaaattagtttttaaatttccctgattctcgatctt

SEQ ID NO: 646670 - DNA, 411 bp, Homo sapiens
  misc_feature (27)..(27): n is a, c, g, or t
  misc_feature (55)..(55): n is a, c, g, or t
  misc_feature (106)..(106): n is a, c, g, or t
  misc_feature (178)..(178): n is a, c, g, or t
  misc_feature (188)..(188): n is a, c, g, or t
  misc_feature (252)..(252): n is a, c, g, or t
cgggaaaccttgcccctgtcctccccnagaactggaagtgcaagtggtgcggaanctcggacctcaactggcaaaactcccgccctcccccaggttcaccccccantccttcctgccttcagccctccctgaagtagctggggacctacaggcgccccatgacccacgcccggctaanttttttgtanttttagtagagatggggtttcactgtattagcccaggatgatctcaatctcctgaccttgtganccgcctgccttggcctcccaaagtgctgggattacagcgtgagccaccacgcccagccttttttttttgtctgattctttggggtgcaaagactgtcttcaagttgatttcatggtggttttaggtgggggtgtgtattattccattcttgcattgcca

SEQ ID NO: 646671 - DNA, 559 bp, Homo sapiens
  misc_feature (412)..(412): n is a, c, g, or t
  misc_feature (488)..(488): n is a, c, g, or t
  misc_feature (519)..(519): n is a, c, g, or t
  misc_feature (537)..(537): n is a, c, g, or t
attttactattctaagtattccaaataagttgactcatacagtgtttattcttttatgtctggcttatttcacttagcgtaatgttttcaaggttcattcgtgttgtagcgtgtatccaaatttcatttatttttaaggctgaataatatcccattgtacgtacataacacattttctttatccattcatttgttgatggacatttaagttgcttccacctttggctattgtgaatagtgctgctataaacatgaatgtacacatctgtgtccctgctttcatttctttggggtatatacccggaagtagaaatgctgggatcatatggtagttctgtgtttaggctttttgagggaactgccatactgttttccacagcgggcagtatatcctgtgcaaattttaagtgtncaaggtccagctcccttactacctcctccaggacattttttcaaatcccctttctggatggaggggactttttttngggaggggttgtgggtgatttacttggcggnttgccttccctcgggctnttttaggagggtcttcttggat

SEQ ID NO: 646672 - DNA, 714 bp, Homo sapiens
ggccaggctggtctcaaactcttgagctcaggcaatccgcccgccttggcctcccaaagtgctgggattatagggcttgagcaatggtaagggaggggagctataaggaaggagaggaagtgagattgaggtagaaactaggaaaagcaaagagaagggaggggaaaacggatgaaaaagaagaaaagggtgagaagtaaaagaagcaagtagggaggaaaagtttggagagggtggataggagaaaaaagtggactgtggaatggaagatgaggagcctgctgggctttggggtgagtgtggtggttggagttgaactgttttggtttccttgggcacaggccctgagaggaggttacccctgctctgactgcactcagaggtttagtaacaataatattctaagcttttatttttatttccatctttattgtctatttttgacaatcagaatattttctactgggattttaaacatcttcaccttgcgacaaaattacttagaactaaagatttagaaatttagtgattaatattagattgtattaatatgtatagcctgtatttgctttgatggatttaaaccttacagattgcattaattatttttaggaaagattgagaatgtgtcatttcataatgtctagatattggctcttatttaaaaaataaatctattttagtctacgtaggagctggtattgaggatcacca

SEQ ID NO: 646673 - DNA, 123 bp, Homo sapiens
ggatcccctgggctgggaagaggttgagggattgtcagcacacacagctatttagtggtggggcgggacccgtgatataggcctctccctgagggaaggtgaacaggctgagggagatgcgtc

SEQ ID NO: 646674 - DNA, 853 bp, Homo sapiens
cgggccatggcggcgaatgctgagccggaacgggccagcgctgctatcaggcctacgtgcgggtggctcacctcagaagtccccgaccgactgggctctctttacctatgtaaggcaacagacaatgacatccgtgtggctgtgcagaggggagggtggcctggagtgagatggtggagagtagctctacacaagtcgggcaaacggtgatgtacgccgttctgtcgagagatgagggaccccaagctctggactgcccaaagtttgtcctcatcaactggacaggcgtagtggcggttaactgatgtgctggaagggagcctgtgcctaagctcgatcgttcagtcaggccgatggccagcttcctgaaagggggcccatgttgaccatcaatcgctacgggctcgaggaggatgtgagagaccatgaggtgcatcatggcatgaagtgtggcctaacggtcttcaggatgccaactagcagctttcacaatggagagtggcgtttccgaggacgtggagacctcccatggccccatgtgtggctctgtgtaccagaaggaccatttgcccgtgtctgagcacttcaaagggttggtaagagacaggccttcgtgggctcaaatgctagagtaaggaggaagtgcataaccgtcggcctgtgaggcaaagcggcgggcgcgattgaccgtgacagacgtgtaggctgtgaggcaggagacgccggggagctgtgaggtggcgtcgaggcttgctgggccggggatgcagcgcgtatcaggagcagggttgggagggccagccccccagtaggacgtggggaggcagcacctggaaagtggttaccaaggaca

SEQ ID NO: 646675 - DNA, 466 bp, Homo sapiens
gcgaattcactagtgattgtgagctgagatcgcacccggtccaagcactggctttgagataagcaatattaaaaacattttcagcttcatcagatgctgactaactgacctccaaccactgttccaccagccataactacagctttgattggacaagtgactgatttcagtaactttttcctgacaaggtgactacccatcatggactggttctggctggcttacagagctcctgcacttgcatgtctttgtgtcctgaaaagaccttttgccatatagggcctaattataatacatttaaatgttaagtctccaccccaaagtgaccatgggttgtatgttgcatgcatgtttgttcaatatgcatgtgtcagaaccactttcatgaattttcatagctcctcatgtaacctgttgaatgtgtatgtttagtccatccattgagcatgaagctccttacctaaac

SEQ ID NO: 646676 - DNA, 136 bp, Homo sapiens
  misc_feature (69)..(69): n is a, c, g, or t
gagccgaggccaagtcccgggcgctagcccacctccgacccgcctcttggctcctctcctctaggccgncgctaacgagtctcttcatcgcttggtctgtcgccaatgtttgaggagaaggccttttgtccttcag

SEQ ID NO: 646677 - DNA, 325 bp, Homo sapiens
  misc_feature (7)..(7): n is a, c, g, or t
  misc_feature (300)..(300): n is a, c, g, or t
  misc_feature (302)..(302): n is a, c, g, or t
ccaaggngttcttcccaagggggagcagacctgacatcgtttgtaccactcaacagtgctggatgctgtaacctcaagacagtgcaaatgggtgatactagcagattaaccaccatagtttcagaactcaaggaacaactgagaagcaccattttaaattctataaaaatgttcactgtagaaatttgtgataagaaagacacacagacgtagaaaatgagaatacttgctgcaaaattaagatgctcctagcaaaagaatgcttttaagtgtttgtcatgtatggatatatatgatgtntntataataaatgtcatgtaaagca

SEQ ID NO: 646678 - DNA, 687 bp, Homo sapiens
gtggcagtgcaatatatccaagaagaggaagttctgtcgctcgatggcatcttcaaagctgacactgaatgagctttcttactcgaggagctggactgaatgatggctactctgagagttgaggtgcgagttactcacaaccagtgacaatggaatatcattatcttagccaccagtaactacatgaatgtcctttggtgagtaagggccgtgcgtgattcgggaactgactgctgttgttcacaagagggtttggctctatccagagggccggtgtagagctttatgctgaagaggtggccacttagaggtctgtgtgccagttgcccttggccgatgtctctgtgttgcagaatgtcctacgcgagggcttgtctgtgtcggagggcctgctactggtgtgctgcggttcaggtcagtggcagagtggggccagtagggctgctgatggtcgtggtgtctgggaaactccgaggtagagaaggggtatacattccagtgtaagttcgtggatggcctgatgtatcctcgagtgtagtaccctgtttaattactacgttgacactgcatgtgcaccagcgtgttgctcagtacagggtgtgctgggcatcaaggtgacgatcatgctgtcctgttgacccaactggtcagatcggcctaagaagcccctgtctgagcagtgagcat

SEQ ID NO: 646679 - DNA, 720 bp, Homo sapiens
caccttttggacggctccactcaccatcataggtggacgacacccctcctcacttggctcgctcctgatcggcacaacggaggattccagtcagccaatctgcatcgctgggggggtcgcctgccccaggatgtcgtcacgcttccatggagaggagttaacagtcccttccgtggggatgggatgcctcctccatgccttatagtttcagtacctgtgcccctccctgttcacgttccctgctgccaccagccccagtcaaatctaccttttagctattgtctatgccatcactccgagcgctgggcagattagcatccttatacccttctccacagtcataggattcagtctaccgaccaagacattgcactggcagcgcacccatcatacactcgcccactagccatctcaagtctcatcttccccccagccctggacattgccattacattcatactaacgctcccatattgttatttgttagtgaacctcaaaccctctagttcattctagcaatacatatataatatatcctgcctagattaaaaagaaagcgatgcattgttaacttattttttctatttgatgtaggttattatgacttagcttttctcactctttcactacccagcatgcacaactagatgtccttccattggtaggtagtcagacctgattgataagccaaccaatggagcgtccattgaaaaaaaaaaa

SEQ ID NO: 646680 - DNA, 133 bp, Homo sapiens
actgccacagcctgtagaccaagctttagcctattcatactcagtgtactttgagcttctccatcaacatcttcagcgcattataccaagaggcttacggtgagcattggctatttcaagaagcaggaactgg

SEQ ID NO: 646681 - DNA, 1746 bp, Homo sapiens
gtcctgttttgattgtaagcatacacatcgtcgctggttgtatggagagctagccctgctgtcgatttgttggcgtgggtcccccgcactgacggttcagctgttcactggctgtcgtgcgttgttgtcgtcccggccgtgttgtgtgtggcgcccaccgacgagttgggttgggctcactctcacgacgagatgcatggctgggtgttggcccccctggaggagggtttgtgtgatgtggcgaggctcgcccccccgggtagagttggtgttggacccgcctggacgtcagcgtaagttgtgctccaagcgggggcccgccaacgccgcttggggggtggtgcgccgagattaaggctccgcgtgccgggcggttgtccggcgagcggcttggttgaccagccttgcttgtgcgggcgcaccagaacaagataatgggggcccggcgcagcggtgacagttgtgatgtgttggcgctgtggaggtgagatgagtcggtctcgccgttttccgccccgtgtgggggtacgccgccgcgcgtccgttgtgtggttgtgtagtggagtcggccaccagcgagtggagtgttgcctcgcccgccgcaagattgaggcttgttggtgcccgttgtttttggtggaccccgcacacgccgcccccagacacgccaccgcgaagattgggggtttgggtagagaagatttggttggaaggcgccctgctcgtgcgtccccacaatcgggggtataaaaaacaccacagtggactttctgtctctgtccccccttgtttgtataaccccgctgtggttacacccgtgtggtttctccgcccacaagagagtgtttcacaagttgtctctgccgccacagttgaccccacaccacctcttcacatactccaccacagcgcctcactgcccagcacttctcacagctgtgtgtgtgtgggagattgtgggtgtgggcgcacaccctgcgggcgtctcttcacacagtggtgtgtgcgtcactcgcacacgcttgagacgccacagcccttctcccaccactctgttgtgtgtgggccctcctgtgttgtggagaagacactctctgtgtcacacacaggtgacacacagagagagacgctctgtgtgggtgtcacactagcctgtgagacgcacacacacaccacgcacacgcgcacactgtgtctctgagaggcccctctgtggcgtctctctccctgtgagccacacacacaggtgtgtgagccccgtgagagtggagagtgtcccacagcgggtcgcgccctcttggttcacctcggtgacacctgcggggtggagagaggagagattggagaggagaagggcgagagttgttctcacgagaggcctccctggagaagaatatatggctcgcccctctcgagagagaagagagatatatatgagagagagagggttgggtgtgggagatttctcgcttgagaaggagagagagggtgagaggagaagaaaggagagagagggaaatactataattaatccacatctcctcttgtggccccgcacgcacatcgtcacatgctcccacgaaattgtcacagcttcacggcttataactgaccacacgacacctttaaacttttctggttatgattgttttcacacctggtgatcacacgtcttttccacacgtgtacacccgtaaaaatttttccctcacaaatcctcccaaattaagtcccttaaccactccc

SEQ ID NO: 646682 - DNA, 424 bp, Homo sapiens
agaggatcccccccgcaccactgcaaagtcggtatggtgttcgacctggatgatttcaacacccccatgtgcgtgtgccacgaccgggccagctgcccatcccccattggcgacctggatatggtgtgctgcaatgacaacatgaccttctactcttcctgccacttttttgtcacaaagtgcaccctggagggcaccaacaagggccacatgctccacctggactacatcgggccttgcgaatacatcccaccttgcctggactctgagctgaccgaattccccctgcacatgcgggactggctcaagaacgtcctgctcaccctgtgtgagagggattaggacaacaaccttctgactgagaagcataagctgcgggtgaagaacatccatgacaatgataagcggctggaggcaggagacc

SEQ ID NO: 646683 - DNA, 402 bp, Homo sapiens
gggtgcctaattaagtaccccacagtggccctcaaagaacctcaaatgaaaggaagacttggcaagtcctcctcactttaagtcccagagcctagaaatggattaagccttagtgaagatgccagaattttccatagcctagagagaagtcaacgcttggccttcaaaacttcaaaggatgggctgactctctttgaggagcactgcagctggtgactttaagttacagccagtgctcattgaccactctgaaaatctcagggcccttaagaattatgcaaaatctattctttctgtgctctagaaatggaacatcactgtctgggtgacagcacatctgttaatagcatggtttactgaatattttaatcccactattgagaactgctgcagaaaaaaaaa

SEQ ID NO: 646684 - DNA, 148 bp, Homo sapiens
agatctagaggacccagtccgggtcccccatggcgagaaccggtccttagaatgtctgcttcccgccgtgccagggaccacttattctcactggacgggaggaggatgtcccaactggcagccatgtgtgtggggtaccggagctcga

SEQ ID NO: 646685 - DNA, 156 bp, Homo sapiens
aggcgatagaaattgaaacctgcgcaatagatatagtaccgcaaggaaagtgaaaaattataacccagcatatatagcaaggactaaccctatactctgctaatgattactggaataattaaccaaggggccaagctaagcccccgaaaccgcgag

SEQ ID NO: 646686 - DNA, 283 bp, Homo sapiens
ttcgtgtccccaaagaaacagaaccagtctatatacagtggtgtgtgtgcgcgcgtgtgtgtgtgtgtgtgggtgtgtgtgtgtggagagagagagacagaaagagagagtttagaaattgtctcatacgactgtagaggctttgtcagaggcatttgaaccacagcaactccatcttgaataggggctgggtaaaataaggccaagacctactgggctgcattcccagatggttaggcattctaagtcacaggatgagataggaggacacgaatgttcagga

SEQ ID NO: 646687 - DNA, 664 bp, Homo sapiens
gaggagcgggcagccaaggttcctagcaccccgccccccaaggacagctccaccacgcccctgccctcactccggactcgcagaacgtggacagcagctgcaagacacctgaggtctcctatccatgcccgaggaggccactgcagagaggctaggggtccgaggatggggcggagcgaggaggacggaggaacgaagaggaggacggaagaagcaggaagcaggacggaagagcagccagcactagcataccaccaacggaccacacagcacatgcatgcagcacagaccacacaagcaactgcagccaccaagcgcgcgggatccacaacgcacggatgacctcgagaggagcgagagagaacgcggccaaagcaataacccggatgctacatacacacaagacatagcacacaaaccaagccatagaacacaccaacgacacccacactagcgaccatgcagcaaacactacataggaccaaggcaccaagagactgactaggcgcaacataggccaacacaaaacacaaaggacagagaaagattcaccataggcgaccccagtaacagcacacagggaccaccacacaacaatacattataccaccaggaacatgaggacgccaaaaagaccgccaacacaacacaggggcgcgggcag

SEQ ID NO: 646688 - DNA, 357 bp, Homo sapiens
  misc_feature (115)..(115): n is a, c, g, or t
  misc_feature (253)..(253): n is a, c, g, or t
  misc_feature (354)..(354): n is a, c, g, or t
ataccttttcaaggccaagagcattctccaagtaactgatatcttcaacagaaggtggttgatgagggccaaaagaagaggttctcaacatgtggagcagcatcacctagcactntattagaaatgcaaaatctcacaccacactccagatttattgaatcaaaaactgcagggcagggctcagcagtcgtggtttgtttttgctttttggttttttttttaaactttttgttttgaaataattaaggattcncaggaaagtgcaaagaaatggacagagagattccatttgcccttcatccagcttcccctccatgttaacatcctgaatgagtatataaagcaatttcaaancca

SEQ ID NO: 646689 - DNA, 148 bp, Homo sapiens
catttggtcccgagagaaacttagtatatttacctgtgatggttagtacaatggcttgtgttgtagaaagggaaccagagtatgaagaaaatcatgtgggactcaataatgtacaagttccttgaggacatctatacagtgcatttcc

SEQ ID NO: 646690 - DNA, 1304 bp, Homo sapiens
ggaggccccccatcatcccctgtaatttattgccacagcagagtctaatttatatagccacggcacactacctatagagcacggattcggaccacttgtgggatcccagtaacctcacctgcacgatatcctaggaaggactgaggcaagggagtgcctggggcgccgagactggatgggtagggatagcacctagcgcttcctggcaaacatgagacgccatgattctcaggcgctccatatctcctagagatgacccacagcacgcctaccgctaagcacgctattcggccgagggaggcatatccaacaaacttccgacgaccataaagagcgagataacaacctactatacattataagccttaactaagtcacaagtacggtgcctaggcgacaataccctcttgacccagggctcaactatcgctagtaaacgcagagcacttgcccttggactataaaactacaagccaccgcacagaagaccatcctaaacatctgggcgatcgctggtacacgagaagagggtactaaggccccacagggcgaagccgctaacacggcaaccggcacataaagacactaaggcgcgctggaccgtccacagcgcacaggggaacaaaacgcccacggacaatggcacgcaaacggggaagcaagacacacaacagcggggagccgaccgcaccacaggcaatccaagctccgtaacgccacacggccggagagcagcaaaaagaaagagagaaacaaacaaacacaagagcagcaagaaaaacaacaatccagaaagagcacacaaccacccatgcgagcaagacagacacaaacgcacagagacaaaaacacaacaaagcaacgcctgcatcatacttggcgagcgtgtaactcaacgcgctcggcgggacaggcaggacagctgaatgtcagggtagcgacaaccacacaggaacgtgtgcacaatgtagtgtcagcggtgccgtcaggtcactcgagtacggatgtaaaaggtggagcggtgcatcctactaagaagtggtgaaagtgtacccggagatgccctctccaaattatattccaacactcccaaacgccacaccaggacaggggaaggcggagcgcaacgcgcgcagaggagagagaaagcaagaagaatgcggggggacgcggaacgacaagcaccacaagaggaccaaccgcgcgggagaaacaaagacagagcaggaacgagggcaacagagcaggcaaccagggaggagtaggacggctgccctggccccgcgccgcagagagcaataggg

SEQ ID NO: 646691 - DNA, 163 bp, Homo sapiens
  misc_feature (35)..(35): n is a, c, g, or t
  misc_feature (160)..(160): n is a, c, g, or t
agcggatgaggggaggcaagctctggagccgctcncagggcatccaggagtctctaaacaacctaccctggggacttagaggaaattgtcaagatagaacctgagacacccagactgacaaacgcaggctagcaactcttgcgcggacaaagcagaagcnaca

SEQ ID NO: 646692 - DNA, 655 bp, Homo sapiens
  misc_feature (43)..(43): n is a, c, g, or t
  misc_feature (67)..(67): n is a, c, g, or t
  misc_feature (173)..(173): n is a, c, g, or t
  misc_feature (211)..(212): n is a, c, g, or t
  misc_feature (256)..(256): n is a, c, g, or t
  misc_feature (261)..(261): n is a, c, g, or t
  misc_feature (326)..(326): n is a, c, g, or t
  misc_feature (415)..(415): n is a, c, g, or t
  misc_feature (452)..(452): n is a, c, g, or t
  misc_feature (473)..(473): n is a, c, g, or t
  misc_feature (509)..(509): n is a, c, g, or t
  misc_feature (529)..(529): n is a, c, g, or t
  misc_feature (539)..(539): n is a, c, g, or t
  misc_feature (622)..(622): n is a, c, g, or t
aaataaacgaggctgtggttaccatctagaaggagaaggagtngtggggagggaaatcactgctccngggtgccccaggaaatgtagtttggctgggtggccgcatggtacttatcaatgagctcctgaacaacctcccatagacctagttcatctaatcaaagttgttcttnaacatgttctccttacggaactgctcgaggaaggcatnncgcttccgcagcttgtaaaactgctggaaggaacttttaaagancgagntttttctggtgtggttggccatcatgagcccgcagacccggtgggccgagggcaggaagggaganttcctcgacagggccacctggatgctggcggggccccaagggatgaagtaggccaactaccgttcccggatcctctgcaggctcttgtngacctgggtggggtcacacctatacctggatgatgtngaggatggcgatgtagcagtngttggtctggcggtctcggcctgtggacaccatcangttcttgggctgcagcagcngcctcatganaaccaggaccgtggtcttcctcacgctggccactgactggtctgttgtaagcggggtgtagccggtcatgaggaagtagagcngtggggtgggaatgagcgaggagatgaggccga

SEQ ID NO: 646693 - DNA, 141 bp, Homo sapiens
gcccacacgcgtccgggagaaaggtgaaaaaaccaatggagacacaaataaagcacaactaaatgagacctaataattggccttcgattttaaataatttgtttttataaaccttgtccaataaaaataaatttaaatcca

SEQ ID NO: 646694 - DNA, 542 bp, Homo sapiens
gctcgatgccactgaaatacaaagattattcaagtctactatgaacacctttactcacagaaactagaaaatctagagatgaataaattcctggaaatatacagctatcctagattaagtcaggaagaaatagaaactctgaacagaccaataacaagtaaacaaattggaacagtaataaaaaaaaaaagttgccaacgaaaaaagtccaggaccagatgtggattcacagctgaatttggtcagacattcaaagaagaattgataccaatcttactgaaactattccaaaagataaagaaagaggaaattctccctaagtcattctgtgaagccagtactcatgctaatttccaaaaccaggaaaggccttaataggaaaactacagcccaatatcccagatgaacacagattcaaaaatcctcaaaaagatactagccaaccaaattccaacagcatatcaaaaaaataatatttcccaggatcaagtggatttcataccaaagcatcagggatggtttaacatacacaagtcaataat

SEQ ID NO: 646695 - DNA, 946 bp, Homo sapiens
gccctaaccctgaggctggcggcgggggtcactgcgccgggtagtgggccccagtgtggcgctctctggccgtccttaccactttgcttcaggctccagtgcaaggggcgtagtgggatatggccaacctcgtggctgcaagggacgtcacgggtcccagatgaggagagtccccctggtacttgtgctaccggaagccaacctgctggagagagaggatccactccggaaaacaccctcgggggggcagtacctactagttgtgggcccgggcctggccggcattacaacgcttgacttgggcaatttcccacagggcaacacacacaggtccaaacagtttggcgccttgtagggtggaattagggccaaccgattgtcttaccggaggttcctgggcggatttaaaatgttgctggcgacggtatgatcttgggacacacttgccgcaacaatgccaatctttacaacttctcttctggggcattgacgaccacgaacaggggcgtttcaaccacagtgtggccacttggttacttggtggggcacctcacggaccggttcacacaggtttcgccaccttcaaggcacaggcacaccagcaaaatatacacctgtggtacggaagagttatattcgtgggcattgacacaacatcattcttaacggaaaacgtatggtctttcccccccaaaattaccccaacaatggtcaattagcacaccgcgacttacttctgtgcccattgggttgctaaacaaggcaacacagcgggtcttgggccgggcggggccagtactccaaggaaggacaggtcaacaatgtcccaattaggacaaccagcaagcttgccctctacatctgcgcaaaggtgtcctcgcgcccacaaaagttgtgagacgcttacgttccaacagaggtgggggacacacaagatttcttttgg

SEQ ID NO: 646696 - DNA, 289 bp, Homo sapiens
ctagatgcgtcatgcagataacgacagaccacctagacgaggactggacgaggacagaggaagctggcgaacagctgatgaggacagaggacccagacgtgggatggacgaggaccgggggcctcggcgaggaggtgtggatgatgagcggtcatcctggcggaatgctgacgacgatcgtccccggcggggcatggatgatgaccggggtccccggcggggcatggatgatgaccggggtcccaggaggttgatgatgatggctattattagtatcagggtaccgagc

SEQ ID NO: 646697 - DNA, 191 bp, Homo sapiens
ggggtttgcccccccccttttcccaaaaaagcctttcccctttttcggggtaatagggggggggggggggaagccccccccccccgggttttttgggttgggggggggttttttggggggcccccgggtttattttttccggggcccccccctgggaattaagccccccccccttccctggggccccccca

SEQ ID NO: 646698 - DNA, 118 bp, Homo sapiens
tactcttgagcctgtgcatctctgcactggagtcagtccttcccatcagacctcagccctggtgcaccctgttgtggccttttaagaggttctatctactgaagacccttcatcttcc

SEQ ID NO: 646699 - DNA, 515 bp, Homo sapiens
atgtaatattcctcatttccacgttgaacttcatcttgtaaatcgttggttgattgtgagaaaacagttgaagcttggctgcattctgattcctcagcatcaacccctggccttgaactaccttcatctccattgctgtgcatccacgaggaagatgaagcgatagatttgttctgaagggcaattaatggcgagctttgacactgatctaaaagacctgatgcatagtaggaatccaacttcttcttaactgagctgttccaatgattttttatcgaattatctgacctacaggaacgtaagaaaaaataagcaaatcaccaaagcaggaacgatagaccacaactaccagcatcaaaaacctattatttcatttatgaggccaccaattttacggacatgttacacctatgttgttatactaggacccatgggaaaagacatatttaccttcctggcaaaaatttcataagctctgcccatttattcccattaaatttgatgcgcacgaataa

SEQ ID NO: 646700 - DNA, 107 bp, Homo sapiens
  misc_feature (64)..(64): n is a, c, g, or t
tcggttatcatcccccttcgatagtgtcaggccaggtagagaaggtagaacttgggctacggangcctcgaggaaagatgtgcggcattggtggtgcctgcctcgcc

SEQ ID NO: 646701 - DNA, 405 bp, Homo sapiens
gcaggtgtattttttttctcatgcctcagcctcccaagaagctgggactacaggcatgtgccccaagaggccagattaagttttctttttcctttgttcttttttctgggtagagacggattttcgctcgtcacccatactggtggtgcaatggcgcgatctcggcccactgcaacctccgactccgcgggtccaagcgattctcccgcctcagcctcccgagcagccgggactagaggcacccgtcaccacgcccgctacctttggcattcctagtagagacggagttccaccacgctggccaggctgatctcaaacccccggcctcaagtgactcacctgccttggcctcccaaagtgctggaatcacaggcccggcctatctttgcaatattggtctgcaca

SEQ ID NO: 646702 - DNA, 136 bp, Homo sapiens
  misc_feature (57)..(57): n is a, c, g, or t
  misc_feature (59)..(59): n is a, c, g, or t
agcaggtctggaactttcaaccccaacaggatgagggggaacgggggtggatgtcangnaagaaatttctggccccactacaaaactttatttttgaataggggaccgttttcaacttcttgaacgggaagcaaaa

SEQ ID NO: 646703 - DNA, 962 bp, Homo sapiens
  misc_feature (131)..(131): n is a, c, g, or t
  misc_feature (960)..(960): n is a, c, g, or t
  misc_feature (962)..(962): n is a, c, g, or t
gacatcgctgcgggctcacaaagcggcagacgctcggggcgggtgtggcaggagcgcaggggcgcgagcgggatcagccttcccgggacgtccgggagtcgacactcggataggggaccgggccgcccccnaggatgccgggagatcggcggtgtggcggcggccgccgggggtggtggctccctccaaagtcgagagccggcacgtgacgcgctccgcggaaggggggggccccaaacccggggaaattcccttacaacatgggacaaggggttggaggccccggtcccccaagaacggaccggggaccaggtgctggaaccgtttcgaagaaggggaattcaccgggcggccacccggcccctggggggggaggcagaaaacccttcacggaaaggggaacccctggaaaggcggggctatggacgcgtgttgaggtcgtagcaacagcaaggagtgatgtggatggcgtaggagaacacagacggaacggcagggagtgagcacaacccccggcgaggtgcaagaggtatcgacccccaacacttcggagggagcgactccgtccggagagaaggacaactttaaagagaaaaattcgagaaggcactccagtggcgtttcgcattagacacgttggcgctcagaggttgttgtatatccacagcgcagagggagtgtgactgacaaaaatgagaacatatcacagtggtggaacaaatgagttcgtggaccgccgactacaaaccggtaagaaacttcctgccgaaaacccccggagggcggacgaccctttggtggtgcacaccgccagacggggcgggacaccatttaggaacatgggccgcgattgtggtgtgtcacgcccaacagccaaacgagggggtcccatctaaaaacggtccgtgaacggtatgcgcggtagagtctgctcgactgcttttgttcaacatagttctngn

SEQ ID NO: 646704 - DNA, 152 bp, Homo sapiens
  misc_feature (56)..(56): n is a, c, g, or t
accatgtgcacatttttgtagctaaatgggctggtgcagtctgttcacttgtgcangggttcctgagcttagctggtgttgtgctaatgtaaggcatcacagtcttttccacaaatgagccaaatccaattctgaagtccgaagtaatcctc

SEQ ID NO: 646705 - DNA, 532 bp, Homo sapiens
gggcacacagccgcgttaccatggcacctgctggacgcgcgatagccaagacagtgagattagtcacatcgatcctagcggagctcctggccgctgtgcttctagcgactcctttcacacccggcgaacatccctaggcaagccctggggcctgggtcacttggacgggatggccctgagactcaattttaccctgtcacgggttgagtagcggttatggagcccttactcagtgcctgtggctgtacacagagctgcgctcaagatatctcctcatcttcacaattattcccagtttacaggtgaggaaactgaagcttggcgagtcatgcgaatagctcaaggtcacgggttcagcccctcggggagcgaggatcagaagattagcttatggacgcatgtcgcgcacacattttgttaccgtaaacgacactcgtccgcaggtctttgggctaaatcgaacggggactctttagactgtgccctcacgttttggctggccttggggggcgcccccagaggtggtgcgggg

SEQ ID NO: 646706 - DNA, 246 bp, Homo sapiens
cgtgagaaacacccaagaatgaacaattaaaaaaaaaaataaaaatgaggctccttgcaaaaataaatagggtggggaaaaaaaaaggttttttaaacccctggggccaaatggggcagttcttttggggccgggggttccagaccagcctggccaacttgaaaaaactccgccttttttaaatttccaaaaaatttggccggccttggtgtcttccggctgtccgaggggggttggcccacggcc

SEQ ID NO: 646707 - DNA, 449 bp, Homo sapiens
gaggacgctcccggggcccagaggcaggactgtggcgggccgggcctcgcctcacccgcccctcccatccaggccccagatcccgtgcctccctccaggatcaccccgggctccacggacgccagcctgggagcggtccaagacccaccgacagggggacaagcatgtgcccagagaaggggacaggaacgcacggcgcgagataaccatggcgccgatttgcgagaacggtcctgtacgaagctccgcggttagttggatacaaatgtccacggatttctatcaccaccattgcagtcaaccaccaccctttcacgacgaaagcccgaagtgtaagatttcaatcagcattccgctcaatcagaagatataccactaggatagaagaggcattagtatcagtcaagaggtacgagagagtcacagaagagagaaatagaaacgtggag

SEQ ID NO: 646708 - DNA, 300 bp, Homo sapiens
taaccagaaatggtggtcaagcatgtagtctcaactactagggaggctgatgtgggaggaccaccttagcccaggcagtcaatgctgcagtgagctatgactgcaccaatgcgcaccagcctggacaacaaaatgagaccctgtctcccagaaaaaaaggaaacacactgtatatcatgagttctagtaagctgcatctacgcaaatgattaaaccccgaagagggggtcatgaggaacccctgaattagtaacaggattggatcaaaagtgcaggatgacaaccttaggacttgaccat

SEQ ID NO: 646709 - DNA, 474 bp, Homo sapiens
  misc_feature (188)..(188): n is a, c, g, or t
  misc_feature (224)..(224): n is a, c, g, or t
  misc_feature (245)..(245): n is a, c, g, or t
tctcctgaagcctcctccctctggcaagtactgggatacagccaccctttcaaccccagcactctgaagaccaagacagccccctctggtgaccactggccaagcttgatctttttcctaagaagtggtcttcagatccctgcaggtcgctcagaagacactgggctgcctagtgtgaattctgtccnactaacgtacagtgagcagctcctcacccccacccncgcaaaagctctcaccaagtnctggagtgtcaggcagggggctggaaatccaggaggacttcctgcaaaaggcagcatttcatcttgacctcagccttcaggttggggagaatgttctttttaaataccagttcatttgtcttttgatattaaagctctttatagagagtctggaaactgtaggcgattgtcgagaagagaaataaaaatgagctgttatctagatccatggcaaagcagcacaaaaaaa

SEQ ID NO: 646710 - DNA, 360 bp, Homo sapiens
tactggagaggatgtcctgtctccccaccaccaatgactacttcccgcacttcgacctgagccacggctctgcccaggttaagggccacggcatgaaggtggccgatgcgctgaccaagtgccgtggtgcacgtgaacgacatgcccaaggcgctgtccgccctgagggacctgcacgcgcacaagcttcgggtggaccgggtcaacttcaagctcctaagccattgcctgctggtgaccctggcctgccacctcccggccgagttcacccctgcggtgcacgcttccctggacaagtccctgggtactgtgagcacggtgctgacctccaaataccggttaagctggagcctcggtaag

SEQ ID NO: 646711 - DNA, 626 bp, Homo sapiens
ggattacagatgcccaccaccacacctggctaattttttgcagttttagtagagacagggtttcatcatgttggccaggctggtctgaaactcgtgagctcaggtgatccacttgccttagcctcccaaagtgctgggattgcaggcatgagccacccaaccagtgagagatttatttcctataaagggttgtagcctgcagggttgtccttctgacaggctgggaagcatagcctccagccagaagccagaaacagactcttcaaggaggaggtaaaggaaatagcaatttatgctgactggaatggccaaatacatttatttaataagctccaggaggagtcatgaatatttatggaaggagaaatgcatgcatgcacaattgagtttctggcttcttcatgggtcccatgtacaaaaatggcagtgttagcatgatcccagggttgagttttcagccctctgacattaaaaggtgaagcagaggacatgaaaactcgctctgtgcatcctctgtacggtggccagaacctctctgttgtgggtggtctcttatcaggcaaggaaggagaggttgatatcggtagtggaggctttgaaagggttgttctgttaaatccttaggt

SEQ ID NO: 646712 - DNA, 514 bp, Homo sapiens
  misc_feature (13)..(13): n is a, c, g, or t
  misc_feature (17)..(17): n is a, c, g, or t
  misc_feature (100)..(100): n is a, c, g, or t
  misc_feature (118)..(118): n is a, c, g, or t
  misc_feature (120)..(120): n is a, c, g, or t
  misc_feature (144)..(144): n is a, c, g, or t
  misc_feature (182)..(182): n is a, c, g, or t
  misc_feature (205)..(205): n is a, c, g, or t
ggcggtgggtccngtgntgtcacgggataatcgcccgaatttccttaatttctagaggatcttccattctctacatgctccaaaaattgagctagggacnctcctactgactctgggngnccgcttactctatactaaatcggntaagcctgacagaagggaaactacgtctctctaacctngtgcaaatccttaacaaattttngcaatcaatgcatatgtgtaaaagatgatatattatgaccagtgggatttattccggtatgcagactgattcaactttgaaatcattatgtaaccctcatatcaactactaaagaggaaaaaatcatgattgtattaataggtacagaaaaagcatttgacaaaatccaacactcattcaagataaaaatgctcagtaggccaggtatgcatgtaatcccagcacttttggaggccaaggcaggaggatcacttgagctcgggagtttgagaccagcctgggcaacaaaacaagaccccgtctctaatt

SEQ ID NO: 646713 - DNA, 987 bp, Homo sapiens
ggggtaaacatggagaccagtgaagccgagtgaatgggggctgaaatgctgcgacgtactttagctgaacgagggggggccagatggtggaggaatacacttatggtatggaaactgtctatgagttcttcttgaattgccagttttcagcctcctcatgcctccgtctcctttaacgacagggtagatagtggcactatctaggcccgtccgacctcaggatctcggacctttgtttagactctagttaccttggctctgccaacccaggcagtaacagccaccctacctgtcatacgccaccaccgaagtgtccctcaatgctgcgaatctgacagtatatgacctcataccagcggctctgcccgcatcgctgaattgtggatgcagcagtgccagcaatgcatgcaacagatggcaacactacagacaaggacaatcaggcccaaacccaagccatagccgcatggcacacaccacacaatgccatcggaaccatctaccacctgacccatgactaaaccacgagtgggtcaaaacaacataaatggagaacgtacaggacaccactagaagatccaatcaaaggagagcggtgggagcaggcccatggagataaagggggaaccccaccaagagcagactagacacaggcagtcaacaaaatacatgctacgccacaaagagaacatcggacaacagaaaaattgaccaaacatgcaagacaagaagaacacctgaccgaaaaccagggcccatgagaactcaatcgaacatggagggccaaacaaagagagctaccaaaaaagaaattaacaatcaaagtgacagtggccaccatcaaaccagtgcccgaatcgcaaccagcaggcgaacgaagagaatcaaggaaggaaaacaaagcacaaaaaacaagaataacccgaacagacaacaagaaaaaaaaccagaaaaaactagaacaaaaaaaacaaaagacacagagaa

SEQ ID NO: 646714 - DNA, 126 bp, Homo sapiens
aacttgtgcagatactttattaccataaacatataatactcctgaatagtttcccaattcgtggggcactctagggagcaaagcaaatgtttcaatttttgtttacaaaagtatactttaccaatt

SEQ ID NO: 646715 - DNA, 475 bp, Homo sapiens
acacatatcatatgtcatcaggaaagctcattcagagattcaatgctcagtgcttatgtatgagtgctggtagtgcaccctctgactagatggtgtgccaatgctatgcagtcccagaaggcaacagcatacaaccaaattgactgcacacattgcacaggcacagtgagctaccctgatagtatagggaaagtttcatgtggctgtagggaacagcttaccagtcaatgcccaaccttgcaggcctcaccttctcaaagcatagtcatctctggcctgccatgtctactgttttcagcacagtcagccaccaaccttcatgcatgcactgcactatgcagcacacagcaataagcagcatcatagctgatgccacaaaactctattcttttaaaggcaggtggttcagtgccatcttgtggccccgaggcctctgagcaggaaggtgtgctcaggatatgcacattcatttctg

SEQ ID NO: 646716 - DNA, 258 bp, Homo sapiens
gtagatgtggcacatgtatgtgtcagcaagtctatctctttgcaaactcagcatctgggattgtaaataggatacgactaactaggtgtcaaactattacataaagccctccaggtgaaagtgggatatcttcagtctaactgatatatcttactgatagaatttcacacagcaaatttctcataactgatcatccatgcacaaagtttcccacatgtgtaacaaaaatgcaacaactcaaaacagtcataagaactg

SEQ ID NO: 646717 - DNA, 171 bp, Homo sapiens
agctgatacaacttcgacgctcggtacccgaaactggttcgcggtgttccgctggtgaccacgtgtgttactggcgacgcgtgactgcttccacctactttttgccgccgggcgtgaccttcgaccaacgctgggggactccttctacgacgtcgtaccctgcacggcatg

SEQ ID NO: 646718 - DNA, 915 bp, Homo sapiens
ccgttggtcccaccaagacaagaaagtgtcttcccccgtgcagcaacatccccgcgtgtcgataaattttctccgccataccacattgtgtcggctcatcatgaccctcctccacatgtaatttcttcctcgccgtttatttccaatacaaaagcattagttgcacacccgccaaccccctcgttgattttcattctgtcccccgcgctcgctctcacccccactcgcagttccgtcactctttttcacaaccagcgctcaacaaattgattttcctcccccccccctcgataaaacttgtgggtgttaaccacacgaacactggcgggagacaactatcacaatatctcttctcctctcccactcaatctaatgcctcataattacgtgaatgttccccccccccccccctactgattgaacttgtcctggtacaccaccctctcccctctctcaccaccgctcgcctggttactttccaaagtgctctctctacctaactgacgcggacaccacacactacacttctatgtcaacaacacaccatgttgtcgcaccactagccttttctgaccactccttcattagggattcaccacgcaagacaagtttagacccctcccaaactactctcatctctaggcagtattattcttcttcgcggcatagatgaataacatggtggacagcacaccacgcgatggatagattccactgaaagcggctcggcacaataggtcacgcaagatttcaagaccacccaggtgttgtggacgatgatgaagtcccaaaacttgttgccgccaaaaacacgtagtagtgctgtttcagggcacagccggggaagacgttacgtcgatttgtgacacccgaaggcgtgccgcccaaaaattaagatccccccccacaataaca

SEQ ID NO: 646719 - DNA, 437 bp, Homo sapiens
  misc_feature (437)..(437): n is a, c, g, or t
ggcacattatggccgggtggtataatacgcctcacactcattctcaacccgctgacaagcttcatctgcctacgacaaacagacctacaatagctcattgtatactctacaatgagccacatagacctcgaagggacaggcattctcattcaaacccgctgaagcttcaccggcgcagtcattctaataatcgcccacggacttacatgctcattactattctgcctagcaaactctaactacgaacgcactcacagtggactgataatccgctataaggactttctttactaccactaatagctttttgatgacttatagcaagcctcgctaaccattgcttaccacccactattaacctactgcgaagactctctgtgctagtaaccacgttctcctgatcctatgactatcctacttacaggacctcacatctn

SEQ ID NO: 646720 - DNA, 250 bp, Homo sapiens
aagagggagtgaacaggaggaagcacgcaggcgaatcgtaatgaggcgtgcgccgccggtatgcactgtacattgctcacgaacgtcatgcctctacttatttcactctctctctatgcctgtttaactttggaagatgcatcagaggtaggatcaagtttaagatgactgtgctgcccctgtcacatcgaaagaactactgacaacgtagggccgcgcctgcctttcccatctcgtctcttctcttgta

SEQ ID NO: 646721 - DNA, 108 bp, Homo sapiens
gtaagtgaattgtcatcgtttcaggcatcgtaggtcctttgttatggcagcagcacgctgacccgtgtcctgggtggccggagcgcgggaatcacctaagcttcaggc

SEQ ID NO: 646722 - DNA, 372 bp, Homo sapiens
acttaaaaacgtttctgtaatactataacacttgtaacctgtggcactggtacgttagtcccttaatctcgacatctgctgctatgtatcatcttcagttcctatgttaaacatacaccaacatacatagagttctgatgtacatttatttgttcattttcaagctggaagcataccattccttatttattttatgtatacagcacctacatttttatgcctcttgagcgtataagaaacagagcaatgtttctcactgtgcacaatctccatcaatatcatcaatatgctgatttgcaggcctattccagactcactgaaattctctcacattgtactgttcgtcaggtgctctgcatttttaataagcag

SEQ ID NO: 646723 - DNA, 134 bp, Homo sapiens
  misc_feature (130)..(130): n is a, c, g, or t
gagaggtggcccgctatgtgacttcaaccccatgagcagcaatgcagtgcaaagatgtgtccgcctgcgctcggtgctcagtgtcctgaagcagacgccactgtcccgctaggtgcctgctagtgtgcantgcc

SEQ ID NO: 646724 - DNA, 212 bp, Homo sapiens
ggctcgagcggctcgtctttaaatagcctcttgggagttcccattgtacgctcagagggttaaagatgtagacgtgacgtgccagtggacctgatgcagagtgagcactggggaaaaggtgggagaggaggtgacagagggggaagactagagagaggagggccctgcaggcccagattattctcctaggtgggatggaagtcggaggatgt

SEQ ID NO: 646725 - DNA, 184 bp, Homo sapiens
  misc_feature (29)..(29): n is a, c, g, or t
gtggggtggaagaaagtggggtgggacgncccaatgaaatctagagtaaaacccaagtgggcccaaggtttcctgcaggctgtaatgcagtttaatcagagtgccattttttttttttgttcaaatgattttaattattggaatgccaatttttttaatatgcaaataaaaagtttaaaaactt

SEQ ID NO: 646726 - DNA, 330 bp, Homo sapiens
acgacggcagtgtattcgacggcagatgtaaaccgacggcagatgtaaaactgacggccatctgtaaactgactgccagtgtctaaactgacggccatctgtaaaacgctagccgttgtcaaccgactgcccaagtaaattgagtgtctttgttaaacgtgggtctttgttatgttgcgcaggctgttctcaaacgcctgattcaagcgatccacccatctcagcctcccaaagttctgagattacaggcatgagccactgcgtccagtctgaagcacattatacttaattgatagtatggctacctgcccacagttggtgtaccgagct

SEQ ID NO: 646727 - DNA, 181 bp, Homo sapiens
ttgacatcgggcttgtgcgcagagatagtcagactgtgctgcaggcagttcatcgcatctggatcacgaccctccctagttatgctgagacactgcggctcccagctccatgctgtgctgtgctccgcgtctctcatgcagaggaggaagagcgggtaccccctgaggatgatgagtactc

SEQ ID NO: 646728 - DNA, 759 bp, Homo sapiens
tcccccgggctgcagggaaaaagttaacactcctatacaaacataaaaattcttcatgaaatattatattaaaaaacaacaaagtaacccagtcatctcaaaattgacatctatgaattccagaaaagttaagagtgatgttaaaactagagcagtgaggggaagctgaagtagaaccattcccagggaaaagaaacagagttaggccttcataatgagggacatgaaggagaatcaaactccatctgcagaagacgggaagctagacgccaggctccaaagaagagccaaggttcatacatgactgtccacagtgatgtcataagacatttatcaaccagtttataaagaagactaggactttccttaagggttcagaagtgaataaccttcttccttactgaatataaaacagaaaccaagaggcagcatgggatcacaggaggagaaatcttgcaagaaaggagccaaaacccaagaaagccgacgcatagaataaagagtcccgctaacatttctgagccaccacatcaagcccgaggatactgaattcttctcttctactttcccttctgcgatggcaaagtttgagaactgcttaaaaatactgcttaaatagcggggattattataatccattttgcagagctttcatgttgatgaattttttcctttaaggggagcttacttggtttgctcctacctaaggtttcacgtaatcttggccatgttatttgtgcagcgcctttaacatgtttc

SEQ ID NO: 646729 - DNA, 94 bp, Homo sapiens
tcaagatgaagctgacagactagggaaagtgtatgataaatacatgtgcagctttctgttcaacttgaacaatgattttgtggtggatgcagcc

SEQ ID NO: 646730 - DNA, 904 bp, Homo sapiens
ctcgcgaggcggtctcctgcttctaggatgaagctgaacatctccgtcccagccactgggtgccagaaactcattgaagtggagcgatgaacgcaagacttcgtagtttctatgatgaagcgtatggccacagacagttgctgatgacgctctgggtgaagaatgtacaggtgcttatgtggtccgaactcagtggtgggaacgacacagatcaaggtttccccatgaaggcatgctgtcttgacccatggccgtgtccgtctgctactgagtaaggtgggcattcctgttacacgagcgaacgagaactggagaacagacagagaattatcagcctcgtgtgttcgcagttgtggactgcaacatctgagcgtgctcaaccgttgtgctagttgtaagaatacaatggatgagacaggcatattcctggactgtactgatactacaagtgcctcgccgcctgggaccccaaaaagagctagcacgaatccgctaaacttttcgaatctctctaaagaagatgcatgtccgccagtatgttgtaagaacagcccttaagagtaacagaaggtaacgaaacctaggacctaagcacccaagattcagcgggcttgtaactccagcgtgtcctgcagcggaaacggatggcgtattgctctgaagaagcagtgtaccaagaacaaattacagacgaggctgcagtaatattgctgaaactttagggccgaagagaattgaaggaggctcaggagaaagcgccagggaacaaaattgcgatgagacgcagactttccttctcttgcgaagcttctagcttctatggtcgtggaatccagtcagaaattaagaatcttggggtaaccaagtaaatccgattctgactctggaaaaaggacaatagaca

SEQ ID NO: 646731 - DNA, 124 bp, Homo sapiens
acgcaaggattctgcgcacactcagcctgcagggagccgtgttaggaggcgtcgggagaaatcaggctctcggtggtcactaaaattcaacgtgaggtacgcagtacatgacgcccgatgcaca

SEQ ID NO: 646732 - DNA, 695 bp, Homo sapiens
cactgccacttctactcagaggccacttaggaaccttgtgtcctatctaaagcaaaagcaggcagccgggcgtgatcagcctccctcgtggagggcaacaaagacagaggcaaaacaccggggtcctgcgatgccttcccaccttgtgagttctcccagcagttcctggattccccggcacaaggcagctggcacaaatctgaagacagattacctggtcatgatcattgtccgtgggtttaggttttcagataggagttaggtatgagaacaagaagagagaaaacttggcgctgaccctgttatagtggttatagtggtgtccctaaagggacggaaactgactgttcagcgaatacatctggcttcgaactagctggcactgtaagcatatcggacatgtcacacagctctaatggacctttttgaagacgaagttgtggctatatgtggacgttctacagtgggcctctgatggaagaaagctaatctgtttagtatttgtgcattttactaaaatggcagcttaaagttgtgtatctgctaattgtgatgccaatgccggtgttttaagtggaacaaaaatgacctctctggatttgtgctgtgtacacaagatttctggaaaagtaaagaacaaccctttttatggcttacacagcttaagagtatactgtctctgcaaacgtgcgcta

SEQ ID NO: 646733 - DNA, 220 bp, Homo sapiens
acagaaggtctgcggccgatacctccagcagcagctggatgctactaactgtctgggcatctgcgagtttggggaacagcaaggcctgctaggggtagctgccaaagcctgggctttcctgcgggagaactttgaggcggtggcccaagaggatgaattcttgcagctggcaagagaccggctggctacctgtctggccagcgacctgctgcaggtacct

SEQ ID NO: 646734 - DNA, 104 bp, Homo sapiens
gtcaaagggtggaatagtgggagctgcccacatgctgcagatgcactcgaatcatagtgtaagtcacagggctggctcgggtccgacactttgatgggcaggtc

SEQ ID NO: 646735 - DNA, 527 bp, Homo sapiens
ggggcttctttttgaggaagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaa

SEQ ID NO: 646736 - DNA, 1149 bp, Homo sapiens
  misc_feature (605)..(605): n is a, c, g, or t
gtcaaacattgatttgggtatacttattctcttttcttcttttcttgggtaactattagaaaacacccacagtgctatttattctccgagggtgtgcagagtcattctagtaatttctccaaatgtggctcaccgagaactcagagttgtggagctcaaaagaaacacgtgcaactatgtgggcctctcgagatgtggggttctatacaccagaattctaaattgtgctgaatctacaaatctccattgtgggcgcctgtgagtgagtgtgccctgtgtattaggtctctaataagtctctcataagctgcgcatccagcggcgtctctctgttatatcatatgtgaaacaccccgctttataaaaagcgtgatgtctctaatatctcccctagtggggccgtctccatacatttttgcgccgggggcttctctcttctacaacaagcggggcggagaacattattaccgccctcttgttcgtaccacgcacggaaacaggggggatccttcaccgaagaggaaaatcttccatgctcttcctgctgctaataacaccaggggcagaatctttcataggaggcagaaggtgggccccgcctgggnggtgtggtacattacctaacgaagagagaaagaacacacaatatcatgggtggtctgctcacacaccgacggttggtcgatcaagccccaaagcctcgggtggggcatcattgttttacttcattcaacaactacatgaaattatcacgccctgacttggtagtgcacgctctcctctgctacttacatcaaataatcagtgcttatattgtttcaccccccagatgtatctcaccgcaccggacggaggcacctcaactctttcaacccaggccgccccgtcctttcacgcacaacccacaagcactgcgacgaaacgcaacgcaagacgacagccttggccttaactcgacaggcttgggcgcgcgcctacaatataacgcgctgttcatgacgacaaccacgcaaggtcgggctggtcggccgaccgtacaacaacttctctccacagatggtcacaccaacgaagagggggggacgacccactatgtgtcctagcgacacgacacgaacggggtgcctacacgtactgcttcaccgaaaa

SEQ ID NO: 646737 - DNA, 1406 bp, Homo sapiens
  misc_feature (533)..(533): n is a, c, g, or t
  misc_feature (535)..(535): n is a, c, g, or t
  misc_feature (537)..(537): n is a, c, g, or t
  misc_feature (539)..(540): n is a, c, g, or t
  misc_feature (547)..(547): n is a, c, g, or t
  misc_feature (550)..(550): n is a, c, g, or t
ggggcttctttttgaggaagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaacaaaananancnnacaaacnacnaccccacaacacaaatcaaataaacaataaaaaacaaaaaaaacgagcgcaccccccttcaatacacatatcccctcccggctccccaccaactctccctcctattcaccccaccactctcataccccatcaatcctacactttataactcaaccgactactcgttattacttacaataatacccagacgaacaaaatacagccacacaacaacgataagtagacagaacagaaacaccaaccatctcctgcacgaaataaaaacacaacataaacccaatcaaaaaaacacaaaaaagaaaaccataatcatattatgtaccaccctcatacacaactaacacaccaaacacttacccagacaacatcacctaaaacacaattttcaacatattatacaaaacctacacgaactacatatctaaaatataacccaaccacaacagtcccttttcggctgacacagcttaccacccaacaaccaactagcagatcgacacgagataaaataaatttttccatacacgcacaacggtaatacacacccataaaacgataattatatacattcatctattatcaatcatcatcaaacaattcatcacccactcccccctcccgcctcacctgccacaccacatacatgcaaaacacacaaaactctccaccccacacctcgaccaatccaacaccacaaaatcacccacacagatctaagcaccagactaacacacgcacgtctaaccccaccactccatcgtcacccataacattctctgcatccagcactgcgagacaccgcaaaaagtcatctaccacgagcaaacctgtagtcacacatctctagctctctgtc

SEQ ID NO: 646738 - DNA, 1001 bp, Homo sapiens
ggggcttctttttgaggaagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgagagtctttctctgtcacccaggctggacgtgcactggcgtgatctcagctcactgcaacctctgcctacctgggttcaagtgattctcgtgtctcagcctcctgagtagctagagactacaggtgtgcaccagtgtacccagctgattaaagaataaatgtcagagactggggtaatgccactatggccaggctagtctcgaactcctgagctcaggtgatacacacacctcagccactctcccaactgatacattctgtgacactcccttgaccttctgacacaagaaagtgatattgcagtaatgcatacacttgaacaagtgtgggttattaacacgagcccctttacgcattgtgcaacattcccaacgaaacgcacaagagttagagagagacgatacgtgattcatctaccgcaccccacgcgctacagcgatgtgcaacgagtaacaccgatcaactccacgggtgagcccgagcgattcaacgcagagtcagaaatatatgcaggcaattgcgaacgacgatatcaagaaa

SEQ ID NO: 646739 - DNA, 864 bp, Homo sapiens
  misc_feature (399)..(399): n is a, c, g, or t
agcggagggggcggctgcacgcgcggagcgccgggtgcggccatgcggggatcgggcccgatccctagcgccgaccccgaggcccaaagcgcgatgccggagccacgagacgagagacccgagtcgcgagcccgagcagcagagctcccggtgcggctggcggctacagccggcggaggcggcgggcgcggggcgcgctctgaggcccagggggatgcgccaggcgacatcgaccatgggcgccgccgccatccaggaggagggcgctgaggagcgaggtgatgtcctcggtggcggcctaaagtgtcgcccgagtcgttaggacgagtacctgtcccagcagttcgcacctgttagaatgcgagaactggtcgcaggatcaggctgcttggcgtgatngctcttacttcttgggcacactgaccaggggtgcgccccgaagattgcatggtcgggcgcacacccagaagagctagaggcgtcgcgtacctgtcacactccggttgctccaaaacaggcatggcgtactggacgtgggcaagcgcgtcgtcgagaatggacgcctcaaggaagttaaggcgcacgacccccgggatgggcctgtatgggccgcatgccaggccccttcgaaggcttggttaccacacattcgtgcccggcgcgtgcaaagccccgtaggctccctggacttgtggctcattggcccccttgactggctgggacagcgcgaagcttggaggccttggacttgcgtttgggtggaaacggggggggttggggccgtggcctgccggggccacggcgctcaattccattaccatcaaggggccaaggccccttgactgcggcccagggtcctgggtg

SEQ ID NO: 646740 - DNA, 110 bp, Homo sapiens
cagagtgatagagtatctactgtgccaattacccatctaccagcagcaatatgagagttccagttgctctacaaccttttcaactcttgatattctaagctttttgtcgt

SEQ ID NO: 646741 - DNA, 610 bp, Homo sapiens
ggggcttctttttgaggaagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagacacaagcgactcattgacttgcacagtccttctgagattgttaagcagattacttccatcagtattgagccaggagttgaggtggaagtcaccattgcagatgcttaagtcaactattttaataaattgatgaccagttgttaaatactcaatttagatcttcttggtttcttttcacctctcattactcccctactcccagttccgtgttatgcggactgttacttctacatcttatttattttttttggctgttgtaggtccattatttaaataacttct

SEQ ID NO: 646742 - DNA, 350 bp, Homo sapiens
ggggcttctttttgaggaagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaagctgacgagttgaacttgataagcttactacttggtatgagaacttaagtatacacagaccagcagttagcgggaagaggttacaagatctatgcagcaggcaggaattacgacggggt

SEQ ID NO: 646743 - DNA, 103 bp, Homo sapiens
acctatcttcgatctcgccggaggaggagaccccattctataccaacacctatgctgatttttcggtcacccgtgaagattgccctgaagattgattggctgg

SEQ ID NO: 646744 - DNA, 515 bp, Homo sapiens
  misc_feature (24)..(24): n is a, c, g, or t
  misc_feature (42)..(42): n is a, c, g, or t
  misc_feature (81)..(81): n is a, c, g, or t
  misc_feature (155)..(156): n is a, c, g, or t
  misc_feature (165)..(165): n is a, c, g, or t
  misc_feature (214)..(214): n is a, c, g, or t
  misc_feature (217)..(217): n is a, c, g, or t
  misc_feature (232)..(232): n is a, c, g, or t
  misc_feature (291)..(291): n is a, c, g, or t
  misc_feature (298)..(298): n is a, c, g, or t
  misc_feature (310)..(310): n is a, c, g, or t
  misc_feature (313)..(313): n is a, c, g, or t
  misc_feature (351)..(351): n is a, c, g, or t
  misc_feature (358)..(358): n is a, c, g, or t
  misc_feature (386)..(386): n is a, c, g, or t
  misc_feature (410)..(410): n is a, c, g, or t
  misc_feature (482)..(482): n is a, c, g, or t
  misc_feature (499)..(499): n is a, c, g, or t
  misc_feature (503)..(503): n is a, c, g, or t
  misc_feature (505)..(505): n is a, c, g, or t
  misc_feature (513)..(513): n is a, c, g, or t
ggggggaagaagaaaaccttcccncccaaccaagaaaaaagnaggttctcaaccggcctaaatgtttctttaaaaacttgnctggggggcccaaagtgggagagagagagaaaccgccctcatgactcacctggtcaggagatagggggccagannctgaccccnaatccccggcagcacccctagcaaataggtctgtatcaaagattctgtncanctggttttgggggtnaagggcacctatgggggcttaaataaatggacagggggcaagggatgtaacgagaacanagggtgnctgtccggccancancctgggcctctggcgccccttcattctgacccccggtnccacctncccactgtggcccgcgggactccccagntgggaaaggagggaaactctccancaagtctcggccccacctctctctgaacagatgggacaggaagacgggcactgggggctgggtggggcttancgcagtcctctccatcncctngnctggcgangg

SEQ ID NO: 646745 - DNA, 101 bp, Homo sapiens
atccacccacctcggcgtcccaaagtgctgggattacaggtgtgagccacaaagcccggcccattttcttcctctttggaggtaatggattggtttggaga

SEQ ID NO: 646746 - DNA, 2084 bp, Homo sapiens
ccagctttagctatgatgcagcaagcacagcagccccttaccttcattccttcttccttcccactttcaatcaattcatctattcttttcctttcttcagactgggcagagagaaagaaaaacagcatcagtatcttctcctaggcccatcgtgcgtagcttgatggtcttgagccctgattgcccaggccatgcccaccgggccacaatcggcctcatttggcatcactggggatgatgggtccccagtgatggcaaagcccccaagtatccctccttttctcatcacccatctgttgtggaagatctgtcacctggggttcaactggatcaggagggaaacagtggggacccaagaacagaatggggctcgtagatatgttctgttgcccatgcagcacgttaaaaaatgtccaacttgcccacacctgaaaatcaggcctctgacttcacagaaaatcaggtacagtgggccaggcgcggtggctcacgcctgtaatcgcaacacttcgggaggccgaggcgggcggatcataaggtcacgagttcgagaccagcctggcaaataggtaaaaccctgtctctattaaagatacaaaaattagccaggtgtggtaggagcctgtagtcccagctactcgggaggctgaggcaggagaatcgcttgaacctgggaggtggaggttgcagtgagccaagattgtgctactgcactccagcctgggcgacacagcaagactccaccttaaaaagaaaaaagaaaatcgggtacagcagatcagaggctgtgccctttggatgggacacacgcagtccacatggctctggtctgatggctcatacttctgtttgggatcgctgagattcacctgtatggaggccaccacgatggatgagaagagggcctccaatcccgagggtcaatacagacctgaacagagaactgggagggggcacccctggatccacctctcctctaaggccacccctcctgcacctacctccatccctaaccctgggttctactgctctgccactgcacagatactacagagcaaaagggaaccaaatgaagacagatcggaagctccaaaccagtgtggctcaccccaaaccagcatgtcttgacggcatagactttcaccaaaccagatggcacgtgtcaggagcctgacaccaactgctgagctcagcccattccccctacacagaggcccaaaccagcttgcagcttttccaggcactcaatccacacctgcaatgtgccaggcgctgcagtctgtgctgggaacaatggtgaatgagtaacctcaaggacagtcccaaatcctgccacctcctctccatctccattcccactgcggccctgcagcccagccacggccccggccccgctccggcccccttgctagtcaccaggctttcactctgaccccagggaacactcagttctccacaaggtagccagaggggtcttttaaaatgtaaatgaggccaggggcagtggctctctcctgtaatcccaacacttcaggaaagccgggaggaaggatcgcttaaggacaggagttagagaccagcctaagcaacagatccagaccctgtccctacaaaaaataaataagctaggtgtggtggcgtacacctttggtcccagctactctagaggctgaggaaggaggaggattgctggagcccaggaggttgaggctgcagtgagccatgactgtgacactgcactcctgcctgggcaacagagtgagaccctgtcttaaaaaaaaacagaaaacatgaccaggcatggtggctcacgtctgtcatcccagcactttgggaagctgaggtgggtggatcacttgaggttacgagtttgagaccagcctggccaacatggcgaaaccccgtctctactaaaaacacaaaaattagctgggcgtggtggcacacacctgtaatcccggctactcaggaggctgaggcaggagaatcgcttgaacccaggaggtggagtttgcagtaggccaagatcgcaccactgcactccagcctgggagacagagcaagactccatctcaaaaagaaac

SEQ ID NO: 646747 - DNA, 430 bp, Homo sapiens
cgatgggctcagatcatatagatcacttctaagccatgtacccgagagacgtccacaaaggctgagttagtacctggtcctatggtctcacctgtgatataatagatatgtttctggttctccttcattctaggtgcagttgtccttgagagaacacatctcatcaccagaggcagatgtgtagtaccttaccagctctgaaaagcttcttccgatattagagagtcttcgtgtattccaagctttatgttaatagagaactgctcatagaatttcttgtagttctctttatcctccggcagttcagtcaagagttctaagcattatttttgaccaaattcttcctgataactttcaaataatagctattgtaagcaacatactcacggggaaatgttatgagggagaaaagaccctggggtaaccgaag

SEQ ID NO: 646748 - DNA, 217 bp, Homo sapiens
ctgacctcaagtaatctcagcactttgggaggctgaggtggtttgattgcttgagccctggaattagagaccagcctgggcaacatggcgaaactcggtctctacgagaaatagaaaaattaggtgggtgtggtggcgcatgcctgtaatcccggctgctcgggaggctgaagtgtgaggagcacttgagcctgggaagttggggccacagtgagct

SEQ ID NO: 646749 - DNA, 131 bp, Homo sapiens
ttaggatccggatatttggaaaacacgattcagccttccatgtgcctgttcccaaattccaatgaaacacaggatggtgagcagcaagagaaccctgtgcaggaccccgcttcttctctacgcgtgcctca

SEQ ID NO: 646750 - DNA, 261 bp, Homo sapiens
  misc_feature (217)..(217): n is a, c, g, or t
  misc_feature (255)..(255): n is a, c, g, or t
gctcacacctgtactcccaacactctgggaggccgaggtaggcagatggcttgagcccaggtgtttgagaccagcctgggtaacatagtgaaaccctgtctatacaaaaaattagctgggcatagtggtatgtgcctgtagtcccagctacttaggaggctgaggtgggaggatcacctgagcccagggaggtcgatggttgagtgagccatgtgcngctcactgcactccaacatgagcaacagagtaagacanctatct

SEQ ID NO: 646751 - DNA, 163 bp, Homo sapiens
ggtagtttattttattttttaaaaataggtcaggtgcagtggctcacacttgtaattcctggcccaggtgggaggatcacttgaggccaggagttcaaggctgcagtaagctatgattgcaccattgcactccagcctgggtgacagagcaagatgtcgacgc

SEQ ID NO: 646752 - DNA, 1027 bp, Homo sapiens
  misc_feature (1)..(1): n is a, c, g, or t
  misc_feature (84)..(84): n is a, c, g, or t
  misc_feature (99)..(99): n is a, c, g, or t
  misc_feature (154)..(154): n is a, c, g, or t
  misc_feature (164)..(164): n is a, c, g, or t
  misc_feature (184)..(184): n is a, c, g, or t
  misc_feature (246)..(246): n is a, c, g, or t
  misc_feature (294)..(294): n is a, c, g, or t
  misc_feature (316)..(316): n is a, c, g, or t
  misc_feature (325)..(325): n is a, c, g, or t
  misc_feature (327)..(327): n is a, c, g, or t
  misc_feature (334)..(336): n is a, c, g, or t
  misc_feature (340)..(340): n is a, c, g, or t
  misc_feature (353)..(353): n is a, c, g, or t
  misc_feature (372)..(372): n is a, c, g, or t
  misc_feature (378)..(378): n is a, c, g, or t
  misc_feature (394)..(394): n is a, c, g, or t
  misc_feature (406)..(406): n is a, c, g, or t
  misc_feature (419)..(419): n is a, c, g, or t
  misc_feature (446)..(446): n is a, c, g, or t
  misc_feature (450)..(450): n is a, c, g, or t
  misc_feature (463)..(463): n is a, c, g, or t
  misc_feature (466)..(466): n is a, c, g, or t
  misc_feature (487)..(487): n is a, c, g, or t
  misc_feature (515)..(517): n is a, c, g, or t
  misc_feature (527)..(527): n is a, c, g, or t
  misc_feature (564)..(564): n is a, c, g, or t
  misc_feature (568)..(568): n is a, c, g, or t
  misc_feature (580)..(580): n is a, c, g, or t
  misc_feature (582)..(582): n is a, c, g, or t
  misc_feature (596)..(596): n is a, c, g, or t
  misc_feature (617)..(617): n is a, c, g, or t
  misc_feature (624)..(624): n is a, c, g, or t
  misc_feature (634)..(634): n is a, c, g, or t
  misc_feature (858)..(858): n is a, c, g, or t
  misc_feature (874)..(874): n is a, c, g, or t
  misc_feature (883)..(883): n is a, c, g, or t
  misc_feature (934)..(934): n is a, c, g, or t
  misc_feature (946)..(946): n is a, c, g, or t
  misc_feature (965)..(965): n is a, c, g, or t
  misc_feature (967)..(967): n is a, c, g, or t
  misc_feature (997)..(997): n is a, c, g, or t
naaagaaaagaaagaacaaaaaagaggcaggaacggtcggaattccggggtatccggttaccggtccctcgctcgctgctcganagcccagactcggcnctggcagtggcggctggcgattcggaccgatccgacctgggcggaggtggcccgngccccgcggnatgagccggtgaccaagctnggggccgagcgggaggcagccgtggccgaggagtgtgaggaagaggctgtctgtgtcattangtgtgcgtcggtcaagtataatatccggggtcctgccctcatcccaanaatgaagaccaagcaccgaatntactatatnancctcttnnncatngtactcctgggcntcattgccactggcatgtntcagtnttggccccattctatngagtcctcaaangactggaatgtanagaagcgcagatccgtgatgtgccggnttgntaggctgccagcnganagtcccatcccagagcggggngatctcagttgcagaatgcacacgtgtnnngatgtctatngctgtggcttcaacccaaagaacaaaatcaaggtgtntatntatgctctgaanangtacgtggatgatntggcgtctctgtcagcaacancatctcncgggagtatnatgaactgctcatggccatctcagacagtgactactacactgatgacatcaaccgggcctgtctgtttgtccctccaccgatgtgcttaaccagaacacactgcgcatcaaggagacagcacaagcgatggcccagctctctaggtgggatcgaggtacgaatcacctgttgttcaacatgttgcctgggaggtcccccagattataacacagccctggatgtncccagagacagggccntgttggctngtggcggcttttctacgtggacttaccggcaaggctacgatgtcagcattnctgtctatagtncactgtcagctgaggtggntntccagagaaaggacaggtccacggcaatanttcttcctgtcatctcaggtgggtgtcatc

SEQ ID NO: 646753 - DNA, 417 bp, Homo sapiens
ccggtgtgagcatgccagcattgggagccgcctcctatcaggcagcaccataggtccctggctgtggctgtgcgcccagccctacggatgtggtacaggtccgattccaagctcaggcccgggctggaggtggtcggagataccaaagcaccgtcaatgcctacaagaccattgcccgagaggaagggttccggtggcctctggaaagggacctctcccaatgttgctcgtaatgccattgtcaactgtgctgagctggtgacctatgacctcatcaaggatgccctcctgaaagccaacctcatgacagatgacctcccttgccacttcacttctgcctttggggcaggcttctgcaccactgtcatcgcctcccctgtagacgtggtcgagacgagatacatgaactctgccctg

SEQ ID NO: 646754 - DNA, 350 bp, Homo sapiens
  misc_feature (227)..(227): n is a, c, g, or t
ccaaactcgaaggcttgaagggcgccgacggagcaacctgtcccagcgcgagcctatggcctttcccggcaaggttggcgagcagctcaacctgcgggaaatcgagcagttggtggaccagttgaatcgcttgccgtccaagcaggcacaaatggaactgacccccggcagccaggtgggcggcagtgaagtgcaggtcaagaacgtcccgcaaaagccctggcgtngcagccgtgtcgcgtaataacgacgggcagaaaagcaccggcgaacagcagtggggcgccggccttgagtgggacagccccctgcgctggccgaccagcttgtgttgcgcggcggccacgatg

SEQ ID NO: 646755 - DNA, 601 bp, Homo sapiens
ggcagttctgttctttgcataagatagcttgggtatccgggtctttgtaattccatatggttttaggactgttttttctatttctgtgaagaatgtcacagaatgcagtctacatatgcatagaatctgtagattgcattgggtagcatggacattttaacaatattgattcttccaattcatgaacatgaaatatctttccattttttgaggtcttcttcaatctcttttatcagtgtttcctaattctgattatagagatctttcacatctttgatcaagttgattcctacgtatttcactttatttgtggctgttgtaaatgggattactttttgcatttctttctcagattgttcagtcagcatacaggaatgatactgatttttgtatgttgattttacatcttgcaactttactaaatttgtttatcagttctaacagttttgatggcgtctctggatttttccaaatataagatcatatatctgcaaacaaggataatttgacttatcttcctgtttggatgcctttatttctttctgtggtctgattgtctagctaggactccagtactatattgacaatacagtgaaaagag

SEQ ID NO: 646756 - DNA, 1210 bp, Homo sapiens
ggaaaacaatccaacacttgttggaagtcctagaaggagcttgtccgcctcccggagaccgtacatacgggtgtgcgatacaccagcattgaatcggttggagagatgagtgaacgtcgtcgatcgaaatccgtcagttccattgaccctgttgtcgggctactttgagtgaaaggcctgtgtgcagaaagcccctggcttcctgcgtgcagccaagagccatggtcagtaacagtttgctcgtgtctgccgcagatcactatggcgtcagacgactttaatggcactccttggagaatatgcccgtctcccgtcgactctccattccgtgtcgtcgtccaagaacgctgctgttgggcttgctacaacagggacagcaactttgctcctaggcccgacttaccctttggactaaggagttaccgaaactgtactttaggtgaacctactggtcccctcgtcccacgggctaactggcccacttgcatagcagacacgcctgcttcggctctccccagcaaggccccagcgaactggcccattactccctaccaggactccgcgacccagccggctcccttctccgactcggcccttggccaccgtgcaatacttcgcaagggccatgtcacctccaaactccccccagtgggtcgcgcaccacacttgcgaccacgcatcgtccaatccccggcgggctccacccacaccacgcctcacttgcccatgggcactacataacttgggcccatagctcctctacttccgctggcaagaacttccttacacgcttacatggccaccccggaaggccttggacttacacctccggggacttcgctgacgcaaagcccgctctggctctcggccacgggctggcccttgcccgccctcttggcctcgcctcccgccttgcgtgctacgcgcgcccaacacgggacttcttggctatgccacacccttggcgtggcgccgcaccaccctaagcctcaaccaccaagcagtggagctgcacaccggcccgcaccccccccgctcaacgctccacgccacttcacacctggacccttccccggggacccatatggccccacggcaactccacacgctcgcccgccaaccgacccggggccaaccgcgcgcaccccccgcggccccagccaccgacccacacgtacacacccgctcatcaacccgcctccccccaccg

SEQ ID NO: 646757 - DNA, 258 bp, Homo sapiens
cgagcagcgcggaacccactcggggccgccgccagacgcacgggggggcggcggagccacctcgaggattgccaccagccaaaccatcccatgccagaccaggaagcagccgtcctacctcccagagaaacagacctcagccctaatgatcactcaaatccgagtcaatccctctatttaaaaaaagcgcggatatagtctcccctcccttccccagtcctcttggcgacagggcggtcacaggacatatgtgttctt

SEQ ID NO: 646758 - DNA, 311 bp, Homo sapiens
tatgttctctgataggtgcagagacagagtcttgccgcgatgacgtccgatcagaatagctcctctatgcggaacgtgcacttcgtgcccctaagcagaaatcatagggctgctcatctgccttgccgcaacttgtggccagtctcataatggctgccaatgcttcctcagcagtagcgactagtgacgaagccgtagatgtccccttggacacggaagtggatgggtgcactcctcaaatctctccaaaaatggagaacctctgtgtcagctctgatcgagtcatgcggccagggtatctttccaatgaa

SEQ ID NO: 646759 - DNA, 172 bp, Homo sapiens
gcatgtatggacatcatcacttaggaaatacagctgtccttatgcaatccatctcctaggacaggcttacattggtgtcttgtctttgctatatagctcacgacataatgtggtggctatggttggcagggtgggggagagttcctgatcttgttggagatattcatgttac

SEQ ID NO: 646760 - DNA, 889 bp, Homo sapiens
ggccctcaggcttccgaggagcgcacacttggagccagcttcctcagaacaactggaacccaccgtcacgttcctgtttacactcctgaacacctctgagcccactgagccagaagaccctgaatcaggactcggagatcctgggaggtacctagttcttacatcgagcgaggacgtggggccccgcacgccgtgacctcaaaggagtatcagtgcaatgcttgtcagatatgactgcagtgaggcttcgggagtccactgagcaccacccatgtgcacaatctggccctggggcgcagaagcttgctaagacatcttgctccatctttatttgtatacatgccgtccttgcatatggcatgcgcgagccctaggccatccagagaggaggcccatgccatccaggatagaagtgaaaggccctgacgagaggaaagccaggccctgaccgagaggtggctctgctcagtgacccaagacccccggaaggtcatggtctcctcttccaagctgcctgatgctgccccatcgacctagcagagaaccagggtctaggcctggcccaaggcccccatgccagagagtcggagcacctcctctgcggaggcctgctccttcagaccgagctcctcccatagatccgcagaagatatacttcggaacgcgtaagtaggaaccctgaagaccgggggcggcacccaaggctttatataaaagggggggggtggagcgacggatcacagttaggacggcccatcgggtgggccccaaagaaatcggccagtatgcagagattctattcttgtgtcacagccgggtgcgacccagtacgtggccggggccttttccataagtgcgagcctggggctggcatcccttgaaggacacg

SEQ ID NO: 646761 - DNA, 102 bp, Homo sapiens
actgaatgcctcagcctgacgtgcagagcagctctcccacagcgtggcggagttgaggagccagaaacagaagatggtctcagaaatgggatgcggctccag

SEQ ID NO: 646762 - DNA, 150 bp, Homo sapiens
ctgcgatccttttgagattggggaatacaaaggaataaaattgaaaacacctcacagtgatttgccaaatctttctgcaaaatccgctcctcggctattaacaaagacgactacctctctcggttccgcacgaacaacacgtctgtgtca

SEQ ID NO: 646763 - DNA, 123 bp, Homo sapiens
ccgactggtccggacagccaggggttaccgatcctgctgattcagccgtgggtgtccttgctgacaaagactcgacgaactttctggtcatcccagctgaaagtgctgtcgggctagtcgggg

SEQ ID NO: 646764 - DNA, 470 bp, Homo sapiens
  misc_feature (10)..(10): n is a, c, g, or t
  misc_feature (38)..(38): n is a, c, g, or t
  misc_feature (433)..(433): n is a, c, g, or t
  misc_feature (449)..(449): n is a, c, g, or t
ggggttgttnaagatggggatccaaaagagccctttgnatcaaggtccccagattggaaaaatataaatagcccttgtacctaaaagcccaaccctaagtacaggtttgactaactccttatcccaaaatgccttgggaccagaagtccttccagatttagaatttcagaatatttgcattctacttaccagttcagcaaccccaatccagaaatatgaaaaccaaaatgctccaacgagcatttcctttgagcatgaccctggagcactcaaaatgttttggatcttggagcatttagaatgtcagatttggcctggtgcagtggctcacacctgcaatcccagcactaaaggaggccgacgtgggcagatcacctgaagtcaggagttcgagaccagcctggcccatatggtgaaacccccgtctctactnaaaatacaaaaaaaantattttttttaattgcttcgg

SEQ ID NO: 646765 - DNA, 373 bp, Homo sapiens
gcaaagatacagcttccacggtgtggaaaccaccccaccgtgttgccaatgttggctgagcctgcttttattcccttatctggcaccacccacatcctgctgattggtccattttacagagagctgattagtctgttttacagagaactgattggtccgttttgacagggtgctgattggtgcatttacaatccctgagatagacacaaaagttctccaagtccccactagattagccagacacagagcactgattggtgcatttacaaaccttgagctagacacagagtgctgactggtatatttacaataccttggctagacataaagattctccaagtccccaccagattagctagatacagagtgctga

SEQ ID NO: 646766 - DNA, 803 bp, Homo sapiens
attggaaaggagcaggagccacttggtactaagccgtgactacctgcatgcattgatgaatcctaatgatagagatcgcgtaggcgtgatgctagtgagtaggagtgaacaagtaaatcgtgtgggatgggaagcatgctagttaatttttttatttgaaccttagcttgatcatagtgaatagtagctagagcatgtaggcctaaaaatagtgaatggagcacgggtgtatgattcttggtaatgatgctggtctgagggggatatgtggtgctagttgtgttgacagagtgtgaatgtcccttagatgtttcgattgtcgaggtggagttaaacggggtataagtgatgagagtagtgagaagcaatcagtatgaacttatgtgaaccatttgaggggtggggctgatgagaacatctctaatgtggttaaagattgcgtgaatagaattttgattccatggtatccaggaggtgtagaagatgtgaggtcttgttatcatggctttgcatcaaaagtagttttagactgcttgcttgcagtgggaatagtcacttgtctaatttagtgagatcgcattgctggaaccagcaatgaagtgtggaaatgttcttgagtgtataatttgatgcaagtaacggtcaggtggcatcagtggcaagctatgtgaaacactaactaatgggtgtactatgaatacccgttagattgatgtgaacggataaggctaggataggcacgtataagtattgggccaagcaaaccttaaatgtgtagaagaactttcagggttgcccttaga

SEQ ID NO: 646767 - DNA, 375 bp, Homo sapiens
gccttccctgccccccccctataggacttggacagaaacccgagggtcatcctttgactttttcctttcctctttacccaccccctacccaaaatgcccacccagttgcccaagttttgtcagttcaacctgctgagtgtcaggagagagcttcacttctttatcctctcacccaggataatacatttctgggttttgatatctaatgtgacattttaactgagtacctactttttttttttttgaggcaggagaaaggcatgaatccaggaggcagagcttgcagtgagctgagatcacgccattgcactccagcctgggcaacagtgttaagactctgtctcaaatataaataaataaataaataaataacaa

SEQ ID NO: 646768 - DNA, 456 bp, Homo sapiens
gcacgagctcgtgccgaattcggcacgagtataagaacatataggaagaatacattattcctatctagggcatcaaataattgcaaccacttaatgttaacttccttcataattcaaaacattatgttctatagcactatgtattttatgtcattatatacgtagtcaataactttatacgttttttttattgaacaaaagtaagaattgcttaagacataataagaggaaactcatcgaaccaattcaaaacggattatagatttatcataccagatacgtttatcaggaggcttgtataatggagcacagatataacgtgtttaatgatactccacgagggaaccattggatgggcagttctgtgtcaggatcaccacgtccatcttatagcagtcgtcctaatgtaaaccccccacgacgcttccaatatagtgacgatgagcccgctgagaa

SEQ ID NO: 646769 - DNA, 156 bp, Homo sapiens
cgttattacgagacgactatttctctgtcgtattatgtatctatatgtacaattttaaagttcttattttagtatacatataaatatcagtattctgacatgtaagaaaatgttacggcatcacacttatattttatgaacattgtactgttgctt

SEQ ID NO: 646770 - DNA, 1253 bp, Homo sapiens
attttttatttcaggggtcactgatggcttttaatttgggtagcagcaaaaccaccggggatatctatagccctgtgggccaccccgggaaatgcacagcgaggctccactatgagcctctagaaccatctgtggttgtcaatcgtgaggcgcagacaagagacaatcgatctggggcacattataacacgatctgcaagatgctaaggaggcgtgccaacgagggccctccgagggcagcactagggctctcgtgctagaaagttctcataaggaaagccggttacgaaacctccagcgggcgggtggggcgcttacacttagccgagggaaccccttgtcaagttttttgcggctcgggggggcgcccttcagaagccttggcgctgtgacgctgtgaccacgagagggggcgaaggaggcgtctgtggtgtatacgcccaaacagggcgttgcacccagaaaggggcttgtgcctgtgcccaaaaaggctttacacctttgtgcgcccacagggggggatccttctagtagaaaggttcaccccgtagcgcggggggcaaaaaaccttattagcgccccttttgcgttgccccccagaggtgtaccatttttatagagaatctcccgttagaggagcacgctaggggggttgtaggtcccttttggggccaaaagagcgcgccatcaaagaatttcggggccaaagggggggccacccacaagttctgttgtagaattcgtcggcccccgaagtggtgtcacacgaacggcctcccctcaacaaagagcccgatgggtgtatcagaggccagcgatcgcaaaagggggtaaactcctcagacaaggattacttcccccccgtgagaaaagcaggattggaagacaaccactacatattggagagggcgcccccaaagagccctatttgtggggccttgtgggggcgacccaaatactttgtcgacacacggccctttttgaaagaagaaagaactctcctgggggctccaaccgcggaggacgcccaaaaatcctggggggttctcgagccttcttagaaacccaaagtggcggagcacacttcgtttcgcaagggacccattccctcccgggttcaaccgaggggggcccctaggagggaaacccccatcttttagggggaggtcgagggcgacacctatgttggaggagtatataaatcccgccccagaaataaccagggggtaattcactcggaccagggcggtcgt

SEQ ID NO: 646771 - DNA, 764 bp, Homo sapiens
tgagccgtacttgaaaagcggtgttgttaggacactgctgttgttggtgcgagatgttctccacgtggtaccatagtaaggtgtattccatctacagcactcttgccgttaagttgatacgtctgcatgttctaacacgtgctatctggtgctccggggtggcgattgctcgacttgatcacacccacggtgttgacatggaacttcatcctagacatggagagtgcttgtccgtgtactggtggattgttgtgggtgcgtctcttgttactgtatcttcatagacaacgatttatgatatcttcgacgcattctatgatatcgattttctcaagatatgctcaagtagtgactagaatatacctgcatgacatatgtgtgacattctctgggcgtcttgtacgataccatccactgcgttctcttgcctctgttatacactcagcttcatccacaggatcgtagactttcctacttcgcgtgtgttaaacacagcaccgccctttaatactgtattgactaaataagtggtgactgcactgttgagcttcgggctcgcgaaagtaactcaatctcataacatgagaactcgtttccactaacttctcatgggtcataggtaccaagccttatactttgtgccccctcgtggggaggaatcctccaaaaaggggtgttctaatcccggcaatgtgtacaattggtgccccacaaggagaaataacagacacgcccggcgaggtgaagttccccaatgtaacgaa

SEQ ID NO: 646772 - DNA, 272 bp, Homo sapiens
tcattgtcatgttgtgaggacaattagaatgggctctgaatttccaattgtccttcaactgataaaattgctttcacatgctccgatatctatcccacgttattgctccctgctcttcttgcattctccgcctctcctcgattatttttatcggttcgggactcttgggatccccttggggtttgttttgttgagctcttcttgatcgatgtacttttccttaatcttcttttcttcttcttgtcaccatccttcttttcttcttcctcatc

SEQ ID NO: 646773 - DNA, 221 bp, Homo sapiens
agtgtctacagagcaaatctttagagtaggtcaggtaggaagccatttgccatctaagacgggctttatctctgtgatgcagagtgctttattacaggcagacataaagcggagaatggcagttctcccttcctgtctatacatcacgctgcattcactagagataaagcagcggctttgaatgcaacactggaaacatacccacaagctagaattttcaa

SEQ ID NO: 646774 - DNA, 928 bp, Homo sapiens
ggcttctctccgatggccatggggccgctcgccgtcctcctccccagccatgtcgtcgacgtccgccgcgttggtgctacatgctggggctgttgctcacttgccggcgcatcttctctggcggcgacgggggactctcgatagcattgagatgacggggaagactgatgtagcacagtactcctatagcactcgagtgtgatatacccttgcaagtccgccgttgtacctcccgaagagtagctacaatccagcgcattttttttctgcgatcaattgtggtctttgtgcagcgggacgtggcgttagcccgggtctctaatatgccccggcggtgggcaatatcgatatgtggccggtggctcttggaggtggcatcacgtggaggaaggtggcgcccggcagtctatggatcgcctataaccatcatggatgctgcatattctgagcgtatggtctgagggagggatgggggatttagctttgaatgtatctagcatttttgtattacctatatggcgtgatctatgtttggtgagcgtctaagaagcagcagactagtaaaaattgtaccagttaaggtgcatggaaaaaagccagaagatgaagggattctatccagcacgatcctgtccaagagtagcctgtgggattcggatccggtacttgtggacatgatgccttattgtgaggtgttccattttgcggggaaaggctgtacatgtgtgtaatgggttacgcttaagggatcaggaagataactacgtggtccctgggtggcctgggactggcgttagggaagagaacccgagaggttagagaggccaaatggggtggcaagatggggcatcgggtaagaacaaaagaatagtccgacgaaattacgcagagggcgagtgaaaatcaaagagagggagagggaattcag

SEQ ID NO: 646775 - DNA, 236 bp, Homo sapiens
atggtgtggtaggggcggcaggcactgtgaggcactggcgctcacgtgtgaagccagaggcatgaggtctccccaaacaaagggacactgtctgtgatggaggactctgcccaggagatctggcactgtgaagccggaacgggaacccgggccccaagatcacgtggtatcgcaaccgggcagcgcgctggaggtgcccgtagagatgaacccaggaggcgtacatgaccaggcgg

SEQ ID NO: 646776 - DNA, 105 bp, Homo sapiens
  misc_feature (31)..(31): n is a, c, g, or t
acgggcatgagagacctgggccatcaagccncgctctctgtccctttcatcacaggcttaccctatgtctatcatcacccctggcactgccaggagcgcacagga

SEQ ID NO: 646777 - DNA, 243 bp, Homo sapiens
tcaagcttctaacgatgtacggggacatggtgacacaccagtagtcccagctactcaggaggctgagacaggagaattgcttgagcccaggagtttgaagctgcagtgagctatgttcacaccactggccctccgggcctgggcaacagagcaagacctttgaaaacaaaatacagaaaaaagaaagaaatgaaaagaaaagaaaagagaaagaagaaagaaaagagaagagaagagaaaaaa

SEQ ID NO: 646778 - DNA, 674 bp, Homo sapiens
tccttatcgggttctatagcagcaaaaataagggacggggcttctcgtactcttttcatagcttcctctatttctttactaaaggtatccgattccaaactgggtggaaacagagaccagcagctacatgatacaactggggatcaacagtactcataagcttcagcaactgatctggcagcaagagactggaagagtacaagtttggccccagagaacgcccaatgtgcacgcaaggggcaggatcaaggagtaggagcccccaaagcagccaggggaacagcgccaatctggggtaaagtggggtcaaggagtcaggcaggagtccaccaccaggcaaaaaacctggccactggctattaagctgggtggccaacgagagaacaaagctttaagcttacatcaggaataaaccccttcggcatagggtacgacatatacaaagcctcgtgctcaacgaatacggggttggtcagatgcgggtgccacaacggctgagctcgggatacagggaacttaacaaagcagacacgagatgagacgggcaagggcgaatcatccggggggaagaggcgcagttcgtcgatctttgcctaggaaaccgaaaagagtccgatctgctcagagcaagcgccgggggagacattaagccccggataccccggggcgcgcta

SEQ ID NO: 646779 - DNA, 376 bp, Homo sapiens
  misc_feature (77)..(77): n is a, c, g, or t
  misc_feature (335)..(335): n is a, c, g, or t
aaattaggcatagaaggaacatatttccacataacaaaggccatatatgacaaacccacagctaacattatactgantggggagaagctgaatgccttttttccaagaactggaacaaaacaaatatgctctctttcaccactcttattcaacacagtgctagaagttctgtctaaagcaatcaggcaagagaaagaaataaaggttttccgaattagaaaagaggaagtctaattgccccctctttgaagattacgtgatcttatatctagaaaaatgtagagactccaccaaaaactctcagaacttgattcaacacagttaaagttgcaagnttacaaaatcagttcaacatggcaaaagttcagaagcattt

SEQ ID NO: 646780 - DNA, 867 bp, Homo sapiens
cttggagtctgggaggaggaaagcggagccggcagggagcgaaccaggactggggtgacggcagggcaggtggcgcctggccggggagaagcgcgggggctggagcaccaccgaactggagggtccggagtagcgagcgccccgaaggaggccatcggggagcctgggaggggggactgcgtagatggacccctggcgtcctgggctcccgtgtgccagcgctatgaggccgactcctcgtcctgctgctcctggtgcctgtgctggccggctcgcccccgactgtgactgacaacaagtatccccagcctctgcccggggcaccccgtgccttccaggcacgccgggccaccatggcagccatggggcttgccgggccgcgatggccgcgacggccgcgacggacgcgcccggggctccgggagagaaaggcgagggcgggaggccgggactgccgggagctcgaggggaccccgggccgcgaaggagaggcgggacccgcggggcccatcgggcctgccggggagtgctcggtgcctccgggatccgacttcagcgccaaagcgctcctgagagccgggtgcctccgccgtctgacgcggcctttgcccttcggaccgggttgcctggtgaacgagcaggggaccattacggacgccggtcaccggccaagttcacctgccaggtgcctggggtctactacgttcgccgtccatgccacggtctaccggggccaggctgcagttggatctggtgaagaatggcgaatccattggctcttgcgttccaggtattcggggcgggtggcccaaggcaagcctacgtcatcgggggcggcattgtggaggttggagcctgagggaccag

SEQ ID NO: 646781 - DNA, 294 bp, Homo sapiens
tcgagctcggtaccactctagtctagcaagtgtggtggctcacacctgttagtccagctacttgggaggctgaggcaggaggatcatttgagtccaggaggtcgaggcttcagcgagccatgatttgcaccactgcactgcagcctgggcaatgtagtaagaccccagctcaaaaaaaaaaaaaggtttcacagaaaccgggtgggttcttgggggttttcccaaggttaagggggaaatattggggagaattcttttatggcattaagaggggcggggggaatcttctaagaa

SEQ ID NO: 646782 - DNA, 726 bp, Homo sapiens
  misc_feature (48)..(48): n is a, c, g, or t
  misc_feature (50)..(50): n is a, c, g, or t
  misc_feature (75)..(75): n is a, c, g, or t
  misc_feature (140)..(140): n is a, c, g, or t
  misc_feature (157)..(157): n is a, c, g, or t
  misc_feature (169)..(169): n is a, c, g, or t
  misc_feature (192)..(192): n is a, c, g, or t
  misc_feature (207)..(207): n is a, c, g, or t
  misc_feature (213)..(213): n is a, c, g, or t
  misc_feature (226)..(226): n is a, c, g, or t
  misc_feature (228)..(228): n is a, c, g, or t
  misc_feature (236)..(236): n is a, c, g, or t
  misc_feature (245)..(245): n is a, c, g, or t
  misc_feature (264)..(264): n is a, c, g, or t
  misc_feature (270)..(270): n is a, c, g, or t
  misc_feature (291)..(291): n is a, c, g, or t
  misc_feature (312)..(312): n is a, c, g, or t
  misc_feature (520)..(520): n is a, c, g, or t
  misc_feature (626)..(626): n is a, c, g, or t
  misc_feature (685)..(685): n is a, c, g, or t
taggtgatgtgtgaagctgggcagtctgtggtgtggagagcagccatntntctggctattaagaggattctaaanaaatggctggatgcgctgctgaccaaaatcagcacttaaataaatgcaaatgcaaaatttttccntttgggccttgaaaatncttgcttttatnatttggggtgaaggagaaatttntgtacttggcttccnaaagcnccaacgcagtttntntatgattnttgggattnaaagagtcctcctattttnaaagtnttttgattgttctaaaagtanaggcccatcgtttgttctttnaatgaagcaatgttctaaaaaaaagggaggtaatggaacaatctgtggaaaaaaaaggggagaaatgggtgataaagaataaagttcttaaaaaaattaaatggaaggatgggttcctctcctgctgggtggtgctttctcttgcacaccactcccaccacggggggagagccagcaacccaaccagacagctcaggttgtgcatctnatggaaaccactgggctcaaacacgtgctttattctcctgtttatttttgctgttacttttaagcatggaaattcttgtttgggggatcttggggctacagtagtnggtaaacaaatgcccaccggccaagaggccattaacaaatcgtccttgtcctgaggggncccagcttgctcgggcgtggcacagtggggaatccaagggt

SEQ ID NO: 646783 - DNA, 725 bp, Homo sapiens
  misc_feature (528)..(528): n is a, c, g, or t
gtcgcagctgagggaggtaaggaggctcccagggcaaccgtgagctggaaacccggccgaggtccagccagagcccaagtagccatgagtgacccctctacctgtcagccatgggggagatggagcaactgcgtcaggtaagcggagtcagctcaagaatgcagattgcgatgatgccagggaaaggcctgtgctagacgtgtactcctggtcagtacgtcgtggatgtctggcctagaggtggtgggcacgcagtccagagtgcggacgcggcggacgtgaaggggacacctggccaagcatttacgccactgcgattgggccgactgattctacgctgctggtaagtgcctcgcgagaggatggggatagctgactccgtgtggtgcatcatgctagcactcactcaagcgaggtgcgcgccgatcccatctgcgctcctcctgggtctagtgacctgtgcctatgccccatcagtgggacttctgtggcatgtggggggctggacgacatgtgttccatctacanactctaatcccgtgagggcaagtgtcatgtcagccgggagctttcttgctcacacaggttagtctctcctgcgtgtcgttcctggatgcccctactattgtgaccgacctcgggggacaccgcgtgtgcctgcgcggacctcggagtggccgcgagactgggcctggggaccccggtgcctggttaacccggcgggc

SEQ ID NO: 646784 - DNA, 397 bp, Homo sapiens
aatctgtgcctcactgcaacctccggtaccaggttcaggcaattctcctgcctcagacctcccgagtagctggattacaggcacatgccaccacgcccagctagtttttgtgtttttagtagagacaggatttcaccatgtctgtcaggctggtctcgaactcctgaccttgtgatcagcccgcctggcctcccaaagtgctgggattataggcgtgagccactgtacctggcccattttttttaaaagtgaaaaaccaatctaaagtgtgataatagttttgaacatttagtggagtgtaagaaaagagaacccatttgactcaggttcactgataaagggttctatttccttttctaggagttgagcattgctgttggttttgtgcgaggtaata

SEQ ID NO: 646785 - DNA, 224 bp, Homo sapiens
agtgctcaatgtcagacctcactgatttgtgccattagagctgagtcacacatggacagagcggtttcaagctcctcacccagcccacaacaggaggccggttaggctgcatacaggctagggactgaccatcacataacaagggctggagcacagagctacttcttcagtttctcataaacttagaaagggaccgtttataggtcagtatagaactcatttcc

SEQ ID NO: 646786 - DNA, 1207 bp, Homo sapiens
gcaggctgtactggtcctgaattctttgtgatggcgaagaggtggccgaggaggcctgagctaacacagaatagtgcctgggtttatgctggctgtgagtgagccggagcctgccgcagcgaccgaggaagtggctgggatggtgcctgagccttgcggagggtgcggtgtggtgtgccgcggtgtggaagactgtgctggatgtgctgcatcatgctgctgatgggcctgcgtgagaccacgtgtgtgcatgcaatgcatgttctggcccaggactccctgcttgaggcccggctcctggatggtggccctcccctgactccgtgtcttgcttatcctatatagatgcattgtagtggttccaggaagatcgtagcagcatatcgacattaaaaccttgcggaattggaatgtggcccgttgggaggtgacctttgcatatcagacaggagcagtaaatggcggttccctccggacaagggcggccttccgccagtggggcttttcccgttggacccccttccacgtggacgtcgggggtgggaaaggattagggcgattatgggccggaaaaacaattcaggacgagcgggaagggttccctggacaagcggttagattatccccaagagggccggccatatactaagggggggttggtaaacgttcggtgtcacccaagtggtgaattaatcgataacaagggcccacgaaaagggggcaccccctgggaacgtaaaggtttcaggaaggccacgccccgttccgggccaaaggcaagggcctatggggatggtatggtttccccgatggcggacagacgggcgggaccccgcactggtgttggattggacccgaacagccgttggggggataccgtcccccaggaacattcgaagtgacgagcagattggagacccattcctggaggagtatcccgttgtccagggggatgtccagcagcaagacgcaaaagtaccgggtgtgaaaaaagcgcggaagcggctgggggtcgccagccccaaagcgtttttatgcccaaggtccgttataagaaagaacaggtatccagaaatagcgatggtgtgcccgcatatatccgtggtggggcaagtatccccaagggacctattccgacagaaaatggggcattacgcatcgattgaatctgggtagtggaagtgtggccgccgctatcccgtttgta

SEQ ID NO: 646787 - DNA, 124 bp, Homo sapiens
  misc_feature (95)..(95): n is a, c, g, or t
tcccctgattcttcgtccctccttatctcccagccagaagactcttactatttttcattgatgatacacttatgagtattaattttaacggaganattgactctctatattaatcactcttcat

SEQ ID NO: 646788 - DNA, 1297 bp, Homo sapiens
ggccaaggcccgggaggtcagaaaaccgggccgccgggcgtgcacctgacagctgtggtgccctgggtcagggacactgctggaggtcatgtgcctggtgaagtgctggcaggaatgctggatgcactgatcccagtgatggaacaatcctgcaccatgactcaacaatcccctgaaagctgtttgagtttgataccctgggacaaccccaaggtggctctgtgacctctgccccagcctggagaagcaactgctagtgttccctgggacacaatgtgtgggagtctgcaacttgtgccaggcactgtaatgggcttagagcctccacgaaaagggtgtaccttaaactcgtaccttcatattgcacaacaccaataccgaaggagaagaggacgtgagagtggacgctgcagccggaggacaccttgaccactgacaaaccgtcatactgctatagaacattcacgaccaacgaaatccatacgctatcactcttgcagctatccaagatgataacagcggtacttgtcccattattcttatggcatctcaagggaatacacctgccttcaacccgctccgacattccgacggcttgggctccgcctgttggcgcacacggctgcggggccatatgacttgggcgccaaggtaacgttggaacatcttcacgctcggaacgccttgagccgacgctttcaacttggttgccttgcctgacgctcaagcctttcgcattcttcgcggcccttcaggggacggcacaatgtacctttcccaaacgaaaacggttaaaaccttcttggatcacagtttggcaccagtcctttggccgctaagaaattggggaacgcttttccaagcgaacagtaacttgttcttccaagctacccttgactggcacagagacttggcaagccacggaggaagggccttccacgacaccgttgtaaccattatgacaattcctagctggactggacatgacatgcacgttattcaaagtgcgcgcccttgagtgagaggcgttagttcgcattaacgggaacctttggcaagtatggcaagtgaacagcttggcagacgcataaaatgcctttttgacgacagtgagcacgagtcgcaatcgggcaacgccaggcgatgcccagagacagcaattcacatggcgcgatgcgttcccacaactcacacagtcccagcagagctgcataggcctaaaagaaagcaggtgactgatcaccgaccacaacaactcttgaaaccatgtgtgccgcacagggcacgacgcaaacct

SEQ ID NO: 646789 - DNA, 251 bp, Homo sapiens
catccaacaccaaaaagatactcaatgtccaaaagtcagagactatcctgtcgagtcggctggttttttgcatcccatgctaccactgcagagtgacgggcaggagagtgaagggcactaggtctgctgcacaccatagcccagatccatctccctcaccccacctctgcccttcccctaactcccatacatgttacacccctctacttttagcaaaaactgtggaaatgatttgtaagagggaaggagaa

SEQ ID NO: 646790 - DNA, 873 bp, Homo sapiens
tgtgcgcctctcggcgctccccggaattaatggcaggaagatttttcaaaagagtggaggacttttaggtgtgaccaagatggaggaataaactggggaagagttttattacaaccttaaggggggtaagagagccccccctggtccaaaggtgtgtgaagtgcccacgaagttatcgtatatttaaatggaggggtttcttgaactgttacctttgggttgtagacacaccgccgtgttataatgtaaagagaattgtaagaatggagaattaccgttctttacccagcgtttaaagcttgatttgatctttgggtttataatgccccaaatgtgaccttgaaatgaggtactttaggatgcccatcaaaattgccagagttcaaagtgatgtatatgaatcaatgcgtccaaggtgataatgtttagttaccgtgataatagcgtttttgagatgagttttacatctttaaatccatttgggtaaataaccatattggcgttgcctgtttacatcccctcttgtagtttttaattaaaaacttttaagataagtgcttcaccattacacccatggtccaccatctgacagcgtttatcttgtgtgtgaatctaagtgatatgtgaggaatccaggaatgcgataatttgtctttagttgatattccaggcgttttaaagtccatatattccctgggcttggtaagtgaatttatgagatttcctgcttttgaaagtatagatggcccaaggacccttttgtattgcttcctgattacccgctttgattatacccagtggggtaatatactttttttgttatagattgttttaatggtaggtccagttattaaaagagatgaaattatttta

SEQ ID NO: 646791 - DNA, 632 bp, Homo sapiens
ggtcataatgtcactattctctatgattgctagcttcttgtatcatacgcaagattgtattttctgctggattgtgtgacctattgaattctggaaacttgcaaccactccgctactgcatctcagctacatcctattcccctgttatacttccacctgtcgttataatcggtccttcacatagttgtcccgtattgcctatgaacagtcatacactgcccgctccttatacaagcttaaacacaatcataccaccatcatggcctgctgcaaagaggttaaggttagggtgagcagctaggacccagaaacgatcatggtctctgcggaaagtctgaaccccagtccgcttagacatatcccagactcgaatactctagtcctcagaattgctagaggatcaactcttggcgagggtggaagacggcacaagatacattgttgtaatggccccggcaggtatcaacctcccatgcctttgattcattcatgcgccagatcttcacttgacgatcatctgccccagatacaataaggggcatagtggggtggaaggcagccagtttactccacgatcgtgaccctctagtacatgcttcaccactgcatctgttgtccaaatagatcacccc

SEQ ID NO: 646792 - DNA, 289 bp, Homo sapiens
acacttatcccgcaccttggtatcatgcacccgatgaggtaaccaggcagaacgcctgaaggcaggcacaatacttcctattgcatacaccctagttaggctcgcttcccctagtgcatcgcccagatttagactgacagcatcgctaggctgactaagcatgctactactcactctcacggccgaggaaactatcgagagtcctgagccaacaacttaatatgactagcttacacaatagcttttatagtaaagatacctctttacggactccacaaatgactagaaa

SEQ ID NO: 646793 - DNA, 310 bp, Homo sapiens
atatcccccggggattactgtcttacgaacgcaccggcccctttctcctttgcgtggatagggtgcacgagaatccctacgcgtgacgcatgaaccccgtcttcccaggcatgggcggtgttcgtctacgccgtgccgatccgtgctctactctgcgaagacgaactacacggaggatcggcgatgaccggcgtttttcacggaacacaggtcggtgaggtcaccgagacgtgttccatgtccagtccggtgctgttgcaaacaggatcgattgacatcgaagtcttctgccgtaagacataaccgcggt

SEQ ID NO: 646794 - DNA, 300 bp, Homo sapiens
  misc_feature (74)..(74): n is a, c, g, or t
gatgttggaggagagtgtagggacgggggaggagagaacttattggcacggacttcttatctaccccgctaacngggggatggaagatgggatatgctgaagaagtttcttatgatgcgctgatgtgggagctgcaacccctgttgtaccccatgcgctaatagatcagttaaagcccggaggaagattggatattgcctgtgggtgctggaggcgggaaaccaaatgtggggagcagtgtgacaagctacaagatgggggggtgattttttagccggtggtgggggtgatatgcgggcg

SEQ ID NO: 646795 - DNA, 85 bp, Homo sapiens
tataaaagggggtgccacttgggggagcccaggggggggtggaggggaatggtgtgggccccacgcccccccccccccccgggtc

SEQ ID NO: 646796 - DNA, 441 bp, Homo sapiens
cccccacccacctatgagctcggtaccacaatttgcgtaacgatgctaggtgcgttgcatgccgagccaacgcaaaggacggtgaaacatgatgggggtgccaatcaaacacaaagcccgcccagcgggtagccgggcaggctttgaacaacaatcaaacacgcgcgagctgtagggggtaagcgactgcccctaaactctgggcttggcactactttttctactgccccttggccggccagcggcctacaccaacggcgcaacaacatgcaacggcgcagccactcacctgccaaccccgaggccacgcggcggcgactccctcctagcagctcgacccctgccagacgcactgtcaaagcctctggccacctggccccgctcgctctttaccaaccgctcgctgcacctggcgacaacacccctgggccggcccccccc

SEQ ID NO: 646797 - DNA, 454 bp, Homo sapiens
  misc_feature (210)..(210): n is a, c, g, or t
cccattcaaaacgggtttttggtgccccccccccatgggggagaggttttgccctcacacctcccaaacggttttttttaacccttggggggattttggaggcccggaaagattcaattgttaaaattcccttttcccttgggcggtgggggccgggtccccctttccctttggggcgaaaaaaaagggggtaccttaaagggggggttnccccccccttttttttcttccctaaaaagggggggctccccccaaaacccccccccttggggccaggggcccccccccttttttttttttttcccccccccgggggggccctcccccccttttttttccgtttttggcccttttgggaccccgggttttaacaaacagggaaaggggggggggggggggggggggttttggggtaaggccctttcaaataaaatttttttttttttttccccca

SEQ ID NO: 646798 - DNA, 170 bp, Homo sapiens
cagtgccttggttgtggtggcagcatgtcgatgtggacgctggcctgctgctccttgtgctgtggccctgagccgcatctgaacgagctgcgtgaccaggctgttctccagggatgctttcatgctgcgctgggactgcagctcaatctcctggttctgacatggtgcgc

SEQ ID NO: 646799 - DNA, 250 bp, Homo sapiens
tcgtgtgatgagcatggtggaggaattgccacactgtcttccacaatggttgaactaatttacactcccaccagcagtgtaaaactgttcctatttctccacattctctcaggcatctgttgttttctgacgttctctttttttttttttaggaaaacaaattcgggttctgtccccaaatggaagtgcaggggcctaatctcagctcactgcaacctgcacctccggggtctcaggtgattctcctgcc

SEQ ID NO: 646800 - DNA, 125 bp, Homo sapiens
ccccccgcaaaaaaaaaataaaatactgctagtacatggtagtgcataactagcagtcccagccactcgtgggtgctgagcgtgggagtgatcacttgcagctcagtgagtttagaggctagcag

SEQ ID NO: 646801 - DNA, 801 bp, Homo sapiens
caggctggctacgccggagttatgggatgggccggacccactgagaggctctagagtcgtctgtgatgttccgtcacccgtgtcccatctggtagctccttgtctcgcctgtgggacctcagctccgtcttctccgtgctctgtgggccgggcctcgcatgcttagcagcggtctctagctccgtctcccgtggggacctggtgcctgattgggagggctggagtcgcacgcgctttgtccttagcgccgtgtactgtctctcctcgtaactaggaccgcagggccgtttggtttccccagctcatccttggcccttccgcgtccaccagcctggtctgcaggcgtgctctgtccttagagaacggcgcggtgtgccgggttcccttcaccctagggcacattactaagggaggtcaggcactgaaatgctcgtaacccagcaccatctgggactgggtacagtacctccagccccatgggccctgaccatgcgcaacatagcttgacatctcacgcacctcaccagagctggagccacatgagtaatccggaactcaccagctctatatcctttgagcaccaaggcaagagctgggagctggcgcaaaccagacagcgtcaggtgtggctggggatagagctgggaagtacttgccaagtataaacccaaagtaccctctagagatatcgatcaggggacttggataaattctttcagagaactcaatcatggaaagctggaaggagtaagaaaccaaagccccctgcatccatcagtagaactccataagaaaacaaaa

SEQ ID NO: 646802 - DNA, 929 bp, Homo sapiens
gggatccttcagcgtctgaatctcggctgtcgccccgcgtaccgtcgcccgggctctccgtccgctgctcccgggggtttcggggcatcgttgggtcccacaggtctggctcctgcttcacctatccccatgtagcctgatgtagtcgtccatggtcgagcaggttctcatgaggcactgtgtactgactgtgccctggattggatgagtcgggctgactgcagtaacactcgttcggaaggcttatgaccatggcttgtggcacagtatgaggagagcatcctgactcgtgtagagcatcccgaaggtaatgctcagcgaccgggagaatctctgcacgcgcttatagagaggtctgctttggcacgcggagtcttctggactgaccctgaagattcagaacctgaacactggatagaatttgagaacacactcaagttgttggctctgatgataagcctctcggcgtccatgcatggcttcatgcaactgcataatcattgcctttgatattggagctggacacacaatgacacaaagctactagaccagaacattactcgactctcagcggcacacctgtaagacactgagcagcccatccaaactcactcgtctgtatgcaacgaccgcacgtacttggacttcaagcggccctgggcaacagatagaccgtggattgcaggaggacgaacctgacaagggggttcaccctcaactcccaggacagtggccacgggattcggcggacagggtttaccgtcccgttgccgaccggcccttcaaaccttatcgaccgaccccccttggaatcgccgtcgcgacaactccgatttgggccaggctaccagaggagttcttgacacaaaacgaactggactcgaacgggagtgtcaatttggcaccaggacttgccgctggcacaccta

SEQ ID NO: 646803 - DNA, 895 bp, Homo sapiens
gggacggagtctcactctgtcccccaggctagtgtggccatcgtcggctcactgcaaactctgcctcctgggctcgagtgattcttctgccatctctgctgaaaatggaataaattggatcaggtgtgctggcgggtgcctgtagtcccagacatactcaggaggcatggggcaggagaatcgttggaacccaggagacggaggaggtgtcgtgagtgcaaagattgtgctggcgaaactatagcctgggtgacagagcaagactccatttcaggaaaaaaaagaattagtagtacccatattactgatatggatacccagagagagagatctgtagagaactagctaataggtgctcgaattacttttctatacagcagtctaaactgtgtagacaatttgtgggtatatggttgtgaatcacttggtttagaagtgtgagtaagaagaagcaagtctttttttatatagaagtctataagtaagaccatgcttttagaatttgtatggaatggtatcgtggaatctcatagttcattgccatgtgcttatagggggtgaggtcatttgctttccgggaacatttacggatgagaagtccaaagctcccaccaaatttaccatattcttcctcacaagacgatggtcagtagtttggtgtgaacagatgagtctcctctccaatgcatttatgtaatacccaagatttaacgataacagtttattgggttggtgtgtgagatggtctgcccaagtaatgcggggcgatcgtaggcacacacccggtaaagttcgacaagcgtgtatgaatagccaccaggcgggtttgttaaagagcaacgggagggggagtcaagtcccgtcagaggggagccacaatagggttaaggccaaa

SEQ ID NO: 646804 - DNA, 632 bp, Homo sapiens
atgccgtaaaggacataggctggggaaagacttcatgacaaaaatgtgaaaagaaattgcaacaaaagccacaatagacaaatggaatctaattgagactaaagatcttctgcacagcaaatgaaactgtcatcagagtgaacaagcaatctacagaacaggagacaatttttgcaatctacccatctgacaaaggtctaatatctagaatgtacaaggaatttaaacatacttacatagaaaaaaacaaacaagcttatcacagagtgggtgaaggatatgaacaaacacttctcaagacatttatgcagccaatggacatatgaaaaaaagctcaacatcactggtcatcagagaaatacgatgagataccatttcacgccagtcagaatggcgattattaaaaaatcaagaaacaatagaggctagtgaggctgtggagaagtaggaacgtgtttacattgttggtgggaatgtaaattagttcaaacattgtggaagacagtatggtgattccccaaggatctagaaccagaaataccatttgatcagcataccatcctggatatataccaagaataaaacatctatataaagacacatgccacgttgttatggggactatcaaaagc

SEQ ID NO: 646805 - DNA, 140 bp, Homo sapiens
ggtagagtatgaagtccttgagagaagattattatgcgactgtgagtgcgttcgtagttttgagtttgctcaagccgaaaaattattaaggattttagcccgtgtgcgattattaaaatatactgcgcccgttaaacctc

SEQ ID NO: 646806 - DNA, 113 bp, Homo sapiens
  misc_feature (6)..(6): n is a, c, g, or t
cgaccntagaggatcccccacaaattccattcaccaccatcaccatcgaaacggcggatcatgccaggctgcaactgcagctggcctacaactggcactttgagggagtaccg

SEQ ID NO: 646807 - DNA, 122 bp, Homo sapiens
ccttttttcccccccccccccccgggtggaaaagggggcccctccttgggggggggggggggttacctggccccgtttggggggttttgaaaaaaaaaaaagggggttttccctgggggtta

SEQ ID NO: 646808 - DNA, 366 bp, Homo sapiens
ggggacggttgctggcccaggtgagcgggcgcgctggtccacggatgatgctggggcgcgtccccgactgacgtgcgctgcctgccctgatgtgcggttcacgtaaatgacagcgagatcctgagggccagcctggtgaaggagtgctgtggatattggagcttggctgctgccaaggatcctggggccctgcgccctgttgcctagcggcggtccatgggggactctgttgggtgacgcgccactgacgccgcgtgttcgggcgaacccgtaaaagcccggatgattgcgccgccatgtcccgtgcttcttcggcgcaccaggatcctcaaccatcctggctcccctcatggccgactatagtag

SEQ ID NO: 646809 - DNA, 242 bp, Homo sapiens
cactccaccaccaccgagaccacatcccaccgtactcccagcttcacttcttcaatcaccaccaccgagaccacatcccaccgtactcccagcttcacttcttcgatcaccatcactgagaccacatcacacagtactcccagatattggatactgattcggcaggctcctcagagagcacacctgccgtgcttgaaggactgaccctgtgcgccggatcacagcgggatgattgagagaac

SEQ ID NO: 646810 - DNA, 254 bp, Homo sapiens
  misc_feature (73)..(73): n is a, c, g, or t
ctttggctttgggaattttgggaaaattttttttttttgattaaagaaaaaaagggagggaggggcccctccntccccccctttttcgccttaaaccccaaagtgatggttgggggtgggggggttttttgaaccccgccggaagggccaaaagacccccgaagatgcccgttgccccattgttggggtggtgcccccccccccccccttgcctgtttttaaactttttatgaaataaaccccgttttgtttta

SEQ ID NO: 646811 - DNA, 445 bp, Homo sapiens
aaatatgcaactgacaaaagaggatcactttcaggcattggtcctgactggggtaattccaggtatttactaccagggagcacccaattcttcttgagaacaccaacctacaacttgaagtacaattcacctggaatgactcgctccaatgttttgtttacatccagatatggccatctgtgaaacagaagggaagatcgccattggttatacataacagcaattcatttttttcctctgaagttgaacatgcaaagaacatgaccattaagtgctgttttatgtatataagacatatatatgtgtgaaaatatatgcacatatgcaccctaataacatatatttattatattaaatgatatatgaaagaagaattagcagaaaatggaatataagacttaacctttctggaaacgtaataaaccatgttaaaattgtttacaca

SEQ ID NO: 646812 - DNA, 95 bp, Homo sapiens
gccggcgcctgcctctagccgcgccgctcttgagtaccagccgccgctgcagccgccgcgccgctagccgtgcggtgccaggccgcgccctcccc

SEQ ID NO: 646813 - DNA, 924 bp, Homo sapiens
  misc_feature (865)..(865): n is a, c, g, or t
  misc_feature (903)..(903): n is a, c, g, or t
aaatatgcaactgacaaaagaggatcactttcaggcattggtcctgactggggtaattccaggtatttactaccagggagcacccaattcttcttgagaacaccaacctacaacttgaagtacaattcacctggaatgactcgctccaatgttttgtttacatccagatatggccatctgtgaaacagaagggaagatcgccattggttatacataacagcaattcatttttttcctctgaagttgaacatgcaaagaacatgaccattaagtgctgttttatgtatataagacatatatatgtgtgaaaatatatgcacatatgcaccctaataacatatatttattatattaaatgatatatgaaagaagaattagcagaaaatggaatataagacttaacctttctggaaacgtaataaaccatgttaaaattgtttacacaaatatgtgaatgtctagaatctgctaggtttataattaattccttcctactagaaatgttatttttgctgcagagtatataaaacaaattgatcttgaagatccaattacagtgttaaattattttctagataacatgccttttgacctgaaaaagggtttagtataataccttaaaaattctcatatatagtagccattttaaatgaaacaaaaagatttagaagcctggtgttgcttgatgataagattaagaagtttaaaacgggtttatcattactatagcacactgtaaagtgctagtactcgtaataggtacattttcagtaaggatctggtgagatcatattatgatctaacatgaaggacaggctgggcgcggtggctcacgcctgtaattccagcaccttgggaagccgangggagtgaatcaccgctggtcaggagtttgagactagnctggccaacatggtgaaaccc

SEQ ID NO: 646814 - DNA, 196 bp, Homo sapiens
gcgaaggacagtatggaccagatgaaggtgtggtgaagcgttaaaggattgacttgaaggcctgcatggattccatgttcatgagtttggacgatatacagcatgctgtaccagtgcaggtcctcactttaatcctctatccagaaaacacggtgggccatattatgacttgagggaggtgatcttcttgcaagat

SEQ ID NO: 646815 - DNA, 911 bp, Homo sapiens
ggtcagccgctgtcttctttggcatctacagagcgaacctacattggtcacacatcatggcgaatggtgacggtcgccactcgatggatttggtcgttattggtcgcctgtttcaccacggactgctagtctatactcgtggtaaagtgaatatagtatgccatcacactgagccctttgtcgacgctcaactacgttggtttacatgttccaactactgatttcacaacccagtggcaaagtgtccactgagcaccgctcgaaaggcatgaggaacgggaagtgttgttcagtcacactggataatccgcagtcaggcatctctccagtgagcgagatctcctccaatacatcaatgtgtgctgcgactgctggcgctgaatacgtcgtgcagtccactggagtctatcatgcacctcatggaagaaggctggggctcaatttgcatggggggatgccaacacggggtcagtcatcttgcgtgcacccactctgctgatgctcccgcattgttacgtcactggggtgtgagaccaatgagaagtatgacaacagctcaagatcatcagacaatgcctcctgagcaccaacatgcttagcaccctggcaatgtcaatccatgaccaactttggtatcgtggaaggactcatgacacagtccatgccatcactgcacccaaaaagacttgttggattggccctccgggaaactgtgggtgtgatggtctgccgggctttccagaacatcatccctgctctactggcgatgcaaggctgtgggaaatgtctccctttatctgaacgggaagctcacggattgcttccgtgtcccatgcaacgtttcatggtaactgactggcaaaaactgctacttgcgaatcgaaggggaaagcttaagccaaagaaccgac

SEQ ID NO: 646816 - DNA, 134 bp, Homo sapiens
ctcgtattattatgccatggcatctgaataagcaaacagaacctgcccaggtgcagtatttcaatttaaaaacagtatcgaatgggagaagcagttgtgttcacgcaagttactgtaatttcaaaagcccattt

SEQ ID NO: 646817 - DNA, 347 bp, Homo sapiens
gctgattgcggattactgcgccagcatagatctacgcatctggactagaaaaacccttgtgtggccagatgcagtggctcactgcctgtagtctcaacgcttggggagggtgaggcaggtggatcgcttgagcccaggagttcaataccagtctgggcaacatggcaaaacccatctctattataaatacaaaaaaattagccaggcgtggtggcacacacctgtgatctcagctactcgggaggctgaggcaggggaatcactggaactcgggaggcggaggttgcagttagctggggtcgcgccattgcactccagcatgggcagcaagagtgagattccgtctc

SEQ ID NO: 646818 - DNA, 1827 bp, Homo sapiens
  misc_feature (208)..(208): n is a, c, g, or t
  misc_feature (273)..(273): n is a, c, g, or t
gatgctatgagagtgtcggagtggcacgatatagcctgattactgcgtgggcatgcatctgtgtgagtgtcatagagcgatcacgtgtaactgaggcctgtccatgtgatgtgctggaggccggtagtgctgggtcgcaaggcgctagtgtcaaacacttttcctagggactaatcatgaggtcaaccaggtacataaccaaagctgntggaatctggtctgaagcctctgcatgtcacgtttgatccagtgacttcatccatctcaagtagnttatcctacgcacgtaatccactataatcggcggaagtcgcgtgtagtgcgcccacagcacgtggcaagctcagtctatccctgcgtcagatgtacactcggggctgcacaggctacagtgatcttagtgcgccgatctatgctcccgacaaggtagaaagcgaaccaagatgaacggcattcctttgggaaccttcgtgttcatccaaacgcgcttgctttcgtgcagctgagacgtagctcctcgcacatccttgccaagtcgttagcgctaagtagaggtaggaaggatgtccggagtagggcgtaggggtgataaccatggggtgtgcacatctacgatacgtgatccgcgttgcgcgcctattaggacaaggtgcggtagagcgttaacgcaatacgaccctatctcgcgttgtggaatggctccgtacgctgggttgacggatgcgcgttgatacgcaccatggtacccgttgtagctgcgcgttttggagcaaaaggccttaacgccgaggggggctaagtttcgatactcatggcttcaaattccctccttagtggtgatggggcccgtaataaccgaaaagtgaaataccacagttgcgcaacatataggcccactaggtttgaaagttctcaaagaatattatgcaggagtgaaacacccacgactgttggaccatcgattggactttgcgctatgaaattgatgcccataaagagggggagcacgagccagtggcgttgttccgtgatccattaggaaaatacgcaggtttgagcgcaatgaatgactttcaaagcgaaggtcgagcgagttggcagcctatagtgatatattcccattcggtcggtaagttccggtatccttacactctcaaatgccttccctttgtagggacgttttgccatttggtgggcgatcttatcaaagcgttaacttaacagataagcattaaagaacccatggtatcagccaagggtaagacaccctctcaaaaagggaattctaaatgccccttattacaatataccagaaagccacacatagcgcgcgtgggacagcgcggaaaaggctgaaatagaaaggcccccgaatatatcacatcacttgaagtacggtagagcaccaccctctataattttttcgtcggcatgttgataatcccgagagggtcctacagcccccttgtgagtacaggtcaacgaagtgagttgtgcctgtccaaaattcgcctgaaacgcacgacggcgcgattcgaccggccaactgtggtgagtcacttcgccactccgtttagagttagagtcgaaccctatttattataaaatttctgctgggggcgacgtacatggaggcacaacacccttggtcggcgaataacacacgatgaagcttcatatggtgctccttgtctaggacacgaaccgcactaatcaacagagcatgggtgcacttgacgccacaacgagcagccaatgtcagcaacaacatgtagcgcgcacccacatcatattttgacgtcttcggatgacatgcaacactgcgaa

SEQ ID NO: 646819 - DNA, 375 bp, Homo sapiens
gtgatactcaaccaatgacttcatgagaatcagggggacagccatgggctattgcaccaagttaaattacttcctgttaatctacactacatctcatattgacgaccactctcatcttaaactgctcatctcaaatgattcaccaaattatatcaatgtaactgctatgattacagaccccaataacgattctctgtctagcaacacctactgaaatcatgtaaactgacacagatacttaaacattatactgtattctgctagtgaactcattccttatgtattaaccttttactaaatcttatgagcttttagaacactcctgtacctaagtgatctgaatatgacagacactgtcattctgtctgctgccgg

SEQ ID NO: 646820 - DNA, 382 bp, Homo sapiens
  misc_feature (8)..(8): n is a, c, g, or t
  misc_feature (314)..(314): n is a, c, g, or t
  misc_feature (317)..(317): n is a, c, g, or t
cctgaacncttgcctttgcagactcagttcaaagaaagagaagttggcaatcttcagcactctaatggactaaatagcaggagttttgactatgaagatgagaatccagttggggaagatggcattcagcagatgtaccccctttacaatcaaatgtgctaccaagaccggagccctggcaaacatcatcaaaataacgaccctaagagagtctacatcgacccacgagaacattatgtgtgatttttctctttttccaatgggcgttctaacaaatgtttattcttagattggggagagaagctaaggccaanagntattttactgtctctcatataagaacagtcccactctaagggtatggaagtctaataaataacga

SEQ ID NO: 646821 - DNA, 1103 bp, Homo sapiens
acctcatgtgatcgccagctcccgccttgagcttccagtctttgttctcccgtcgcaatagatctggtacgctccgtgaagcgagagcgtcatacatacgcgtctcttatttctgcacgctcgagcctgggcgcagcctaggcgaagctgtcatcagagtagacgacctgacatcgtacacacgtatgatcggtccactagcctcgatgtcccctgttgttaatcacagtcattgcgtgtcattacgctaagtaccctatcgatacatcgcgaggcattatgggcaaagtgacctcagctatcctccatacagtacaatcgagtgtccgcctcagaattgattgcacagatattccgcgcgccgaatcagagcaacggagtaaagcttcatagacttcatatacacatcaccttcatcgtcctacttccgtgcgtcgctagtctgcgtgtacgtgggtacgtgccggggagctacgtgagacaagagtatgacactacagctcgtatcctcatcacgcaattagtcgatgctggcaacctgatcgtctcctaacactttgggcacgccgctcactgttaaaaccaatagagcccatatcgattcgatccactatacagccaataggccagagatagttactatcctttcataaactctgttgagagagggacactagatcaacatatttccaattcacactagagcaaagttctcattgcagattagttatacacacacctcgcgccttgatgcgaattagagacgctaagtcatgcgcacacagacggccccctgtacattttcgaatacttggattcccgggtacccataaacttccaatgaggacaagcgtacccgattaccattttctatacccctatgttgcaatcgttcgcggcaatgaggcccgtatagagctatgggcctggggagattctagccttaacaatagagttacggttagaccaacgggaacgcctggaacgacgcgtccaggagcaagacaacctttatacttttcggaagacctcaggacagggatagggaacggacagcaacgcgcaattccctagttaacaccaaacaaacattatttcattgg

SEQ ID NO: 646822 - DNA, 1129 bp, Homo sapiens
gcgtcgccccgcagagcacagagcctcgcctttgccgatccgccgccgtcacacccgcgcgcagctcaccatgtgatgatgatatcagcctgcgctcgtcgtcgacaacgggctccggcatgtgcaaggccggcttcgcgggcgacgatgccccccgggccgtcttcccctccatcgtggtgtgcgccccaggcaccagggcgtcgatggtagggcatgggtcagaaggattcctatgtagggcgactgaggcccagagcaagagaggcatcctcaccctgcaagtaccccatcgagcacggcatacgtcaccaactgggacgaccatgcgagcacacatctggcaccacaccttctacaatgagctgcgctgtggctcccgaggagcaccccgtgcttgctgagcgaggaccccctgaaccccaaggccaaccgcgcagcaagatgacccagcatcatgtctgacgaccttcaacaccccagccatgtacgtagctatccagggctgtagctatccctgtaacgcctctggccgtaccactggcatcgagatggactccggcagaccggggtcacccacactgcgcccatctacgaggcgcatgcactcccccatgccatcatgcgtctggacccttgctgcccggccactcactgcatacctcctgaacgaatctcacccgacacgcggccaacagcctccccccaccacgcgccgaaccggcgaacacggtgccgcgacatcaaggcaccacactgcgcaccgcaccccccgcaacacacgcacaagcgcgccacgccgcaccccagccccactggccgcagcaccacaccaccgccaccacgcccaccgcaccaccaccgccgacacaccggaccgccccccagcagcactcccacgcccccaacggcacacgacgacccggcccccaccacacccacaacgacactacaagggcgcagcccccgcacaaccagtgcaacaaccggcagcacgccacaaaacacagaccgacaccgcaacagcaccacgagaaagcaagaagcggcaccaccagccggacacgcccccgccgaccagcccagcgccccacaccccccaccgcgagcccgcgcccaccgcgcaccc

SEQ ID NO: 646823 - DNA, 129 bp, Homo sapiens
ctgacatcagaacttcctcgacttcaacgtaaactgcagcatgatgttctgaagcttgagtttgaacgccatgaacctgtggatgggagaagtgtactgagaggcagtttggtggcatgctacttgcct

SEQ ID NO: 646824 - DNA, 359 bp, Homo sapiens
tctcaaaaactaaaacaaaaacccaaaaccccaatcagatgggtgtgtgtttgtgtgtgtgtgtgtgtgtgtgtgtgtgtgtgtgtgagacagagtctcactatgttgcccacgctgctctgattgtttttgaaggaagtagggaaataaacttttcttatatatagaaatactataatctggtattctgaatagtattttaagaagtgtcttattaaacactgaagggaatgcacactagctacacttcttttctttttgtgtgtttttttccccccgagacagagtttcactcttgttgcccaggctggagtgcaatggtgcaatctcgtctcactgcagtctgtgtctcccaggtt

SEQ ID NO: 646825 - DNA, 125 bp, Homo sapiens
gaccactaaaactgatatggatactagtatacgagactcaggttcgtcctttatgttgtgtatggttatcatttgttttgaggttagttggattagtcattgtgggcggtgttgtcagtgagatg

SEQ ID NO: 646826 - DNA, 377 bp, Homo sapiens
  misc_feature (215)..(215): n is a, c, g, or t
tttattttgaacatcacactggctttcatgattgtttgcttatgatgcttgaagaagttactggtaaaatcagatttataaggtagaaagatttaacacaaatttagttgtttggtcatgacctcacaacgaccagtgttgggcattattgtaaacaaccctttttaagaacagataaagcagcaccacaagtgtcattgctatggagatcacancccctgccggatctatgacaaactgtcctgctatttagcaaattggttcttgtggtctctgtgccatacatgaattttaaaaagtgctatacctcacacaatctggaagggaagacgatttgctcaggaccggtaccccccttttcccccaaaaaaaaaaaa

SEQ ID NO: 646827 - DNA, 444 bp, Homo sapiens
tgagacggagtcttgctctctcgccctgggctggagtgcagtgtgtgctgatctcgtgctcacttgcaagctccactctcccgtggttctcgcacattctccatgcttcagcgctcctgagtagtatgggactacatggctgcccaccacccacattctggctaattaatatgtatttaatcgtacgagacctgagtttcatatgttgttagccatggaatggtctcgatcttcctgacctcgttgatccgcccgactcagactcccaaagtgctgggattacaggtgtaagccaccaaagacgtggccctcttataaattgagatggatgttctcgctttgtagcccaggctggagtgcagtggcgcaatcttggctcaacttgcagcctatggcctcccgggttcagcgattctcctgcttcggcccccaaagagagagcgt

SEQ ID NO: 646828 - DNA, 166 bp, Homo sapiens
taattccagcacctagcaaccatttccaataagtatagcgataaaatgaactgcgcataaattgtcgcagaaagatgaaatataccagatatatagcaaggctaccctatactctgcatatgattactggaatactttcagggggccaactaaacccccaccaagg

SEQ ID NO: 646829 - DNA, 218 bp, Homo sapiens
ttttcccccgaccccgggtcccaggtttgttcccccccccccctgcccccctccccccctttgtttgtttcagacccctccccgcccccttggttttttccctttccccccaaaagggggggcccaagggccaacttttttttatttgggaggaccagggtgagggtgggcccccccggtttccccccccccttcccaaataaaaatgagggttctta

SEQ ID NO: 646830 - DNA, 493 bp, Homo sapiens
gttagaggatcctgatcagtacacacgtttccaggcggcagcagcattgataacagagtccctaccccctctcggtggcaggcgcaaaacaattcccagcagcaggactgatgtacctgtgctgaaaatgaagacggagaccaagcagaggacactgagcccgatcctggtgaatccaaaggggagcccaggtctgagatgatggaggaggatatgcaagggagcttcccaagttaccgaagaaacagactatagcagagcagaaatcagaaccaagtggacgtggactcaacagaaacctgaagtgacaggtcgaagctaaaggggaagacgagagtagcagtaacggcacagccttctcagacaacatctccttcgcagccgccacaaaaaattctttaaaccacgaggattacgccgagcgcccttcaattccaaccatagaaggattgtatcgacaggacccaggacgtattaccttctcgggcagcct

SEQ ID NO: 646831 - DNA, 321 bp, Homo sapiens
tggtagacctttgatcgactcttgtgatgcacagagcagtggagtatactagactcatcaacgccgccatactcttcaatcttctcccgacaagaactggcctctgcagattactactaggcggtgtgtgcttggagttcctaccattatggagttttccacacacattatccaggtttggagatctaaggcctccaactcactttctgttgccatcttcggactgggtcctcctttccgatgatgcttatcaggtcctggtccttctcctctcccgctgggaacatgacacgttctccatggctgtcgcgcaccatgtga

SEQ ID NO: 646832 - DNA, 1069 bp, Homo sapiens
ggacactgaccttcagcgcctcggctccagagccatggcgccctccaggaagttcttcgtagggggaaacctggaagatgaacgggcggaagcagagtctgggtggagctcatcggcacctctgaactgcggccaaggtgccggccgagaccgaggtggatttggtgctccccctacggcctatatcgagattcgcccgggaagaagctagatcccaagatggctgtggctgccgcacgacctgctaccaagtgactaatggggctttcatgggggcagatcagcccttggcatgatcaacagactgcggagccacagtggactggatccgggggagcactccagaaggacgacaggcatgccctaaggcgggacgtcaacgatgcagctggctggggcgcccgaccagtggccccaggcctatgggacacaacgggacctcggcaggatacctccgccgtgccattggcgcgcagcacgcctagcactgaccaggggacagagtggccactcacccggcccaaagggcgcgccccagacgcagaacacaaagggtcactcgccacgctcaagcggggaacgcaacctggagacgcaaaaggaccgcacactgggccccaactggagcaccacggtgtagacgccactcgggccctgggcaaaagacctcggcaaaacgccccaacgcgaggccccagtagcacacgaccgcgacaaacggcctcccgacgaactggcctcgacccgacccaacgaggacctcatcagagttgcggggcaggcccaaacagcgcaaccccgggactcacccataaccgccaaagcctcctgaggacctggcggcccaaccccgacaacagaacccttgggcactccacagccagggtagagcgccaggagccaccctgcgcgaggcatggaaagccaaccactacaagcgagagatcacgagaaacaccacacacaaggcacacagtggcaccccatcgaccgcaccgaaccgccccacggaaacccaggagcaaaagccgcccaaaaaaccagagaccgggccgaaccggacaaagcg

SEQ ID NO: 646833 - DNA, 751 bp, Homo sapiens
  misc_feature (68)..(68): n is a, c, g, or t
  misc_feature (269)..(269): n is a, c, g, or t
ggtttgagtccaaaactggttaagtccagtttcattatccagagttctgaatttatgtttagaatctntagtcagtttcctattctctagtcaggtatccttaggccaataaagtggtcccacttattagcacttgttcttctccagtttgattttgtgtcactgaagtcatttatttctctgagcctcgggtataggtaggtggtcattctccagagatggcaaagctcatgttggtttgggatcatttggtatgtcttcccggaganatgctcttgaacctagtttgagagtggggcctcaagaagagactttggcaatgcccttatttaaatgttagaaatgtttggttgcatttttgatgcattgcttacatagttaatgtttttgtatttggtacttgtcattttaataatttattaaacaggtgatttaggttttctaagatagctaagagcttagaaaaataggactgcaggtcgggtgcggtggctcacgcctgtaatcccagcactttgggaggccgaggcaggcggatcacaaggtcaggaggtcgagaccatcctggctaacacggtggagccccgtctctactaaaaatacaaaaaattggctgggcgtggtggcgggcgcctgtagtcccagctgctggggaggctgaggcaggagaatggcgtgaacccgggaggcggaggttgcagtgagccgagatcgcgccactgcactccagcctgggcgacagagcgagact

SEQ ID NO: 646834 - DNA, 990 bp, Homo sapiens
  misc_feature (83)..(83): n is a, c, g, or t
  misc_feature (220)..(220): n is a, c, g, or t
  misc_feature (222)..(222): n is a, c, g, or t
  misc_feature (236)..(236): n is a, c, g, or t
  misc_feature (819)..(819): n is a, c, g, or t
  misc_feature (866)..(866): n is a, c, g, or t
tcttctggggagccttgagcactaccgaataaagagcctttcagccatcgttgatgagcaattcggacttcacatcggggggntatgtgcttgagcatgagatgagaagtgatatgtactgtgtgacgatgacagttttatctgtgccttgtgtaactggttggcggcaccgcgatcatcaggtggcagctttgagtgagcgctatgcaaattgaaggantnctgtgctctggacngtgttatatacattcctcaaaaattcttctaaactctcaaggccctcttcttggggtcagactcaacggtaccaatgagaaaagcctgaaagcatggaagacttctgttgtttagcaaagctgagagaagacattgtcttaactatctacactagttgttaaattaactaatcagttgatttactacattggatttcagaagggttgtccggtgaatattcagttttccatgctaattggaaatatcttgcatatttaagggtgtacggtgggaagggactaagcaatgatgggtatacagcaagtactcaatacatcctgtggctttattatactctctttttgctggtagaattttctgctacacacatgcattccaggcaaagggaagagactgcgcccatgctcagacccagaaacaagcctggatccataaaacagcttgttcacaatggcaggagcacagcacaggagtggggaaagtagaggaaaagaggtatgagtagtactgaccacgaaaggaaagggagttgcccattcaaactaacagatgagaagggcttcatggacgagatgacaacanatagtagcattagcattcattgagatttaggacatcgcacaacattntagaaatatgtacacttagtctaaaacagggacctgcagtccagatgggaattcttgacataatcacatcatgagaaagctgagccaatacgattcagtgtttttggaaaatgtaatcttaggg

SEQ ID NO: 646835 - DNA, 172 bp, Homo sapiens
tgcacactgttgccgactggagcgtaagtcatatttgtggccattgattaaggggcactcggaagtagaagagcagtgtgatcaaacaggggccccgcgtactctgcttaggaagaccgtcacccagctgatctgggccccctggtcccggaagtaccgtgtggccgtggtg

SEQ ID NO: 646836 - DNA, 95 bp, Homo sapiens
atatgcacaaagatgctaaaaagggcttcatcaggctggacatgtccgagttccaggagcgacacgaggtggccaagtttattgggtctccacca

SEQ ID NO: 646837 - DNA, 258 bp, Homo sapiens
  misc_feature (45)..(45): n is a, c, g, or t
  misc_feature (83)..(83): n is a, c, g, or t
  misc_feature (88)..(88): n is a, c, g, or t
  misc_feature (91)..(91): n is a, c, g, or t
  misc_feature (100)..(100): n is a, c, g, or t
  misc_feature (104)..(104): n is a, c, g, or t
  misc_feature (189)..(189): n is a, c, g, or t
  misc_feature (197)..(197): n is a, c, g, or t
  misc_feature (199)..(200): n is a, c, g, or t
  misc_feature (250)..(250): n is a, c, g, or t
ggggggggggggcggggcttcctattacacacaaatgcttaagtncatcccctggtacgcatgtgtaagagtttctctagggnatgtntcngggaatggntggntacgggagaggttatggcacacccacttataccaaattgtttcccgtttcccaaagttgttgtttctaaacattcttaaatctgntgacaaangnnctatttgggatggctgggggggagaaatagatcagctacaaaactcttgnatttttaa

SEQ ID NO: 646838 - DNA, 321 bp, Homo sapiens
  misc_feature (235)..(235): n is a, c, g, or t
  misc_feature (298)..(298): n is a, c, g, or t
agcaatgctctaataaaggctctctgaagtgacttcacccttgcagtaagtctctgcctgggcccctacactttcagcaacatcctttgaaatatgggtggaggctgtcatgcctccctagctgttgcatttagtggccctgcagaattcataccacattgatacctccaagttttatgtcgtacacctttggggagcagcaagattgaggccacaccttggggccactgggagncttcagctggggggtgggccaagggagtgctgtgctggaaatgcagggggaacagataacccngggggcaccttgaggcagcaagc

SEQ ID NO: 646839 - DNA, 825 bp, Homo sapiens
gggagcccttcctggcagtggctcatgcagctcagtaatgagtacagccctgccacatgtgcatactgtagagctatggagatgatgaggactccctcaatcaggcgctcgtacatccaagcggcgtcgaacatcgtgacgctcatgagaggctagtcgcatcggaggtctcaccctgctcattcgcctcaggtgacatggggggccgggtgttggtcggtctctggaagacaccagttccggccttactctgtccctgtcgatccgaagcgctccgtatgtcaaccacatgctgaggaggcatcatccgttccatggaacctttcctcatcgcaatagtgaaattgttagacgtatatcatcggtggtggcgttcagcatagtgttgttcccgagctggccttcattagccaaggaaggaatgctggtaaaccgaagttcctgtagctctaatgcccccacgcgtgcacaccgattccaggttagcttccagatggccgaggtggcactgtagcctaaccgcagatagttggctagcaacttatactagatcggctaacgtgggttggtcagcaacgagagtgcccattccatggagtgtccggaacctcgtggctctactccagtgttaggaggggatcctatacctatgatcacatgagcatcaggatccttagatggctcgccccctacttggcattactcaagccaaggctctaccagtccatgcatggggctacgtgactctttgatgttacccgtggttgccatgagtcctgtctggatgaagaggtcagagggccaggggttgctagtgtggtactg

SEQ ID NO: 646840 - DNA, 946 bp, Homo sapiens
accgggcatgggagcgtctgaggagtgcgcggtgccgctgctgtggctcgggacgccgagcgcgccgggcggagcccctggacgaggcccaccggagccgtcggcccgacccagcgcccgatgtcctcaaaatggaggcatgctgtgggtgctgtgctggcgtgtaagaaagctggtgctgtgggcgcggtgagtagggggccctgtgtgctgtgagtgcaggtgtgcggggagtggcggctaggcttgtctcactgcatccgtggctgtctgtgcctgtgctggggttccttctctcactgctcctctgcccagttcttcctgctgtaccgcagacagcccgatgccgccggctggaccgaggcctgccgctgcgggcgaggggcttcctgctacatcaatgccagtgccggtgcctgattcctaaggggagtaccttttatggcggcggccggggatgagggagaccctccggagacggcctcctgagtgggcgtgccgctaaccaataacccgactgaacaaccagtcgtaaacacactgagccagtcacgaagcacacgaagcacgaactagtgacaacggagcggaaaacgcaccagagatgacgtgacacccatagatatcacatgaaacggcagaagaccgaaaaacaagagaggagaaacacgaaagacacgggtgcaccccacgcaggacccagcgcggcgggaccgagcgggcagaagagcgacgacgatgcacgagacaagaagcagagaggagcgagcgaccggacgcggacaggcaggtgacacgggaagtagcggcgcgggacagaggggagacacagggccggcagcgacggcggaggacagacagcagcggcacgaccgcgggaagacagcgagggcgcgggggaaggccacagggcccgacggcggcgcaacccggaaggaggaccagg

SEQ ID NO: 646841 - DNA, 302 bp, Homo sapiens
gagcaggcaaagagagagagagctggtgaagggagctcctctttttaaaaccatcagatcctgtgagacttaatcactatcatgagaacaacatgggaaagatttgaccccatgattcaattacctcacacttcgtccctcccacaacacgtggaattcaagatgggatctcggcggggacacagacaaaccatatcaacatgaataaagaaaatgtgaaaaaaaaatgggatattattcagccttaaaaaaagaaggccccatctctactaaaaaaataccaaaaaaattagccgggcatg

SEQ ID NO: 646842 - DNA, 162 bp, Homo sapiens
ggcctcgtaaagatctcaactcacacggcaccgctctcttactttctcgctatcaaagggtatagggtctccccctccaaggccaactctccatctccatgatgacttacttaggaattcaactttcccctggggcccaggctatgactccagccagggcag

SEQ ID NO: 646843 - DNA, 179 bp, Homo sapiens
tcgcaggagaaagaggttttcagaggccctgaggacatggctgcccttgagaaggatttgaggaggttggtggaatttgttgaaggagagggcgaggaagaaggagaggatactaaagttaaaacgtcacaaggtgtgcttttaagggagctttcctgttttaaacatgaaagtgtggc

SEQ ID NO: 646844 - DNA, 109 bp, Homo sapiens
  misc_feature (47)..(47): n is a, c, g, or t
agggcacacaggtggtgcaggaaggagtggagcatgggttacagtgncagcctgcaggagaaaagtcaacagagaaacaggattagtagagaaggccactcgcgcacag

SEQ ID NO: 646845 - DNA, 300 bp, Homo sapiens
tgagtctactatgctactgatcgaatgtaacattttggaaattttgccaaaaaaagccgagagaaaaaaatgaaaaatgtctctgctcctcctgttcgtctgtcagccttatcttcttttgcgtcgccagcggagccagatcgctctgacaccatggggaaggtgaaggtcggcgtcaacggatttggtcgcatcggtcgcctggccaccagggctgcttttaactctggcaaagcggatattgctgccataaatgaccctttaattgacctgaactacatggcttacatgttccattat

SEQ ID NO: 646846 - DNA, 236 bp, Homo sapiens
tctgcagaggaagtgtgaaccaaacttttaaaataccagggaggatgaggtggagtggattgagaacaggagtggaagaaaaaatttcaacccacttttcctggtgattatttaaaaacaaaaaatctactatttaatgtttcacaataaagtgttttagaaaaagtaattagctcggccagcttctgccccaggatgtagaaagctggaagcagtgttgttcacatccttaaaat

SEQ ID NO: 646847 - DNA, 250 bp, Homo sapiens
tgacctgaaaacttgttgacaagaatgaacaccaacaacgtgctccctgggctgatgtgaccctttcttgcctccctaccccgtaatgctgaacctgagggagacaacggttagatggagtgagcagggcagaaatagcagaggggcttggagtgtcacatcggtggatggtaaacgagaatgaggagaacaaggagaggagggaatagcagaatggatcctgtggacagagtttggaaggttgctaggg

SEQ ID NO: 646848 - DNA, 130 bp, Homo sapiens
gaaagaaagaaagggaggaaagacaaagaaaaaagaaaaaagaggaagaaaggaaaggagaaagggaaggaggaaaagagagagaaagaggaaaggaagaaagagaaagagaaagaccgaaagaagggga

SEQ ID NO: 646849 - DNA, 123 bp, Homo sapiens
ccccccccccccccactaattttttttgagacagagtttcattttgtcacccagactggagttcagtgagcccagatcacgccattgcagtccagcctgggcagcagagcaagactccgtctc

SEQ ID NO: 646850 - DNA, 272 bp, Homo sapiens
cggcagatgatccagctcggtccattcaattgcgtgtgagcatcagacccagtcatcacatccattttttaataatagagtatgggtgtctataagctcacaaattatcctacatctttctcattgtggcctgttttaatagtattatgagatgggaatattgatgttcctgtgttggccctgaaccagatgtattctactttgatgccacctgcattgtatctggggttttgcattatatgtcgtcacaagatggccccccgcgattgaat

SEQ ID NO: 646851 - DNA, 257 bp, Homo sapiens
gaggaagatctaccaagcaaatgagacaaagcagagtgcatctagtcttataacagcttaaccacagtcaaagagcataggcatacatatgtaagtatcattcacaagagagctactatctaatatatatgcaccatacagagacagattcataaagagtctgagtcactcaagctagactccacagattattaatggggactttaccacccactgtcacattggcaggtcacggggcaagaggtcaggatacccag

SEQ ID NO: 646852 - DNA, 108 bp, Homo sapiens
atgtagtattgcattacagtgttttgggaacagctcgatacttgtccattctctgcatatactggttagatgaggtgagcctggtgctcttctttgcgctgatgctaa

SEQ ID NO: 646853 - DNA, 561 bp, Homo sapiens
gcctagagatcccgactagtccaaccatacagggaagcattagggtttgatacttatgtcatacattggtgttgtagctttgagcaagccatcattaacatttctagcgctctgcctcctctgtcagaggaaggctggtcagaggactaaagccccttatcatctagggctactgtcatccccttgtgctcgaatatggtagatagaaggctaaaggtccccctgagtaaaaagaggggtgaggtgttagggtacaatttctgcttgaaatcgatctgagtatactggaactcattagagagtttcattttttattccatcactgagtagaacttggcttgaacatttgaggatagagacataaaaagatcttaaggagtttctccaagaagtcacatctgttagttaaagcctgtgtaacgatcttgatggtgaactggtactccgaaagcagtggtgtatcgtagagacatcacagtgtcactggttccctatttcacttagattctccaaagcttcaaatagcagatctaaaagcatcaggcatttgtcggatgactg

SEQ ID NO: 646854 - DNA, 103 bp, Homo sapiens
tggcttgaagtgtcgcatctgcaacagtggctttcatgtggaaggcataggactcaagtgaattctgggatgacacctggtcccctctggcttctcatcttca

SEQ ID NO: 646855 - DNA, 167 bp, Homo sapiens
tgtgtatagtgtcacctatgctagactcacccggagatcagcacatcccccaagtactgcggctcctgctgtgctccacgccagcccagcgctatggcggatcggatcaacatcacgaggaagggcgcgtggccctccacccttactgtccgtgcagaacgtacatc

SEQ ID NO: 646856 - DNA, 188 bp, Homo sapiens
  misc_feature (7)..(7): n is a, c, g, or t
tcagtantgcagttctgcagagggcaccctggaccctgagacgggctcctattatactttctctctctctacagtgactgggcttcctccgtgcagttttctgcaactctggagaagtggaggcatacttgtgtgtctgggttgtttttttttttttttttttttgggcattcttaaattttgggtgg

SEQ ID NO: 646857 - DNA, 592 bp, Homo sapiens
agcgggctctcgcctctcctgcaccctcagccggcgcgcttctcttatgggcgtctgctgcattctgggctgcggtcgaactgaaagcggcggcgggagaccacacttagcaccccgctgtggactagagaactcagagaaggcagagggagagggagagagagagagagaagggacccggaggaggagcgcttccatcacgtcattgcaagatgttctggaagctttccctgttccttgtcatgggttggcggtgctggtgaaggtggctggtaagcccggaaagaaccggtcggcgggcgccatccactcgccttacagaggacggcagacctgcaatcgaactcggagagatggctgccaccacgatcgaggaggtactggcctccaagccaggaggccctggcggtcacacgagcgcgcagtaccgtcaagagtgacttggtgcaaagaccgcagcccgcctgccggcacgacgggagacgcgaggagggctgccggaagccgaaacaaacgtcaaccgatatctgcatacggccagagcaactccttctacatgcccgaggggcctgctgaaagaaggaggagagaa

SEQ ID NO: 646858 - DNA, 618 bp, Homo sapiens
  misc_feature (192)..(192): n is a, c, g, or t
  misc_feature (308)..(308): n is a, c, g, or t
  misc_feature (320)..(320): n is a, c, g, or t
tcgcgtttgcgagggagggggtagaagcaccggagggatcggtttgggagcgggtccctaggcggttccgcgcggtttttagtagccaagactgtatccctttctgcggcaatcatttcctcctagacttctgtcctttggggactttcagagtctcccccgcaagagctgaagaggccatttctggggaanaggggtgactgcggcttgttgattgggtttactgtgctaacttgcactgggctcctgccatgccttgggggagcttgccggagccggctctcctggggctgacctggtagtccccnccgcccgccagngtcaggtccttcacctggcatgcagagcgatctctcattgtcaagttgggataggtggccccgaacccatgaaatactgattggctgcttcctaggcccccagaaaagggatctataagggagtcgcctggaaatctgtattattaactaaagtgtcagatgattcataaaacccagcaagtttgagaaacttggactataactacaagtccaaaccctttagtctgtgctcaaatgaattatcctgacatgaatttctggccaccaagcattgagttaacaaatttaaaaaaaaaaa

SEQ ID NO: 646859 - DNA, 456 bp, Homo sapiens
taagagaagtgggctaagagggccataaaaacactttaaatgagattccaatggagtttccctggtatccatgaaaataaagcccaccatggcaaataaagtaatgcgaactgatggtcagaataagctgtgtaagccatgggaagtgaggttagaggtccgtgtgtcttcacttgcatgtgagtgatcgcgtgcaggaccttttgctctccgggtcctggactccacagtgcttgttcgggtcaaacaccctccctgtaaacaccagacggagagaaaaaaaaaaaacccaggtcatcacggctaatttcagaatttgtgcttccggagtaccacgaaaacttcttttgccaatacattgtgaatgacaggagaaaagtgtcttaccacgtggtgtaaaaggacctacagaagactgtggttcgactagaaactcccaaattctcctgagaagtt

SEQ ID NO: 646860 - DNA, 123 bp, Homo sapiens
aggtttctcgtgccccgtcctactcgatttcatgactaagagattttcgcgtacagggctatcacccactatggccgcactttccagagcgttccgctaatctcaaagccacttaagggctag

SEQ ID NO: 646861 - DNA, 157 bp, Homo sapiens
  misc_feature (33)..(33): n is a, c, g, or t
gtcgttctgaggatcccccccttcccccacagntgaggtgattctgaagccagcctggcgccaactcccacagagccaccccctccctacagcttcaggctgaagaatataccggggatcagaggggcattgacaaccctggccttctgatgtcacc

SEQ ID NO: 646862 - DNA, 1093 bp, Homo sapiens
tggtggttttctaattctatcaactcttttgcaactattagtgtgacttaatctataaagaagaatttttctggtacgctttagcctctactgggcactagaacaacaaaacattactatctacaggtactggtaacccctgcaacactacagattcatactggcaaaggcagcaattcttatcctactaaaattcctgaataatatacataatcgctattataccttaagaccaagaaagctgtaagcacacattatgcttaatgctaaccaccattaaggcaccttcgaaccgttgacgcagacatctataacaacaagacgtcaaataacttaacacattctccacgtcaactaggaacaatggcatacaatgagaccgataaatagaatggtctgcacacgcataaataacgaagacatgacttactggtacacatctatacccggaatactgcgaggatgtagactccagagcacaaactacagaaaaataaaatatagagaatacactctaggcatccttaggccctcagctgggctagagcaacgtcacaagaagcaaaacacaaatcacaaaggaacaacgaggacgccagcagagttacactgaccatcactctgcctcatatacaacagaaagcccatgaggacaagagcacaagacactcgacccaacgaaccacaaaaactgcgaaaccctaaacgatccctcacgagcagcacccttatcgactaccctacttcctccaaagcaacatattacggtcactatggtattacactacgtttggatgggcaatagaactttggtcacactgctgaaataaagtactattagtaagacactgaaacacaacaggctttggatatcaacaaaattagtgcccgaacaacgtactacaacttggcagataaaataggtaacacacggtgaatacatgatattagaggagacacggcatcagtcatcctcgaaactcgagtgtacaccatatggcatacgcgcaaaacaccggctcatacaaacaccagcacaaaaaacaaatagtacgcatactcgagaatattatacagtggcgagcccgaatga

SEQ ID NO: 646863 - DNA, 206 bp, Homo sapiens
  misc_feature (172)..(172): n is a, c, g, or t
  misc_feature (197)..(197): n is a, c, g, or t
tgaaaatttattaattatttactgctgttagatgaaatgaatgagcctacagataataggatgtttcactgtggtgtatgcatctgggttagtccgaactaacgtcggtgcattccgtataggccgagaaagtgttgtgggacgaacagttagatttacgccgataaatatngtgttccgagctcgatttccgtaantcttggtca

SEQ ID NO: 646864 - DNA, 1230 bp, Homo sapiens
taattcctttttttttaatgctgaattttactcccgggccataagtttttgtggtttctttcagtttctttcgtgggattatctttttctcttctgtgggcaacctctccttctttcgtggttttaggaacaactcgtggttcctttttccgataaggatcatcttcaatgtgtgtggcagggaaagagcctcagtgtttgtgggtttaatctccgacccagtgaagcttcgtgatagcgctccgggggggcgcattcttatagggtgctgtgtggtctcacttgtgcgatatattgcctcaatgtgaccaagagaatatcttacatatcttacaaccctcttaaagttttccagccatatttaacttcttcgtggcgggtattttattaaagcattgtgtgccaaagccaaaaaatattcaaggaccacttctttttgggggggcccacgcgacaccctggtgtgtcccaaggccccacatgtgtccttgtggccccgtgtgcgccaacaacccgtgcccaaaacttcccacccattgtgtttacacgtctgcgggaaagtggtgttacacagcgtgtgtatctcgtgagtaaaaagggtgaacaatttcttttcaaaaattcacttttcggggggctatatatcgcggtaattagtgcctataccccttttggaggtgccgtggagacaagtttcacaccgaaaggttggttcttatacaaagggttgaacacacagaaagaattgtggcaacccctcttttggactttgcgcagtagactttccggggggggggaaccccccgggggcccaacgggtgcaattatggcagacaccccacttttttccacaagacttcacccttcaggggccagatctaagacccgaacatcactaaccttttagggagatctccacagcagagggcccacaaattgttctacaaaccccccatgttgcgagcgtggctaacaacggtctggaagacaacagggaatatgtgccacaaattggggagccaggtgttcaccaaggggagtagttaaaaaacaccggtggaaaacggagcatacgtgcgggcccacacataggacccctctatatagcaacccaaatcaagggtgtacatgctcccaaagttgatcacccccgtgcaaatccaatgagaacagaagagagaaaaggacagatgcgatcaggggaaacgcccaacctctgatcgaagaaac

SEQ ID NO: 646865 - DNA, 731 bp, Homo sapiens
gcaaaggcccaacagccgtgacttcatgaacatccttatcatcttctactgatgcatgcaagctatacgtgtccatgagccgctcccatcctcagtcctccattgagtgtactcccagccatgtaatgtaggcaggtggcgcgcgtgatcactataagctgtgtttctccctcgtcgcgcagggattatgcataggtaagtacaatctgttgcttgcctgtctaagaaaagacaggagaacaaagaagacaaatcaatccaaactgacctataatcatccagcgtgagtccacacctggatattatctcgctgaagggagcacaggtattactggcaaaccttagtatctaagcctacaggggagacccacagatttagcagtttattgatccgacggcagtctgcccgcatcatgtgccggagatctgcgtagggaagggctacacagcgacggcaggaggctgttctggtcgattgtccctgtgaaaccagggtgaagtggggatcttgaagggtcctaggaccaaatgtctgtgatcattcccggaagtgacggtcaaatcatcgagcaggatccccattgttcagccacgcaaataacgaacggcagcttgttcatcaagatgggcagaacaagaactatggtccgggatgcggtggcccacaggctgttattgccaagcatttggggaaagcagatgccgggtggactggcttgaggcccagggag

SEQ ID NO: 646866 - DNA, 331 bp, Homo sapiens
tgggcgacagagtgagacaccgtctcaaagaaaaaaacaaaaaccaaaaattatccaggtgtggcggtgggcgcctgtgaggcaggcgaacctctgcctcctgagttcacgtaatcctcctgagtagctgggattgcaggcgcctgccaccatgcctggctaattttgtgtttttagtggagacggggtttcaccatgttgtccaggatggtcttgatctcctgaccttgtgatccacccacctcagcctcccaaggtgctgggattacaggtgtgagccaccgcgtccagcctgggcaacaagagtgaaattccatctcaaaaagaaacc

SEQ ID NO: 646867 - DNA, 167 bp, Homo sapiens
ctttcaaaaaaaaaccaggagttcctgtcttggcacagtagaaacaattccgactaggaaccatgaggttgcaggtttgatccctggccttgctcagtgggttaaggatccggcattgccatgagctgtggtataggttgcagacgcagctcccgcatgttcgctgg

SEQ ID NO: 646868 - DNA, 265 bp, Homo sapiens
ctagctagaaatatgattttatttgacaaaatttgttgcgaatattgtatgtttacatatcacctcatgggctatttatatttacaatatggctataaatatataaacacgaacagatcaagatgatctactcagaaatttttatttttctaaggttctcctagggaaagtacatttaatacagcagtgtcatccagaagataacttgagcaccgtcatggcttaatgtttattcctgataataattggtcaaattcattttttc

SEQ ID NO: 646869 - DNA, 184 bp, Homo sapiens
tgactctagagtgatcccgtgaggaccagtgctgaggacaatgcgaggcctgtcttaaaaacaaacaaaaaaaacaaacctcttgatttcacccaccacagctcccctccacattgagagaaccatattttgcgttgcggcattgaggctgccccacccctggaggaagagtacccgaaagtct

SEQ ID NO: 646870 - DNA, 520 bp, Homo sapiens
atggagctctcatcgcctagtcaaggcgagtcacccattgactacctcaatcaaaggccatcttctaccccgctcaccctgcggaccccgagcaggtggcaaaggccttgccgttgtcctccaacaaagtctagagtgtgatgatggttgtcgttcgacaatgagaaggtcccagtacagcagctgcgcttctggaagcactggcattcccggcaacccactgccaagcagcgggtcattgacgtggctgagtgaaaacaatagttcaacactgtggagcacattgaggaggtggcctataatgcactgtcctttgtgtggaacgtgaatgaagaggccaaggtgttcatcggcgtaaactgtctgagcacagacttttcctcacaaaagggggtgaagggtgtccccctaaacctgcagattgacacctatgactgtggcttgggcactgagcgcctggtacaccgtgctgtctgccagatcaagatcttctgtgacaagggagctgagaggaagatgc

SEQ ID NO: 646871 - DNA, 99 bp, Homo sapiens
  misc_feature (24)..(25): n is a, c, g, or t
aagacaatagtccacgaaagtgannagactagaggccttaaaacatgctttgcactgtacgatcttagcatcagcagggcagcagcgttctcggatgct

SEQ ID NO: 646872 - DNA, 836 bp, Homo sapiens
agcgggagagggtgggggcgaaggggaagctacgtcccggaggtgcggtgtggggcaccgggcggggccgcgggaaccggcgccccacggagctgctgctgtcagaccaaccccagggccccacatcatcacatgcgccgcgctttcaggcgccgagaactaccaggtccacggcatgccactgaaagttggcctcggcgctgaggcggggtccggccctccacgccgcgtcccgtcgcgcgacgcagaatcgcgagtctgacgagctcatggtaggatggaggcgatcagtccaccgggcgctgggcgtgcagacaaggcgcggcatcgcttggatgaatgcttggacccgtgaggtcagtcacagcggcagtcacgtagtagatcgttcgcaccgagggtagtgagctgagagtgagcctatctattagaaacagtggctcctggactgaacgttcatgatgattattcttcctggtgatactaatacagaatatacattgtgtggatgcgcgtgaaagatcgtgagaagaatctttgtatcctgtagtgactcaagtaggacttacctagcgatgatcatggcagatgtgaaagtctagtggtgaagcacagtcatttctcactgtgagaagtcgatggcgaagtgtaaccagcgatcatcaaataagctggcactcaagtcatcattccgagatctgtgccaatgttattgcaacttcactaattgcatgccagatccgtggcaggaccgtgggaggtacgatacaacattgaatgcgcagatgatggatcagcgcagagaacgcctcacgtttgactcgtcgcagtgtgaa

SEQ ID NO: 646873 - DNA, 257 bp, Homo sapiens
tcgatctagaggatcccgagaacaaaacacaaaatgccttggtctaactgagccagctctcaggggaattggtcttaatggtctcaagcggtgtggcctgtgtgaacaatgaggatcttggcttggttaggctatctgggggagaaaattgggatcttcagggagactgcaacttttttttttttggaaacagagtctcgctcggtcacccaggcgggagtgcaggggcgcaatctcggctcacaacaatcccgggg

SEQ ID NO: 646874 - DNA, 178 bp, Homo sapiens
gcatttagatcctgtgttttaaccatcacagtaaatggctaaaacataagtattcgactgtattttagaacttaagtatttatttgggaaattggttctcgattccagttgttgatgttaagaacatgtgtagtatgggcactcttcttcacaggtctgcctagtgtacaccacatat

SEQ ID NO: 646875 - DNA, 570 bp, Homo sapiens
agagcaaaggaggggagaagccccttataaaacatcagatctcgtgagaactcactcactatcacgagaacaggatgagggaaactgcccccgtgattcaattatctccacctggcccctcccatgacacatggggactatgggaaccaaaattcaagcaggcaaatttgggtggggcaccaccagccagcaaccatcatcagttcagaatcaggcaacattccatgcagctgtatttcagacatcaaaagcagcactccagcacagtcagcagtgcccatgcgtgcgtgtgtgtgtgtgtgtgtgtgtcagagacaggctgcccgggcctcaagagcatcatctacatcattcctgaggtattagggagctaactagacctgcgattaaacatacaaacaacactaaatatacatgagtacttacatcttcatgaggtcttaattcgaccatccactggtgaccacccattcaggcaccaggtatactctgcccagtaaaacaccaataacacccagcaaaagataccacgtctagagtagcgaacagaatagaaacggaaacaagaca

SEQ ID NO: 646876 - DNA, 305 bp, Homo sapiens
ttctactataaacgatacatgcacatgtatgttgtatcgcagcactgtggagggggagcaaagacttggaaccaagctaagatgtccatcaatgatagactgaataaagaaaatgtggcacatatacaccagggaatactatgcagccataaaaaagattgagttcatatcctttgcagggacatggatgaagctggaaagcatcattctcagcaaactaacacaggaacagaaaatcaaacactgcatgttcccactaataagtgggagttgaagaatgagaacacatgggcacaattatggag

SEQ ID NO: 646877 - DNA, 475 bp, Homo sapiens
  misc_feature (53)..(53): n is a, c, g, or t
  misc_feature (79)..(79): n is a, c, g, or t
  misc_feature (357)..(357): n is a, c, g, or t
gggggatacacccgggacacttgccatgcgcaagtcgaattacctcataaggnaaaagtggactccacgcgtgcgccgnttagactagtgatccccgggtgcaggaattgcgccgcgtcgatcggctgcgagaagacgacagaggccaccatcactgcctatcatttgtaaaccagcccatgaccctaacaggggcctctcagcctcctaatgactccggcctagccatgtgatttcattccatcctacgctcctcatactaggcctataaccaacacactaacctataccatgatggcgcgatgtaacacgagaaagcacataccaggccaccacacaccactgtccaaaaggccntcgatacgggataatcctatttattacctcagaagtttcttcgcaggatttttctgagcttttaccactccagcctagccctaccccccaattaggagggcatggcccccaacaggcg

SEQ ID NO: 646878 - DNA, 408 bp, Homo sapiens
gactgatctttcatgtttttcttttttgattctgttctatgttgtcctgatggaggggtaagcccctgccttctgcctttcctgccttggactcttgcaattgggccagatgagagggtccatgtggtctgagaattcaagcaatgcaggccaggtgtggtggctcacacctgtaatcccagcacttttggaggccaaggtaggcaggccaggatttcgagaccaggtggccaaaatagtgaaaccctgtctctacaaaaaatacaaaagttagccaggcttggtggtgcgtgcctgcaatcctagttatttgggaggctgagcaagagaatcacttgaacccagaaggagcaggttgcagtgaggaggaggttgcactgaggaggaggttgcagtgaggaggaggtt

SEQ ID NO: 646879 - DNA, 554 bp, Homo sapiens
  misc_feature (28)..(28): n is a, c, g, or t
  misc_feature (32)..(32): n is a, c, g, or t
  misc_feature (37)..(37): n is a, c, g, or t
  misc_feature (43)..(43): n is a, c, g, or t
  misc_feature (59)..(59): n is a, c, g, or t
  misc_feature (69)..(69): n is a, c, g, or t
  misc_feature (75)..(75): n is a, c, g, or t
  misc_feature (77)..(77): n is a, c, g, or t
  misc_feature (80)..(80): n is a, c, g, or t
  misc_feature (465)..(465): n is a, c, g, or t
  misc_feature (472)..(472): n is a, c, g, or t
  misc_feature (520)..(521): n is a, c, g, or t
  misc_feature (527)..(527): n is a, c, g, or t
  misc_feature (529)..(529): n is a, c, g, or t
agagccccccctaaaaagatatttattntttnaaccnagcccngtttgggctgcctggnggtgcaccantcaggntnttntcctttcacaaccttttgtggctcccagacccttggagccaatggagactgtctcaaaagggccctggtggccccacaccttggcccagggcagtgggacagggcatggccaggtggccactccaaacccctggcttttcactggtgggtgccttagaaccttttttacattaacagtttgctttggaagccccttgtttttttctttgggtcttgttttttttttccccttaaaaattgcatttcctgacaaaaggactcaggttgtttgaagtccctgcccagtgcatttcagcccccatagtgatggttcccctgttccctttacttagcatgtccccaccgagttttttttcccctggatggaggaaaaccaaaccgtggntttccgntcagccctccctgcccctcccttcaacccttccccatgggaaatgtcnncaagtntnaataaaaaccccttttgggtggcca

SEQ ID NO: 646880 - DNA, 110 bp, Homo sapiens
ggatttgctggtgcagtacaactaggcttaatagggacatgccactgcactccagcttgggtacacagcaagactcttgtctcaaaaaaagaaaataaattaacgttaga

SEQ ID NO: 646881 - DNA, 890 bp, Homo sapiens
  misc_feature (668)..(668): n is a, c, g, or t
tgggaaacctttaaaatccctcaaaaacggtttattatacaagtgagtttggagtcacgatgggcttatcggtaggattctctggtagcgagcgcgggcaccagggcctccaaacttttgggactcgcagcgacgagggtcagcttaccagcagggtctccggtctcaatacgtggagtgaggatgctctatggatcctcctttctggggaagccctcactccacaatatttctcgtggataaaataggccaccagggctttgggagagtggacgtgacggaatagcaataacatctcgtggcgccagcgtgtgaccaaccaccctttataccagcggaaccacggggatttgtcttaaccaccaaggccaaaattcggctctccttgtgcccggagagaaccgcccagagaaacttgggtgctcctcccatcgacagccttttggggtcaccttgatacgcgagatagcccggcagggcctacaaaatcgaactctctcaccaggggggtggccactggccacttggttccacccctctttgaatttggagagaaccccaatttggcgcccgggatgttatagggccagtggtgtgcgcgccccaaagtgcttgtgctccccgccatggagtcatacccatagagcgagctcccaggaaagagaacncttgggagaaccgagagtcgtgggccgaaggcgggaagaacccccctttgtggacgcaactgcgcggggcaatatggggcggcccctccccgaggaaacggccgcggctggagacggaacccaataagaggaaaccacaaaagccgcccttacaaaacccacgacggaggggcgcaaggggacgcgcgacaaaaagaaacaaccaaaccccaaaaataatgg

SEQ ID NO: 646882 - DNA, 346 bp, Homo sapiens
  misc_feature (341)..(341): n is a, c, g, or t
gacatgcgaagccaatattaggtcatggccgagcagaaccggaaggatgcttaagcctggttccccagccggacttaaaaatttaaccgggaggtcgctggccccccggagcagctccaaattagcaggtccgaggttttttaccttcggcgcacccttcagggtttttagatttagctgcagtccctacaacaatttgtttgcctccaaggtccttttaggcagcaggctttggggcttttgctgtcctttggagggtgttttttgggtaaagggatgggaaggaagggacccttacccccggcttttttcctgacctgccaataaaaatttatggtccnaggga

SEQ ID NO: 646883 - DNA, 168 bp, Homo sapiens
catcgagctcggtcccccgccgtacagttgcgtgggcgaagggcggggcacgagggagagaaacaatgtcttgcggctgctgttgctctggctgctgctccacggggcttgtttggatccccctgcagtgaaacaggtcctgtacggctccgcaactggtacggcggg

SEQ ID NO: 646884 - DNA, 289 bp, Homo sapiens
cacacatgtccatcaatagctctgttgacgttgtgttgggagaagcggctggatgtcattctctcacccccttatgttgatgtctggcgtgtgagcagccagtatctacacgagctctgctgcttggggtcatggcatgagcggctctcttgatgtcttaagaggcaggcctctctcattcttgcttttaatgaatcctccttcctcacacctgtgctcctctggcttcagcttctcagcagcaagcaccagccttccacaataacactatatttttatgctactttcc

SEQ ID NO: 646885 - DNA, 349 bp, Homo sapiens
  misc_feature (90)..(90): n is a, c, g, or t
  misc_feature (250)..(250): n is a, c, g, or t
gaagatgagagacaacaataggatgcatataaggtgtacttcttatactgtgctcttggagtacgcggatgagtacttcccttcagatgncacggaaaagctttgggcttaattgggaagtaagcttcttctttatttggaaaaatgaaatccaactgatacttcttagagaggagtggcatccctaggcagctgatttaagaaaatgtcttaagacgtctttgagtgacaaagcctaagaacccagacnatcctggatgagcaaaggtaggcaggaagctgaattgctgagcatgataaaatgaagtgaagccttgtgtttagggtgggcacaactactgtctcagag

SEQ ID NO: 646886 - DNA, 392 bp, Homo sapiens
attaacatgtgtgcacatggacatacgctgttgaagtatctctatttgctatccccttgggttagagattgctttctgctactttcttacctgccttcatcctaagttgggggtccactgcagatcctgaacaagtgtatctcacgaatattcccccatgtcctgtcatagctgtacctcctgtgtaagaatggacaagtgtgttcaaggctggcctgcctttgtaatcagtcctccgtgggctatgctgggatcccactagttacgcactcatctgttgcagcatatcagctgcggctgtactgtagaagaatgcaacgccctagtggcaaatgctgactccaggaatgcggaggaggaggaggactgcatagctcatcactgggggccat

SEQ ID NO: 646887 - DNA, 471 bp, Homo sapiens
  misc_feature (305)..(305): n is a, c, g, or t
gagtttcccaattcatagaggccacggcagtccactgtgatgggtggtttctatatactgggcacttttgaggtgctcctccaccagcttgggtgtgacacagatacacgtgctggcccttccagtactatgcccatattagagggattgcagtggtactagatgatgtcatttggcggtgatactggtcatctggctagaggtccttgcatggacagtgtgccccgggaagtcccgacaggatctccagacagcacccatggaccatgtagcttgcggtagctgaagcttgcccaaggtcagancagcggacttctccgtgggagccgacttgtgctctcacagcttggaggaagctcattaactgacaagcgatagaggaacttccctgtagccgcggcagtaggtaaggggggcaagagtcaggatgcacggccacatttgtttccattccgtggtgcctctaaattg

SEQ ID NO: 646888 - DNA, 753 bp, Homo sapiens
  misc_feature (166)..(166): n is a, c, g, or t
  misc_feature (201)..(201): n is a, c, g, or t
  misc_feature (381)..(381): n is a, c, g, or t
  misc_feature (417)..(417): n is a, c, g, or t
  misc_feature (442)..(442): n is a, c, g, or t
  misc_feature (564)..(564): n is a, c, g, or t
  misc_feature (573)..(573): n is a, c, g, or t
  misc_feature (721)..(721): n is a, c, g, or t
  misc_feature (727)..(727): n is a, c, g, or t
  misc_feature (737)..(737): n is a, c, g, or t
  misc_feature (746)..(746): n is a, c, g, or t
ggccgagaccccggaggcttgggtggctgcagggtctgcggcgcgcagtgtttcggtaactgctttgcctcccggtcccgcaggaggatgctggtggtggaggtggcgaacggcgctccctggtgtggggagccgaggcggtgcaggccctccgggagcgcctggntgtggggggccgcacggtaggcgccctgcccgggncccgccagaactcgcgctgggcctcccgtgctgtgatgcccgaagaggcgcggtcttggccgagatcggcgccgtgactctggtcagcgcccggtccagactctcggcaccacagcctggcctgaatccttcaagcgccagcaagaggagagcttccaggagcagagcggcctgtggcangtgaggccgggagacccgtcgtcagggagctcctgnagaaagatacggagggccagggtgntaagaaagcagaaactagaacaggcttcaggggccagctcaagccaggaggccggctcgagccaggtgccaagaggatgagacctgtgatggccaggcttcgggagagcaggaggaagctgncccctcgtnttcccagcaggaccctcaatgggtagccccttgcccagatctgctctcttgtcagctggcactgcaggctcgaccggtcaaggccgggccctggactggcgtgtccagtctaaaagactggcccacgccggcgcctgccacgagtggntacagnattacagaanctgggaacnaggttct

SEQ ID NO: 646889 - DNA, 417 bp, Homo sapiens
aaaaacccggcccttagggcatcaggaaaactagctcccctgccccggaggatttgctcagtgcttatggcagcccacctgtgtggactcagggggcttttagggctagggaaacaggaagggccttttttacaaggtaggagctgtgcttggaggggcaggaaaaaaacttagcattttgcaggcagcgggcccagccttagcaatggcaggatgtgaacttccccatcgcaaatgcagttttcagccccctgcagtggatacaaggaagggccttttttggggccggaaaaaaaaccaaaaaaccaggcccgggcaacagccttccggccacgtggaacactggctccggagttattttttgtcaaatttactccccggacctcaaccatggcaagaaccttagaacccaaccga

SEQ ID NO: 646890 - DNA, 830 bp, Homo sapiens
gtttatgccgctccatctctaggccacccgtccccatgccggttacaccggtatctcttctccgtgacccctaccggttttatcttatatttacacggccttctttctttaatataccccccatcccctcttggaacaattgcttttcaaaagaccctgttcttctaaaggatgaacctataaaataaacctgtgctgcaaaaccctaaaaactcctgggctctgactatacataagaacaccgggtttctttactattctcccctcccccacaattttttaggtccttactccccccgcgaaatatttaacatgccgacaggggaaagttaaaaagagttctttttcgacacattgttcccccacccagggtttttgcccacccctattctcccccaaggggtatgaataccgccgtgataaatttttacggggaaatagggagagtgaaccactggctctcacagggcacctagtgggcatacatcgtccatgttaaataatctggccctcatagacgacttcttgtagacgagatgggtcgcctggagcactacagggttgtagttcactcagtcgacatctccctttcctccgtctcaactaacctttctttttaaaccaccctcttctagtccccggcattcagcagtcccacgcctatctttgtgattcttgacggacccaagaatctgcaatgaacccgggagaaacaacttcttgctactcgagacatagtttggcaccccatgcaaaaacaatatggataaaaaaacctttacaaacaatatctaaggaaagaattttagggggcaaaaacagcccacaag

SEQ ID NO: 646891 - DNA, 696 bp, Homo sapiens
  misc_feature (324)..(324): n is a, c, g, or t
  misc_feature (360)..(360): n is a, c, g, or t
  misc_feature (385)..(385): n is a, c, g, or t
  misc_feature (507)..(507): n is a, c, g, or t
  misc_feature (516)..(516): n is a, c, g, or t
  misc_feature (664)..(664): n is a, c, g, or t
  misc_feature (670)..(670): n is a, c, g, or t
  misc_feature (680)..(680): n is a, c, g, or t
  misc_feature (689)..(689): n is a, c, g, or t
ggccgagaccccggaggcttgggtggctgcagggtctgcggcgcgcagtgtttcggtaactgctttgcctcccggtcccgcaggaggatgctggtggtggaggtggcgaacggcgctccctggtgtggggagccgaggcggtgccccgccagaactcgcgctgggcctcccgtgctgtgatgcccgaagaggcgcggtcttggccgagatcggcgccgtgactctggtcagcgcccggtccagactctcggcaccacagcctggcctgaatccttcaagcgccagcaagaggagagcttccaggagcagagcggcctgtggcangtgaggccgggagacccgtcgtcagggagctcctgnagaaagatacggagggccagggtgntaagaaagcagaaactagaacaggcttcaggggccagctcaagccaggaggccggctcgagccaggtgccaagaggatgagacctgtgatggccaggcttcgggagagcaggaggaagctgncccctcgtnttcccagcaggaccctcaatgggtagccccttgcccagatctgctctcttgtcagctggcactgcaggctcgaccggtcaaggccgggccctggactggcgtgtccagtctaaaagactggcccacgccggcgcctgccacgagtggntacagnattacagaanctgggaacnaggttct

SEQ ID NO: 646892 - DNA, 100 bp, Homo sapiens
tgccaggattccaggcatgagccattggatccagccccaggatacatttgtaaaggctggattcaggacaatttctaaaactgtgcacatgatgcagtca

SEQ ID NO: 646893 - DNA, 197 bp, Homo sapiens
  misc_feature (12)..(12): n is a, c, g, or t
  misc_feature (107)..(107): n is a, c, g, or t
  misc_feature (119)..(119): n is a, c, g, or t
ggcccagcaganggaggaacactaccgaggctccagcttaacggtatttggaggtcagcacggtgctcacagaagccaggaacttgcccagggaggcgtgcaccaanggggcgaactcncggggaggcgggcgaccagggtcaccagcaggcagtgcttaggagctgggagccgaccgagcccaccgaactcgcgcg

SEQ ID NO: 646894 - DNA, 385 bp, Homo sapiens
ggggtttccagctgggtttgtcaccatgccaacaggggaggaggtcaaaagtaccctgagcatgctgcccatgatgctgtcaggcatggctgttgtgccccagatgtttggtgttgggggactcctcagtccacccatgtgaaccacctggactttcactggttcggcgtctctattaagcacaacgaaaagtggtaccgcagtgactgagactgcggaaggccgagtagccatgatgtgtctgaacctgcgataactactagaagtcctgtggcttttaacccatttctcataccaagagtatctcctggactcaattacccattcatgttcctcttccctgggatgggcatggctctgtcaggcatgccagaagccccctctg

SEQ ID NO: 646895 - DNA, 349 bp, Homo sapiens
  misc_feature (8)..(8): n is a, c, g, or t
  misc_feature (25)..(25): n is a, c, g, or t
  misc_feature (78)..(78): n is a, c, g, or t
  misc_feature (143)..(143): n is a, c, g, or t
  misc_feature (160)..(160): n is a, c, g, or t
  misc_feature (223)..(223): n is a, c, g, or t
  misc_feature (326)..(326): n is a, c, g, or t
atattttnagtagaggtgggttttnaccatgttggccaggctggtttcaaactctggacctcaagtaatccgcccgcnttggcctcccaaagtgctaggattacaggcatgagccacctcgcccagcctgcttgctttctttncttttcttttctttttncttttcttttcttttctttctttctttccgtctctctctctctttctttctttctttattttnagatacagagtctctctctgccacccaggtttggagtgcagtgggtgcgatcatagctcactgtagcctcaacctatagagcataagtaatcctcccaccttnagccttcctgaggtaggccgggg

SEQ ID NO: 646896 - DNA, 500 bp, Homo sapiens
  misc_feature (491)..(491): n is a, c, g, or t
gctgccgatacagtgtttatttttctcatttttaaaaaagaaagagggggaaacaaagaaggaaaatacaaagaaagaaggtagacaacgctcttgcatagcccgaagcccatagagaaagagttggctggcttgtgagaagacatgaggagttgggaaaaggaatgccagagttccctgaaccaatacagatctctatgcaactcaaggctggcttatagagccagctccaggactctggcaccagctatcaggtctgctgaaacctaatacattcgcgggcctgaatacaagggggtagcctgttggtgagcagaggcgtctattaataatctggggtttggccatccagagggcctctatgtgctcaagattggtgcaagagcttttggtgacttgttagcagccagtggctggaatgtggtggtgggctggtggctgcaccggaggggcaaggaactacgggagctacccagggggggctacactgnggggtgggt

SEQ ID NO: 646897 - DNA, 875 bp, Homo sapiens
  misc_feature (123)..(123): n is a, c, g, or t
ggtgggcagcatggtgggcgtctacaatcccagctacttgggaggctgaggcaggagaatcacttgaacccgggaggcggaggttgcagtgagccgagatcgcaccattgcactccagtctgngcaacagagtgagaattccgtctcaaaaaaaaaaaaggaaagggaaaaaaaaattggctttatacctctttcctgtgtctcaacccgccagtgaaaatttctgaaccctccaaaatccggtggaataaatccaaaacaaattttatagcgtttaaaaatacttttaccttcttatagtactagtatccttaaaaggcctcagggtatattatcttctaaacagctacaattcagtgcagtctacattaaccaattatgttctctagcttgagaacaactaggcctatttcactgctgtgtagcctcagtgcctaacatgggtgccaaataaatatccgtagaattacccctgatttgtaaaacccattcgttttgtgttacaatggccaaaatctcaaaaggcctgtatttatgtaatctttgaccttcttacttctactctaatttctccggtatggactgccgggggtggcctagtactaagtctcatttttaaaagctcaataatgggttggttttccacatccttcccttttaccagttaactcttccccaccccggggtgctcccccaaggctatttttctgctgcccgaacacggtcccaattgtggcgtccggccaattgtgtttttcccccgtctcgcttcagagtttgcggaatgcgggggacgaccattggtgcacacatgacgggcagaacaggccccgcacgggaaaaatacgggggccaccaagttgtattaagacaaa

SEQ ID NO: 646898 - DNA, 374 bp, Homo sapiens
ttggaaaccgggagaaacatgatcttaacgagctgctgggtgaaggtgcatctgggttacgttggtcttatgtcacggagcaatgcagagtccctcacttcacaagctggtgctggggaagtatggggccctggtcatctgtgagacgtctgaacagaaaacaaaacttgaagattttggccggcggcttgggcagcatgtggtgggcatggcccccctctctgttgggtccctggacgatgagcctgggggagaggcagagactacgatgctgtcccagccgtatttgctggagtcctccattaccttggggcagtatgtgcagcctcagggggtgtcggcagtagaccatgtgcggactgaatgtggagaag

SEQ ID NO: 646899 - DNA, 452 bp, Homo sapiens
  misc_feature (1)..(1): n is a, c, g, or t
ngttctctgcatttagaggatcccggagtgcagtgactggaatctctgtggtcactgcaggctctgccttcccaagttcatgccattctcctgcctcagcctcccaagtagctgggactacaggcacctgcaccatgcccagctaattttttttttttttcagtagagacagggtctcaccatgttagccaggatggtcttgatctgacctcgtggtccgccgacctcggcctcccaaagggctggaattacaggctgtgagccattgcgcctggccaagatgtgcctttttttaaaaaaacatcggtacttcctaccaattgttgcatgagtataaggctcgggaattatcagaaggcatattggagaaataggaattaggggaccttactcatgtgccatataagcttaccttacaaacaggtatatccctattcgcgacactgcactcg

SEQ ID NO: 646900 - DNA, 531 bp, Homo sapiens
atgtatctctaataaccacaagcggctactacataccgcatctaccactccacatagggcaagtcctacagctccctactcctggcgtatctggtgatagacactgaacagtacaggctaatttgtctcttccatttcccattgctgataccataactctttctgtactcctttagtttactgtccatatttgctttctgaaacaaccatctccacagcctgaaaatattagtctagttaacctcctatccattgccttcaaaggtttgcctggcagtaatacagttctcttaattagcaaacacttctttgaacttgactctttcttagaagcaatcactattcctttgacctgcagattacacattacttggggatttacagacatctgccatactggtctcgtattcccttccttcaagtatttactaaatatccagtagacgcctttgtcttacagccatgagcttacttaaatatacatcttactactacgtatcgctttagaattaatacggcataaaaggcttg

SEQ ID NO: 646901 - DNA, 882 bp, Homo sapiens
tatgagaaagacaaattatgaaggtagaacagagtgtaggaactgggaatcggtttcagtggtataggttttaaaatgagacaggctaaccttcgggagtccaccgtctcttgaggcggtgagcagaagcttgttccttcctaatatttatagcctagaagtgtgtgcactgcatggttgccctgccacagtactgccggttattcactaggaatatttcccctaagctacccaggcagttgataaaatgactacagacacgtctgtgttaaagactaacgtgtctacatctccatatgttgtagctgtggtgaaaatgtgattttaaaaaattatcgccagttcagaactggctattcttgttcctctatttcgaagtcattttgttcagtggaatagagacagcaacgagtggtgttaacctctcgaattagaagtacgaagttgacgaccagtaaagttttgccataaataagttacacagatctctgtgttccggaaagatgtgtatcttcttaatgtgtccatgtcagagaaagtgtccccatctcactgccaagaatgacagaacactatttagatcctctttaaatgattcaagtgtaaggattctactcgcagtgcattaaccagacatatcttggacagatgaatttctcaggaaataacctttcgttaaggtatctgatacagtatagtaaagcaatcgctttatactcagtatagccctggagagatacgcaggtccccacgaaatgtcactctcattccaaggttaactcgggactaaggcactctacaattccaaatactcgaatgtttccattgatggccaggcttccaccgaattaacaggcttaacttcggggttccgaacttatg

SEQ ID NO: 646902 - DNA, 1163 bp, Homo sapiens
accagtgtggccgagcagatggctactgtgctagagggcaaagacgttggagttctactcttaggaaaactcaaggcccgcaaacggcaaactaaactccttgtttcggtcttcacccagtgtaataacagggtgttatatctggtttaggtttccccaagaagaaagctaaacacacaacacacaaacacaaacaaaacacaccttggtggcggcgcgacggactcttcgagcgccaccagcgagaagcaaacgctttgcatcagacacccccaatcatgacttgagagagagacaaggaggaacacaccaaccagaggcacaaacggtgaaaaagtggggcacaacagagcgctggaaaccacaaaggaggaaaaacactctgggggcccacagtgcacaaaaggccgctgggacacctcacccccacacgattacacaaaaacaacgccatgggagagcgcaaaacccccaggaagagaccagatactagagagacacaaaaaatcgaacaatgaaaacgcaactacacactgatgacgagctacaacaataacgcagggagagacacagcaacaaaacataaccagacgcgttgccttcacaagactcgtgccacccccgcgacgcaaacaacacacagacaataaagaagacacacacacaaacaagacgggggagaaaacatacacaacacaccagcacaaaaaaccaaacacacacccaacaaataagaaacaaaacgagcaaaacaatcagactaacaacacagaaacaccacaacagcaacacaaaacacacccaacaacaaaaaataagacagcgacacgcgaaacatacacaaagcagacgacgacaaacaaaatagacaaaaacaaatgtacaaaagagaagtatgctggtattgggggacgccagacgtgcagtcacggagtcacacgctacagcgcacgacagtgcacccccgcagagagcagacacgtagcaagatagcagacgagctaggcggcacgggtcaccagcgatgacaagaaccactcgacctagctagaagacaacacacaaccgcacgcgcccatgcagacacatcaaaggaggcgagaatgagcgatcgctacatatacaggatgctcgagactcggagtcgcgtcgacacattggca

SEQ ID NO: 646903 - DNA, 695 bp, Homo sapiens
  misc_feature (468)..(468): n is a, c, g, or t
agtgcctggcatttcccctactgctctcattctcactcttgccgccctgtgaagggggtgccttccaccgtgattgttaagtttcctgaggccttcccagccatgtggaaactggtgagtcgaaaattaaacctctttataattaaaaaaacaaaaaacaaaaaaacaaaaaacacaaaacaaagagggtggtaacaaaaaaacaaaaaaaaaaaaaaaaaaatgtgtgtggggcgcgcgcgcccccggcgccccggagaaaaagaggttttaaaaacccactcgcgcgtgggggcgcggcggggcccccaaaggagtgtttgggaacacacgggggcccacaagcgcggtgtccccagaggaagaaactctcggggacgaacggacactcgggctggtgggtgctctcctccacccaatataaaaaaagccgcgggggggggaaccacggggtgcgttgttgaagcnaaacactccacacgaggagggagttctgcaggggagcgccacacagcggggtactataacaccagacgcggggccaccaaagagcaggcgcgaatatataaaatttacccgcagcggccggagggggaggaacaccaataatcatcttactagtcaagccaacaactacatcacatcgcaaccaacatccacctatcacgatcagaaacactaacagcgccgaagaa

SEQ ID NO: 646904 - DNA, 758 bp, Homo sapiens
gctacttctctcctgtcttccccgccgacgacgctgtcatcatgacaggaaatcgtgcacttgcatgtccggggcagtgcaggcaacctaaatcggcgccaacgttttgggacgcgtgatcagcgatgacgcacggcatcagatctccaacaggtcacctaccatggggacagcgacctgcagctggaactgcatcaactgtgtactatcaatgaggccaccgtggcggtcaacgtacgtgccccgtcgccgtgctcgttggatctggtagcccaggcgaccatggactccgtgtctgctcgtgggacccattcagggcagatcttccgtgccgtgacaacattcagttttcggtacagagtgagtagctgggtaacaactgtggaccaacggggcactactacgagaaggcgcgtacctggtggactcgcgtgactggatgttgtgacgaaatggactggctgaagagctgtgactgcctgcatgggctttccacgcttgacccgactccctgagttgcggcgtggactgcggtctgcggatgggcgtaacccttcctcatcagcacagatcctggagaaagaacgtagcgcctagtacacgcggactcacttgaagcgatgtgtttgctgatggtcgccttacgccccggcagttgtagaacaacagctggatggcagtcccgtatcttagcactccctcctaagtccacaaacatcgttgcacgacagcagactgagacctactgcagtgcacca

SEQ ID NO: 646905 - DNA, 254 bp, Homo sapiens
ctgcaaaactagcataccatggactaataggaaagcatgagcccataaaccaaaagtaccaatctagtgtactgattagaaatactgagtacacacccctgatgcttactctaaagtttctttttcaagatacttaagtcaattcatataactggtataaattccatggttgtatcgaacatggttgtatcgaacatggttgtatcgaacatggttgtatcgaacatggttgtatcgaacatggttgtatcgaa

SEQ ID NO: 646906 - DNA, 422 bp, Homo sapiens
tgctaggattacaggtgtgagctaccgcgcctgacccaactttcgtctttaaaggactccagtgtttcccagattcttttttttttgggagtgggagtctcgctcggtcgcccagtctggagtgcaggggcatctcggttcgctgcaaattctgcctcttgagtccaagcgattctctggtctcagcctcctaagtagtggggatggcacgcgcttaccaccgggtgggctaattttggtattttggaaagagagggggtttaatcgtgtgggccaggcgggtctcgaagtctgggcctcaagagattggccggcctcagcctcccaaggtgcagggatcaggggcatgagccacagcatcgggccaaaaacaatctttaaccggatctacaaggtcgggcagctcaggagagcagcagttt

SEQ ID NO: 646907 - DNA, 656 bp, Homo sapiens
  misc_feature (29)..(29): n is a, c, g, or t
  misc_feature (91)..(91): n is a, c, g, or t
  misc_feature (136)..(136): n is a, c, g, or t
  misc_feature (170)..(170): n is a, c, g, or t
  misc_feature (175)..(175): n is a, c, g, or t
  misc_feature (183)..(183): n is a, c, g, or t
  misc_feature (186)..(186): n is a, c, g, or t
  misc_feature (205)..(206): n is a, c, g, or t
  misc_feature (213)..(213): n is a, c, g, or t
  misc_feature (215)..(215): n is a, c, g, or t
  misc_feature (231)..(231): n is a, c, g, or t
  misc_feature (237)..(237): n is a, c, g, or t
  misc_feature (242)..(242): n is a, c, g, or t
  misc_feature (244)..(244): n is a, c, g, or t
  misc_feature (247)..(247): n is a, c, g, or t
  misc_feature (276)..(276): n is a, c, g, or t
  misc_feature (289)..(289): n is a, c, g, or t
  misc_feature (291)..(291): n is a, c, g, or t
  misc_feature (295)..(295): n is a, c, g, or t
  misc_feature (300)..(301): n is a, c, g, or t
  misc_feature (308)..(308): n is a, c, g, or t
  misc_feature (318)..(318): n is a, c, g, or t
  misc_feature (349)..(349): n is a, c, g, or t
  misc_feature (361)..(361): n is a, c, g, or t
  misc_feature (367)..(367): n is a, c, g, or t
  misc_feature (379)..(379): n is a, c, g, or t
  misc_feature (391)..(391): n is a, c, g, or t
  misc_feature (397)..(397): n is a, c, g, or t
  misc_feature (415)..(415): n is a, c, g, or t
  misc_feature (475)..(475): n is a, c, g, or t
  misc_feature (637)..(637): n is a, c, g, or t
ctagcaagacgcagctccccctcagcctnagcgcccccccgcagagaggggacagagaaggaaaaaggaaggtgacacaggactggggttnaaatactcagaaagccacacaatagaagacaaaaagtagcaagcncccaagaaagcggggacaaggaggaaccagtgcncgatnccgccctnttnccagctgggggactgtgtnnccaggantncgtggggcaaggggtnggattnggagntnttnaaggatttgggggtggaggggctcaaggntggacccaccctncncttngactnntgggctnagggcaagtnaggcccgaggggccccctgcagttggcagtnatggggccagtngaggcntacagcttggtnaggtccagcttnagcttntagggtggtaggctgtcntcacaggcgtgggacggcggcgggtacaggggccaatcgggctccatcatgaagcccttnttctgcttcagggtcagaggctggaacttgaggtgtctggccaggcgcggtcaccagggtggagcagctcagccacagcatcaccagcacggagaggaagaggcagcaggccaggatccagcgaggcagacccgagcgccgggacatgcaactgaggaagtnattgtcctgtggctcttca

SEQ ID NO: 646908 - DNA, 133 bp, Homo sapiens
gactgtagtgcagtgacaccatctcagttcaccgcaacctccgtctcctgggtccaagcgattctcttccctcagcctcctgagtagttgggataacaggcatgcaccaccatgcctggctacttttgtcttt

SEQ ID NO: 646909 - DNA, 117 bp, Homo sapiens
agggttaccgatcggactaagttccagaagcaagagataaagtaataatgggtactgtggggaaaaacacagaagaacaattcggtaatatagtggtgatttacaagtcaagttaaa

SEQ ID NO: 646910 - DNA, 113 bp, Homo sapiens
accgctacgtcgtgctgactggagacgtgaccagctctggagtctcccttgagtcccttcctaggacgcagtggtgctctagggctcagtgtgtttctctgcttgtctctctt

SEQ ID NO: 646911 - DNA, 1136 bp, Homo sapiens
tatgcaacaaatgtttattggaactcctgctgaatgtcattctgaaaactgaggaccagtggtaccaatttggacttatcatcaccaaagggaaacagaccataaagaaagtaaacaaattataaaatttaattttagatagtaagggaaagcttccctgaggcaatgactatttaagcagagacttgtataaagtgaattaaatttttacccagtgttaaggtgaaattgggtgaggggacattccggacattagggaacggtattgtattgaaggcctcatgacaaggagagcagatgagttcataggagctgaaagtaatgcacatatggctggggcaaacagtttgagggtggcgctgaatagcttaagaggcacatactcgggaattgggcaaacctggcatgcaaaactgtcatgtgtccctataatgatcggtgatacactctgagaaatgcatcgtaagggggtatcatattggttgtgaacatcactagggtgaattcacacaaacctagatctaaacacctaggctatgtgtaatatagcctgtgtaacaaggataaaacccgttaaaggtgtccctgtaactagaatacgcttgggcaatggtaatagcaagggtaacgtctttgggtatctcaaaccttcgacacggtaacacaaatactttagcattcacattgacccttggaacagataaggttgaacatgaggaggttcccaattatagaagaaaatatattacaaaaaaagatatcactagtagggcggagggggtaaacacgtgttaaccagcatgggaagagaacggtgaaaaattctagagcagaaatggaaacagcgtgtaaaatataataccaatttatatatataaaataaaaagaaagaaaatgaaataacaaataaaacaacaagagaggggggagcagataataagaggagaaatacccactatttataagaccagtagagatataaaaacggcggcataaaaacgagagaacgtagtataagaacgtgtagtagaccacacggaaatattaattacagaataaatataaataaagaataagataaaattaaacactcaaagattagaacagagaccagataatagacatcatataaacaa

SEQ ID NO: 646912 - DNA, 299 bp, Homo sapiens
gaaaaggggggggcccccccttttccccgggggggttttttccccctggggggggccccccccccccccccccccaaaggggggggtttccggccgtgggcccccggcccggccccccctttttttttttccaggaaaaaaggtccccccctggggcccgattttttttttttccgggggccccccctttggtttttaaaagcccctttccctgggggggcttggggggggtttttttttttggggggtttaaaacccgggggttcccgggggggccctttttttttttttttttttta

SEQ ID NO: 646913 - DNA, 783 bp, Homo sapiens
  misc_feature (1)..(1): n is a, c, g, or t
  misc_feature (73)..(73): n is a, c, g, or t
  misc_feature (85)..(86): n is a, c, g, or t
  misc_feature (125)..(125): n is a, c, g, or t
  misc_feature (139)..(140): n is a, c, g, or t
  misc_feature (178)..(179): n is a, c, g, or t
  misc_feature (207)..(207): n is a, c, g, or t
  misc_feature (209)..(209): n is a, c, g, or t
  misc_feature (241)..(241): n is a, c, g, or t
  misc_feature (336)..(336): n is a, c, g, or t
  misc_feature (355)..(355): n is a, c, g, or t
  misc_feature (365)..(365): n is a, c, g, or t
  misc_feature (404)..(404): n is a, c, g, or t
  misc_feature (413)..(413): n is a, c, g, or t
  misc_feature (423)..(423): n is a, c, g, or t
  misc_feature (433)..(433): n is a, c, g, or t
  misc_feature (436)..(436): n is a, c, g, or t
  misc_feature (446)..(446): n is a, c, g, or t
  misc_feature (464)..(465): n is a, c, g, or t
  misc_feature (486)..(486): n is a, c, g, or t
  misc_feature (489)..(489): n is a, c, g, or t
  misc_feature (508)..(508): n is a, c, g, or t
  misc_feature (518)..(518): n is a, c, g, or t
  misc_feature (520)..(521): n is a, c, g, or t
  misc_feature (524)..(524): n is a, c, g, or t
  misc_feature (540)..(542): n is a, c, g, or t
  misc_feature (551)..(551): n is a, c, g, or t
  misc_feature (563)..(564): n is a, c, g, or t
  misc_feature (576)..(577): n is a, c, g, or t
  misc_feature (579)..(581): n is a, c, g, or t
  misc_feature (583)..(584): n is a, c, g, or t
  misc_feature (614)..(614): n is a, c, g, or t
  misc_feature (635)..(635): n is a, c, g, or t
  misc_feature (679)..(679): n is a, c, g, or t
  misc_feature (776)..(776): n is a, c, g, or t
ntcccctaattttttaaatctaacacaatgcttagcacaaacaatactcaataaataacacattaaccaagtnacattattcttnncactctctagagttgtgtgcgcgttttacggcaaactgnggggtaggtaaagnnagacatccggcagacttgactgagaagggctccaaaanntgagcagccaaagcgccgggtacccccntnctaagttagcaaaatgaatacagcattttccnagcagtctagaaatccgagctcactggggggcatgacaagggtttgggggtggtccgtgttccgggcctcctagttgggtcttctcctatttctnggttctttatttggggtcngtcccaatcnaggggggcttctgccaaagggcaggggattccttatgcngcctggggngggctatgcntccgcggtgnccnttcgctttgncactgctatggcgggggnnccgttccggcggtgggttgcnacngtgtgggccagctccggtntgggttgggncnnccnttcatgagcgcgttgnnncttgtgcangggcagcggtgnntgcgtccggttnngnnncnntttgtccccctctacgactctgcgtggggncgggggtcgggggctcacagngcaacagcagcgatggtcagaaaataagtgccagttccaatgcnagaactctctaaagttcattggtcacaattttttttaaccacctcacctaccatggcttttttcttttctcattatcttgccaattatttctttcgnaattcaa

SEQ ID NO: 646914 - DNA, 381 bp, Homo sapiens
tgtggggggtccccagtgatatagatctgggcgtaagactctgctgtgaggcagacgttgggactgtagaggctgacaggaggcagaggctagggcctggaggggccaccaagatgcatgagctgggcctggatgaggtcgaacttgagaaagttcaggacctggacagagaaggctgggaggcaggagctgggtctaacgaggccattgtaacgatagagctgtgcctgtggaggctgttgtgaggcacgtagcctcatctgacggaggctgccgtgacgtaaggtatgggcctaaataggccattgtgagtcatgagcttggtctgtaaaggctgactggagaaagttctgggcctggagaggctgacgggaggtcaga

SEQ ID NO: 646915 - DNA, 302 bp, Homo sapiens
ggagctcggtaccagattcaccggcagctgcgccagctagcacggagctaaaggggatgccacgtctccaggagacgatgccactgacaggctcaaaatcacatggtaatttacaagtttgtattaggaatgcgttagtggtgcgcccgctgaagacatcacacagcaaccaggtttcagcatagccagtcccacaggagcccagcaggaaaagattacgagacctaccagccatttcagaattccacaagaaattacgatgagtccttcttcgaggaccaggtccaccatcgccctcccgc

SEQ ID NO: 646916 - DNA, 322 bp, Homo sapiens
  misc_feature (211)..(211): n is a, c, g, or t
cgcaagaaccagacgctgttgaagaaggactagcacctccatatagcctgaatccaaagcgggtcacacttgctaccacatggtctatcgcatctgatgctcctgcagcgcatggagtaaatggaaagagcctggtagaagcgacaattatctgcggtggagacgccattggttctgaaaacacaacatcggtatatggaaggttattgcnaattgactccggggcgttcaaccaatagctcccgcagatagatgtatacaccgagccgctttgtatctctgttgactctcccggtgaccacaccccggattggcaatgtag

SEQ ID NO: 646917 - DNA, 816 bp, Homo sapiens
gaggcgcaggcagcgccatccaaaggagatctcactccgcccagcagtgactcctgtctccctcaaaaaggccccaggcaacgttcagcccccaagaggaggcccagcgtaccccatcctccaaaggggatcccagcctgccaggcagtgactcgctccttctcatgaggagaccccagtgacaaggacgcgtgcacaagtgctgacatcatgcccaaatcgaagcgctcccgagtccagggttccgaggcgccacccatggggggagaacaccggtaacggcatgaacagatcaggtgacaatcacgaatcgttgcgcgccagatacagagggatgcccaaagcagaaaccgacgaatcacggctaaaaagggggcacacgcatggtgaccacagaaccggagcggagccaccgtacagcaggctacagagaagagagaccccgcggaggaacatcaatcgtggagccgcgcccgcgcaaaggcggggaccacatcacagccacgcgcgaagaacgtgtacagtgaacaccggaagcaccgcatcccgagtgggagaagacgcccacaaccacgaagccagacatgcgaccaacgtggacgaagcaaaaagaaccgtggaaacaacgtaacccaccttaggatacctgaaaaggaatgcgggccacacagaaaacgcgagatagccaacgggggggacactctgaccaacagtagaagacagagggtccatggaaactggtggccgaccacacaccccttccgggacacaaacccaaatgacagtgaaaccgacggcatcagagccccaatagcc

SEQ ID NO: 646918 - DNA, 130 bp, Homo sapiens
ctgctattcctctatgaagattcctgtttagctgtgggtgtcccgggtgggtgtgtgtcgatcaaaggacaaagacagtattttgacaaaatacgagtgaggatttacactacatcgtccaagggatgaa

SEQ ID NO: 646919 - DNA, 422 bp, Homo sapiens
ggctaattttttttttttggtatttataagtaagagagggggttacaccatgtaagccagggatggtctcgatcctcctgacctcgtgatccacccacctggccaccccaccgtgctggaataacaggcgtgagccattgtgcctggccaaagatggtaattccactgagtattggaaagtccacggcttgctgtgtgaatagtagggcaaagtaccggcactcaccttatgtcctaatgaaagtagcaatcagtgagtaaatacctatgatgtaatttctggggggtaaataagtgctatagggagaaccaaagcagaataaggggtcccagagggatgaggagaatattggtagaagggacattaagggaaggctcctctggataggagcgaagagtgtagctgccaaggcgggggaatc

SEQ ID NO: 646920 - DNA, 912 bp, Homo sapiens
gaactacgggagccctattacaagcctgaaccctggggagacgcgagaatcagctctccatcatctccagaggaggatgtcatggtagggatccctcaccttctcagtggactatgaactgtcccgaaaagaagcgcctgagtggtgacaactccaggagtgcccacggtgctgcgcaggtgcatggaagtgacgcagacccagtggatctgaagtccttagcatcagtattaggttgacacagtccattccatgagcaaactggcaatcgtgcgctgaaggaccgagatgtgcgtgtcgagaaagacgccttggattctctgggtgttctgactgagactcattcagccgttcgtatggacagtccccgtgactgtcagactgtctgggaccatggatgacatgaacattcccttgtccgtcaggttagaccggcgttctcctcggagaatgattgtcacttggcagaggtcaatggtgccgacctgggcgaaggggtgggacccccagctactaggcaatggtactaacctgacccagggaacagtcactcaagaaaggaagtatcccaggaaagatgcatcatcagaggggggagcctccaggtgtctcctgtcataatcagcctgttggcaacaaggaagaagtgacaggtgggtggtcctcaataggccagatcacttgccgaagatggatatcaccggtctctcaggtcactccttatgtcagcggtgaacgtctactacggccagaaagcgcattgccaagaaagaaaggcccatgtgaatgaaagtgcacttttgaacccccaatcttcatgcagtcttgcatcttacgagaattcccacctgcacctacctggctgatatagcatagagtcattgtaacgattaggtgaccaccaaatgatgg

SEQ ID NO: 646921 - DNA, 572 bp, Homo sapiens
  misc_feature (171)..(171): n is a, c, g, or t
  misc_feature (173)..(173): n is a, c, g, or t
  misc_feature (178)..(178): n is a, c, g, or t
  misc_feature (194)..(194): n is a, c, g, or t
  misc_feature (226)..(226): n is a, c, g, or t
  misc_feature (231)..(231): n is a, c, g, or t
  misc_feature (233)..(233): n is a, c, g, or t
  misc_feature (255)..(255): n is a, c, g, or t
  misc_feature (320)..(320): n is a, c, g, or t
  misc_feature (344)..(344): n is a, c, g, or t
  misc_feature (355)..(355): n is a, c, g, or t
  misc_feature (358)..(358): n is a, c, g, or t
  misc_feature (360)..(360): n is a, c, g, or t
  misc_feature (365)..(366): n is a, c, g, or t
  misc_feature (369)..(370): n is a, c, g, or t
  misc_feature (373)..(373): n is a, c, g, or t
  misc_feature (391)..(391): n is a, c, g, or t
  misc_feature (393)..(393): n is a, c, g, or t
  misc_feature (396)..(396): n is a, c, g, or t
  misc_feature (409)..(409): n is a, c, g, or t
  misc_feature (411)..(411): n is a, c, g, or t
  misc_feature (428)..(429): n is a, c, g, or t
  misc_feature (436)..(436): n is a, c, g, or t
  misc_feature (456)..(456): n is a, c, g, or t
  misc_feature (462)..(463): n is a, c, g, or t
  misc_feature (468)..(469): n is a, c, g, or t
  misc_feature (494)..(494): n is a, c, g, or t
  misc_feature (499)..(499): n is a, c, g, or t
  misc_feature (507)..(507): n is a, c, g, or t
  misc_feature (512)..(512): n is a, c, g, or t
  misc_feature (528)..(528): n is a, c, g, or t
  misc_feature (534)..(534): n is a, c, g, or t
gggggagggtggtagggggcagatctttcaccagtgtttaagcaacatcttcttgatgctgaccttgtgatagtgagttctcaggaaatctgcttgtataacaggtttatacaacatgtggcagctttttcctctctctgtcttgtttctacttctgccatataaaacatncnattgntgcttggtcttctggnatgattgggaggcttcctgagtcctcccagangcagnancctctatgatttatttaaagcntgcagaaccatgagccagttcaacctcttttctttctgattatacagaaaattagtgctgtgaantggagctatgaaatgccttcaagnccttttccttnttntnttggnnatnngcnctcagcttcttttcaggnanatntctgaagcctgcntnaatttttctcctgaaanngactttncttcttttaccacattgccnggctgnnacaanntagctgaaaatgtagaagcaggttnagaantgtgtaanggccngaggttggagagtttngaggtnttggaagaggtcagcttgtgggatcctctagatcaccg

SEQ ID NO: 646922 - DNA, 359 bp, Homo sapiens
ctaataaatccagagatctgggagcaccagatggagtatctccaagctcgaaccacaaggtccaagaaactcttctcctgcttagcttgcctcggcccatgtaatccgtacatgaggccacttaatgaggacacatcagatgtatccaaatcctcaccaatctctgccatcagcactctatagtccgaaacaaggtgagggtgtcctgagcacggtgggtctccacagcttttctgtccatcttcaagatccgtctgagcagggcacgatcgcctcactctgtagagcagttcagtcaagtccccgagagacagcttacctctttcccgtaaaatatccagacggtccctgaccttagg

SEQ ID NO: 646923 - DNA, 952 bp, Homo sapiens
tggtgaagactatgacgacactgcgtcagatagatgtgcacatgttcaatgcagtgttcgttgcgttggacaaagctgcccccggtgaagtctgccatccgtgggcaagctcctgtggtatcctacatgcgactatggacacatcaacgcgtcctcatcgacggacacagtcctccttcggggcgggcggaatgacggccgaaggggcctgcaatgtgctcctatgcctttgactgtctatactgcaacaagtggttcactaccaccgagtgtcaagggactagttccatggtggcccggggatgggcattcagcctgtgtccgtagtgctaacgatctatgttccattattgggggcgtaacggagcagcatgcggacatgtttttccaatgacgttcgacaagctagtatacctatcagcatgacatgggaactcttatctgtactaagggcagtcgctgcacgctggtgggaattccactcagccacaatgctgggaagtcacatgtatgtcttcgggggccgtgtcgaccgttttgtgtcccattccattccaacaatggagatttactgcaagcgcattcgagtctttgaactccagaactgagggcttggtggaatggcccccgatcctgtgtgctgaggggccggagcactcggcccttggtacaatggggagctgtgctcctggtggtgatacttgcagcgagcgggtgtttccttactcttcagttagcctgtgtccttaccgggccaagactgcccggggaggggcctgtcccgcgggccagttgcgtcctgggtacatggctcttggggccgcctctggaggccggactgcctacccggcttggggttccgctgatcggcgcggctactgacctgtctttggggggcacacagcctctgaggcctcggcccaccggttgctgcctcctctcccgttcttgt

SEQ ID NO: 646924 - DNA, 235 bp, Homo sapiens
gttcaatagcagcctggccacatagtgaaaccccatctctactaaaaatacaaaattagccgggtgtggtagtgggcacctgtaatcccagctactcgggaggctgaggcaggagaatcacttgaacctgggaggcggaggttgtggtgagccaagattgctccactgcactccagcctgggagactccgcctcaaaaaaacaaagaaaatgctatggaaacttctaaaactagg

SEQ ID NO: 646925 - DNA, 461 bp, Homo sapiens
cgcttagagattttgggggccccaagttttcttttcctttcacatttccccctttttctgtttaaaaatcttttggagaaagcattttagaagaaaacgagtctctggtctcaggtttcgtctggtctctcacagctgggatggtttattcctaggcagatgggtcttgagttattaggaaagctcctttttctcaggttgagaatcctcatgtcctatgaagagaaaataggtggaggaagggagaaaaacaacaaacaaaataatgatcctagaaaatcgatataggccacactactctgaagtccaaacatcagtaggcaggtatgaaagtagcttatatatgtaaacaggttgctgttattttcttctgaagtttaagttgtctagcttcagttcacagggcttcacaaagcacagcttagctttcagtgactccaaattggggaaaataggaaaaa

SEQ ID NO: 646926 - DNA, 352 bp, Homo sapiens
gagcacagtcctgtagggccagaatggccaggtccccggcagggtggcccccactggctgggtgcagactgggagtccaggtggggtgcaggtggcacatttctggtgtgtgtagaggcatggaagccggctcttttcagacctggcatgggtctcagggtggcctctgccctaactaggaagtctgggcctaggctttcttctggtgccccagctccatgacctcagcctcttgtgaccccagtgtctgtcatgatcctgacctctctccaccacagccgggctggcccgttctccagcagcaggtgcggcgcctctgtccccatcccagtccccatgcgtggattgccag

SEQ ID NO: 646927 - DNA, 1361 bp, Homo sapiens
gccaagatgcccacaccgtaaacaaggcgggagggaaagaatggtggctccggcccccagctgtcgtgacgaagcatagcaggctacataaacgtggtgaatcccctgctttgagaagacaggcctaatgtaattttccggtagttggaacaggcaccatccatgtcccaaaagagtaccctcatccgctattggtgcaagaatggcccctgcatatagtcgagcgtatgcaggcggcatagcagccatctctcgtaatcagtcgtgcctggtacggctgcctcctgacgattaaccagtttcaccacagtgctcccttggtacgcgtccagaatcagccataactcaggactgtctttactcgactgtgacctcagcaaggtacgggacccagaagatcaaaagacaatgagagacgaacgcactgagcacctgcttgggcacccgtgttgcccgtagaaaatcgactggcctgcatgtgctaatacgggagatcgtccgcaatccgacagcagatgcagccttgtcctttcggagccacggacgtttaatccacacgttcaaccagccttgtgttggcagcaaccaagcacaagcctcaggcgtggaatgaggtgagtttgacaacacggaccgctgtcgatccccagtcggagccttggtaagatactaaccttggccctggccctggctgctcggtcacaaacattgaggcgggttcccatttatcttgccgactttactccaatcgcgacgagcaatgggcacacgaccgatggcagaactgcttgtacgatccagacagcgaaatgacacatggcagacccacatggtcgaccctttcaccacgcgtcgttggaaacctcgcgaaacggaaccataaaggggctggctattagagacttaaagacctggggttgggcacagccttaatccaggggaacgcaacagtcagcacaacattgaaccacggagttacgaagtgcactaacttcccagccggatcaaaattggcggtgcttggacacacattggtgccttgggggatcccttacaggatcttggtgggcgttccgaacttacgcccatcgccttctgaaaaacaaaccccaaatcagaccctaaaacataaaacctttggaccacactcaataaccttgcacgttcaaacttgtaccacctcgtaagactattacctttcgacccatttaacacactaccagttatggcgctcaattacatccacacaaacaaaacaaaaacacatctacccagcacgccatcctcatccaggcgcacgcacatcatccatctccaccaaagtacacacaatctgccaaacacccaccaccagcacacca

SEQ ID NO: 646928 - DNA, 229 bp, Homo sapiens
  misc_feature (45)..(45): n is a, c, g, or t
  misc_feature (60)..(60): n is a, c, g, or t
  misc_feature (82)..(83): n is a, c, g, or t
  misc_feature (113)..(113): n is a, c, g, or t
acagtagctactcttaggtatactatatcacatacatgattatanatagatggagatcantccagaagaacagcatgactannctccaagcattaatttggaaatagaaatgnagaggtgtacagttcatcctcagtagggttagctatgctttgtgcctacctagaacttttaatcactggaggctgtcataatcttccacatccacaccgtccataaagcatatgtt

SEQ ID NO: 646929 - DNA, 360 bp, Homo sapiens
ttgagagtatacggatgggaggaaagtagcagacatcatctattgtgtgcaggctgtctcatgtagtagcgccattgtcgttacattcattttgtgtaatataaagcgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgctta

SEQ ID NO: 646930 - DNA, 697 bp, Homo sapiens
cttttttctccccttcgcatgtttagtttctttcctttctcacaaaaccagttcggcgttccggagaccattttctcttccctcattggtcacactacacatagagctgctgtggttggccttcattctccagggagcttcttccattagttctgcgattctgacccctggttttggctctttcgcagctgtctcccttgcacatcaataaagatgacttcaggcatctcacttgaagatccatcagatgatctgagagcaaggtctcccccaaaaatccacggcatgtattctttcgtttagaatctgaaagcctctttctttcaaggcttgatgactctcttaaggtatttgttatgcctctcttctgggtttttcgttttgccttatcaagtagctcaaattctttctccatggcaacagaaactgcttctatttcgctggctgctgcttctttctctttccttagcatacatgtcacagctctgtttagtctctggctcttaatacgttaagcatcttctttctcctgttgtgctaatctaaagaaggaatcaattcggagctgtgtcttttattcagtaaattcacttttaagaagatattctttggccgggcatggtggctcacacctgtaatcccagcactctgggaggccgaggcgggcggatcacgaggtcagctcgtgccgaatcct

SEQ ID NO: 646931 - DNA, 519 bp, Homo sapiens
  misc_feature (50)..(50): n is a, c, g, or t
ggaaagaatagtaagaaaagccccagcttccctcccatgaacagagcccnccgccggatcatccatgacttggcccaagtttatggcctggagagcgtgagctatgacagtgaacccaagcgcaatgtggtggtccctgccctcagggggaagtccgtttgtcctcctacccccctgacaggtgtgctttaaagggaaatgcaggcccggcctccccccccgattcctcatcacagacatcagtcagacaaaaattctgggagcagtaattttcagaaaataaccaaggagcccataattggctattttgacgtcccgggctaaaaagatcatgatgcccttagataaaagaatgtttaggtatagtggaggcttttttgccaacaaataaatcatgcccgttcccctctgcctggcaaaatcccagtttcccaaactgttttggtctgacccatcccaagcatgagtgggtcagaaatcccttgtttattcctgtttgtataaagtgtttccttatta

SEQ ID NO: 646932 - DNA, 786 bp, Homo sapiens
cttcgccgcctccgtgttgtttgtcttgggatcaatgctcgtcttctcgcgctccgttcgtgctctccgctgctttgtgggtggtcacacctcgtggggctttctctctctgtttttgtctctctctccgtgtgcgcgcccgccatttcgtttgtaggggcgcccctcaaccgggcgtacactccttccccacctgttgtcttgtgtgccgtgctatttttgtttgttttccgacacttcttttctcccgctgtgccctctatgtgtttgtgtgtcttctatactcagtctgttctctcacctcacctctctccatctcctccgtcggcgtggcggaggtctctctctctcttattcggctctctcttcttccctcctttcgatgtttggtgtgggcgcggccgcgctgttttttcccacccaatatatttgttctctccgccacccgcggtggtgccctccgcggtatgtcgatttgttatatatgagagaggcgaacgcctcttgttccagcattcgttctccccaccccccccgccctgtcccctgctgttgctctccccccctcctctctgtgggctcccctcctcctcccctccgcggctcccctctcgcctcttttctcttctctacctgcccctccccctctcttcctaggagggcggggtgtggggggtgtgggcggggcgaggcccccccccccccgtcttgggggtcgggcagaaaaaagaattttttgttttattataaaaaaaaattttgttttttttatgtatgtgtgagata

SEQ ID NO: 646933 - DNA, 375 bp, Homo sapiens
cagtctttaaaattcgtctctgatttgccagagaaaaacggtggtagccatggaaatcgggagtgaaggagcactgcttcattgtgctcagcccttcctagggcctctgcccttgattgtccttgagctactcttctgctctgtaagttgtggacaaactgtaggtatgtatgtgtgcgtttgttggtgtgattgtctgtgattgtcagtccctggctattgattgatgttgtcatcaatttagcaaatttatttcctcattcttgatgtcctgaatatatgtctgcactttaattgctcctcttaaccagtttaatcattctaccatttccctatcatatttaattagtttaataatattttttgacacatgtt

SEQ ID NO: 646934 - DNA, 366 bp, Homo sapiens
ataagcagaaacacgtcagttaggatttccttctgcataaagttataagtagtagtaatagtcttaatcatagtctaccatcaaatatttaggaatatctattaatgtttagatagtatattaacagcatgcaataattacatcataagttctacaagcagaggcagtctattgcaaggaccttctttgctgccagttatcataggctgttataagttagaaaactgaatagcaacactgaatcctgtagaaatgcacttagctcagtaatacttgagttgttgcaatatttgattatccatttggttgttacagaaaaattcttaactgtaattgatggttgttgccgtaatagtatattgcact

SEQ ID NO: 646935 - DNA, 394 bp, Homo sapiens
  misc_feature (11)..(11): n is a, c, g, or t
  misc_feature (198)..(198): n is a, c, g, or t
  misc_feature (263)..(263): n is a, c, g, or t
  misc_feature (274)..(274): n is a, c, g, or t
  misc_feature (333)..(333): n is a, c, g, or t
taaacacggtnaaaacccccatctctactaaaaatacaaaaaattagcccaggggtggtggcaggcacctgtagcccccagctacttgggaggctgaggcaggagaatcgcttgaaccccaggaggcggaggttgcaatgaaccgagattgtgtcactgcactccagcctgggtgacagagcgaggctccgtctcagnaaaaaaaaaaaaaattggccaggtgtggaggcgcatgcctatagtcctagctactcaggaggctnaggtgggaggntcacttgagtcctggaggtcaaggctacagtgagccgagatggtaccactgcattccancctgggcaacaaaggcagactcaaaactgcagactcaagcaacagagcctgcctccaaaat

SEQ ID NO: 646936 - DNA, 477 bp, Homo sapiens
ccagtgagataacttagagcaggtgatctcgcgatctctatacagatcacaaaattccactctacaattcagtgataagattactacatacgcattttcatataagatgttacttgtattgctgctttaatatgaacagccatgatgcaaagatttttctaaaatggaaaactacatgcagcaaacttgtgtcccaatcttcccagggaaaacaaactatgcataaacacaagaagaaatatcaagtgtaacaccaacgtaaacctactgcatcctcagcaacacactgcataatgaacataagaaacacatttaagggtcaagacaatctgaataaaatccttaccaacattacatggttacgtaattaatgtctttgtggaagcaatgacttccaaaccctcttgccactacttaacaagtcgtgtgtaagtgtaaattcacgtacttctgaagcacttcagtacactggagtgc

SEQ ID NO: 646937 - DNA, 186 bp, Homo sapiens
aaaatacttggtataccagtaattaactctcattttttaaaaaaatggattgaggtggggcaaagaagcatagaagagggaaaatgtgggcaatcagaaacctaggtcattgaaaatgaccccaaaagatctaattaaactaaagaactgctgcacagcaaaagaaagtaccatcagagtgaacaa

SEQ ID NO: 646938 - DNA, 1122 bp, Homo sapiens
  misc_feature (818)..(818): n is a, c, g, or t
tggagaactatggaatgtgcactgatgagaactccagaaattcagtccaacttggctttcactggggaaaaattgggtccagaaaggctgagtgatgtacccaaggccatcccgttggctggtctgctattcctgtccttaggatcacataatacaattttttttttaagaggagctgtgcacctcaatttgctgtctagttgagaatagagattgtgtgccttcatttcatttgacatttacccagcatgcctcagttccacaccgtgaccagtgtaagaagaggaactatgataaaaacagttcaacaagccgcaaagagggtgggaaattctgaagtccagaagcgagtgtgatctttggaatagtggctgctgtgcccttgggcgccatttgaagaatcactgttcttgaaagtgctggttcactttctgcagtaagaagtgatttatgggcttttatgtaaaattttaagaatgacttgggtttcagagtagcctttgaaactttgctggcagcttttcattttgtcattggaaggctaagagacttttctcctttgttcaaagaactccttgttcttcagggcttgaacggcaaaaaaaccttagacaactttaacgaagtttaaaaagtatgttctggttttggagcagaaaaaagattcgtgaactggttagtacttagcaccaaaagcagttcagaatgctcagccccacaatgtgtgtaggctacatttatagccagagaaacgaaaataacttaggttgcctgattggctgcagtctggcatttgccttacctgaacatgttttagnagccttcagccgacgattgactgaaggtttggctgctgtgattggctaaaattcggctacttgttagaagaacatacttttaggttaggttacgagttgtttacacgttaagttacaattcactgtgtacagaggcagctttaggccagacttaattcagcttcacagtgtccctcattttgctcagccccttaattttgagagattgaccaaaatcccacgcactgacactaccttctgtcactatttgacctcattatggaactcacagtttacaatgttaaatcagttagcggattcaaaa

SEQ ID NO: 646939 - DNA, 780 bp, Homo sapiens
  misc_feature (16)..(16): n is a, c, g, or t
  misc_feature (476)..(476): n is a, c, g, or t
gatggtcagttactgntagtctagtcagacgaggagtccaagcgatgctcgagtaatcaacattacgcgccggccgtgaggttcactttctgcagtaagaagtgatttatgggcttttatgtaaaattttaagaatgacttgggtttcagagtagcctttgaaactttgctggcagcttttcattttgtcattggaaggctaagagacttttctcctttgttcaaagaactccttgttcttcagggcttgaacggcaaaaaaaccttagacaactttaacgaagtttaaaaagtatgttctggttttggagcagaaaaaagattcgtgaactggttagtacttagcaccaaaagcagttcagaatgctcagccccacaatgtgtgtaggctacatttatagccagagaaacgaaaataacttaggttgcctgattggctgcagtctggcatttgccttacctgaacatgttttagnagccttcagccgacgattgactgaaggtttggctgctgtgattggctaaaattcggctacttgttagaagaacatacttttaggttaggttacgagttgtttacacgttaagttacaattcactgtgtacagaggcagctttaggccagacttaattcagcttcacagtgtccctcattttgctcagccccttaattttgagagattgaccaaaatcccacgcactgacactaccttctgtcactatttgacctcattatggaactcacagtttacaatgttaaatcagttagcggattcaaaa

SEQ ID NO: 646940 - DNA, 140 bp, Homo sapiens
ccccacattagaagggccatatgagcaggccaatgcataaatctccgggtatagacggatccacttgtttataagcatgggacagcacaagacccacagtacgtatatcctgcatgggagggcaataatggctctagcag

SEQ ID NO: 646941 - DNA, 186 bp, Homo sapiens
cgaaaagtgcccataatggcaggtaataatgggacagtggttctggtcagtgatttgatggaaggggtgtagatatatattgttgtaaataataaaaataaaaaattgttgcaagtaatggtactactgttgcactaacccaaaagtaaaagaccaaatatttctcctactttattacttacaaca

SEQ ID NO: 646942 - DNA, 116 bp, Homo sapiens
actgatgtgtgtgatctcctgagttgatattttctgtgccaccgatgcgtgtttgaaagttccgaagtatttgtatatgatgccccatctttttgtctttgtgtctattgcggggg

SEQ ID NO: 646943 - DNA, 183 bp, Homo sapiens
agctatacaccatttaaaatcacagttacggctaggacagtagctcactggctataatcccagtactctgggcaggcaagatgggcaaatcacttgagctcagtgagttcaatgaccagactgtggcaacactggccacaatcttgtgtggtatagtggtggtatatgggtggtatagtgggg

SEQ ID NO: 646944 - DNA, 552 bp, Homo sapiens
agcgggggggcgagcgggctggccgaggaggaggcggcggcgtggtagctgcctcctgtccggcgggccgggccgggccgagccccggtgcgctgcggcgacgcctggatcctgcctccgccaggccggctgcctggtgccccgaggaggtctgctgagccccaggtccatggtcccctctcgcaggacgtggaacctgggagccacgccctcgctgcggggcctgtggagagtgggccgggccccggagcccgagccggggatggctcgccccgccacagcccagacagcccggacgccgccgtttcccacacagccggtgccggggatggttgatgaacctgggcgtggtagaaatgataccctcgagtcatgtcgtgtgacgaggtactccagtgtcgctcgaagtgcagctcgcacctagctcgtagctcagtgccgagcccttagcgtggactgggctggccgccggaagcccccacgggactctacctgatccctgcgaggtagaatcgacctgaaggagaagctcattagcaggccccaggaagt

SEQ ID NO: 646945 - DNA, 1400 bp, Homo sapiens
ccacccaaaggctccaccgtccgtaataccatcacattgaggattaggattttaacatatgaattttgggggggatgcaatcattcagcccataatcaccctctaacatattaatccatagttattatttcaactccctgtctgcatagttccaactactcaggtcaactgagtctaggtctgtatgttgtcttctcttgcatcttttcgccatctcaatcaattttaatggctcgcaatgtcaacagcatgcttagtatcgtcaggcacagtagcaacactgcaggtcaaatcagtaattcattccctggcaacacagcccatggttgccctctttgatagggccatatagtcatggaggagctctgaacatccactctcaatcagggagttcgggcatgcgatttgtgtttctattgatagccagatgattaccttatgactgtaccaatagcacttacaaaatatcctcatatagctacatcgtatatgccttgacgcgtagcgcactgaggtatttgaccacgcagcaagtcacacatactacacccacagacacaacaactatgccatcttcaggccatgcaagagccgtgtaccatgatgatgcctgcaatacttcaagaggaagcggatcctcatcacaccaaagaaagataagacctccaacatgatcaacgtagcatacaacaacacagcacacatgcactcagcaacacaaaacgacctgaccaccagcatcaaatacgacgagagcaaacagacgttgacacaggacgcacaagaccacccagaacaacgacacaacagcccccggaacaaccccacatagacgcaacagacaacgcatcaacgaaacacaaacgcagacacatcaacgtagcacaacgacgaatcaaaggagaggacaacaggagcccacagaaacaggcaccgaaaggaggcaaacgcgcgcacccaacacacaccaggccgaacgaacaacacacacaagaaacaaaagcactgaagcacacgcacacaccgaccaagcaaccacaacagcaaacaaagacagagagatgaagcagggaaacgaggtttcactcttccacccacgccaagtgggaagaagagagggcaggacagcgcgaagcgggcagcggagcaccatgaacgaaccacaggcagaaagaaataagaggaagcaaacaaacacgaggccacaagaagaggaagacaagagaaagaaacaaaacgcagcagacaagaagcagcaaagagaagagaaaacgacaggacaccacgacacggcgcgccggcatggcgcgcaccgacggagagcggctataaaccagccagccacgccgagaaagcgaagacacacgagtctatcatgcgaggagaaggaacgacaagag

SEQ ID NO: 646946 - DNA, 331 bp, Homo sapiens
  misc_feature (249)..(249): n is a, c, g, or t
aacgggctagaggactgccaggagcccagtgctgcttgcagctggagggcggttggagctacgttggaatccaggctgatgacccttgattagaccttttggggagctaagaagactcactaaacacgtacgtttgaacaaggcttgtagctacccctatgggtctacctgatggcataactatgctctgtaactgtgtctgtcaccgtgtgccggcccagcgtgataaaaattgatgaagtggcaccnccctacagaaaagggcatggtacaagggatgaggaaatcgctggcactcacattcagcacagtcagggcgcgctcggcaaga

SEQ ID NO: 646947 - DNA, 209 bp, Homo sapiens
caagaggatcccaagcttacgaggcattgcaattacatctctccacacagagctgtttctgatgcagagaaacttctcatgccagactcatgacttctggaaggggttgacctctttgtctcacagttgaaggagaccatatcaagtgaagtactgttcctgcctgaccctagccaatttactacatcacactttagacacccctcgtt

SEQ ID NO: 646948 - DNA, 1285 bp, Homo sapiens
gcagaacaaggaatcagcaaacgccgggagcaggggcctgcagttaccgctgagggcagcagtggtgctgctagcagtgaccccgtgaggtgaaagccagcggccagcactgatctgcacgagagacgtcacaccaccttatcaaaacatggccggacgtggggaggcatgaggagtggcatggagtgaaatcatattatggcatctcacaggccgagtcgggtccacgcgcgcactctagtcgaagcattgcaggtctccaagaggtggactcgtaggactccacatttatgccgcacacctcgaacagacatcaatacctggttcaaaggcacggggctgtttcccacacggacaagttcaccattcaagggttttccgtccatggcaggggatccacgagccactctgccgtgacataatcaaatactcccatatccttataatattacctccagcgacaaatacgcttccattttctggttcacctgtgtggggggtatcaaaaacacaggtaaattggaaccaaactggcgcacacccggactgctcctatatgcaacaaagtcccttgcttcaaatttaggactttcctcggtggcatcaagttaactacaaatacatagcgcacccgcacagcaaatagggcgggccagaacatcccgcgggcggcacaaccacagacccaaccaaaaccccacgtttcccctacataacgccgcgtgcatacactggagactccacaaaaacaacgctgcagaacaccaggaaacaggatccacgcccatagcacccaagcaaacactaggcacatacaaccagacgccaagctgagaggactacacagcacagaaacgaaccccaaagtggaacgaggatgccagccacatcggacctagcccccaacatggacacagtacagagaccagaaccaatgagcaatatacacaacaaacctgacaccggccccacccacaggcagtaacagaacgcgcccgccagacccagacacacaagcaacggatgcaccaacggagccctacctacacccagacacaccaccctacaacacccaaggcctcgcaccccaaccagacagaaaaacagaaccagcaccaacaacaagcacaaaccacacccatccgcaacccccacaacagcaacgcaacacaggacccaacaccccccacacccacgccaccccgcacctgctacaaacacaccacaccacaacacaacccaccaccccaccaccccacagcaaccgacccacccactcaccacc

SEQ ID NO: 646949 - DNA, 393 bp, Homo sapiens
ggttctgatgctcttccgggagaaccgaggtgtgtgacaatttgacgctggatgctgctacccccggcactgccacagcccacccccagccctcggccactgcttgcactgaagccagagcccaccacactgagcccaccacctaggccgacacccccactgctgctggagtagtagcttccactgctacctccggcaagacctccaccgaggccgccgccaagacctccaccgaggccaccgccatagccactgccactgccatatccagaggaaacactgcttgtgacaacagagatgttgactggtccaactccttctccactgagtctgcattcctcgccctccagcagcttgcggtaagtggcgatctccacgtccagggccagcttg

SEQ ID NO: 646950 - DNA, 120 bp, Homo sapiens
atccgtcattagaggatccctaaaggcgagtcctgggtaagactggagatcatccctggtgtgctgtccatctgacgaagtccatgatgctggacattgagagcttctcctatctcaacc

SEQ ID NO: 646951 - DNA, 1080 bp, Homo sapiens
  misc_feature (1)..(1): n is a, c, g, or t
ntttgaagggggcgatttgacaaactgtttaaacgcgctttcaagtaggggcttttcaaagacgtcccccaggaggggaagtgcagaaaaaaggttgctttcaatcgaagaggtgccaaattttttgcatggccaaccaaaatttagtccttgcagtcctggagtttggaaacttctaggttgctacctatgggcaactttggtttaagggaccatctccacatcaagtgtaataaactctcctgtccagcaccatttacgtggagcccattccacggttgtatgaattcctttgctaccacctccaggaaaagaacagtatccccgtgtatcttttagcttcacttacaccactagtaactagtaggtaattaatcccaagcaattgcggtaatcccccccagtaccctgcaactgttttatctgtttgggactcccaagctgatgcattatgccttccaaacccagcccgatacatggtgaggtggcgacattgaaaaacttgcgagcaacaaaccctcccgggaaaaagggcgtgggaaaaagaatgaaaaaaaaagtatataataggaaaattcttgataacactggaatatgattaaaagcataaagagtattttagggaaagacatttctatatgcgcgagggagtgtggtaacataaaaggattatagagggtataacctcatataaggagtggagggcattctgaaaatatcgagcggagaggaggtaatcaacccctgagagaggagacttgagaaatattgtaggacgtaggatattccctcgttgtaaatgaggaaaggctgaagactcactgcaaatcgagcttactggataatgattccggagaaaggcctgactataccaactttgaacacaaatcggaccaagatcattccactggctgatgcttctaataatgatgaatctacaccttcgacccacagaagtgcactcattgtgcactatttctgaagccaggaaacaataaaagcaggcagaataccacctttaggtgaacgttcaatcccagaaagcatgttaacataccaagaggggcaattgaaatatca

SEQ ID NO: 646952 - DNA, 263 bp, Homo sapiens
acgattctggccgctctcggggtgctactgcgggagcagaagcatctactacctaggaccagctcctgacggtcagcatgatcatcgtgcaccccccgttctacaccgcccagatcgaagcgcacttcgccctgctgcagcttgagcatctggtcatggtctccagacctcgctccagcgactcgtcaccctgccccccctggcctcatatgcagcttcccctctgggcatgccgtgactgggtcactgcgctggggactgca

SEQ ID NO: 646953 - DNA, 255 bp, Homo sapiens
atgtggggccatccagtaccgcatctccctgcagtttgacttctttgagacagagggcaatgatgtgtgcaagtacgacttcgtggaggtgcgcagtgtactccacagctgactcccaaagctgcatggcaagttctgtggttctgagaaagccccgaggtcattcaaccttccccagtacaaacaaacaattgcgcattgggcccgaccaggaaccggagctccgaattcggtaaatcattggtccatagcctt

SEQ ID NO: 646954 - DNA, 278 bp, Homo sapiens
atggactcttagaaaagcttgtaaatgcctatattgtgggcttttaacagtatttaagggaccacttaagacgagattagatgggctctcatggatatagttcctcatttgtcacaggtgtcttgtgattgacaatcatgagcgaagtgaaatagcatagaactacaagggaatttagtatgtaaatcgtgcctttactacatgtgtgatctgcaaaccctgcttggttctgagctgcgtctattgaattggtatagtaataccaatggctttttatc

SEQ ID NO: 646955 - DNA, 416 bp, Homo sapiens
ttgagggaggaaggagcaaccagaagaggaagaaggccaaaaagtgacattgccaaagcagctgcagcagctgctgctgtagcatcaacttcgggaatcaacccactactaatgaacagtctgtttgctggaatggacctcaccagcctccagaacctacagaacctgcagtctctccagctcgcaggcctcatgggctttccgccagggctagcaacagctgctgctgctgggggggatgctaaaaatccggctgccatgttgcctctgatgttgccagggatggcaggattgcccaatatgtttggactaagcggattgttgaataacccaataacggctactactggaaatgccactactgcttccggtcaaggagagactgaggatggcgcttcaaaagctgaagagaagaa

SEQ ID NO: 646956 - DNA, 129 bp, Homo sapiens
tatacattatttactcaaatcctaacctatctaactcagaattgctgtatatacttaatcactattatattgggctcattatttatttatttatttattatatgggcggggcggacaaaaataaaattt

SEQ ID NO: 646957 - DNA, 936 bp, Homo sapiens
  misc_feature (686)..(686): n is a, c, g, or t
ggagagaactagtctcggttttttggtgttttttttttagctgctgaaacagacactcattaatttccccaaaaggaggcaaaagggggtcctgggggagtctctgtcccagcccggacaggcagatctcatttccagaaaaagcaattccaaaaaagcgccagcggggtagaggcccaggacagagggggaagagcagggcgccgaaggtgtggtgctccagcacacccggggctagcgctgccaggaaaagctgccagccctcggccagtgacaggggcgcctccgtgcagctcccgccacaggaacaggctgccaaggagcgtggctgccgggctggtcagaaccagcagggcagatagagggtccggggcccatgaggcttggcaagcgcaagcaggggggcccctgggtggtgggccatgaggaagcccagtgagaatgtggtgaggcgcgaatgcagcccagctgccgtcgtctaggtaggatcagggctaccactcttcagtgccatcaagcccctgtttgggggcctgtgtgcttaccacccgggtggttctggtgcggcccggccggcatgtcgttaattcgcagcagttggtcgccaaagctcagccttgtgccagtggaaagtgcgtggggggcacagtgttggcccaacagtgcagagacatataagtgccaanatcccaggctggcgacatacacgcaaaggttgccaaaaaggaggaaaagcccaacccgtgtaaggggagacgagaccacggcgaaggtgaacccccggagcccctagggcacattcaaagcataacattgtgcacaacagtaacaactcatgatacatgaacacacacaacaaggaggttaacaacaggaaaacagagagggcacgagctccgaacaatcgactacaccaagatcatgagaagcacacac

SEQ ID NO: 646958 - DNA, 388 bp, Homo sapiens
ccatgaggcaggttcacaacggattgcgttcgcggcgcaattgtatgtaatgggccagggaaaggcaggatccagtgagatatccttgggtatacacatgcgtggagaaagaaacatagatgagatagggtattggaccatggaaaaagttaacagattgatctagacgaaaaagttggataaatatgagaaaaagaacacgacacggacgccgaaaacaacacgtacaacatacagcacacagagcccgcaggacggccgcgaggaagcacaagagcagccaccacacgctcggcctcggcccaactgaagagggaaaagaccccaccgagcaaacaggaccaccccaaggaacacccatggaagcaactgccgccacacaggaacc

SEQ ID NO: 646959 - DNA, 491 bp, Homo sapiens
aacgcaatatgtgctctagaaagcaggatcacacaccaagcgggaggcatcgtgggaaaaaatgttgggtgatgggtggatgcttgacctgctccctgggtaacagggcctgaaccaataagggagagagattgatggtcatagctgatatcggtcagaccgtaagatctagtgttgaaagtgaatcacatcattcatctgatcaaaaccctcgcagagctcccatgttccttgggaaaaaaaacacagttcttttaacagcctgcaaagtcctctgtgacctgtgtccccgttacttctcacttctcacctcttagttatcacactctctgctctaggcatgctggcttctatgctgttccaatacccctggaattggaacctgagacctactatagactaaatgtttgtgtccccctaaaattcatatgttgaaacctagtctccaatgtgatagtatttggagagtgagcctttgggagctgaggagg

SEQ ID NO: 646960 - DNA, 1627 bp, Homo sapiens
  misc_feature (1278)..(1278): n is a, c, g, or t
  misc_feature (1321)..(1321): n is a, c, g, or t
  misc_feature (1360)..(1360): n is a, c, g, or t
  misc_feature (1467)..(1468): n is a, c, g, or t
  misc_feature (1484)..(1484): n is a, c, g, or t
  misc_feature (1505)..(1505): n is a, c, g, or t
  misc_feature (1544)..(1544): n is a, c, g, or t
  misc_feature (1571)..(1571): n is a, c, g, or t
  misc_feature (1575)..(1575): n is a, c, g, or t
  misc_feature (1577)..(1578): n is a, c, g, or t
  misc_feature (1592)..(1592): n is a, c, g, or t
aacggctaggtagcgaggctgggtgtcggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccagtatggagtttgcagccatatgtctcagaaatgccttgttgctgctacctgaagaacagcaagatccaaagcaggaaaatggggctaaaaatagtaatcaattaggtgggaacacagagagcagcgaaagcagtgaaacttgcagcagtaaaagccatgatggagattaaattcattccagctccaccttcttctccattgagaaaacaggaattagaaaacttaaagtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggatcagacaaaggtgaaaatgaagcaatggaatcctctggtaagcgggcccctcagtgctaccccagttccgtcaactctgccaggactgtgatgctgttcaaccttggcagcgcttactgcctgaggagcgaatatgacaaagcccgaaagtgtctccaccaggcggcttcaatgatccatcctaaagaggtgccccctgaggccatcttgctggcagtctaacgttgaactgcagaatggtaatactcagctggccttacagatcatcaaaaggaatcagctgctcccctgcangtgaaaacacactctgaagtgagaaagaagccagtgttctacngcctcgtccacccgatccagcccatccaaatgccggctnttcaccactgtgcagagaaagtgatacttcacttttggaaaactgttacctgagacccaggggagaatttactggccattttagttgtatcacagcagaatgaatannagatggtgaaggctgntaattttgagtcaattctacncctgacttttggccaaaagcttacttaaaattaaggatntactaagtcatcatcagctgtttttcntaantnnagccagctattaantttgagccattatgtaatatatgccataggcaatt

SEQ ID NO: 646961 - DNA, 136 bp, Homo sapiens
cactacaagcggtacgatgttgtcattgctgtgtgggctgaacagaaagtctggtgccacttcacctgggtcgcggtgtgaggcagtttcgagttgatcttgctgtggtgaaagcgcgcgccattgctgcgcatga

SEQ ID NO: 646962 - DNA, 167 bp, Homo sapiens
  misc_feature (160)..(160): n is a, c, g, or t
atcctctgtatcattacttacaagttgtgtcccttcacccagcctcccccaatggcaacatcttgcaaaactacaatgtagtctcataaccaggatattgacattgatacagtgaagatacaggacattctcatcaccacagggatccccagagagccgngaattcg

SEQ ID NO: 646963 - DNA, 766 bp, Homo sapiens
  misc_feature (480)..(480): n is a, c, g, or t
gaagaagaggggtcttattgcagagaggttggtgctccagagatacagttggtcctacgattaactgaatattctctaacactgagtggtatggaatcctactgcgttcgaatggtttgtgcatgatgtcatatgcgacgagtacatctccatcataacatcgtagtctgatccttgccaggccgtagaatcccattttctacattgtaaggcgatgaattaagacaaccggcaatgcctcagggataaaaaacctgtaggacattgaaatggtccgcaagagtggatgtgtacttgtccaaacattttcggagtgcaatctggtattgctgccagcctctcctgatcggcgtatacatgcatcagatgtgcatcctggagcattcctatgcatacctgaaaaacctgttttcgagcagtcatttcctgcaaaaatatgcactgatgtgggttaaaacagcatcgtactaaagtctggantcacctggacttatcaccatgttatgattcaccatggtattagtcgcgcatgggcaagtccgcgaaggagagggacttctagccattttgaggtggtttaccctattgatactatggtacagcgaatttatttcctcccttccttgagagttcatcctgtgagggcctttggcgttcggatcccaagatattgcgcctactttttgactcatcgcagagggatcttgttcacttctggaaagaacaaactttctaaagtggacctccattgttttcactcgcttct

SEQ ID NO: 646964 - DNA, 2052 bp, Homo sapiens
  misc_feature (1703)..(1703): n is a, c, g, or t
  misc_feature (1746)..(1746): n is a, c, g, or t
  misc_feature (1785)..(1785): n is a, c, g, or t
  misc_feature (1892)..(1893): n is a, c, g, or t
  misc_feature (1909)..(1909): n is a, c, g, or t
  misc_feature (1930)..(1930): n is a, c, g, or t
  misc_feature (1969)..(1969): n is a, c, g, or t
  misc_feature (1996)..(1996): n is a, c, g, or t
  misc_feature (2000)..(2000): n is a, c, g, or t
  misc_feature (2002)..(2003): n is a, c, g, or t
  misc_feature (2017)..(2017): n is a, c, g, or t
gcgattttgccatgttactcaagctggtctcgaactcctgggctcaagcgatccgcccgcctctgccttccaaagttctgggattacaggcatgaaccaccatttcccacaaattctacattttgaaaatgctctctagactggtaataacaacaacaaagatggatctaatcataaagctgaaagtggagctctaatagaagctgcaaaatcaaagatacatcagtacaaagtacgagcttatatccaaatgaagtctctgaaagcatgtaaaagggaaatcaagtcagtcatgaatacagctggaaattccgcaccctctctctttcttaaaagcaattttgagtacttaagaggtaattatcgaaaagccgtgaagctattaaatagttcaaacattgctgagcatccaggattcatgaaaacaggtgaatgcttgagatgcatgttctggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccagtatggagtttgcagccatatgtctcagaaatgccttgttgctgctacctgaagaacagcaagatccaaagcaggaaaatggggctaaaaatagtaatcaattaggtgggaacacagagagcagcgaaagcagtgaaacttgcagcagtaaaagccatgatggagattaaattcattccagctccaccttcttctccattgagaaaacaggaattagaaaacttaaagtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggatcagacaaaggtgaaaatgaagcaatggaatcctctggtaagcgggcccctcagtgctaccccagttccgtcaactctgccaggactgtgatgctgttcaaccttggcagcgcttactgcctgaggagcgaatatgacaaagcccgaaagtgtctccaccaggcggcttcaatgatccatcctaaagaggtgccccctgaggccatcttgctggcagtctaacgttgaactgcagaatggtaatactcagctggccttacagatcatcaaaaggaatcagctgctcccctgcangtgaaaacacactctgaagtgagaaagaagccagtgttctacngcctcgtccacccgatccagcccatccaaatgccggctnttcaccactgtgcagagaaagtgatacttcacttttggaaaactgttacctgagacccaggggagaatttactggccattttagttgtatcacagcagaatgaatannagatggtgaaggctgntaattttgagtcaattctacncctgacttttggccaaaagcttacttaaaattaaggatntactaagtcatcatcagctgtttttcntaantnnagccagctattaantttgagccattatgtaatatatgccataggcaatt

SEQ ID NO: 646965 - DNA, 319 bp, Homo sapiens
gaaacacgtgagggaaaatgatcaaaagagaaggaaacggccaggcacggtcgtcacgcctgtaatcccagcactttgggaggctgaggcgggcagatcacctgaggtcaggagtttgagaccagcctggcccacatggtgaaaccccgtctctactaaaaatataaaacttagccgggcatggtggcgcgtgcctgtagtcccagctacttgggaggctaaggcaggagaatctctagaacctgggaggcgaaggttgcagtgagccaagactgcaccactgcactccagcttgggcgacgaggatcactccatctca

SEQ ID NO: 646966 - DNA, 1526 bp, Homo sapiens
ggcctggcctcccacttggttgcggcctggcctcccacttggttgcggcctggcctcccacttggttgcggcctggcctcccacttggttgcggcctggcctcccacttggttgcggcctcccacttggttgtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggttaatgaggacatctttgatcagaactggtcactgtttccatttccctcctgtcataattcaggatgtgtggaaatttaggcatggtggtaatgagaagaaagttttaggttggctttccacatttttgtctgtacttactttgtagcagttgtttgctaagtagacctgagagttaatgatcacatcatctaaattctcacttttgaaaggctggtactgttagaatggttaattttggttctgatactatttatttgttttcctttggagtgattctaaaatccataggggagtaaaaatattgcattcaagagtcagttttagtccaggcgtggtggctcacgcctgtaatcccagcactttgggaggctgtagcaggagggtcacttgagcccaagagttcaagaccagcctgggcaacctggtgagaccctgtctctattttaaaaataagggacaaacaaaaaacacaacaaaaaaaaaacacatggaggacagcacaggccacgaagaaccaccaaaaacacaaggaggggacgggggccccaaaggaaacagaaaacatgggcacaaaaccgtgttccaaagaaaaaccaggagagagaaaaaaggacgggagattcacaccacaaaaaaaacacgcccggggggaaacagcgcggtttcgaaacaaaacacaaaagaggacaacacagagaaaaaaaagagagacataaacaaagggagagacaaaagagaagacaaatcataaaaataccccgacgagtgcggaaaaagaaaaacaaaagaaaaaagaaaaagagaagaaagacacaaaaaaaagaaaacaaagaagaggagcaagacaaaagaaggaagagaggagaggaggagaagaggagaggtaggcaggaagcaaggagaaagaggacgagaagcgccgaaagagaaagaggaagatacagaaaaggcaagggaaggagaagagaggacaagagaaaaaagagagaaccgaagaaaagaaaagaaaaacagggggagacgaagagagagaggcagaaaaggaaagagggaaggaaagcggaaagcagagagaaggaacagaagaggagagacaacgaagaagaacgaacgacgagaggacgcacgacactaagcgagaggagct

SEQ ID NO: 646967 - DNA, 496 bp, Homo sapiens
ggtagtgatctagaggatcccggaagcaactgcacaaagataaagacaaagagtatcattggaagaaggggtcagcggctcctgcttctagtgaaaaagggccctgagctttagtgcccttggtatttattgggtaaaggagatagggagaagggggggtggttgtcggtcagcagcttgattcacagcaggctcacaagatggcattcttggaacagtaggctctagatgtctcagtagataacctcaaagagcatggcgccagggagtgattgccctcagcgaaccttctggcggctgaagcagaagtgagttggcccacattctgcacttatgataaacagttggctgtttgatcatatagcctcagtggaatgctgagtgggtcacaacccatgggcattcagctctctacatttccccctttctgtttatgaattaattgaaagaatgtaaggccaggctgggcagctctcattttctgatgggcagtcca

SEQ ID NO: 646968 - DNA, 991 bp, Homo sapiens
agtgggtaccgggacgccgtgaggcggaagctgtgtatggcgggaggctgtggcggtcccttggtggggaagctgttgctgttgctagacgacgggaactagctctcgtcacttcctcagcccgccgtctgcccactcctctagccggaacctgggggcccggagccggggtaggcacagagttgtcctcggaggtccaggacagcggccagcccggcggcgggagtcagggccacgccacctgcagggaagaacccgagtcgaagcgggaagatggctgcagacaagcctgcagatcagggagcagagaaacatgaaggcacagtctggaaattatgatgcctgtctacaacaccttgcctgtctacaagatataaacaaagatgattataaaataattttgaatacagcagtagctgagttttttaaaagtaaccaaacaacaacagataatttgagacaaacacttaaccagctgaagaatcaggtccactcagctgttgaagaaatggatggattagatgatgttgaaaacagcatgttgtactataatcaagcagtcattctttatcatctgcggcagtatacagaagccatatcagttggtgaaaaactttatcagttcatagagccttttgaagaaaaatttgcccaagcagtgtgtagagggaaattatagcactaaatgcccacaggagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacgcttcaaaaaatcagtgaatccaggagctggtttcttgaaaggatcaacaaaactgatagaccgctagcaagactaataaagaaaaaaagagagaagaatcaaatagacacaataaaaaatgataaaggggatatcaccactgatccca

SEQ ID NO: 646969 - DNA, 571 bp, Homo sapiens
atatttaaaaattgaatctggccgggcgtggtggctcatgcctgtaatcccaacactttgggaggctgaggagggtggatcacctgaggtcaggaccagcctggccaacatggtgaaccctgtctctactaaaaatacaaaaattagccaggagttgtgtgccgtaatcccagctacctgggaggctgaggtaggagaattgcttgaacctgggagctggaggttccagtgagccgagatcgcaccactgcactccagcctaggcaacagagtgagaccccatctcaagaaaaaaaaaaattggaatctatctcactagagaacaggtgaactagccctcctaaccggaccaggcacaagacaagaaattctagcctatagatccccttccaaggtgccagtgaggacataagccaaacggtatacggcctccaaaggattacacacttatggccccggctcatcaatctggaggacgtcacggattcttttccacaacggtatgccaaatgtcctagtcaacggatcttcaaaggtgtcaagaccttatgaatcgggtctatcagactaa

SEQ ID NO: 646970 - DNA, 111 bp, Homo sapiens
tgataccccttgaccaagaagaccctcattggggtctatgattgggacccctttctgtaactatcatgctactgcactccagcctggtgcaacagagcaaggacctgtctc

SEQ ID NO: 646971 - DNA, 318 bp, Homo sapiens
cggagcccaatggctaggtttagaaatggctttctgtcccacccccacccccccaaatggtcaaaaaaatcatgtaatttctccaaccttccatgtctaaaatggtgacgattccgtcatatgcacggaggatcaatgagctaattcctgtggatttcagacaaatgatcagaaatgtcacccgttcgtttgttctcctaccagtatgtgctgtggtggctgatcttatgtgtcacctttgcctggccatggttcccagagacctggtcagccactgtggaagtttttatgatggtgcagtaaatatgtgggcaaaat

SEQ ID NO: 646972 - DNA, 249 bp, Homo sapiens
cattccgggggaggagtggaactgctcactctgccagtgtgctccctgtacctgaaggaatgaggatggcagcactcaacctggatggtgcagacagcgacttggcgttgtggccaggctctcaccagccaaccagcggaaatgtgagcgtgtactgctggccctattctgtcacgaaccctggcgccccactgtgatcagctggctaccgactccaccttctccccggaccagcccggtacatgcaag

SEQ ID NO: 646973 - DNA, 776 bp, Homo sapiens
  misc_feature (297)..(297): n is a, c, g, or t
  misc_feature (300)..(300): n is a, c, g, or t
  misc_feature (306)..(307): n is a, c, g, or t
  misc_feature (311)..(311): n is a, c, g, or t
  misc_feature (314)..(314): n is a, c, g, or t
  misc_feature (316)..(316): n is a, c, g, or t
  misc_feature (340)..(340): n is a, c, g, or t
  misc_feature (346)..(346): n is a, c, g, or t
  misc_feature (350)..(350): n is a, c, g, or t
  misc_feature (358)..(358): n is a, c, g, or t
  misc_feature (370)..(370): n is a, c, g, or t
  misc_feature (512)..(512): n is a, c, g, or t
atccacctgggggggctttcagactgcccctgcccgggcctgtgcccggaggtggtgcccattagctccatggataaggtcgccggggtcgtggttgcacgccactgcaggaccaacatggtcccagcttccgtggacgccattaattttcatgacaagatcagaaaagggtgcgtcatcaccatctcgggaccgcatgaccctcccgagcaataagatccatggagatcgaggtgttggtggacgccgaccctgtttggcagcctctcaaaagcgctaccgggccccagtgccttnttnacctanntgtngtnanccaggaaggcaggtcctgcctgtnccccanctgntgccccanacccaggaccanaaaaagcgcttttaggaaggcaaagggcggttcctgcaaattaaggcgaaacgacagggccccgcggagcctcagccctagactccctcctcctgcccctggtgcctcgagtaaccatggcaacgggcccagtgtccagtcncttaaaagttccccccttggcccaaaaccccattcccattgaaagctggtgttgtttgaagtttttgtatcccagtgttaacctggactctttcctgcaaacctacccccccaagctttttttatatccttccaggatcaatgctacccagtgttgtccccagcgccgggaggggttgggcaaaaaccctcgggaatgcttccgagccccctgtagggtatgggaagaacccagcccccctaataaaactgctgcttggctgga

SEQ ID NO: 646974 - DNA, 101 bp, Homo sapiens
atgtaaccactggcctacaccacagccagagcaacgccagatctgagccgtgtcttgcgatctacaccaacagcttaaggcaacaccagatccttaaccca

SEQ ID NO: 646975 - DNA, 150 bp, Homo sapiens
ttatgcctgctcggctagcaaagtgctcgagattacaggcatgagccagcacgcccttgctgcacaccccctttctaagtatagaagaatgtggaaggggtgtagtgggtatcatttacaaaacaaaatacacgcatttccacgagatca

SEQ ID NO: 646976 - DNA, 782 bp, Homo sapiens
gggcctgaggagcgcggagcccggcgctcgtgtccggcgccatgtgagggggctcgggggccgcggtggggcctgggctgctccccgaccggatgatgaggaaactgaggctcatagaggtcacatggcttgctcgaggccccccaggcagtgtgaacccactagtcccgtgcccccagggtcaactgcaggagcgccgatacctacccctcagcagacggcggagagaaatgagtagcaacaaagagcagcggtcagcagtgttcgtgatcctctttgtcgcctcatcaccgatcctcgatcctctacagctccaaacagtgccaaatgaggtcttccattacggctccctgcggggccgtagccgtgcgacctgtcaacctcaagaagtggagcatcactgacggtatgtccccagttctcggcaacaagacacatgcctctcggtgccagcagtgtgtgagttgtcagcagctccagccacctgcgtgggcgaccaagctgggccctgagatcgagcgggctgagtgtacaatccgcgtgaatgatgtaccaccacctggctactcagcgtgatgtgggcaacaagagcactacgcgtcgtggccattccagtgtgttccgcgtgctgagtgaggcccaggagtttgtcaacggaccctgaaacgtgttcatcttctggggggccccgagaagatgcagaagcccagggcagctcgtgcgtgtgatcaggaggcggctggggttcccaacatgggagatttgcggtctccggcgatgtg

SEQ ID NO: 646977 - DNA, 969 bp, Homo sapiens
  misc_feature (771)..(771): n is a, c, g, or t
gaaactcatcactagacattcttactaaagacacgtactacgttgtactcacttccacggatgtgctatcactaggagctgtatagccatcataggaggcttcattcactgatttcccctatatctcaggctacaccgtagaccaaacctacgccaaaatccatagcactatcatatcatcgggtaaatctaactttcttcccacaacactttctcggcctatccggaatgccccgacgttactcggactaccccgtatgcatacaccacatgaaacatcctatcatctgtaggctcattcatttctctaccaggagtagtattaataatgttcatgatttgagaagccttcgcttcgagatcgacttagtcctaatagtagaagaaggcctccatatacctggagtgactatatggatgtccccccaccctaccacacattcgagagaagcccgtatacataaaatctagacaaagaaaggaaggaatcgaacccctccaaagctggttgtcaagaccaaatcgccatggtcctccaatgacgttgttctcaagaaacataatgagaacggacatttcgggttctgtatgttggagagggtggcccatcctggggtactaactgtccgccctgtgggtcgctaggggtgtgaccagagcccaaccttctgcctctgactccatgagtgagtcaagccttgcggggaggtcagccctaattaagcctgacgttttgattggaccttggcgcgaataatggcacggggttanacctaggttaagaacagcacggaaaagagaaaaggggctgttgacacacccggtaaaagggtagacttttgggcacgcaagccacccgaattgaagattttcggtcacatgtaacaccaaaccctttgttgtctgacagccactgttttctacacgacccagttatgcttccaaaggaaccagaaatagtaagttcct

SEQ ID NO: 646978 - DNA, 466 bp, Homo sapiens
  misc_feature (9)..(9): n is a, c, g, or t
aaggatganataggagccaaggtatgctatgagccaaggattatgagtaatccagttttgtgcactttaagccatttgaaaaacagaaaagcaaaacaacaaaataatttttaagaaattgaatatagggtgttatgctctgaatgtgtccccctaaaattaatcaccaatgtcataagattaggaagtagggctttaaggtagtgattcagtcatgaagggagagtgttcacgaatgagtttaggatccttacacaaggactggatggagtgggcttcccctgttttgcccttccaccttctgccatgtgaggacacagtgcatctcctcctgaagacacagtgcacaagataccatcttggatgcagagaccagaccctcaccagacaccaatcctgctggcaccttgatcttggacttctagcctatggaactgtgagaaatacatttctgttcttcagaaaa

SEQ ID NO: 646979 - DNA, 130 bp, Homo sapiens
  misc_feature (52)..(53): n is a, c, g, or t
  misc_feature (63)..(63): n is a, c, g, or t
tcggctcggtacctttaaagcgtcatgctggcgtggctatcgattacgcttnnttttcacganccaggcatcctgccagtggaacccacgcccggctcaaagtgagtgcgccgctgttccactgcatgca

SEQ ID NO: 646980 - DNA, 84 bp, Homo sapiens
tccgggtagtggcgacggaccgtttactgggctactttccttacttttatttactaccacacaccctacgatctgggcttacac

SEQ ID NO: 646981 - DNA, 367 bp, Homo sapiens
ccaaacccctgaccaattggatggggcccccccccattaagggtgggggtccctctattaaaaattttaacaaaaattttaactgtgaaaaaggccctgaatttttgttgctaaaaatttggtaaaaccccttttaactaaaaagtgaggacgtggaggaactcctccattttaggctttcaaacgtaacaggctttttgggggggggggggggggggggggggggggggggtgtgttttttttaaaaaaaaaggaattcaaaccctgggattaaaaggtatgttttcttaaaaaaaatttatgaatgaatggataaaaaaaattccgggaaaaaattttaaaaaaaaaaaaagtttgtttttccca

SEQ ID NO: 646982 - DNA, 523 bp, Homo sapiens
  misc_feature (11)..(11): n is a, c, g, or t
  misc_feature (17)..(17): n is a, c, g, or t
  misc_feature (96)..(96): n is a, c, g, or t
  misc_feature (199)..(199): n is a, c, g, or t
  misc_feature (208)..(208): n is a, c, g, or t
  misc_feature (248)..(248): n is a, c, g, or t
ggcagccctgnggtggngtcggctcttatagctgaaacctaaggctggcgattcttcttggaggcgtggtaccacttggtgcttccgacgtacccntctggccctagttgaaaaacggagccatactgctgtgtgtagcgcgtcatttttaaggtttgcgagtatattttattttccctaactttattaagatctcaanttgaatganttgcgtggcctctttatcccctcatcaacggctgccttanggcttttattctactgttttattactatctatcctcctcctccctcagtctatcttatttttggatgctttcaaagtgaatgtagcagatttcaccagttaacttcataatattttatacacttgaagtctagctttttgaacagtacacaaatgtgactaaattgctatagatgctgttaaagaaggtataaaataaatgccccagttttggaaaaaatttaggagccttattttaaaagtaacaggtattctggaatcctggcatggagttgg

SEQ ID NO: 646983 - DNA, 370 bp, Homo sapiens
agaactcaagcagtgtggcattgcttcataaacatcttcagctcttgctgcctcatgccacagatatttattcacgttccgcaaatttgcttaaagaaagtccttggaatggcagtgttggagaaaaattgagagatgtgatctatgtgtcagctgcaggcagtatgctctgccagattgttaactccctactgttactcccggtgtcagtggctcgtcctttattgagttacctcctcgacctcttgccacctcttgattgccttaatagactcctgccagctgctgctcttttagaagaccaagaattacagtgggcctcttcatgggggggccagaagtaattgacccagctgggtgtgccaattac

SEQ ID NO: 646984 - DNA, 103 bp, Homo sapiens
agtttcactcttaaagagtggctggagccgaaggtatagccgagattaatgctcctttttctttatctgatctcggcttagtggctgaagactgacactgccg

SEQ ID NO: 646985 - DNA, 892 bp, Homo sapiens
cgcgccctccctccccatcccacccccctccttcccctcgatccagccctcatgaccctgaccctggccgcggctgcaggcggctcgcccaggcgcgcagccctcggtcccacctccctctggctcgggcctgagcattccgcagcctcggccggcccgggcctcttctccgctgctctgctcccccaaggactttctgtgccccactcctacccaggcagggctgccctgtcttgggtcctttacgggggaccattccccagcgtccctgagacactcatcctgggatttcttcccctaaatacagacattctcaaaccaaatgagacctcgaggtccctacacctgatcctgcctcccactccctgagccacactgagaaggaaggtctctcctttagggaggactctggcgcctgcaaccttgatcgacagcaaagatgtccagtgtgtatcctgcatctgcctttcctgaccattcctcgtgccccattctccgtgggatagattctcatggggagtgggggagccttcgggtgtggcagaacggcatgatggaattcataaggtgagcagaaactcaaggaaaactgtccaaataccggctcgactcctgggtacgctggagcaaggatgaagaagctctgagactttgcacgtcagtaaccaccaacaccatgcctctggttcccacactgcagggatcacctgaagtagaggatctcatgtaacttcatggctctctctgaacttctgtttctttatctgtaagatggggacatgtaacttcatggctctctctgaacttctgtttctttatctgtaagatggggatcagaaactctgtcttaaggagttgttttgaggattaaatgaagaaacatgaaaagcaa

SEQ ID NO: 646986 - DNA, 764 bp, Homo sapiens
tacagcagacgtaaaaattcaaattattttaaaaggcaaaatctatatacatatgtgcttttattctatatctcaccttcccaaaagacactgtgtcagtccatctgtcgtattttcttacacgagggagacaaattatttgcaaaactgtgctaaagtcaatgatttctacgggattacttgacttctgcttatggaaaacaaagaaacagacacagctgcacacagaaaactatcagcatatggagagacttattcaaagtgacaggggacacatcatatttctgcattttacttgcattaaaagaaacctctttatatactacagttgtccctatctctcccccgacccccaccgacccaccacacacatatattacagtttatcctttcataacgaatatctccgtaagaccaatacctgggcatgagaagaatcctgagactgcctggaggtgaggcagcaacattagaaactacttcctaattcttctcaaggctgctggcaaactatatctcacactatcggagcagtacacatgttacacacctggtcgagcacgacattgctggatctcctggaacaaatactcaggtaccatccatcctcacagactggcaccggagaccaggcatgaagagaaaacgcaacacccctggacccacaactgcacaaccaggaacacaatacccaacatgcaaaaacacccatcaacacaacagaaaatcaaaacgaaacaccacaagccaccaacagagcaaaa

SEQ ID NO: 646987 - DNA, 344 bp, Homo sapiens
tttatacgagagtgagcttcccagtgccaacgtccacataggacagggtgtgctatccgccagtgctcctcaaagggcttcttctgttagccccgtggatgggcttggagtaatcgtactcatcaatccgcaccttgtagtcttccctggcatgctgcgccccgtgactccttccgtgcctctgctccgtagatcgtctgcagcgcacacagcattaggttctgcagctccagggtctccaccaggtccgtgtcccagaccattccccggtcgaacgtcttcaggtgcttaaggtctccatagagcttgctgatttaccaacaaaccttcttgcaacaacggct

SEQ ID NO: 646988 - DNA, 158 bp, Homo sapiens
tcatagctgttctagatgtcccggatagctggagaagcgtggcctgtagatgatgatgcatgaggcatatggacaacagatagatggatagacgtgagaggtcagtggacaccagactggaaagatggaaaggtcagtgtgccaacagaacagatggg

SEQ ID NO: 646989 - DNA, 400 bp, Homo sapiens
ccactattctggtaagccaacacactccataacctgacccttagagtgcatggaggacacggggccagtcctgtccttggcacagctgtccaggccaccacactgcttctctggatacgccagggcgcttgcccgatccatcatcatcggtggaaagcacattaatactctgatctttgccttataacttattatttatattgaagtattttttagctgttttttagattgcccttacgagctagagttattttcacagttgaatatttttacaagtatgtcccaatcatttcagcattatatttgtttcttttagtaaagcttttaagtggatgtcactatgcaagagaaacacagttcaaaatcataccgtcatacatataccttgcctttggtagtg

SEQ ID NO: 646990 - DNA, 147 bp, Homo sapiens
tgcaggtgattctagtaggatcccacaattggattgttgtaatgaaggataaatgctcgagggaatggctaccccattctccatgatgtggttatgtgcactgaatgcctgtttcaaagtatctcatgtaccccataaattatttca

SEQ ID NO: 646991 - DNA, 277 bp, Homo sapiens
  misc_feature (5)..(5): n is a, c, g, or t
ttatntttattatttttttcttttttgagatggagttttgctctgttgcccaggctggagtgcagtggcatgatctcggctcactgcaacctctgtctcccgggttcaagtgattcttctgcctcagcctcccaagtagctggtgtgtgcctgtagtcccagttgcttgggacctgaggcagaagcattgtatgagcccaggagtttgaggttgcaatgagctgtgatcaagccattgtactacatcttgggcaacagagtgagaccctgtctgttt

SEQ ID NO: 646992 - DNA, 243 bp, Homo sapiens
ctaacgccaatcaaggacctgccgtgcttctcaggctattccttgctggaaataacggatcattctggccggacgtggtggctcacgcctgtaatcccagcacttagggaggtccaggcgggcagatcacttgaggccaggagtttgagaccagcctggccaaactgcaaaaccacgtttctaccacaaatacaaaaaacataagccaggcattgtggcacacgcttgtaaccccagctactc

SEQ ID NO: 646993 - DNA, 220 bp, Homo sapiens
gtctctgtacaagagatacccctcactctggcaggcgacatagccactgctggaacagaggacagaaaatagtggcctcgtcgcatgatcacggatacactactctagccaccaatgtgaccctgttttaagcctccgaagtggaagagattctggatggccacgatgagaagtacaacgcggtgtccatcagcacagagccccccatcactgtctcctg

SEQ ID NO: 646994 - DNA, 141 bp, Homo sapiens
aatctagaatccaacatgaggctttacatctacggtctagctatggttccagatctcttccccaagagatccctaaggaaacttagtagactacccacagactaccatacctggaagaagcagtagccaccagggtacaac

SEQ ID NO: 646995 - DNA, 308 bp, Homo sapiens
gcatgtagttattttaatataatgctagatttaatttgccaatcttttgttgagaatttttgcatctatattcctaagagatactggtcagtagttttcatgtgatctcttactctgtttttagtatcggggtaattcgggactcagagaatgaattaagaatttcctcctcttctatttttttgggagaatttgaaggattgggtgttaattcttttttaaacattggggtaggattcattatggaagccatctagtcctggggctcctctttcctgggaagtttcttgattgctggattcaatctc

SEQ ID NO: 646996 - DNA, 562 bp, Homo sapiens
tgtactttggtcttgctgtccaagaggatcccaccttacagcgccttttgggacattggtgtgtggtggccttggaatgtgcttctcgtgtacatcgcgccatcatgggtatatggttagtggtgtgggttagtaggcctagtatgaggagcgtaatggagtggaagtgaaatcacatggctaggccgaagttcataaggagggctgagaagggccccggtaaggggtcaggggcgggagtttaattatatgataggcatgtgatgggggggtcataatgtgtggtcgtgcaggtagaggctaactagaagtgtgaaaacgtaggctgggataagggcgacagcgattccaaggatagtcagttagaatcagattggtgaggatgataagtgtagagggaaggtcatgggtggatatggctaggggggcgctcccaattaggtgcatgagtaggtggcctgcagtaatgtaaggggtaaggcgtacggccagggctatggcttgaattgagtaggcggagtggttcgataatacctagtatggggataaggggctgtagggg

SEQ ID NO: 646997 - DNA, 402 bp, Homo sapiens
  misc_feature (95)..(95): n is a, c, g, or t
  misc_feature (104)..(104): n is a, c, g, or t
  misc_feature (187)..(187): n is a, c, g, or t
  misc_feature (194)..(194): n is a, c, g, or t
  misc_feature (257)..(257): n is a, c, g, or t
  misc_feature (280)..(280): n is a, c, g, or t
  misc_feature (289)..(289): n is a, c, g, or t
  misc_feature (293)..(293): n is a, c, g, or t
  misc_feature (328)..(328): n is a, c, g, or t
  misc_feature (372)..(372): n is a, c, g, or t
gcctcccccaggcctctcaggggcccaggctcattacctccctgacttcccgtctctactggaaatacaagaattagccgggcatggtggtgcanacctgtaancccagctacttgggaggctgaggcgggaggatcacttggctccgggaggcagaagttgcagtgagctgagttcacgccactgnactccancctggatgacagagcgagactctgtctccaaaaaaaagagaatataagggaagaatcacaaanactggtttgaatatatcttccanccaggcgcnggcngcacgcctgtaatcccagcactttgggaggccganacgggtggatcacttgagatcaggagttcgagaccaccctaaanaacaatggtgaaaccccgtctctactcaaa

SEQ ID NO: 646998 - DNA, 1068 bp, Homo sapiens
ggctgcagcggcgccaggactgactgcgccgtggaggctggtgcagtgttgtgagttggaagctggggagctcggcatggcggtcgccgactagcagtcgcatgggtgccctcgtgcgttgaggccaggagcggacccgggtcgatggccccgaatggtgcatcagtagaagcaagcaggctccagtcggcgctagcttgcttgggactgcatggagtctgtgtccggggcgcacagacaagacgtcgctgatattcctgggcgtcaacagctgccaaggtgcaactcagagtgagcctggacgttggcgactgggacgctccgccataagacgctcaggtgcgatcctgtcgaacaacgagcggcccaagccggtcattacgtatgcctgaggagcaaagggaccccggattaggttcaacagaagaaacagttttagtcgggggaccagtggaggatacggtgtggagcccaagactggggaccgggccactccccagagatgaatcacctagcccctgtactcttggctgtacgcgaggcggatcctggggaacgcattagagaccaccccaatctcctgccagttcgtggagggaatcgctgaaggcaccttccagcatagtggcgagttggctcagcgtgatgagaaaacactgtaaatccgggatgaaaggcattgaattagttcttgtctgggaccgttgccctcgaagtggggtccagcgaacccaatgtggcctggtaccgtataacatgacgggattgcactagttgggctaggaacccggcaaacgtacgtagtggcaccgatcataagctccccagcattcgccaaggagccttacaagaacggcattgttccaggacgttttccgcatgcgttcgttgagaccatcctcgtaccttggaaaacagggtggctctatgtacctaatgcttgggttggcatgactaatatggggaaccaagagtttagcgtacttcgcccaagtatctccgagtcatagactcccggcaggttgaacgtcgcgtcgttgcgaggagtgactcctatggggtccctta

SEQ ID NO: 646999 - DNA, 236 bp, Homo sapiens
gcaggtgtgggggcagcattgtctcagcaccagctccgcagtgccgcagccctgagggcctgggcctgaaagagaaccagctcggaggacaacctgtacctggctgtgctcagggcctctgagggcacgcacgatgagcgggatcgtggacagaagccgtacttgccatccttctcaacgttgtcggtggtggagcaccagaggcacgccatctgctgctgagccgcagcctcgtg

SEQ ID NO: 647000 - DNA, 1983 bp, Homo sapiens
tcttttcctggtccctccagcatctgagtcctggggttctgccagcaactgtctgtcttttcccctgagaccggatccaatttccagtccttggcatgttgggtaatttggggttgtatcctggatgttttaaataatcagatgcgaggctctgagccctgcgagaacgcgcttgagaatgttggcattttcactttggcgggcactcatcccggctgggtcaggccacaagccgtatcccagccgctgtgtgcagtggatccgtgttggctcaattctcaaggctgttgctgtgcggcctgttccccacacgtgctgctcagctcaggcaagcaccgagcttgtgttgtttcatgctcagcgtggaggcccctcctccaggtcgctgctctgtggggttcccatacactcaggctcctaggaggagtccatttagaaagccagggtttttctcagagtcttagttccttgtgctgtcatccatttcacacgacttgggccctgctcggggcaacacagcaagagaaaagacagggaaaataagagagggaccttgcacacacacgctctggaccacagagccctgtgcccagctcctctgtcaatacaggtggaatctcgtgcaggatcgcaggggtctgtgatgccaccaaagagcaggccgggacagggttaggagagaaaggagagggaagtgggggtttctcctacgcactcttatttgcagagggaaaggcgggtttgtattggggttgtcggtctttgcacccacggcacagttgtgagacacccccatcctcagatcaaagccgcacatacagctggggaaaaacaaaacaaaacaaaacaaaaacagtaaacctccatgccagttgttggtaagttttgagtttcctccccagccagctgctactgttagcgtttcacagtcctccaggagtcgctttttatattctgtccaaagggagagaggagctgtagtggctgtgctccatctctgccagcccagaagtttccagaagtgctcttctgattttacaggtgaagaaccggagtcctgggggtgtaacaagcccaggtcctcaaggcaagggtgggaactcacgagcgcccaactccaagctgtgtcctcgccccgcaagcttgtgctggtcactgctgccctgtgccccccggatagaaacactgctggaggagaagcctttctcagagccctggggaaggggatggtcaggccacctacactcctggccctgctccactggctgcactggagtggcatctggatggacagcagccggctggagactgggaggaggcctgggtgcaggaggctggggcgctgggcagcatgcgccgcggggcagcaggacgcaggggcctcccagcgggactcgcacgtggcactctctggggcaggtggtgacgggaggcagacacactccaggggagtccctcagtcaccatgctccaggtacttgcgcctcacgtttagaaccagggtagatttggagactcctgggatcttttgacaaaatttctctccaatctctaagtacaaaggatgctcctacaaagggccagatggcaagtcctgggatggaacccctgcccttggtgccaccactgctctttcataactgtgggctcttccgaaagtgacttcatggctcagtgcctcagtttccctttttgtaaaatggtcatcatggctgggcgcggtggctcaggcctgtaatcccagcactttggggggccgaggcgggtggatcatgaggtcaggagttcgagaccaacctgaccaacatggtgaatccctgtctctactaaaaatacaaaaattagctgagtgtggtaggtgcctgtaatcccagctactcaggaggctgaggcaggagaatcacttgaacccggtaggcggagcttgcagtgagctgagatcccgccactgcactccagactgggcgacagagtctctgtctc

SEQ ID NO: 647001 - DNA, 131 bp, Homo sapiens
tctagaggatcccttaggctccccatatgtgtctatgagttattccatttacagctgagaataccaccagtgtgaattgtccatgatccacttacaggcaaattttcttcctcccgggtagggagctcgaa

SEQ ID NO: 647002 - DNA, 359 bp, Homo sapiens
agtatattaacataaattctattactgatcattgaataagaatccagtaattgaacaaatcctatttaatgacatccttgttgtcatatgattgtctattatgctgaccactgatttctttgaattgctgctctctctatttaactaacattttgttcagttttgcctccggtggaagcagaaagggttttttcagctgttagatcctaaaaatcaatataatttatttatgctcagataaataactctatcgatatatttttgaaccttttatagtactagttttctttttatcaagtacgaacataaatctgtttttgccctatatccttataatacaaatgcattagactgggtag

SEQ ID NO: 647003 - DNA, 1752 bp, Homo sapiens
  misc_feature (612)..(612): n is a, c, g, or t
  misc_feature (940)..(940): n is a, c, g, or t
  misc_feature (1118)..(1118): n is a, c, g, or t
  misc_feature (1126)..(1126): n is a, c, g, or t
  misc_feature (1128)..(1128): n is a, c, g, or t
  misc_feature (1132)..(1132): n is a, c, g, or t
  misc_feature (1138)..(1140): n is a, c, g, or t
  misc_feature (1146)..(1146): n is a, c, g, or t
  misc_feature (1150)..(1150): n is a, c, g, or t
  misc_feature (1173)..(1173): n is a, c, g, or t
  misc_feature (1179)..(1179): n is a, c, g, or t
  misc_feature (1183)..(1185): n is a, c, g, or t
  misc_feature (1189)..(1189): n is a, c, g, or t
  misc_feature (1197)..(1197): n is a, c, g, or t
  misc_feature (1199)..(1199): n is a, c, g, or t
  misc_feature (1202)..(1202): n is a, c, g, or t
  misc_feature (1216)..(1216): n is a, c, g, or t
  misc_feature (1218)..(1219): n is a, c, g, or t
  misc_feature (1225)..(1225): n is a, c, g, or t
  misc_feature (1230)..(1230): n is a, c, g, or t
  misc_feature (1232)..(1232): n is a, c, g, or t
  misc_feature (1242)..(1242): n is a, c, g, or t
  misc_feature (1247)..(1247): n is a, c, g, or t
  misc_feature (1258)..(1258): n is a, c, g, or t
  misc_feature (1260)..(1260): n is a, c, g, or t
  misc_feature (1268)..(1268): n is a, c, g, or t
  misc_feature (1283)..(1283): n is a, c, g, or t
  misc_feature (1286)..(1286): n is a, c, g, or t
  misc_feature (1296)..(1296): n is a, c, g, or t
  misc_feature (1298)..(1298): n is a, c, g, or t
  misc_feature (1303)..(1303): n is a, c, g, or t
  misc_feature (1309)..(1309): n is a, c, g, or t
  misc_feature (1318)..(1318): n is a, c, g, or t
  misc_feature (1321)..(1322): n is a, c, g, or t
  misc_feature (1324)..(1324): n is a, c, g, or t
  misc_feature (1333)..(1333): n is a, c, g, or t
  misc_feature (1337)..(1338): n is a, c, g, or t
  misc_feature (1340)..(1341): n is a, c, g, or t
  misc_feature (1348)..(1348): n is a, c, g, or t
  misc_feature (1364)..(1364): n is a, c, g, or t
  misc_feature (1371)..(1371): n is a, c, g, or t
  misc_feature (1378)..(1379): n is a, c, g, or t
  misc_feature (1388)..(1388): n is a, c, g, or t
  misc_feature (1391)..(1391): n is a, c, g, or t
  misc_feature (1406)..(1406): n is a, c, g, or t
  misc_feature (1411)..(1411): n is a, c, g, or t
  misc_feature (1452)..(1452): n is a, c, g, or t
  misc_feature (1469)..(1470): n is a, c, g, or t
  misc_feature (1479)..(1479): n is a, c, g, or t
  misc_feature (1482)..(1482): n is a, c, g, or t
  misc_feature (1488)..(1488): n is a, c, g, or t
  misc_feature (1491)..(1491): n is a, c, g, or t
  misc_feature (1501)..(1502): n is a, c, g, or t
  misc_feature (1547)..(1547): n is a, c, g, or t
  misc_feature (1560)..(1560): n is a, c, g, or t
  misc_feature (1656)..(1656): n is a, c, g, or t
  misc_feature (1674)..(1674): n is a, c, g, or t
  misc_feature (1682)..(1682): n is a, c, g, or t
  misc_feature (1687)..(1687): n is a, c, g, or t
  misc_feature (1729)..(1729): n is a, c, g, or t
tagggtatagacgcgagagagcccacctcgtgggtgtgccgggagatatattctcgcggccaccacgcgagaggacgcagagacccacacccatagtagggcccggcgggtctggggccgccaagaagacaaacacccaaaggcgcgaccccgctcgttggtgcgcggcaagaaagcgcgcccgtgcgcgccaaccaaaattaagggggggtcatccgccccacgaaccgaggacaagaagaacaaaggagtaggggggtgtgggcagaacgacgccgagacggtgtgtgtggctcggacagagacaaagacagagagaaatgtgtggtggtacagatagagtagagacggttgggtagaaagaagcccgccccatccacctcggcgcgaaataaagggtcgcccacaaaagaatggaaaagcacgcaaaatgtaaggttggggggagaaaaggaggaccccgcgcgttctggttgctgaccccccaccggaggggctctcccccatcaacaggggggaggccccccccccagaagaggtgtggcgccacaaatgtcagctggaaggattgggggtgtctacatccaccaacaggagaggttcctcgatggntggggttctttaggaagaagaggtgggaagagtttcttctttcgcccatttaggaagaatatggtcgccacacgagaagagattataatgttggaaaaggaggtgttcgccgacaattgttttaatagacaaagaaaaattgtgccacgaaagccgtttgggagttattataatcctcgtgggggcacgagattaatggtgttccacaccacgagggggtgtaaaaaaagacaacctcgcgcgcccctcgtggggagcttgtagaagcgttgttctccccccattcaggcggccccatcaggaaggattatcgtttttgtagccaccnccccgtggggcaacacacagaaataatggtgggttgtcgccgccccatcagggggttgccccacacaagagatatgatggcgccccaagcacgacacagtagtggagtgttgggaaaacgccctgctcacacaagtgtgagagaagtctgctcaaagaagacagtcaccccccgcagntgggtgtnanactntgggcnnnttctgntctnctgtgtgtctctgtgggtttggngtgttntgtnnnactnatataaananacnccgcacacacacantnnacaganatatncncgagaagacnctctntttttatatgncnctcacgcnacccacacacacagngtntccgccccanantctcnggaganagataaganatnnanatggagaanctcnncnngagactncgcagagagaggtgcncacagancacacanngagactctnganaagagaagttgggtncacantataaattgagttgccacgagccgccacttggagaaaaganacactatgagaaaaggnnttgccacanttntatttnatncctcctcccnntagaatgttcttcgttatgaaaaagttaaaaatgctgagaagaangccccaagtttgnaattgggagaagctcactggaggcttcactggtgaaaggcacgtagtttctggagaaaaccccctcggggaacgagacaccggtgctataaattgnacgagctgatggatatgnaccccccntcccngaatctgttttaagttccagacttccaatagtggcccaattnaaagtgctatttgtgatggttta

SEQ ID NO: 647004 - DNA, 1735 bp, Homo sapiens
  misc_feature (1033)..(1033): n is a, c, g, or t
  misc_feature (1156)..(1156): n is a, c, g, or t
gtggctctgttggcgctgctcgtgtggtggtcacgggcgtcggcgcgcgcgtgttggtttgttctcgtcctcttgtcgtcttgggtgatcgtgtgctcctgtggcggcgtgggtgagcgcgtgcggtgctttactccccaccacgcttgtgtcttttgtggtggatggctcgtggttgctggatccgtcgcgtggttgtgtttgccccccgactgcgcttgttatgtggtgggtgtttctcctcccctgttcggagcgagacggtgtggtgccacaccaagacggtgggttgtgtggggcggcccaccagataggtatgttctccaccccgctgtgtgtagcaatcacatactattttgggtgtgggcacgccagctgggtgtatcaccccccccgaggtgggtgctcctctcgtcctcttgggtgttagctcagcacacccgggtgtggtgggtatcaccagaggtaagtcctctccccccatttgttcgggggcgcctcctcgtgtagggttggcccccggttttttttggccgccctcttgtaggggagcaccacttctgggggaacctcctttttctgaagtaagacccccccctcatgccttgtttgttggtccgccacaattttgtgggccctctctctggcggcccctggtagggggttttttctctgccacgggagacacgttgttgtccccattgttttggggccgcacacagaggcgccgctcatatggtgtgtgtgtcccctggtgtggggctccgcttgcccgcgcacgatcacccccgggagtgggggctacacagcgtttaacgccccgcttgttggtcatgtggttgcccatcaaatacgagatgtatgcgtgtgtttgttcacccatggggctgtgggagggagaggtatttcaccccgctgttggtgggtggacattcatctgtttagaatgcccacgggggagtgttttcctccccgcgctccaggttttgttgatggacctcttgttgttgggcgcagactggtggccaccganacactgtcgggcttggggtgattgatcggcgcacacgcctggctttgaataaatgagtgacccaccgctttataggggggagcgagatccccccactctttacgcttcttttcttctagctcncacgagcgaggtgttttctggagaacaatctcgtgggaagagtctcttacgacgctctgtcattgtttagaggcgtcgacccctcacatggtgggttgttgacacacgagacaattggagaggcccgcctcgcttaagcaggactaccacaagcggtgtgtttgacaccactctagagaagtataagagatgttttagcgcgctctctctgtctacagagcttgggtgcgacacagagatgtgtgggggcgccacatttttagagatttcgcacattttttcacgaagaggaggcaccacatcacacttgtgaaactaaatataggcggttttttttctttgcgagaaacactgcatactttttgtcaaccacggcctcgtttataacgttatattgtgaattatttcgtgccccggtgccctcagagaggctgtcgggtcctttcctcctcccctcacacggttggggtttaaacgagggagaatacccaaacagtgagagattttttttttatttttaagccccccactttttcccggtcccccaaaggggaaaaaaaaataaaaattaagtttata

SEQ ID NO: 647005 - DNA, 667 bp, Homo sapiens
  misc_feature (67)..(67): n is a, c, g, or t
  misc_feature (70)..(70): n is a, c, g, or t
  misc_feature (80)..(80): n is a, c, g, or t
  misc_feature (90)..(90): n is a, c, g, or t
  misc_feature (117)..(117): n is a, c, g, or t
  misc_feature (146)..(146): n is a, c, g, or t
  misc_feature (174)..(175): n is a, c, g, or t
  misc_feature (184)..(184): n is a, c, g, or t
  misc_feature (187)..(187): n is a, c, g, or t
  misc_feature (207)..(208): n is a, c, g, or t
  misc_feature (218)..(218): n is a, c, g, or t
  misc_feature (228)..(229): n is a, c, g, or t
  misc_feature (231)..(232): n is a, c, g, or t
  misc_feature (273)..(273): n is a, c, g, or t
  misc_feature (316)..(316): n is a, c, g, or t
  misc_feature (318)..(318): n is a, c, g, or t
  misc_feature (344)..(344): n is a, c, g, or t
  misc_feature (369)..(369): n is a, c, g, or t
  misc_feature (413)..(413): n is a, c, g, or t
  misc_feature (450)..(450): n is a, c, g, or t
  misc_feature (463)..(463): n is a, c, g, or t
  misc_feature (496)..(496): n is a, c, g, or t
  misc_feature (500)..(500): n is a, c, g, or t
  misc_feature (504)..(504): n is a, c, g, or t
  misc_feature (538)..(538): n is a, c, g, or t
  misc_feature (540)..(540): n is a, c, g, or t
  misc_feature (554)..(554): n is a, c, g, or t
  misc_feature (571)..(571): n is a, c, g, or t
  misc_feature (573)..(573): n is a, c, g, or t
  misc_feature (579)..(579): n is a, c, g, or t
  misc_feature (633)..(633): n is a, c, g, or t
aggcgcttgtattgaaactttaggttttcttgagctgtggtgctgagggcaggaagaagacactaanagngaaatgtgtntgtggttganggaggattcctgcagttcacttgaggnggcggaatcttctggtggagggatgcccnccggcgtgggtcaggggttgtgtgctcnnggtggaccnagnggttttccttgactgtggtnnagatactggnggatagtggnngnnccgtgtggttgggacacgtatgtacacttggcgttacggcntgatcacgtgacagttgcagacacacgcccactgctgggtaantntccaggtggaagaggctaacatcacnaggtgttgatggccaccattactancaccagtccaataacgttgacacccaggccagctttcaccatanctttgatctggcagagcccatagctgaagacgatggnattagggggattncccacaggcagcatcacagaaaaagaaatgcanatgntgantgggatcagggtgtagagggggttaatatgcagngnttcagacaggcagnacaggatgggcaggaananggtganggttgctgggttgctcacaaactcagtgacaatggacacgaggatgcatgccancagggtgacagcccacggtgggaggctgctcagg

SEQ ID NO: 647006 - DNA, 104 bp, Homo sapiens
  misc_feature (59)..(59): n is a, c, g, or t
  misc_feature (82)..(82): n is a, c, g, or t
cagagatgagctgacggaaatcttcaagaagatccggaggaaaagggagtttcgggctnatgctcgggccgtcatttccctnatggagatggggttcgacgaga

SEQ ID NO: 647007 - DNA, 692 bp, Homo sapiens
  misc_feature (35)..(35): n is a, c, g, or t
  misc_feature (102)..(104): n is a, c, g, or t
  misc_feature (125)..(125): n is a, c, g, or t
  misc_feature (137)..(137): n is a, c, g, or t
  misc_feature (155)..(155): n is a, c, g, or t
  misc_feature (170)..(170): n is a, c, g, or t
  misc_feature (172)..(172): n is a, c, g, or t
  misc_feature (181)..(182): n is a, c, g, or t
  misc_feature (199)..(199): n is a, c, g, or t
  misc_feature (204)..(204): n is a, c, g, or t
  misc_feature (207)..(207): n is a, c, g, or t
  misc_feature (232)..(233): n is a, c, g, or t
  misc_feature (235)..(235): n is a, c, g, or t
  misc_feature (244)..(244): n is a, c, g, or t
  misc_feature (248)..(248): n is a, c, g, or t
  misc_feature (262)..(262): n is a, c, g, or t
  misc_feature (279)..(279): n is a, c, g, or t
  misc_feature (300)..(300): n is a, c, g, or t
  misc_feature (304)..(304): n is a, c, g, or t
  misc_feature (307)..(307): n is a, c, g, or t
  misc_feature (420)..(420): n is a, c, g, or t
  misc_feature (435)..(435): n is a, c, g, or t
  misc_feature (448)..(448): n is a, c, g, or t
  misc_feature (456)..(456): n is a, c, g, or t
  misc_feature (469)..(469): n is a, c, g, or t
  misc_feature (473)..(473): n is a, c, g, or t
  misc_feature (515)..(515): n is a, c, g, or t
  misc_feature (598)..(598): n is a, c, g, or t
  misc_feature (636)..(636): n is a, c, g, or t
gcggctttttcatgaaatgcttggaggtgaacganttctcagcctgtaagatccgaccatcccattaactttgaagtatctcttgattaatagaagaacaannnggagggtgaagaaaagggggnacatgctaaacnccttttgacaatcatccnaatgtgggggggggncnaccggttcnncaactcccctttttctnttttncgnctttcttcttctcactcttgttttnngncttcctggntggnacagcctggcagtncctagagcccctgagangagccctggttctccaaaagntggnggnggggaagccctgcaggttgcgctgaccacttcccagagatctgacagtccgtgctcccaaaagtttgaaccaacagcctaatgtgaaaagaaactgcactgaaaggtaaaggnggaaatggtgatganctgggcttatgtnagtttgtntattttttctttngttngccccagtaatctttctctctgtttcagcctcaggcgtaccncgttctggttggtgggttctgcagggatctctcccaccactgagcctctagtcccaaaaccatccttgacaacatcgtgtgtntgttacttccctttgcccacctccaggccacctggggnagcccacaggcagccaagaccctgaaatgaaatgaacacaaagtctgactcggtaa

SEQ ID NO: 647008 - DNA, 233 bp, Homo sapiens
gtggcacagaggctgggcacgtcccggagaaaaagctacagggctccggtagaccacatgaaggtcatcccactcagtactgtccaaatcgaaccgaccttcttgtactggctagtactgagaacacatacctcccatcggagtgtgaccgcacgctctctgtccaccagaacgcgaagcttctggaccactgccaagttcccgctcacccgataaatgccatccacatctag

SEQ ID NO: 647009 - DNA, 292 bp, Homo sapiens
gtcgatgaggtatgcaaatatgggtgagtatctgatttcaaagtgagctttgatcagacgtagtggttctcccagcacgcagcttgagatctagagaacagacagactgcctcctcaagtgggtccctgacccccgagtagcctaacggggaggcagcccccagtaggggcagactgacacctcacacgaacaggtacccctctgagacgaaacctccagaggaacgatcaggcagcaacatttgctgttcagcaatattcgctgctctgcagcctccactgctgataccta

SEQ ID NO: 647010 - DNA, 313 bp, Homo sapiens
accttccattgaaaactcctccctctggaattgtgatccagttgagccgtggcttgttcagaactccttttcttggagtggaatgatagggaggtgtgcctcgtgttctttccagaggttcaagcgtgcagtgtggagaagcttaggattggtgagctcaggctcacctgggttcaaattttggtcctgcatttctagctttggttcctttttctataaaatggggcttataattacaatttcccagaattctgaaaagcaaatatcataggtaaagtgcctaacaaatatgtagcccttctgtcgtcttctc

SEQ ID NO: 647011 - DNA, 430 bp, Homo sapiens
  misc_feature (202)..(202): n is a, c, g, or t
caaatgaaacttacttaactcaatacttagaaatttcccgaggtattgggtcgaacccccggtggcctggtgcggcccaggcgggcactggtaaccaggaaaaagcgcacccagcaacatcttatttttaatggtcataaactctccactttggggatctgtaatatcagtcgcatatctttcctgccatacaatataactnacaagcgatattttgttagtgatcccatgatttcgttaaaagtgtaaatgaaaggatgccctaaaagcatccttagcgagcagagagtcagcggaaatagctgatttaagaatcatcctgggctgaagattacatgcaagcctaaaggattgagttatcgcattatgcccatgaagccatgtacgcccatatacacaccgactaagccaatcaacagactgggaaaat

SEQ ID NO: 647012 - DNA, 1102 bp, Homo sapiens
ggagagagagagagaactagtctcgaggttttatttttttattttttcacgcttaattcacttaatttttcttgtataacaccaccctatgttgtacccacagctggagcctgagtccgctgccagggaaactctggtgtgggtcttgcacacaggtgtgtcagtagaactcctgatcagggagacttgtgtgaatacagtctcctatccaaaggtcgggggtcaggtagctagtaggtacttagaaatggcatcaaacggtggccttgcgcaaaagttgcccacgggctgtgcagtgcaccaccccggtgctgatcagttgtacgcagtccataggaataccaagcacactacaatgagccagaatatactacaggacccacgggtggcggagaaccacatagccaagagtgcccccagtggggtgcccgcggaaatacagggcgatacacaagcaacaaaaaccccgaaagaacggacactgaacaccatttaggaaaagggagaacaggatgagggaggacataagcacgaaattcattgggtagcccccccaacaagtcaagactcatcagcagacgagccacatcgggggacgcaaccagaagagagacaaagaacgaccgacaaggggccccagggagcactaagaatgaggagcgcccccaagacgggaaaacaggggcggggatggacaccacaaacccctccctctaatggaggtacgaacgacgttaaacaccaaccaccaaagcaaaaccaggaacgaggtacagacccgaaaatgacaaacgccccccccaccgcaataaaagagaaaagcaaaaaaagactgcaccattagtgaaaactcactgtggaaagcaccgccaactggaggcgggcgacaaaatgggaggaagacagtgacaaacaacaaggccagctgtggggcaaaaaataagcacctattcaaaaagaaaaccgattcagaaccaccgttaagtaaaccaaaagcaaggccggccgccccgacaggaggaaaaacaaacacacacacagaggaaagccaacggaggaaaatcgcagtaaaaaataggccgcgggggacagcaaagagtgt

SEQ ID NO: 647013 - DNA, 203 bp, Homo sapiens
tgtctcccaagctaatgaggatactcgtgccttagcttctcaagtagctcagattacaggcgtgtgcaccatgcctgggtaattttattttgtatttttagtagagatggtgtttttgcatgttggccaggctggtcttgaactcctggcctcaagtcatctgcctggcacagactccccaaagtgctgggattacatagcgt

SEQ ID NO: 647014 - DNA, 490 bp, Homo sapiens
gggtcacatttgggaattcccacaagcctcttgtcaaaagacgaattatgctcacttgcctgtgcaaccctgagccacaatcccccccctttaccccacgtcaaaactgaaggtgtcataggcagccccaactgggaaagcccagggagcgagcccccggaggggcaaacgaggctccctccaaggccccttttttacaaaagtctctccagcctttgacgggtgcagaaactagacgggccccccgaaagcagaacggcccatttgagcctggattactccccaggtgaaagtgcaggaaagaatatgtttgtttgctcccagcacccatgcctgcctgcctacctcggccttatccaggccctttttttgttgcaggctgagcccagccaggttccagtttgtgttaaaaacagccctctttgcaacccagtggctttgcctgtttttgaccctgtcagggtataaaagcttttgatactttcaggta

SEQ ID NO: 647015 - DNA, 200 bp, Homo sapiens
tacagcagcaaaatacatcattgcatgcaattttgtaagcactcacttcactgctcatgcagcattccgcagttccaaagcaaatctcatcagcatctgtgcttggcatctcaggtccatcaggcaacaccacaactcccacacacatgcatctcaacacttcactatgtccagcacacaacatcatccaaccggcagca

SEQ ID NO: 647016 - DNA, 203 bp, Homo sapiens
acccctccctctaaactccaggcgcggtgtttcacagctgtaattttagcttttcgggaggcagagcaagaggatctcctgagcccgttagtttgaggcttcagtgcgccatgatcacgccactgcactctagcctgggtgacagagtgagtccctgtctcaacaacaacaaaaaatcacacatgtctgatttgcgcagcttg

SEQ ID NO: 647017 - DNA, 453 bp, Homo sapiens
cgtcaactcgtcaaagtcattctccatccagcgttgttctgttgctggtgaggagctgcaatcctttgtaggagaagaggtcctctggtctttagaattttcagcttttctgctctggtttctccctatctttgtggttttatactacctttggtctttgatgttggtgacctagagatggggttttggtgtggatatccttttagttgatgttgatgctattcctttctgtttgttagttttccttgtaacagtcaggttcgtcagctgcaggtctgttggagtttgctggaggtccactccagaccctgtttgcctggttatcaccagcggaggctgcagcacagcaaatgctgcagcacagcaaatactgtagaacagcaaatattgctgcctggtccttcctctggaagcttcgtcccagaggggcaaccacctatatgaggtcgacgc

SEQ ID NO: 647018 - DNA, 796 bp, Homo sapiens
atggtattccttgtgctttgattgcatttctctgatggctaatgatgttgagcatcttttcatatgtttatgagccattgtataccttcttggagaaacgtctgtacagatccttgcctactttttttgtgcctcagcctccagagtagctgggactacagatgtgcaccaccaggcccggctgatttttggatttttaatagagacgggattttgccatgttggccaggctggtctcaaactcctgagctcaagtgatccagcttcctcggcctcgcaaagtgttaggattacaggcgtgagctgctgtgcctggccccctttgcccacttttaaattgggttatttggcactagcccacatcgtgaaaccctgtctctactaaaaatacaaaaattagctgggatggtggcatgagcctgtaattccagatactcaggaggctgaggcaagagaatctcttgtacccaggaggtggaggttgcagtgagctgagattgcgccactgcactccagcctgggccactgagtgagactccgtctcaaaaaaaaaaaaaaaaaaaaaaaaaacaacgcggggggggggggtcacgctggtattcccagcattgtggagcgcgacaaggcgggatcacgagggccggagatcgagacaccgtggtacagtgggaacccgttctataaaatacacaattacggggggatggaggcgctgatccagcccgggagtgagaggaaatgcgtaccagaggggctgggaccaaagccatgccaggggacaaaaaccgtcaaaaag

SEQ ID NO: 647019 - DNA, 135 bp, Homo sapiens
tgagctgtgacgtacgcagcaacccagagcccacggtctatgactggagcacgacctcaggcaccttctcgacctccgcagtggcccatggctcccagctggtcattcacgcagtggacagtctgttcaatacca

SEQ ID NO: 647020 - DNA, 233 bp, Homo sapiens
  misc_feature (114)..(114): n is a, c, g, or t
aaaatgttcacttccaaacacaacctttgtaaaaatcccacttaaagtttgtttctaaaattttagcacaccaaatgcaataatatttttggctgttactgctctttcacactnctagtctcagtggcaaaaactaccagtacctcagcctctgtcagtttttaacatctattataaactaatacaaaaatttaaaatgtctttgcaaaaaaaaccaaaccagcaaacccaat

SEQ ID NO: 647021 - DNA, 409 bp, Homo sapiens
cttcgggaaagggaatgaaggggattggaaaaggattgaaaccttcaaaataatgaatatcctgaaagccccttgccattattttgaagccttattttttcctataaatccttagcaattgaaactaacagttgcctgggtatggcaactcatgccctgtaattccagcactttgggaggtcgaggcaggtggatcatctgaggtcgggagtttgagcccagccctggccaacatggcaaaaccccatctgtactaaaaataacaaaaattaatttggtgtggtggcaggtgcctgtaatcctagcaactccggaggctgggcaggagaatcacttgaacccaggaggcagaagttgcggtgaaccgagatcgcaccattgcattccagcctgggcaacaagagcaaaa

SEQ ID NO: 647022 - DNA, 140 bp, Homo sapiens
cctagttttagaagttcaatagcagtctaagtctgtatcaagagatgaagggataaaaatatgtcatatattttgggaatgtattttatccataaaaataatgaagatccggctcatgtggggacacaacaggggccact

SEQ ID NO: 647023 - DNA, 282 bp, Homo sapiens
agagacagggtcttcctctgtcacccagtctggaatccagcagcacagttcgacctcctgggttcaaccttctgagtagataggccacaggcatgctcaccacactcgcccaattttttaaaaattttaaaaatatttggatatagtgaagtctcaaatctgctagctgctcaactccgggattacagcgcatgacccaccacaactggacaaggctttcactctatatatataaggcatatttatcagtgatataatatgctagcacagggatcagcaacc

SEQ ID NO: 647024 - DNA, 113 bp, Homo sapiens
ctccaggactcatgccattctcttgcctcagcctcctacgtagctaggataacaggtgcctgcaaccatacccggctagtattggtaatgtaagagatacggggactcctcta

SEQ ID NO: 647025 - DNA, 96 bp, Homo sapiens
  misc_feature (65)..(65): n is a, c, g, or t
tgccccgggcgggagggcaccgaggcgcggggacgcacgagagtcccgcccatatgcgtcgcccncgacccgggcagtcggatatggtcccgcacc

SEQ ID NO: 647026 - DNA, 428 bp, Homo sapiens
agaatttggcagtacgtccaactggtctcacaaccgcagaccacgtgtaaccacgccagcccaggatctccacatccggcttcttcacctgcgggatcatctgagaccagccacttagacagctgatgaaactatgcatttgcacaaccgattcgcaccaactgtcagaaaccgtctcagggaagctcatctgcgtggtcgtcttcctcaccagggccttgacttgactgcagttcggcgtcgtaaccaacttcagtgggcaaatgctcacctttgatggccagtctgtgtagccatttgattagatgttcaggagtcttatggcttgggagtcgaagctgttcagaagcctcttggacctagacttggcgctctggtatcgattgcccgtcgacgcggccgcgaatttagtagtagtaggcggccgc

SEQ ID NO: 647027 - DNA, 147 bp, Homo sapiens
ttcgtggtgttatattgtaattgagattgctcgggcggaataggttatgtgcattaggagtagggttaggatgagtgggaagaagaaagagaggaatgtaaagttatacttatgccttgtggggttgaggtgaaagaggaggggggt

SEQ ID NO: 647028 - DNA, 200 bp, Homo sapiens
tattaatgcatctgaagtatgcatgtaagggataagtgcttattatatacgatctgtggagtcttaaatatcaaccatggacactttcatcctgaccccttccctaggggattatcaggactgagaaatttttccatcgacgccttcctaacaatcgtaggactcgttcctgtgggcatcactgatgggctagtacactt

SEQ ID NO: 647029 - DNA, 282 bp, Homo sapiens
ggtaccggcatgtgctgtaggccagcgctttgggaggccaatgggggcagatcgcttgaggtcaggagttcgagatcagcctggccaacatggcaaaaccctgtcttttttgtattttgtaaaaatacaaaaaaaaaaaaacttagccaggtgcacgtctgtggtcccagctatttgggaggctgaggcacgagaattcacttggacacagaatttggcaattgcagtgaaccgaatttgcaccattgcactccagcctgggggacagtgcgagactgtttc

SEQ ID NO: 647030 - DNA, 926 bp, Homo sapiens
ttacatgacgtggggacgtccggtttcggagcgggagtgtcgttgtgccagtgattataagagaatcatatatggtggtgatgttgatgaataggcgagaacgatttatcatgaagggttcccagtgcgcacaccgttgatacgtgaggcgctagtcgatcatagcatctgtgagccatatgtctccatggtctctattgcgggcggcacgacgaggtcatgcccgctgaggatacctcttacacatgtcgacagttaataactagataggctatcatcttgggagtagagtgataccacggatggaagtattgggaagaatcccagtgaatgtacatcacctgtgaacaaaaatgatctttgtcgggtattagagaaggaaggatgacactgggcagacttaatagcttatctcaataaaagctacgaatgagtaataattggccagtgccttatttatattcaaaagagaaatgtctcatgactggtttatgtgtaccatcctttaatagatcttatacatgctagaattcagatcatgaatgactgctcgaatatatgttgggcagtcctgattgaaactaagactggcttgtggtttaaactgaatatgttcaggttttgaacttttaatagttactccaattcagtaaagtggtatcactggttaacccttttaaagatatgagtgagacttcgttaggaatgttcacgtttaacaaggatgggagtgcccgcttaaaattgcgcgaatgctgaatttgacaaattacggtggggaattttttacaatgggggatggtgtgggttgaaacaggaaaaccggttggaaaaaaatgctaagagggaagagaaagaagggaaaggggagataaaaaatcgtgagaagaaaagaggagggggaaaaaaccagaaagatgaatatt

SEQ ID NO: 647031 - DNA, 168 bp, Homo sapiens
tcactcggcactggtgacacagaggaggtagaatttacttggctgagttatagagggggcagcacaagttcaatgctgatgaatttgaagacatggtggctgtaaagcggctcatcccagatggctgtggggtcaagtacgtccccagtcgtggccctcccctcctct

SEQ ID NO: 647032 - DNA, 369 bp, Homo sapiens
  misc_feature (4)..(4): n is a, c, g, or t
  misc_feature (35)..(35): n is a, c, g, or t
gacnaatacagagaacccagatggctgtgtttcantcccagagtgaaggatttgccttaaggcccaggtgcggtggctcatgccctataatccccagcattttgggaggcctaggctggcagatcacttgagatcaggagttcaagaccagcctggccaacgtggtgaaaccccatctctactaaaattacaaaaaaattacccaggcgtggtggcacatacctgtagtcccagctactcaggaggctgaggcagggaatcacttaaacccaggagtccttacaatcgattcagtaacatctaccttaaagggtcatgagccgagatcacgccactgcactccagcctgggcgacagaggaagatgctg

SEQ ID NO: 647033 - DNA, 131 bp, Homo sapiens
aacccaactaacatgtccagcgtattccatgttcgtaatccaagaaaataaagccctcgttgctcacagacagcggtgactactacagtgatattcctcacggcaagcaaccgcatccataatccttctaa

SEQ ID NO: 647034 - DNA, 505 bp, Homo sapiens
  misc_feature (102)..(102): n is a, c, g, or t
  misc_feature (108)..(108): n is a, c, g, or t
  misc_feature (127)..(128): n is a, c, g, or t
  misc_feature (476)..(476): n is a, c, g, or t
  misc_feature (478)..(478): n is a, c, g, or t
gagtcaggatagtgtccatcacacctcaggggataagagcactgattatgctaatttttaccagggattgtgggattgtactggagctttttctgatgagtngtcatntaagcgtggtgatgtgatnnacattcttagcaaggaatacaatagatatggctggtgggtaggagaaatgaagggagccattggcttggtgcctaaagcctacataatggagatgtatgatatttgagagtcctggaaaaggaaaatctctgctgtctgcaaatgcttggattagaagcgtcatgaaagcacgagtgacagctcctaacctctcctgttttataaacatactatcttgactgttatttatgcagtcgctcatttatcctctgatgtgaaataaatgaaggtataagtttagagccaccgttaagttatacctgtgctatttgccaagaataattatagttttattacccattgattgngngagaatcacacaatttatacgaactgc

SEQ ID NO: 647035 - DNA, 364 bp, Homo sapiens
gagtctcgctctgtcacccaggctggagtgcaatggcatgatctcggctcactgcaacctccgcctcccgggttcaagtgattctcctgcctcagcctcccgagtagctgagattacaggcacgtgccaccacgcctggctaattttgtattttcagtagagatgaggttttgccatgttggccaggctgggctcaaactcttgacctcagatgacccgcctgcctcagcctcccaaagttctgggattacaggcatgagccactgcacccagcccaacactgggattcttttatccgctggctggctcttccgcagttgaattgtgtgacttcttcccctatctgaggcccagtttttcttca

SEQ ID NO: 647036 - DNA, 270 bp, Homo sapiens
attttaacactaaggattaatcgggcatagtaaaaaaagtcacagttggtgaataaacatcagcctcaagcaggtagagtaaatgtcagaactaatgaatgtgccagattaagaaggactcagatgattcaaagaatgcaaaaaaaaaaaaagccaggtgctcatggatctataaaaaactgatgatggatggcctgagggaacttacgctggtgtttccgaacccggccttggtctggcttcttcaccagcctggtgtgttgtcgacgc

SEQ ID NO: 647037 - DNA, 190 bp, Homo sapiens
tagaatgatagaatcgagctggtaccgaatgtgtaaagtggtgcagttgtaaggatccaccatgctctatgtttacgttaaagatacaaaataagaggggacattttggaacaatctgtaatattcttcgtgaatctgtctagataaaacagcgacgaggaataaaaaaatgaacatccccgtggaaagc

SEQ ID NO: 647038 - DNA, 149 bp, Homo sapiens
tgttgaggtggtggcaggcaccatagtctaatagaaaacaaccgaaacaaataattcaagcactgcttattacaatgggactgggtctctattttaccctcctacaagcctcagtagtacttcgagtctccctccacaacctctagaag

SEQ ID NO: 647039 - DNA, 243 bp, Homo sapiens
actgccaacactcagtttttcagcccattctgatgggaatctagtggtatctcattgtggttttattttcatttccccgggtgactaatgctggtaagcatcttttaaggtactttttggccagttgtatattttctgtgaagtggctgtcaaatcttttgcccacttttaattggattgtttgtcttattgagttgtaaaagttctttatatatactgtattaaagtcctttgtaagacaca

SEQ ID NO: 647040 - DNA, 261 bp, Homo sapiens
tgcgattcaagccgggcacggtggcttcatgcctgttatcccatgcactttatcgaggcatgatttgggctggatcacttcatgccaggagttcaagaccagcctggccaacatggtgaaatcccgtctctactataaacccaaaaattatccagatctggtggcagacgcccgttcactcccagcttctcaggcactctgatgacggaatttcgcttgtacctgtgaggcggcgtgcagtgtcgcgatcttggctcactg

SEQ ID NO: 647041 - DNA, 695 bp, Homo sapiens
ggacacgggaggcacggagactgctcacctgctcggccatggccgtggagggacccggcgccaagggcctcgcgctcggcctcgcgacccctggcgcgagcttcccgggctggcagccaggcctccgtacccagtaaagtgcgagataccgaagccaggaccgggtgcctccgacgcgacacgagtcgataggacggggacgccgcggacggcatatagcatggcgggctcggtgccatggcggggatcccccaagggcacgagaacgcgcaagggacccagaccaatggagctctgagcacccccgaggcccgacagacataacctagccgctagaaaggccatcgtgactagacaaacggtgacggccaggacagcctaaatgcgagtgcagtggagggccgtcagcacgtgacgtccctgacagaggcccttttggcaagcttagatccttgagagtcgcgacttggggaaggtgcgagtgaacggggagagagtgacgattccacgtagcatgagagacacaaaaaggaagaaggcataggtaggaccacgaattgggaacgaggagtggaattacatacaattccgtttggcttattaaagaagggatgatatgctgtggaatataagagttagagggtcaaggtgaacgagtgatagagaaggaagatttgctgtatagagtaaaatgg

SEQ ID NO: 647042 - DNA, 750 bp, Homo sapiens
accaacggcgcatgcctgacttaggaaagattggccataatcaagcaattgcctgaagcaagatggagtgcttgggcaaggacatgaagatcacgatactctgggtactctgtatcttgtcactgacgaagaagggattagcgaccattgctatgattataaacgactctgtgttgcgcgcgtaatgataatgcgagagcagacatagacacgagtcgataggtgtaattagatgatagtattagttgatagcggtgtcaacatagtccacgtgttaataggagccaaaggctgagcagagcgtgcgcatactttagctagagatgaacctggccaatgagtactatagctttgcacgcaaagatctcttcagattacatgaatcgccgttctacacaagagcgcctttgaatgtagacatgccagtaacctgcatctgcagatgcgagcgacttaggacatgtaatacaatagtaagatagcacttcgttgctgacagttatgccctgagtagagcgtactcagtactagtcatactacatgaggatcaggattgacctcaacgcatactgaggcacgtgcgaacatagttaacgttgggcttcgtcacccttggaattactagccattaagctaacttgtacaacacccttaggctagtgctggagcgggatggcaccaacttgtaggagatacgaactgaacgaccgagtactttcaagacggacaccagtggtctctcccttgtcg

SEQ ID NO: 647043 - DNA, 854 bp, Homo sapiens
cgcggcagcgcctctgtctcgcttttacttatttttcccccctttcccctttctttttttgtttttcttttctttactcccctcccgaccatttatcaccattacccctcggaggcgcttcacccggaagggggaaaagccggctcataacaaaaaagaaagacgaagaaagcaaaacaagaaagaaaacgaacacacaagaaaacaacaaacaaaaaagagaacagaagaaaaaaaagacaacaagagacaaagagaaagcacacagaagaaataataaaaaacaaacacataaaaagacaaagagaaagcaagaaaaagaaatagagaaaaaaaaagaaaaggacaaaaaccacgaacacacaaacagaacaacagaaaaaaagcaaaaaaaaaaacaaaagacacacataccacaaaataacaaaaaaaaaaacgaaaaagaaaaaaaaaaaaaagaaaaaaaagacacaaaagaagaaaaaagaaaaaaaaaaagaaaaaacagaaaaaaaaaaacggaaaaaaagaaaaaaacaaaaacaaaataagaaaagaaaaaaaaaacacacccaaaaaaaaacacaacagacataaaaaacaaaaaacaagaaaaaccaaagaaacaaagagaaaaaggaatcaaaaacagaagagaggaaaaacaataagtgaaaccaaaagaaaaaacagaatctagacgcaagaaggaacaaagtaaaagacacaagacaaagaaacaaaatgaataaaagaaaaagaaaagaagaaaagaaaaggaaaaaaaaagaagaaaagatatgaatataacaatgataaaataaaaagaagcataaaacagaaacaaaagacac

SEQ ID NO: 647044 - DNA, 1004 bp, Homo sapiens
aataggggacgtgttacggcacacatacgagggaaatgagggccgagagctcagagatctgaaagaagtactaccgctgactgggtgtgtagagaagtgctaaagcggatacacacgtcgtcgttgtgacggaaggcagagtgcgccaatatatgcccctggatacatgtttagtggaaggagaattgacatgtgtaatagtctccgactttctgagtgaccccggattttgaagaagacggggccatgcttgagacgggtattcctcgctagtcacccgctgcgagccgtgatgagagagaaaggcccgtgtcgaggaatgctcaaatagttacccgatgaagggtcatcaaagatttcaggtgattaagtggtgacctggttgagaaggagtacttactgcagatactacccgaaagatgctccaggaagcgtttctgcgcaatgagggttccttcatagtgcaacccctatcacggtcatactcgagcatacacagcctggagttaaagtttgcatagacattagtcgtctgcagggactcgttgcattggacattcaatctttgtacttggactgagcaatgattttgacaatagtatctctgagtgatcgctagctcttgagattgtcactcctcctttccccttgggttattttgaaacttgcttggttgaagtcatgaccttgtccctcattcaaaggcgtaaataccacccattcctaccaagcagacgcagacccttcacataccctaattctgacaacccagcctgggtagttgctttattcagggttttattgaaagggcgaagccgtgccatggacaaaagggattaacaaccctgcgttgggccaaaggttttgaactcacaaaggcaataccctccctggaacccgaagggtgttcctcaagaattggaagtcactttctgcacaattggtggcccaggggtataactcacaaggctccctcctgtggagaagattaccgggcaagggga

SEQ ID NO: 647045 - DNA, 866 bp, Homo sapiens
ggggcattgaatttacagagtaaagttttaactgagaatgaatggcctttcgcagttcttctggagtatggaaaagagttggtattgaaagttcctcaatggctgggcactgtggctcatacctataagtctcaatcactttgggaagctgaggtgggtggatcgcttgagctcagaaattcgagagcagcctgggaaacatggtgaaagccctatctttaccagataatacaaaaaattagccagtcatggtggtgccagtctagtggtcccagctactcgggaggctgaggtgggaggatcacttgagccttggaggtggtggttgcagtgagccaggaatcatatcactacatctccagtctgggttgaccggagtgagactccatctaatgaaagaaaaaggaaaggcaactatgttagctgtagtccctctcctctgaaaatgtgaactggcatgagctgttgtgcatcagtctagtgaaatgcactggaaaaatggtgtggtaattcctgcttgaggtatgctagaaagagagaagataatacttgtagacatataagtgctgatcctttgtagccagatgaagtcgttacttaaacaatagtggtggtcagaaggtaataccaaaaggagggatatcaagaactaggttatggtgggttgcaagtagttgtctgaatttttaaggcatagacatgatgtagattcgcattgagctatgagaaaaccagtgtcttgatcagtgggggagttttcaaaaattatccttgttagacatgattctccatgggtgagatttaagggatgatggaaacaaacattgaggaggctaggagaataagaggaatgcagtgttcagaag

SEQ ID NO: 647046 - DNA, 607 bp, Homo sapiens
gggggtcacactaggctgtgcacatggtgtggggctgtgagagccccaggcgagtactccggatctccttagggagctctgtgaagaggtctggacagagaagactgaagtggctgtggtggtgtcagggctggggaggagagggacgggctgcaccagtgcaagtgccaacttcgtctccctagaaccttccactgccaacccttgtgaagacacagtccaggcatcattcgggcacctgtaggacggaccttgctaggtaagcttatctctctgagcactgagtgtcaaggaagcccggttcggtagctaggtgttccctctgaaacagtgatgctctcagaagggtggtttcaagtcccttgggcctcacccattcgtggcacttggggtctccccgcctcactctatctctgtgtgtccagagaggaggaaaccctgccttgagactggcccttgcactggtggagaggagtaggccctgcaccaatgggggcacctggtgtctggcctcagggatccacatgtttgagacagattggtccacttcagactggcctgtgtctagctatcatattggtggtgagcatatccaggaaaatcattg

SEQ ID NO: 647047 - DNA, 152 bp, Homo sapiens
agcgaagtctagagtgactctagaggtctttaacacgcatctcggttactgaacgtagcctcctggtcaagcaatcttctgctcagctcccgagtagctggaataatagttgcccatcaccacaccaaagctaattttggaatctttagtaa

SEQ ID NO: 647048 - DNA, 160 bp, Homo sapiens
  misc_feature (36)..(36): n is a, c, g, or t
gcgctgattctagaggatcccgctgacagcgaccanaaaagcccagtggatatcaaccccagttttctagaaactctgttcctctgctgttggccctcagcctgggggtcccctgagccaaagatgcaggtgtccgctcagaccatggcagctccatctc

SEQ ID NO: 647049 - DNA, 127 bp, Homo sapiens
gagttaatggttgatagataaaaatgcaaagcatctagtgccagtgagtgagacccaggtgtactatcctaccaccccgtagtggtacccctggtgcaggtctattttttcttggtaacactccacc

SEQ ID NO: 647050 - DNA, 442 bp, Homo sapiens
ccccctacctactgcgcccttgccgccccccgccctcagcccccgcccccccctctccccccccgccggcgccccccccccttcttctctcttctctccccgcgccgcacaccctctcccggcccgccgcccaaccaacacccccccccgtttttcactcaaccccttcttggcggccgggccctttaaaaaaaggcaaacccccccgtttcctactttcccccaggtccccaaagggggaaggggaacccccggccttgaacttttgttttttaaaaacccggcccccgttttccccgggaatgggggggccaacttttgggacccccctttgtttctttgtatgtttgtaaaaagggcccttttaaaacacgggaatgttttggtttgtaccgaccttgacaaatgggtgttaataaaaattccttttgccccaagggta

SEQ ID NO: 647051 - DNA, 738 bp, Homo sapiens
gtggtgtctagctctgaatggggaaactgggggcagcaacacttataggcagttaaagccactctgccctctctcctactttggctgactcttcaagaatgccattcaacaagtatttatggagtacctactataatacagtagctaacatgtattgagcacagattttttttggtaaaactgtgaggagctaggatatatacttggtgaaacaaaccagtatgttccctgttctcttgagcttcgactcttctgtgcgctactgctgcgcactgctttttctacaggcattacatcaactcctaaggggtcctctgggattagttatgcagatattaaatcacccgaagacactaacttacagaagacacaactccttccccagtgatcactgtcataaccagtgctctaccggattccatcactgaggactgatgttgactgacatcattttctttatccgaataaacatgggggtctattagctggaagccttacccagtaattggcatgacatctgagcacagaaataatggcaaaaacccaagcaaaccaatacatggtgctggaataacctgatgcccagcccaaggagttgattctgcggttttgacctagggaaactagaggcttcacagacccttcagaaggtttacgagaggcatatgcttcaaatgaaagatatttttggcaacaaatagggcatggttcgcctaggcctcataaagccggccttta

SEQ ID NO: 647052 - DNA, 219 bp, Homo sapiens
ggcctgccgagtgggtccctgcaaacaaacaaaaaaaaaaaccctccccaaaaggagtaatccctgagaggattctcaaatgcataaataatttttcatttagaattttctcgactttccctcaagggatctgaaatttattctcaattatccttctaattgtgtcaaaggcccaagtccagtgttatacaacttggccggtctgatacaatgcagaat

SEQ ID NO: 647053 - DNA, 207 bp, Homo sapiens
  misc_feature (18)..(19): n is a, c, g, or t
taaactttgctgtagagnnggagggaaaaagaggaagatagtcttcttgtcgtgggccgtcttatcagcctagcaataataaactatcaccatagcaacaggaagtctaattgatggcagatgttgagccactttaaaagccacgccaactgaatgccaagctgatgctgtaaacctctctcctctcccgcggctagactaatcatg

SEQ ID NO: 647054 - DNA, 264 bp, Homo sapiens
  misc_feature (86)..(86): n is a, c, g, or t
  misc_feature (98)..(99): n is a, c, g, or t
  misc_feature (105)..(105): n is a, c, g, or t
  misc_feature (110)..(112): n is a, c, g, or t
  misc_feature (114)..(115): n is a, c, g, or t
  misc_feature (123)..(123): n is a, c, g, or t
  misc_feature (166)..(166): n is a, c, g, or t
aatcgagcttcggtaccacatgaggctcttacacatggtcggcgaggagaatcatcgacaatgacaccgaggaggagtctacctcnggcgctggatgnngggctnttgtnnncnngcacatcngctacatcatggccgagatctgcaatgccaatgtcccccagantcgccagagggttcaccagatcctaaacatgcgtggaagctccatcaaaattgtcaggcatatcatcaaggagtatgcagagaacatcggggacggcc

SEQ ID NO: 647055 - DNA, 213 bp, Homo sapiens
attcgcggccgcgtcgacattttgtctctcagaggatttggtctcacaatgaagctggcctcatattatgagttagggaggagtccctcttcctacattttttggtataattttggtaggattggaatctgctcttctttatacatgtgttaaaattcagctgtgaatccatctgatacaaggctttttctgggtgataaggaattttttatt

SEQ ID NO: 647056 - DNA, 398 bp, Homo sapiens
aacaaacactgatcttatttctgtcactatagattaaatttgtgtctggcttctttcacttagcataatgtttttgagatttattcatccatgttgttaagtgatcagtatttgtttctttttgttattagctaagattgatgaaaacctgaacctacaacttaaaaaaaaattgtaatgtcttcttgacattgattctttgtgggaggtatattgtgaaatcacagtgaatcttaagtattaaagtgtgttcaagcagataactgttttagatatacttgatctaatgttattttcttttgctttttttacttgaactgttaaagttacaatgaaaaattattttaaagtcatacttcttggttaatttaaaagccttctcaacactaaaaaaaaaa

SEQ ID NO: 647057 - DNA, 387 bp, Homo sapiens
  misc_feature (1)..(1): n is a, c, g, or t
ngttttctttctctttatacctttaagatcatatcattggtcataactcctttttcttcttcagacttaaatattccctgttagtttagctttctaacaagtcattttactagtgtatttgttttgtttttcattgttttcctatccctaaattttgactttttttctctttgtatactgtctttcagtttggctgtgttaatgctatgactaaatcttcaagtattcataccaggtgtatggatgactaaaaataaaatttcccacctggacttaaaatttgcctttagaaactggatacaatataatatccaagttctctcctccagtactttttgtttgcttgttttgctaaaatgttaaaaaaaaaagtaagttaaaatgtga

SEQ ID NO: 647058 - DNA, 364 bp, Homo sapiens
ttggcacgagcacatttgatgtgaaagcttagatctaacaatgagaaagaaccacaacctggacagcaaggagcatagcattcctacattggaacagcatgtgcaaaggtctcccagcaaaggggaaatggaaaggatagcagtttcaaccttcatttaatttttaattttaatttttttgctgcaaccctcaaatcctgggcttaaatcagtcgtcctacttcaacctttcttggtgcccggaaatacgggcatgaaccatcgcccctagtcataccactcattattatctctttaagtctgtaattggtccaacaggctcgttggtattctgtgaggcctcagaggtcagatttaactcgcc

SEQ ID NO: 647059 - DNA, 186 bp, Homo sapiens
cgagtcctgagacttgtctgttggagacggattacacctttcccacttgcctgaaaaggtcaaggaccttaacttggctgatccatctagcctcagtgtgctgctgccctgaggcgctagtcacagctagctccgtcgcgctgcacgtcagcagcgagtcagaaggcgagacgcgacagaacgtga

SEQ ID NO: 647060 - DNA, 438 bp, Homo sapiens
attggcgacatttcaaagactctaagataatcattgcttcccctcaatagtcagaatccaccatgtcagtatccataatcgggaaactaaagaggtaaaagaaaatcaactaaaagtgtacgcttgttagtatagacggttgcatgtagcagggagaccgcataatcgctcttggggattaaccctctggccctgaaaatagtaaagtcagaaaattaagataagtaatatatacttaaaatacttaaaacctgtatctatatccattttcaagagatgtgacagttaagagatgacggaaattatattattataaatgtttactgcataacagtacaaaattgatgttcccaaaaagagggtaaaaaaatctttaactgacattaaacatcttaagtaatttggaaaaatcccaaggttgaaatggtcgccaatccg

SEQ ID NO: 647061 - DNA, 351 bp, Homo sapiens
gagatatcccctttcttgttctgctcttgtgggtgtgcccggcgggcctgaatttccccttgtggaaagaagctcctttcactggcactaagtcttgcatgaaaccgggaggaccacacagtgcagggaccagaagaacagcatgtacccagcctgttcccgacagcgagaggcgggaagcttctgggatcctgtggttcgcagctcaatcaagctctacgtcccgatatggtgacaacttctccagagagacgtggggcctccctgccccatgaggaccaaggccaagccaccagggatgcggcgattcaatgtgtctgagtgttaacattaccctgttccctttccttt

SEQ ID NO: 647062 - DNA, 160 bp, Homo sapiens
gagcgtgggctaccctgcagctactatggtcctatggtagagtgtacttgcagcgaggcacggacgtgatagaatgagaggctgcctctcctttgacattcacaccatccacgtgtgtctgcaccttgcagtcttacttggattaccatctgatggtccc

SEQ ID NO: 647063 - DNA, 268 bp, Homo sapiens
ttcttagacagagtctccctctgttacccaagctggagtacagtggcaggatcatagcccaccacagccttgaaaccctgggctcaaagcaaatcctcctgcctcagtttcccaagtatttggaactataggcatgaagcaaccacgccaagctaatctttcaaattttttgtagacatggagtttccatatgttgcaaagggaactcctggctctcaagggattctccaaccttggccccccaaactactaagactacaggcatgag

SEQ ID NO: 647064 - DNA, 365 bp, Homo sapiens
gcttcatagtcaacatgtactggtcagaccaagggcttttgatctacctgggaaaatactttggtgttaacctttgaaaatagttaatcttggcagggcacagtggctcacgcctgtaatcccagcactttgggaggccaaggtgggcagattacaaggtcaggagtctgagaccagcctggccagcatggtgaaaccccgtctctactaaaaatacaaaaaaaaattagccaggcatggtggcgggcgctactcgggaagctgaggcaggagaatcgcttgaacttgggaagtggagcttgcagtgagccgagattgcgccactgcactccagactgggcgacagagcaagactccagctcaaa

SEQ ID NO: 647065 - DNA, 867 bp, Homo sapiens
gcgcgatacgcccgtagccccggcaaacggccccaaaggggcgatgcagataccgaaggtatctgcgctctgtattagggaggtcgagctgggcctgaagggcagaagcaggaccactacctgcgtatgatgctgttgcgccgtgaccctaccctcgcgaggccgaagctggggcgctgatcgtgggcgcgctgggttgcgatgattgagggcttctcggagtggtctcatagtaccgagacttcatacagtactagagcagcggggaggggggacgaccccagtgtacatgggtgacattgggctgaggggaaggacggtggtctcacagttccgagtgagagaaacttcaatcatctatgtcagacgggaagcctatcgttctcactagtgtatctcgatgttctgcgccgatgagacacgagtcgaggatggcacgagctatggcggttgtggaacgtgccttgggtgctgtccccgtgacaccaggtggaaaccataccgttgcttgtcgcggtgaccactaacactggcagatggtagagagccgctggtcgcgttgtgggacctctcaaacatgcgtggccaaactcaatccaatgctggcagtttcagtcatgcaagagtcaggatgatgaatatcgattgtagttgatcatcgcctaaatggccgtggagccggcagaggcccggtagttcagaggaatcacggggtgcccccagggcacaaaccggtggagacggtgcgcagccgaggagatcagaggaacgcacaatcgcgggatggcgcacatgggccaagggatccctcggaggtacaaacaagtggaaaaccgaccgttaccatggacgggggaagccaccaga

SEQ ID NO: 647066 - DNA, 184 bp, Homo sapiens
  misc_feature (30)..(30): n is a, c, g, or t
  misc_feature (57)..(57): n is a, c, g, or t
atggatggcagcaacctgatgcctccctanaagctgagcagatgctagcaccatgcntcctgtacagcctgcaaaactgtgagccaattaaacctcttctttataaattacccagtctcacgtatttctttatagtacttcaagaatggcctaatacagatggatagtctctcgtgccgaattc

SEQ ID NO: 647067 - DNA, 249 bp, Homo sapiens
  misc_feature (93)..(93): n is a, c, g, or t
  misc_feature (96)..(96): n is a, c, g, or t
  misc_feature (101)..(101): n is a, c, g, or t
  misc_feature (103)..(103): n is a, c, g, or t
  misc_feature (118)..(119): n is a, c, g, or t
  misc_feature (150)..(150): n is a, c, g, or t
cattaggcgcgtatagcgactacggttctgcgctaggacaggtggtaacacatttgtgtgttgagactgggttggtagaagaacagagctcancanatctntngtgtggagggagagnnaaaaagagcagtatgtgagggcaggtgctcngctactgcttccttcttggagcaggtgaccaaggagtaagggtatcactccctgcccatcccaggctccctgctataggagaggggcctacgctaaacc

SEQ ID NO: 647068 - DNA, 505 bp, Homo sapiens
cagggttacatgctacaaggattctcctaacagcactgacttgcattatccaaaatggaaagactctgaatgctcaccaacaggagattgggcagatacgccagagcatacccattcgatgacgcatcatgctggcaccaaaagagaggcagctctctatgtgagctgttacataacaacagtctgagagatactattaacagaaaagaggcaggtgccgggaacacatgtccagcatgatcccaattacaggtttcctaaagggctgtctagcatgtgtatgtgtaggctatgcatgcttgcctatgcacagaaaatttctagaggaaaattaagaggccattaacagtaggatagtagaaatgaagtattcacgtctacaaaagtgatacctgtattttttcatctttagtatcttctgtactattccagtgttttctcttctcttttttgttttatgcactctgtacatttttcttttatggtaaaacaaatcatctttaac

SEQ ID NO: 647069 - DNA, 154 bp, Homo sapiens
tgtactctatatgacatgctgaccccctacccagctcaccatcagacacccatgattaatacctcactcatgttgcactgcttcatgtgcctccacaatggcctttccttatagtatggccctttggtcctggctgtcttgatgtgtacctgat

SEQ ID NO: 647070 - DNA, 204 bp, Homo sapiens
ccagcaccgagtcttttgacctcagagtcctcacctgaactgctggatcttgaagttatttcatcctcagaaactttatgtatggtgaagtacttttaagcctgtggctatattctgtaagttagctttacacaaaatactcgagggacagtgaacttcattcaaatgcagtgtggaactctcaggtttccttgagtcagcctc

SEQ ID NO: 647071 - DNA, 1757 bp, Homo sapiens
gatcacattgcacagcaagtattatctcctgatacagatgctggtgaatgcaggggagtgagattcattgctcatctttggatatgaagtctgttagggaagaaacagtgccactattcccttagatgcaacagtagcatagcctcttcacccaggcgtccaaaagcttggcgtgaagatttcagcaaacatgtcttacaacatgaggaggaggagtctaaatcagtcaggggataaaagtatcgaatcatagacaagcacacacttggctttagattcttacagagggtttcgtactcgtcatcaccgtcgcgcaggtcgaagattcacttttaactattcagtattcatgaaaacaacatggatctacactgttaactgattgagactccactgctgattcactctgttttacttaaacaacttttcagggcatgtctgtagacatcacagggtcaatatgtcatgacacaagtggtgtggcatcgcatctaaggagggaccagaactaataacagcatataccacaattactgaaggcaacacgcatcattgatttatactacatgtcacaagcaaacaaacgcgaaactgacgagcacccagcccgggcgagacttacacactacaagcacatgacaaccggcgcaccatcacatcatacccaagggaaacgagctgcggacaataccacacaacccagcaggcaaacgaaaccgccacagaacacagcaccaagaccaactcagcgtaaaccagcccacacaaggactactgcacataaccactgtaccgacgaacctgcaatacaccaataagccaaccgaaccaggatgcgaggacgtatgcgagcaagcgaaaacgatgataaacccaccgaacatctcacatacaatcctgtacagacaccaaaaaacgacaatgccagacaagcaaaacacagagacaaaagacacgaacaagcacaacagcacaggagacagaaaacagacagcgaagacacgacaagaagagagcagggaacaaaagaacgacgcacgagcaggagagatcagacagaaagacggcaacgacgcgagaacgcggcgaagagcgagcaaaccacgaacgagaagagaagaaagacacgaggaccgacaaagaagagaggcgagggccgagacagagagcgagaaaagaggacgacagcacagggaaacacgaagcagagaataaggcgacagcaagaagacagacaagacagaaggacaagcacagcggaggagacgaggagccaacggtgagacaaggagatagagagtaagaggatgagacaagagacagagagaaagaagcacgagagcgagacgcagcgagaagcaaacacgagagccaggaggggacaggaaccgacagagaccagagacacgggacgaaagaaagggacgatagaagggacgagacagcaagacacagcggcaggagagagggacggaaagagacgaacgaaggcgatacgagacgaacaagagcaaaagaacacacgacgagagaaggcagagggcagcaagaaggagaggacagacaagacgagaacagaagagcggggaggcgtgacgagaagaaggactagaacaacggcgtggcatgaggcaacagaatgagaaggaagaagcgcaggaagacagaggaagacaacgagacgtagatgcggaacaaaggacgacgaagcagcagacgggacgaggacacgagacagggaacgagggggacaagag

SEQ ID NO: 647072 - DNA, 756 bp, Homo sapiens
tgggcatttctcagcctcaaaacaagaatagatttctaataaagaaacaggtcatgataaaaaagtagaggtgtggggccaggtgtcatggctcacacattgtaatcccacacttagggagactgaggtgggtggattccttgaggccaggagttagagaccaacctgggcagcatagtgagaccttatctctacaaaaaaatttaaaaattagctgagtgtcaggccgggcacggtggctcacgcctgtagtcccagcactttgagaggccggggcgggcagatcgcggggtcgggagatcgagactatcctggttagcacggtgaaaccctgtctctactaaaagtataaaaattagctgggcgtggtggcgggtgcctgtagtcccagctactcgggaggctgaggcgggagaattgcttgaacccgggaggcggaagttgcagtgagccgagattgtgccactgcactccagcctgggcacctgacagagcgagactccgtctcaaaaaagaagaagaaaaaaaaatattagatgtagttaaaaaaaaaaattttaccatgagatgggggggaaaattgcctgaagcacaaacgacaacatcacggatgacagaggcaagcgaaaacacaaataagagcccaaaggaagcacaaaaaacacagggggaaacaccgagagacacaaaccaaacagcagggtacacacacacaaacgggagacaaacagagaaagcaactaaacggcagcagga

SEQ ID NO: 647073 - DNA, 217 bp, Homo sapiens
  misc_feature (31)..(31): n is a, c, g, or t
aggaaaaggagtcacggctctcatgcatgtnttatttgtgtttaaataaaaccacaaaaactgaaaaaaaaaaaaaaaaaaaagggggggctccagaattggaccagttccaaaatatagggtggatttttggtgggcggggcccccaaggagcggtacccatttaccttttatttcctaaaattaattggggggcagtgtaaccattacgtggatt

SEQ ID NO: 647074 - DNA, 138 bp, Homo sapiens
aggtgttgtgaagagcgaagacttatcgctcccagacttatatggatcggcgtgacctccccctggcgcggaggtggcccatgtcaagcacctgttctgccagcctgaaggcactgcaatgtgagaatggagataggc

SEQ ID NO: 647075 - DNA, 484 bp, Homo sapiens
catacatatcagctctgtacctggctgtcagtgactattgatcattgctgcgcaatgtctaatctaccactaatcccattcacgctatatcttcatttctagaagattgattttgggtcttttatctttttgagacagatctcatgctgtctcccaggctggagtgcaatgctatgatcatggctcactgctgcctcaaccttcctgggctcaagccttcctcataactcagcctcctaaatagctgagaccacaggtgtgcaccaccacgcccagctaatttttgtacttttctgtacagatggggttgtccagggtggtcttgatctcctgagctcaaacaatcctcacatctcagcctccagaagtgctgggattacaggtatgagccatgacgcccggccctaggtcttttttttatatcttccatttttttctttatttttatcatatttgccctgacattgaacacgtggaacatatt

SEQ ID NO: 647076 - DNA, 881 bp, Homo sapiens
agcggagtagcgtcacgcggaggcggagcgaggactcgtgggacagtcaccacctatttgcgaattcacaggagaatataagacacgagaagcaaagctgtgaatgaatttcactttgatctcagcaatagattggacactctactgatcttgcctctctacaacctctcttccacctgacctctaaatgttgaagtgtgtcaggaattgtcattagaccttcttccttatctacacttcctctccaatatggaattctcttccccaagctgttggcgatgtctagattcatttgcattgtctgggcatttcaggctcagctgtcatctcagtgaccagtttttatctgagcatgaagtcttgagtggctctgcacaagatcctgaaaaagagggaatattcttctgtgtgtgtgggcagagaagatgacattactgaatctgaaacgaatgtactagctgttgtccatgatagagaagtggtcattttctaccacaagggacgcaatatcatgctatggatcttcgctgttaccactcaggaggacctttacatttgggagatactagaggattcgatggacgaccgtagtatagtctgccccctgtgcataaataacgaagttactttggctacaggagaaggtctgtaccagtctataaaccctaaagatccatcagataaagccaggtggtgctcccaaggaactaacgcaagggttcgcacagtgacggtagacaacggacattttttatgtgactctttctaatgaaccttttaagtgtgactcctgaatttatgccactggagacttcacagtaattagaagttcttcctggtaaaaatttttgaaatggaactggtgtgtatgcttgaaaaca

SEQ ID NO: 647077 - DNA, 435 bp, Homo sapiens
ctcgcatccatgcatggctggggatacctcaggacatttacagtcttgtgcagaagccacctcttcatagagtcgtcgtgatgaaagacttgactgcgagcaagggaaatgccagatatgtattaacccatcagatctcataagactcactcattatcacgagaattgtcatgggggatctgcccccattatccaattacctccacctgtccctaccttgacacttggggattatggggattcatcaattcatgcgtgtagatttgagtggggacacatagcctaatcacatcagacagattacgttcattattctaggattatacatctgatatctattagagtcggtctttgaattcatattctctgactcttagtccattgccttttccattgtatcatgttgtatttgatgtaagaggagccggtgccatg

SEQ ID NO: 647078 - DNA, 958 bp, Homo sapiens
  misc_feature (309)..(309): n is a, c, g, or t
aagaactagtagctttaactgtgagggcacagacttgaagtgggagtgatgagattctgtaggggacccatgagttgtgatagaggtctcgaggggaattggcgtgagacgaatgggtctcagagacactagtgcctgtagcatgtggatgaagaaaatctggctggttaagaagggcttcccttaagtatctcgccctcatacatctcatggagactgttctggaaatagcttttgtcttaccaaccctgccctggacaaggagcatccagatcacgacatgtgctcttggtgtacttttagcctggnggcaattggagttatccacatggcataatgttgggtggctatgcatagctattaagactcctcgtgttggcatgatgcactactagtcccccaggggtgccactacctaccttaacaatgaagatcgcagcaatggatccctaatggatggcgacatatctttcttttgaagaagtcccaacttgttaacttgcgtcgctgtttaagtgaaggccagtacaggttaaagtgccacggcttggctattaacttgcttgggatgcgtcaccagtattcctataaggtgtgtacttgactctttcacgggggcttccttttaacttacgtcctacaactaaacgttatagtagactggaaggaccctaatctgctattgttgaagggaattaccattgctgcgagatgtcgttgcacctttgggaccaatgagcaccttggacctgggaccataaagcgggagttaagagggggttagatctccattcctgttcaagatattgactccctggtgcaaatatcacctttaagattactcccagtgggtgctttccttgcttgaatgaaattacgggacgaggcattaagtgggatagggacttgaatagaacctttaaagaataccgtcttagtgtctatgaattggacccaa

SEQ ID NO: 647079 - DNA, 1386 bp, Homo sapiens
gcgtggtcttctactgctcgttgtccggttgtgtgcttggggccaggtgtgcgggtcggtctgggtgtgtgccgtgtcacgtggtgttgttgcgttagcgccctgtggcgggaggcgtcccgcgttctgtcctcgatgttggggccctgccttctcgttcctttttagcgtgtgtcagcatctcgcgcggctcgctgtcccgttgtgtcccgttttggtctatcgttccgtgcagtctttgtcgtggtcctgaggttctattgctggtaaaccgccttaaggctacttccatcccgctggcttatttgaattgtcctgtcgctcgcacgtgctttctaggggccagttggcgtccggagtgccctagtgttgacgcttatgtttggacctttctctggtcggttccgttttgcatacgtgccctatggttcctgtgcgccctctgtcgttctggtcgtgtgtgtgctttggtcggtctacagccttggtaggttcgcttgctaagggcccgtgggaggctgtgggggggttggtgcatgggtgtgaagttgtctcatgctatgttgtaaacggtgtaatgtgggcgaagttgattctgttagttgggtgttagaatggaggtccctgttacggttgttgttagttaaggggcttgtgtttttctgacaggtgttagcggtgttatggatggtcggagctatggtcgagttgcttctagtgaggaactttacgttttaggagcttgttaggttcgaatgtttgaggtagcgttctgagggttttgttgaggaggtatataagcttgttaatgggtagtggggtagggtcttggtcttggttgtgtatagaaggggtatagataggccaagtactggtttagtacagtactccttatgctcgtagctccaggccttagctgtgtccctggcccctctggtccagctgctgcagacacctgcgcgttaagcagcagcacatcctctaggtagctccacagttttgccttataaggaccttcccaagtctccctttccctgtctggcttctcccattaagaagagagagatacttgatagaattgggtggggggaatgagcatgaacggtccttgccatttgggatatgttacattagtagtgagagtagagaataaggagcctttcgttatggaagtatatgggagtaagagagactagggttcttttcagcagagtctagtagtttctctgtaaggcttaaataatcatgaaaagagacgaacctgcccacgccactccttatattgctgtgagattgcccctatcttgtgctcttctgtctgcagtgtgcacgtcaacgtccaatcccgactataaggtgttgcgggcgggggccccgggcggggcg

SEQ ID NO: 647080 - DNA, 419 bp, Homo sapiens
  misc_feature (1)..(1): n is a, c, g, or t
  misc_feature (52)..(52): n is a, c, g, or t
  misc_feature (78)..(78): n is a, c, g, or t
  misc_feature (88)..(88): n is a, c, g, or t
  misc_feature (108)..(108): n is a, c, g, or t
nggccctaaacactcccaccagtcaaccaactgatagagtaaggttttttcncgttacccctgaatccccctcctccnggctccaccntgcaagatcggccagccatnccacagatgtctttttgtatgattagaaaggaaatcagaaaccaggctggtgcctgccggggcgctgcactccgaaactcagacgccagctctgttatctgtacccttcccccaccgtgctattttctttggattagagatgcttttacctggaaactccactttaatttttttttttaagtcaaactccctgagctactttgaagattttcaccagggtgggactgtctaggcagggtggtggttgcgcttttctcggctaccaacagggtacattatcacagctgtcctgtgaaaggcactacatactt

SEQ ID NO: 647081 - DNA, 478 bp, Homo sapiens
  misc_feature (316)..(316): n is a, c, g, or t
tataatgctgagtaaaagcacaccattaaaaaatttgttttttaagacggagtctcactctgttacccaggctggaatgcagtggcgtaatctcagctcactcactgcaacctccacctcccaggttcaagcgactctcctgcctcagcttcctgagtagctgtggccacaggcacacaacaccatgcatggctaattttggtatttttagtacagatggggtttcaacatgttggccaggctggtctcgaactcctgacctcaggtgaactgcctgccttggcctcccaaagtgctggaattacaggcgtgtgtnaccatgctctgccaaaaaaaaaaatttttttttttggaaacggtgtcttgtccttgttgcccaggctgcattgcatgggctcattctcggctcattgcaccctcggcggagaaagctctcttatggtcttggcccttagctacagataaggcacccaggggg

SEQ ID NO: 647082 - DNA, 847 bp, Homo sapiens
  misc_feature (429)..(429): n is a, c, g, or t
  misc_feature (434)..(435): n is a, c, g, or t
  misc_feature (499)..(499): n is a, c, g, or t
  misc_feature (516)..(516): n is a, c, g, or t
  misc_feature (519)..(519): n is a, c, g, or t
  misc_feature (569)..(569): n is a, c, g, or t
  misc_feature (581)..(581): n is a, c, g, or t
  misc_feature (586)..(586): n is a, c, g, or t
  misc_feature (594)..(594): n is a, c, g, or t
  misc_feature (596)..(596): n is a, c, g, or t
  misc_feature (607)..(607): n is a, c, g, or t
  misc_feature (614)..(614): n is a, c, g, or t
  misc_feature (616)..(616): n is a, c, g, or t
  misc_feature (630)..(630): n is a, c, g, or t
  misc_feature (645)..(645): n is a, c, g, or t
  misc_feature (660)..(661): n is a, c, g, or t
  misc_feature (664)..(664): n is a, c, g, or t
  misc_feature (667)..(667): n is a, c, g, or t
  misc_feature (671)..(671): n is a, c, g, or t
  misc_feature (673)..(673): n is a, c, g, or t
  misc_feature (675)..(675): n is a, c, g, or t
  misc_feature (677)..(677): n is a, c, g, or t
  misc_feature (684)..(684): n is a, c, g, or t
agcggggggagctgccagagtaaagcaaagagaaaggaagcaggcccgttggaagtggttgtgacaaccccagcaatgtggagaagcctgtggcttgccctggctctctgtctcctcccatcgggaggaacagagagccaggaccaaagctccttatgtaagcaacccccagcctggagcataagagatcaagatccaatgctaaacttcaatggttcagtgactgtggttgctcttcttcaagccagctgatacctgtgcatactggaggcatctaaattagaagacctgcgagtgaaactgaagaaagaaggatattctaatatttcttatattggtggtaatcatcaaggaatctcttctcgattaaaatacacacatcttaagaataaggtttcagagcatattcctgtttatcaacaagaaganaaccnnacagatgtctggactcttttaaatggaagcaaagatgacttcctcatatatgatagatgtggcngtcttgtatatcatcgnggnttgctttttccttcctaactttcccatatgtagaagaagccattaagatngcttactgtganaaganatgtgganantgctctctcangactctnanagatgaagacttcngtaaacgtgtatctntggctactgtggatnnaanagntganantncntcgcctnattaccatcatgaacatcatcacaatcaaggacattaacaccttggcaggagtgaagtctcagagaatcagcaactagtagcaccaaatgctcgtacttaatcctgctcttccggccttattcacaccataagcacaagggtcagataagagggacccaagaa

SEQ ID NO: 647083 - DNA, 460 bp, Homo sapiens
gagccaaactgataatctcctcagactatgcctatggagccaccgggcacccaggcatcatcccaccacatgccactcttgtttttgatgtggagcttctaaaactggaatgacagaagtggcctcctcccttagctctgcacgtgggtaagagtacttaatggtgaaaggctctaactccctttgttgctcccttgttaggtccagggtttggtaaagacaagggcaagaagatactacatgtggccacttcccccctccccctccccttggtgttaatgtcagtgtaagagttgatcattccaagaacaggatggcatgtgtattgaaggagcttgtgggaatggcagatgttaaaactttttacatgtagcttattgagtttgagttgaagtctctagagtcacaggccaggttcatagtgctaacattttagactttcagaaataacaactctttc

SEQ ID NO: 647084 - DNA, 660 bp, Homo sapiens
atctccgcctgaaacgtgatgcagcagaagctttctatattgcgaacgatgaaataccttactttacttgcagctatgggaagggttaccaatctcaccgagtgccatggggacgatgtaatacagctcaagagacagctgctgccatctgagaatcttcatacaattgaagaatgcaaagacagggtacctgagcctcgggaggagaaactacttcaagacgaccagaataactgctgaaggctacaagtggagactctagacccatctattgcgcaatatgcatgttctcacttagtgctacaaagagaaggagacaatcttagcgtgtcgggcgcaccctcgaggcgtctgtagactagagcatgcttaggcattctgctcgaataggagctcctttgcacaattcgatgtatggctggtagaactcaatgtactggacagaggtatcatagaaagagaacgtattgccgtggcgtacacaactgaaacttctagagctatatcctacttaaggctgatggggaataccgtagagtgcccgaccgatttatctttaaacagattgcccaccccatatgttgaatggaaattttttgccaaataattggataactacgcgtaaatgtggcaaacctgtattttgtaaccaataggcaa

SEQ ID NO: 647085 - DNA, 692 bp, Homo sapiens
  misc_feature (429)..(429): n is a, c, g, or t
  misc_feature (434)..(435): n is a, c, g, or t
  misc_feature (499)..(499): n is a, c, g, or t
  misc_feature (516)..(516): n is a, c, g, or t
  misc_feature (519)..(519): n is a, c, g, or t
agcggggggagctgccagagtaaagcaaagagaaaggaagcaggcccgttggaagtggttgtgacaaccccagcaatgtggagaagcctgtggcttgccctggctctctgtctcctcccatcgggaggaacagagagccaggaccaaagctccttatgtaagcaacccccagcctggagcataagagatcaagatccaatgctaaacttcaatggttcagtgactgtggttgctcttcttcaagccagctgatacctgtgcatactggaggcatctaaattagaagacctgcgagtgaaactgaagaaagaaggatattctaatatttcttatattggtggtaatcatcaaggaatctcttctcgattaaaatacacacatcttaagaataaggtttcagagcatattcctgtttatcaacaagaaganaaccnnacagatgtctggactcttttaaatggaagcaaagatgacttcctcatatatgatagatgtggcngtcttgtatatcatcgnggnttgctttttccttcctaactttcccatatgtagaagaaccatttagagggcttactgtgggaatgtggaaactggctctttacgactctcggatgaggagctttggcgtgtatctggtggtactgtggatgtggggcatcagcaccctgggcagcgggtggctttggagaggg

SEQ ID NO: 647086 - DNA, 732 bp, Homo sapiens
  misc_feature (375)..(375): n is a, c, g, or t
  misc_feature (380)..(381): n is a, c, g, or t
  misc_feature (454)..(454): n is a, c, g, or t
  misc_feature (466)..(466): n is a, c, g, or t
  misc_feature (471)..(471): n is a, c, g, or t
  misc_feature (479)..(479): n is a, c, g, or t
  misc_feature (481)..(481): n is a, c, g, or t
  misc_feature (492)..(492): n is a, c, g, or t
  misc_feature (499)..(499): n is a, c, g, or t
  misc_feature (501)..(501): n is a, c, g, or t
  misc_feature (515)..(515): n is a, c, g, or t
  misc_feature (530)..(530): n is a, c, g, or t
  misc_feature (545)..(546): n is a, c, g, or t
  misc_feature (549)..(549): n is a, c, g, or t
  misc_feature (552)..(552): n is a, c, g, or t
  misc_feature (556)..(556): n is a, c, g, or t
  misc_feature (558)..(558): n is a, c, g, or t
  misc_feature (560)..(560): n is a, c, g, or t
  misc_feature (562)..(562): n is a, c, g, or t
  misc_feature (569)..(569): n is a, c, g, or t
agcggggggagctgccagagtaaagcaaagagaaaggaagcaggcccgttggaagtggttgtgacaaccccagcaatgtggagaagcctgtggcttgccctggctctctgtctcctcccatcgggaggaacagagagccaggaccaaagctccttatgtaagcaacccccagcctggagcataagagatcaagatccaatgctaaacttcaatggttcagtgactgtggttgctcttcttcaagccagctgatacctgtgcatactggaggcatctaaattagaagacctgcgagtaggaatctcttctcgattaaaatacacacatcttaagaataaggtttcagagcatattcctgtttatcaacaagaaganaaccnnacagatgtctggactcttttaaatggaagcaaagatgacttcctcatatatgatagaagaagccattaagatngcttactgtganaaganatgtgganantgctctctcangactctnanagatgaagacttcngtaaacgtgtatctntggctactgtggatnnaanagntganantncntcgcctnattaccatcatgaacatcatcacaatcaaggacattaacaccttggcaggagtgaagtctcagagaatcagcaactagtagcaccaaatgctcgtacttaatcctgctcttccggccttattcacaccataagcacaagggtcagataagagggacccaagaa

SEQ ID NO: 647087 - DNA, 1169 bp, Homo sapiens
  misc_feature (447)..(447): n is a, c, g, or t
gccagagacgcagccgcgctcccaccgacccacaccctaccgtcgccctcgattacgccatcttcatccgtggagccagtctcgcggcctagcggcagaccgcacacgagccactatctgcctacgcctccggtcagacagtggtccaccaaggttcacagagatctctacgttccgtccatacgcggcgaggaatagtatacgagcgagaacccggtggcaccgacgcaggccgggtccgcaggtcatctcagcacgggagtacttagcgttggacataacggtaccgaacacgcgacgaactcataacaggccgcatgagagacgaggcggacgatctggcgacccacgaggcacgcgtagacctagcgaaagccatactatacggcacatacaggtgcaacccacagtgagccgcgggcgggtaagtatatgagtccgaatggncaaggcgtaccagtacatggaccccgggtaagcgcggccataagcatgtgcagccaaagacagtgtgccaacgtgatggtgtttgcttagggccttacaccttggtcactagggccacatagccgagcctagtgataacatatacctatcgaccatttggtacgcagatagcggacagacattccttaacacggaacggcggcaggattatccaggagcaaagacccaaacgcgcgggcgcacctcaaggaccgcgatgcacacacggcttggcgacagacccttggacccaatatgctggacaggtcaccttggcacaattggaaaccgccggcacatattcacaggtccgcaaaacccttgaacccagttaccgaagctactaactgcggtttgcctggctgtatgacgccctggtggcaccaccacagtgcactcaaaagcttaacaggcgcactcctcttggacgtggggcgccactgtaataccccatccggaatgcgacaaaggcccatccaacaagggggggacccccaaaacggggaccacaacgccaacccgtgcagaccccagtgaggagctggcgaacccgcccgtaaccgccaagggagaacggcaggacatgggccggcagcgcaaacaatggcccacacccagcgagcaaacggcctgcgaacctcccaagaccgcacacccacaacaccgaacccaaacaaagaacc

SEQ ID NO: 647088 - DNA, 756 bp, Homo sapiens
  misc_feature (16)..(16): n is a, c, g, or t
  misc_feature (34)..(34): n is a, c, g, or t
  misc_feature (40)..(40): n is a, c, g, or t
  misc_feature (493)..(493): n is a, c, g, or t
  misc_feature (498)..(499): n is a, c, g, or t
  misc_feature (563)..(563): n is a, c, g, or t
  misc_feature (580)..(580): n is a, c, g, or t
  misc_feature (583)..(583): n is a, c, g, or t
cctggactcctttccncatcgacggcaatcgaangggccngcgccattgcggtcattcccgccaattgggccattatggccggtgggggaatttagaagggaagctttcccgttggaagtggttgtgacaaccccagcaatgtggagaagcctgtggcttgccctggctctctgtctcctcccatcgggaggaacagagagccaggaccaaagctccttatgtaagcaacccccagcctggagcataagagatcaagatccaatgctaaacttcaatggttcagtgactgtggttgctcttcttcaagccagctgatacctgtgcatactggaggcatctaaattagaagacctgcgagtgaaactgaagaaagaaggatattctaatatttcttatattggtggtaatcatcaaggaatctcttctcgattaaaatacacacatcttaagaataaggtttcagagcatattcctgtttatcaacaagaaganaaccnnacagatgtctggactcttttaaatggaagcaaagatgacttcctcatatatgatagatgtggcngtcttgtatatcatcgnggnttgctttttccttcctaactttcccatatgtagaagaaccatttagagggcttactgtgggaatgtggaaactggctctttacgactctcggatgaggagctttggcgtgtatctggtggtactgtggatgtggggcatcagcaccctgggcagcgggtggctttggagaggg

SEQ ID NO: 647089 - DNA, 311 bp, Homo sapiens
tagacaaggtgtgtgtcctgagcgtgagtattttggcagatgcagctcaaagtcatcagcagagtctccagcatccctctcatcctcttagcacactgatcaggatgtgatttcccagagagctcaaggcatgctgtcaccacgcaggcagaatgaaactcagccacaaagagaacgtcctgaagtttccttccctgtcatacatcttttcagataaaaagtcatgacaggagtcactgttttaaaattatccagatcacagttgtgatagagtcgctttaccaccctgaatggagtaagtctcgattgca

SEQ ID NO: 647090 - DNA, 483 bp, Homo sapiens
  misc_feature (11)..(11): n is a, c, g, or t
  misc_feature (54)..(54): n is a, c, g, or t
  misc_feature (158)..(158): n is a, c, g, or t
  misc_feature (210)..(210): n is a, c, g, or t
  misc_feature (255)..(255): n is a, c, g, or t
  misc_feature (300)..(300): n is a, c, g, or t
  misc_feature (349)..(349): n is a, c, g, or t
  misc_feature (374)..(374): n is a, c, g, or t
  misc_feature (381)..(381): n is a, c, g, or t
  misc_feature (405)..(405): n is a, c, g, or t
agggccgcagnaagaagactggtcgaaactccctggagctgagaaagcggtgtncaggcggaggaggagactaggaggctgcagcagctgcaggcgttgcaccggcaagcagtcctgccgccaggtggaggagctggctgccgaggtccagaggctcnggaccgaaaaccagcggcttcgtcaggagaaccagatgtggaaccgagaggntgcccgtctgtgatgaggagcgggtacctaggggtgcctcccagncctggtggacccaaggagaaggtcccatttcgtgcacactcaggnccagtctgggtctcaaggagggaggtggcagatgaaaaccaccgtcaanaccctgtgcggccctgagaaacagnctaaatnggttcagaactcccacctcaccgnttgccatagttgggctcttttgtgtcatcttacccttacagagaaattaaatggtcctggtgggaccaaaaaaaaaaa

SEQ ID NO: 647091 - DNA, 191 bp, Homo sapiens
tgagctccaggcaccccgaaggcacttactatgaaacaagttccaattgtgccatcgtagatctatcacagagtggatgacgtgtacatacattaacttattacctcatttagtaatttttcgaaacaaagccctgaggaagaaaatttaaaactagaggaagcattttggtcattctgtaaagctgcgta

SEQ ID NO: 647092 - DNA, 942 bp, Homo sapiens
cggaccgggaagttttcgggccgtatagtcggatccagcgcgttgcgcatgatgaacaggttgtagagtccaggtttacctattgctctctggaggaaactacactagtcataatcccacgctttatggccctaaatgtataatcatagttcccatcagtattcaggccaggagtggagaggccacatataccaagtatgaacgggtctagaaacatatactatggcagccaagaatttggaggttttaaaatggtgctcattctgtcctctgaggtcttccttgatcccgtttataccttcaatccttacttctgccagtctgtattatcctatcaagggtgaaagtgatgatggtggtgcaggagggtgacaataaaatcctagtggacattggagaccattggcagggcatggactcatacacgtcagtgtgacacactgacgtctcaccctgccatgttgacatcagtgtccattggcttgctcttgagcctgtactctacgcaagcatcggattggataagcccaaactctgcttctatggtagggcatgcggacaacctatatcagcatggtcaaagccttcttggagcatagattccaacttaactatccggctcctcacacccattacatttactctgacacacttaacttgtggctccttatctgcaactttaccgacatgactttccccataccctataatcccaattcagcacaactattagataggtcctcctttaactcggttggcccaagactctttcagccccaatcctttgcatcattcccttcaaattattcaggaggagttctcaaagaccaggaaacacggtaagcccagtattcccctcgtgcggtcgcgtgattgccctgtcgatatgactggggcaacttcttcccgagtcgtcttagtcaggcataaactttcatgata

SEQ ID NO: 647093 - DNA, 346 bp, Homo sapiens
gttatttgccttatttaagggaacccctacaaccccagaagtagaatgaatgtggaaatattccttcttctcttgccgagcatggtggctcacacctgtaatccccagcactttgggaggttgaggcagatggatcactgaatgtcaggagttcaagaccagcctggcaccaacatagtgaaatcctgtctctgctgaaaacacaaaaattagccaggtgtgttgcaggcgcctgtgatcccagctacttgagaggctgagacaggagaatcacatgaacctgggaggcgaaggttgcagtgagctgcgattgtgccattgcactctaggctaggtgacggtgcga

SEQ ID NO: 647094 - DNA, 390 bp, Homo sapiens
ggtgcgacatcccagctactcgggaggctgaggcaggagaatcgcttgaatccgggaggtggaggttgcagtgaaccgagatcatgctattgtactccagcctgggcgacaagagcagcctgggcgacaagagcaagactccatctccaaaaatatatatatatacacatagagagaaacgttatagtgaaaaaaggggcccgttacagcggctcatccccataatcccagcatttgggtggctgaggccagcggatcacttgagctcaggagttcaagaccagcctgggcgacatagcaaaaccctgtctctacaaaaaatacaaaaattagccgggcatggtggcacacttgtagtgccagctactggagaggttgaggtaggaggat

SEQ ID NO: 647095 - DNA, 371 bp, Homo sapiens
caatgtgaaaatgcagtatcttctttttctgccaccaaatgtataatataccatatacatacatgtatataaatatatatatactatctgcctttttataagtctaaacttttctacattagcttatatgtaaggcaggctacatttttatgtatgatttctttcattatagtaagatttttagttataatattgccagtctttatgatgaaaatcataaagatatgtatttttaaaagtcaatttgaaagactaacagactaacagtacctcatatagtcaacctcaatcatgtaagtaccccagatataacatttccacacaaagaaataagaatactttaaaaaggagaacatagtaagtatgtccac

SEQ ID NO: 647096 - DNA, 249 bp, Homo sapiens
  misc_feature (236)..(236): n is a, c, g, or t
ctctatatgaatatcaatattgtttaatttcaggacaaaggacatggtttaaaacgtttgttcagtgtatggttaaagaaagttaacctagaactagtggatattactttatatctaaatagagatcattatttcttttcaaaaaggatatgccagtgatgattatagtctttaacagcagtagcttgtgagagtattaaaatgtttcttcttttataattcattctacgttaaanaaaatgaattata

SEQ ID NO: 647097 - DNA, 399 bp, Homo sapiens
gaggaaaaaccccctgggatcgtgcactatagtgggcgacacgaaacccaagttttacatgtcagttgtcctctgggtggggggggaaatttcgggactttgaccaacctccaagagagaatatggcatgttctagtaacaaccttgtgctacccatgtcttctaggcatccccaatggattggacaattgccctaaagtccccaacccactacagacagacagggatgaggacggtgtgggagatgcttgcgacagctgccctgaaatgagcaatcctacccaggtacagggagatggtaaggacaggggagggatgagggtactgatggatgaagccccagccctttggatggaaagtggtcagatcaccctcttcagagttatcaagaggagatgg

SEQ ID NO: 647098 - DNA, 116 bp, Homo sapiens
cctgcagtgagctacctggcccgccagcacttcaagaagagaaagatccaggacctggccattcgctgtgtacaggaagaacatcaagaagaacaaaggggtgaagtgactggccc

SEQ ID NO: 647099 - DNA, 1056 bp, Homo sapiens
  misc_feature (1)..(1): n is a, c, g, or t
  misc_feature (502)..(503): n is a, c, g, or t
  misc_feature (533)..(533): n is a, c, g, or t
  misc_feature (549)..(550): n is a, c, g, or t
  misc_feature (579)..(579): n is a, c, g, or t
  misc_feature (597)..(597): n is a, c, g, or t
  misc_feature (604)..(604): n is a, c, g, or t
  misc_feature (609)..(609): n is a, c, g, or t
  misc_feature (630)..(630): n is a, c, g, or t
nttggccttttacccccccacacaccacggggcgccacactcgggaaaaaaggcccccccccagccacagcgcttttcacagcgttccctttgccctcttgtttccccctcttaaaaagggggcgcccaccccaggtgctttaatttcctctggtggttatgtgcctcttgtttttgttgccacacaaaggttgtgtgggggcccctctttagggcttctctcgcacactatctctgggcgttgtgtggctatgtcggtgatatgtcctggggacaagaagttttcacgagggaaaaccccttggagaaacgacgcttagcgcacttttttacctcttctcacgtgaaccactcttgtaataccactgctatacttgtcacaaagtaattttgagaccactctcaccacgccccaaagccctcgggaactctcttgtgaaaggtcctcctcacctctatctttctttctctctctctcaaactttccttaaagttctcatgnnccttgccactgcttctgtgaacacgtcttngtctcctccccccctnntggtgggaagtgcggggcagtcctggtcnagacactcatgccctggnatgtgcntgccngagaatgttgttgctaacccnccagtttcttgttgatttggagaggtcaaggccaggcccccacttggcttgaagggacattttcagacttttctttctgtcacttggagtgtctatgcctctcatatttccctaataaactcctccaactttttatctgactgctgtgattatggtgggggggggaaaaaaaaaaaaggggaggtctcaaaaaatgggttcccttattgcccagaaatgtaatacatggcgttattattctaacataaaactttcagatgtagctgtttgattcaaagcctaggtggcttaccagcccaagtccccatgtttggactttcagctgactagctcatcttgggaatcatttggtcattcagcacatttaccaagtatttactatgtaggcatgttaaactccaataaaacatacagcattgaatcaga

SEQ ID NO: 647100 - DNA, 394 bp, Homo sapiens
  misc_feature (92)..(92): n is a, c, g, or t
  misc_feature (215)..(215): n is a, c, g, or t
  misc_feature (286)..(286): n is a, c, g, or t
  misc_feature (326)..(326): n is a, c, g, or t
  misc_feature (328)..(328): n is a, c, g, or t
  misc_feature (346)..(346): n is a, c, g, or t
  misc_feature (383)..(383): n is a, c, g, or t
cccttggagaagaaaatgcccctgtgcctgtggcccccgaaaatgggccaagaagaccttggttcatttttcccacaggtctgtcctcctgnaacccagtggctcctctggtgccaacacccttaccacccttctgttccgctgaggtggtggggacccatggtctgtggaactgggaaacaggaacactgactcatgggtggacaggccttcancccaacacagggaggaggggtgacccctgggaagggtgggctgagggccctgtggcaaccggcttcttganacgttcccccgttccacaccttccctaacttcttctgatntntctccaataaaacccccntcattgagggccacgtgtgtactgtgcctgtggcggngaaaaaaaaaa

SEQ ID NO: 647101 - DNA, 392 bp, Homo sapiens
agagttcaacagatagacacccggacatgtgagacgcaagtatgctcacgagcacatatgtgaccgtcaaactcattacttacgttctggtatggacgcgttagcgtaaccacgcaatacctgagtgagttggaacccagcgagtgtggtgtgcctaatgtatgtactatcatggtacttactatgttgggcacaattgtaggtttctaaacgttaacaggaagcctgtgcctagtcttgagccagtaggatttacgcatccgtatgataagatctagattgtacacagataacaggtgaatcacctatgatatgaccgtcatacatactcaggtacaatactttaaccgagtgttctatacagctaagtactgctctcagatattacggac

SEQ ID NO: 647102 - DNA, 103 bp, Homo sapiens
gttttttatggggcccccccccccccccccccccgttttttttggttttgggcccccaaaagttggggttttgccctgggggttacccttttttttaagccca

SEQ ID NO: 647103 - DNA, 349 bp, Homo sapiens
attggcaccaaagcagcagctcgtattgccgcagttcctagcttcaccttccacgatgtttcccttggtcaaaagcgcactaaatcgtctcccaagttccgaagcattccagcaaacaatgccaagccagaccacccagaaccgtacacctgatttccatgacaaatacggtaatcctgtattagctagtggagccactttctgtattgttcacatgcaatatgtggaccaaagtggaatagaatggccctccccctgttggagagtccccaaggatggaggaatagtactacccccctggtgtatatgattgttaacaacctatattgtcgcaattaagcatttcccc

SEQ ID NO: 647104 - DNA, 469 bp, Homo sapiens
acctaatgctcgactacatgtcacagaaaacgaacgatggacacagaagtggatgagaatatttgttgaccttcatgggtttacagcctctgtctctaaacaaagtatggaaacaagtagagcttttattttgcttgtgtttgtgtttcgttttttttttggttttcccccactaaatagaaatgagggtccttagtcggtttcggacaatcggttaattccttaggacagcggtcttgggttggctttccagcaggcgtagtatatgtacgtcggagagcacatctgtatgcgacaactggataacatctttttttctagctatttggcattttttcttttaccatgtttcagtttctggcatgtagatttaaataaaaaacaaacctggtaaagtggtaccatttcacatggaattgcggcccaatcttcaccagcttcagaaatcggaccttggtcgagcatgtag

SEQ ID NO: 647105 - DNA, 104 bp, Homo sapiens
taacaagtaataggagtgcaaaaagtgaagaataatttttttacaaagataaggaaagctgtaaatttcactcgaaggtttaatatgccacactctgtctcagg

SEQ ID NO: 647106 - DNA, 932 bp, Homo sapiens
aaggaatacgtgcctttttcttaaatgctttcatttatgaaaaaaaaaaaaaattgcccccaaagcattatgcgggtcatgaacatgcttcaaaagtagtgggaggtatctacatgtgacacgcggtgataaaaaaaaaaaaaaaaaaaaaaaaaaaaaaaatgtgtttgtgggggccgccccgcgcgccccgcgagggaaaaaagtttttcagaacccccgtcgcgttggggggcgggcgggggcccccagagggtgttaggtggcacgatggtgcctcacgaccggttctccccaagagagaaaaccccggcgccggcgacatggcggcgtggtgtttcccccccaaaataaaaaaagcgcccggggggggacaccggaggggcgggtccgggaccaacacctccaggagtggagggttgccgacgagggcaccatacggggggttctatctcccaagcgagggggtccccaacgggggcgctccgaatatacctaaaatattaccgcgcccgcccggggggagaaacgataaaaatagcgacacaaacgacaacagacacagcaagataaaagacagaaacaaagagcaaacacagagcagtcgaagaagcgagacaacatccgggcacagacaacaagaaacaggaagaagagaagaggaagacgacgacagaaggagaccgcacagagaggggagaggagaggtagcacgggaggggagagcgggcgcacgacagagcacaagcgagaacgagaggagacagagggggcaaagagaggtgagggagatgggggacaggaggagacagggaaggagaagagaagaaggacgggaagacgagaagcacaaagagaaagagaggagagagacagagacgacacgagaagacgaacggcacgacgaggagaagagcagagggcggagaaaa

SEQ ID NO: 647107 - DNA, 748 bp, Homo sapiens
cgggaggccttcgtttccgtgtcacaccgtcgcttcaacccgcgtgatttgccccgtggggggcgacgtgcataaatggcgcgtttgcatgcgtgggcccccgacagaggaggtgcaacaggacgttggatactgcgcctagagaggggtgcgacttcacttgtgccctcgcattggtgaggcgcgtccgtatctagaacggaccgtgaaagacagtcttgttcggggcgaaatctgacggcagtgtgggaagatcacgagtcagaatggagctcctcaccgctggctgggggtccagcacaggcgtgtatctgcagagggtcccagatggaactgctggagtccaacgagatagcctctgggaaggcaggggtggggaagcgacagtgcatgtgagtggatggcatcactgactgtgtttatgcagcctgtacacacggagcgcatggccatggctttggaaaggagaatggataaaatagaagaaggtcggccgggcttggtggcttatgcctgtaaccccagcactttgggaggccgaggtgggcggatcacctgaggtcaggagttcgggaccagcctggcaaacaccccatctctactaagcagaaaacccatctctactaaaattacaaaaattagctgggcatgattgcgcatgcctgtaatcccagctactttggaggctgaggtggggagaattgcttgaacctgggaggtggagatacagcgagggaagtcgtgacaa

SEQ ID NO: 647108 - DNA, 133 bp, Homo sapiens
tgtgtgtctggttcatcttgagtccatgtgacacgaccggtcagatgcccggctccagtacggactcctgattttaggtgctgctgtctctgtccttctacaggaggtgtaccgcttagactactacaagcag

SEQ ID NO: 647109 - DNA, 130 bp, Homo sapiens
gtccattacgggcgttgttcttggattcccgttggttaactttaaggggaaatttttcacaatttcccgggagcccctttgagatgcatgcaatgtgaggggagggaggagtgtccttaagttcccttgc

SEQ ID NO: 647110 - DNA, 399 bp, Homo sapiens
  misc_feature (34)..(34): n is a, c, g, or t
  misc_feature (230)..(230): n is a, c, g, or t
  misc_feature (248)..(248): n is a, c, g, or t
  misc_feature (316)..(316): n is a, c, g, or t
  misc_feature (357)..(357): n is a, c, g, or t
  misc_feature (366)..(366): n is a, c, g, or t
gggatggaatctcgctctgtcgcccaggctggantgcagtggcgcgatctcagctcactgcaacccccgcctcccaggctcaagcaattctcctgcctcagccttctgagtagctgggactacaggtacccaccaccacgcctggcttatttttgttatttttaatagagacaaggtttcacagcattagccaggatggtctcgatctcctgacctcgtgatctgcccgncttggcctcccaaagtgntgggattacaggcgtgacacccacgcctggccttaaaggtattacattcttaatgaaacttaactctnccaaggatcataggtatataataaaaaaataaaggaaatgncagttgtanggctttgtttaagaccagtttagtctttaaatc

SEQ ID NO: 647111 - DNA, 115 bp, Homo sapiens
gataatttacgtgcggccgcgcgctgattggcgtccagcaaggtttgccacggcgcgtcggcagtgagcgcctggcgctgatacagtgcgaaatctttaccggcggcgtagcttt

SEQ ID NO: 647112 - DNA, 92 bp, Homo sapiens
catggatttgctggtgcagtacaactaggcttaatagggactcgaattcgaggctcgaattcgagctcgaattcgaggttagtataagtaaa

SEQ ID NO: 647113 - DNA, 205 bp, Homo sapiens
gcccctgctggtggggaactcaagaagaagtatgcccaggggttcctggcttaaaaaattcccacagcaggatcacaccaccaccactgactcggagatggaggagcctatctgcaagaatccaaagaggagggtgctcccctacaaactacaagtagtgagctctagtggcctgggtatgacttttgccttaataagttacaat

SEQ ID NO: 647114 - DNA, 909 bp, Homo sapiens
atcccagcactttgggaggccgaggtgggtggatcacttgaggtcaggagtttgggaccagcctggccaacatggtaaaagcccgtctctactaaaaatacaaaaattagtggggcttggtggcaggtgcctgtaatcccagctaattgggagacttgaagcaggagaattgcttgaacccgggaggcagaggttgcagtgagccgagatcacgccactgcactcttgacctgggccacagagtgagactcagtctcaaaacaaaaacaaaaacaaaaaaaacaaaaaacccagttccttaaatagataaccatactgaaaaaaaaaggactattataaagagaattaagagaaatattaaacaaatgcaatatacagacatgtttgaatcctgactctagcaaaccaaccataagatattttgagggggaggaaaaaaagaacatagactattagaggatacactaaattatgttatcttgttgaagtggtaaagatattatagttttaatatgtatcttgtagaggcatatactgaaatattttcgaagaaaatgacatgcttacaaatttggttggaaatactccgatcataaacagcaaacaaacagcaaagcggggaacgagcttacacacgaacagtattaaagtacttgtgtttgggccttgaacaggtcctcctccgtcacccagggtgggttcctctcacagaaccaacacaacaaacaaaaaagttgtcgggggccggcgccaagaatctataccttgtgggggggccaggagagtaaacgtcagggtcagagatcgggcagatgggggccccacaaccgggccgcggaaccaggcgggccgatcacgcacgcaccccacggggccacggggggaaaagaataagcattagacaacagg

SEQ ID NO: 647115 - DNA, 862 bp, Homo sapiens
ggccgagagaagcagtagtcaataaaggagagtgccgtattgtcgcagcattggcagctgagctggtggctgccacgaaggatagcgaagcgaactggacaactgaagagtggaaatcaggaaaacggtagatggaaagacacgaaacgcactgaaaagaaacaaagacgttgagataacacagaaagcggtcaccgacgttaccacaggtgcttgcagcatattgctgaagcaagtgcgacttctggtcttgcggcgatgcaaatcttcacaaggcatagatttcttccgagaacagatagaagaaatctagagatggatatgttgatatatcactacttgtgtcttttaacaacaaatgaagaaacttgactactgatgtggacgttaattgccagagcattgacgaagttcagctgttgtagagcttgactttggaacggcaccatgaattccggtaggaacaataacctctgtggggaacagaccaaacggatgaggactgaagcgcacagtgtatgtggagttacttcccaaaaatgttcatcacagctggattcgaaagagtatgttgggaaatgtggcaatgtggtctatatcagtataccagattataagtctactggagatcctagaagggattcgcggtcgctggaatttgacaccaacaagaaacaagcaagctaataagccatgagtttcttaatcaacccaccagaagaaagcgaccaagcacaactggggatattccctagaacagtgaaacataagccattccagcttaagagtgtgggaagagaagaacacgaaacggagatgaaggccgatgacaggggacgacaatatcaaggcaagaaaaaca

SEQ ID NO: 647116 - DNA, 278 bp, Homo sapiens
tggagagggggtctcactcgcgcccaggcgggagtggagggaggggggcgatctcgactcacggcaacctccacctcccaggttcaagcaattcggggcctcagcctcccaagtagcggggatcacaggcgtccacgaccaggccgggctaatgttggtattttaagtaagaggatgggggtttcaccatgctggggcccgggtgggtcttggaactcctggacctgcgtgattcacctaaccttaagcctaaccagaggggctgggagatgacgggc

SEQ ID NO: 647117 - DNA, 286 bp, Homo sapiens
tgaactagacatagacacaaatactcatagacataaacatgggacaaaaacagacacaggcacaggcaattcaacagacaaaaatatggccgggtgcagtggctcacacctgtaatcccagcactttgggaggccaagtggggagatcatctgaggtcaggagttcgagatcagcctggctaacatggtgaaaccccgtctctactaaaaatacaaaattagccaggcgtggtggcacatgcctgtaatcccagctattcaggaagctgaggtgggaggagaggaa

SEQ ID NO: 647118 - DNA, 354 bp, Homo sapiens
  misc_feature (123)..(123): n is a, c, g, or t
  misc_feature (126)..(126): n is a, c, g, or t
gagaaggatttgacagcccccttctccaaggaaggggtgagtacaaagggggccatgggccgctgccgcaaagaccccctgaggggcctgttgttcctgccaagggcaatggaggggtaccgntgntaccgttccgcctcccccaccgtcccgggttccctttgttgacacgggccaaggagccagtggggaagtgggtgtgttgggccaggtaggataagtaccccttttgcctcagagaagcttaatcccaggcagggggttttccctttgtccaacccctgttttattattttactaacagggggagggggtccctcccctaaccttggggcctgatccatccccagacca

SEQ ID NO: 647119 - DNA, 469 bp, Homo sapiens
tttccattttttagccatgggagctcggatgttaaatgcagccgtattcacaacatatatgatggtatcacagggtgcatcgctttgctgcctgcttggataaagacagtgggatatatatatgcaccatggtatactttgtctgctcaaaagggaagttgtgacctttgcaactggaggcgttatatgcctatagcatctagacttgcatcaacctggatttcaccctatttggctatgcatggatccttaaagcttgtccttcaggacttttttactttggctgtgggttgatacataacacctttgagttgaactttagttgacttgatctcgcggttcacttgctcaacgcgagcatattctatattgtaaagaatctccttttttgcaagtgtgcatatatttgcctggaaagttaatgtgtcaactttaaactttttgaaccacgtatgtatactcgctatcc

SEQ ID NO: 647120 - DNA, 519 bp, Homo sapiens
  misc_feature (11)..(11): n is a, c, g, or t
  misc_feature (63)..(63): n is a, c, g, or t
  misc_feature (84)..(84): n is a, c, g, or t
  misc_feature (98)..(98): n is a, c, g, or t
  misc_feature (109)..(109): n is a, c, g, or t
  misc_feature (119)..(119): n is a, c, g, or t
  misc_feature (144)..(144): n is a, c, g, or t
  misc_feature (153)..(153): n is a, c, g, or t
  misc_feature (155)..(155): n is a, c, g, or t
  misc_feature (169)..(171): n is a, c, g, or t
  misc_feature (177)..(179): n is a, c, g, or t
  misc_feature (186)..(188): n is a, c, g, or t
  misc_feature (196)..(197): n is a, c, g, or t
  misc_feature (199)..(199): n is a, c, g, or t
  misc_feature (205)..(205): n is a, c, g, or t
  misc_feature (210)..(210): n is a, c, g, or t
  misc_feature (217)..(217): n is a, c, g, or t
  misc_feature (250)..(250): n is a, c, g, or t
  misc_feature (259)..(259): n is a, c, g, or t
  misc_feature (270)..(270): n is a, c, g, or t
  misc_feature (303)..(303): n is a, c, g, or t
  misc_feature (340)..(340): n is a, c, g, or t
  misc_feature (429)..(430): n is a, c, g, or t
  misc_feature (432)..(432): n is a, c, g, or t
  misc_feature (448)..(448): n is a, c, g, or t
  misc_feature (498)..(498): n is a, c, g, or t
gtccacaaaanattctcctttccttctgaaggttttatgatgcattgttattattaaccagtnttttattactaaatttaaatngtcaattgatacanacagttctganaccgttcttncaccactgattaagagtggggtggnaggtattangnataatatttatttnnntttttnnnttttttnnnttgatttnntnattttnttagnttaagtngcttttttgttcactgctttgatgatacccacngcaactgtntgtttcatatnacgaacagcaaagcgacccaaaggtggatagtntgagaagctctcaacacacatgggcttgctaggaacnatatcaacaatggcagcatcaccagacttcaagaatttagggccatcttccagctttttaccagaacggcgatcaatcttttccttcanntnagcaaacttgcatggnatgtgagttgtgtggcaatctaatataggggcatagttggtgcttatttngtctggatggttcaggataat

SEQ ID NO: 647121 - DNA, 852 bp, Homo sapiens
  misc_feature (194)..(194): n is a, c, g, or t
gccaccagccacgtgccgagcatgtcagcgacgtgaggtgtcccttctcgttgagaatattgtaactttggtttcgctctatgttcttcctttgtgaagagacgtgactggagtgagtaaagatggaaagtgctgtgaacactgatactggcgctcacagctgtccatcctgaccatcgcctcggctcccgaantccacgtccctgccgtgggccgtgtgcatgtcaggacccgtcagtcaggttcgtatacccgtctgtggctccccttgcattcagctaccgtcccaccaccatagttcaccagagttcaccatgacagcggcctccagaatagccatagacatgatcctgagctgttctctaggtgcttggatgcttgacctatcctggaacaccctggaagaaaaaggagcgcagggtgggccctcggccctgatgcaggagggtgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctctactccccgaggactggatgatgtgctgccacgtgtgactcgtctcccttgtctgccctgtgtgaccctcagtctttggccagccatgcatgcgcccgaagctcgtgcagtttgtacgtgaaggtgcttctcctccctggcaccattgctcatcactctggcctttggccatgctccctggtcaccccacttcccggtccggcggctgcaggcactccttggagcaggcttggggccttcagccactgtgctcgtcccac

SEQ ID NO: 647122 - DNA, 912 bp, Homo sapiens
ggcggccgctcgggcaggatggcggcggccgggtgggcgcggccacggcgcggggggcccgggcgcagcggagcagcatgtggtggggcgcgcgagggggctgtcggttggcggcgcttgtgcctgcgtgtggtacggcgctgagcgcgggcgggcaacgtgttgtccaaccaggggtggattcctggagcggcttacccgggtcccgggtggacccgtggtcggttgtttgcccaagtttcctggcttctgtgccggctggggctccccgggcccggtttggttgcgccgctgttaggcgttctggttgcccccccgggtgcgccatgacctgttttggggaggccccgggagtacccacaagggtccgcagtatttcccggtacgggtaccgggcccacggtttggtttggccggcgcggaggttttttataacccccgggggcggcttaagggtgtggccaaccggggttcgcggcttttttgcgggggagagtggtaacttcccgggggtcacgtggtatcagggccgcaccttgttcaacgccttctcctggggaaaagcggttcccccactgtgtgaccctttgattgggaccagcaacaccgcgtggtaagtagtggcgccgaaccggggtggctcccaagaggcctttgggtttagagccgaatgtgcggccccttccataggagaaaggacgcgcggattattaacccccaaaaggacgggagaagaaggtcgccgcggccgcaaaatattttggttccaattttccccaaagggcgtattaacattcatgggcagagggcttggcttttactttgaagaaggcacaccttaaattggggtggatctctctgggggggacagacaaaattctccttttaaccccattcaggggatattcggcg

SEQ ID NO: 647123 - DNA, 340 bp, Homo sapiens
  misc_feature (29)..(29): n is a, c, g, or t
  misc_feature (162)..(162): n is a, c, g, or t
  misc_feature (170)..(170): n is a, c, g, or t
  misc_feature (239)..(239): n is a, c, g, or t
  misc_feature (325)..(325): n is a, c, g, or t
tttttttttgagacagagtttcgctcgtnacccaggctggagtacagtggcgcgagcttggcttactgcaacctccgcctcccaggttcaagtgattctcctgcctcagcctactaagtagctgggattacaggcactcaccaccacacctggctaattttnctattttnagtagaaatggggtttcaccatgttggccaggctggtctcaaactcttgacctcaggtgatccaaccgncttggcctcccaaagtgctgggattataggcatgagccactgcacctgggcttctctactgttctcggcctgtttttaaacaaagnctacatttctttttt

SEQ ID NO: 647124 - DNA, 699 bp, Homo sapiens
ggggattcaaagtgtgatgactcggatggggggtcccttggagagatcccacttgttaagtcagaaattaaaaagaatctgttgtattaaacctgatcaaaaataactgtagggccgagtcacaaatctggtactgaaatggcgacctatgctactcaaagtgccctttttggctctagacggggcaggaaagaggaagacagaccttctttgagaggattccttctggatggagattcttttgataattgctcccttgccacactattaccaagattgcatagtgctatgaagctatggttcaggtgaagaaatagctaaattttttagttcatgaagctacgtctctcatggctactatcatacatttgggaaaatcatctcttcctaataagccacttactggtgataatgtggatcgaatttacctgtgcctgaaggttttgtctgcatgttcacctttaatgcctgacattctcaataaagtatgcagacagtccgttcctcacatgttatctgctaaactggaagagagaacttatcccaaagaaataattggtaagaggaatgtgacagtcaggctgagaccccatttgcttcagcaattaccgttaaaatgcaaggactgcccggcaatttacgctgagttactggccccctgggcaacccccgtggaagaggggggcaatccctaaagcc

SEQ ID NO: 647125 - DNA, 346 bp, Homo sapiens
actagtccacggttggctgggttggggctcatgcctgtaattccagagccttgggaggcaaggtgggtggatcacctgaggtcaggagttcaagaccagcctgggcaacatggcgaaaccccgtctccactaaaaatacaaaaaaatcagccgggcatggtggtgaacacctgtagtcccagcttctcggaaggctgaggcaggagcatctcttgagccaaggaggtcgaggctgcagtgagctgagattgcgccactgcactccagcctgggtgacagagtgagatcctgtccccactcccttctgcaaaaaaaatcgtagccaaccgtggactagtgggtaccg

SEQ ID NO: 647126 - DNA, 136 bp, Homo sapiens
  misc_feature (33)..(33): n is a, c, g, or t
  misc_feature (41)..(41): n is a, c, g, or t
gtcaggaaaaaagtagctggtgctttttgcaanaagagaanaagccatttgttttaagagaatacccattactttttaagaaaaaagtttgtacaggttctggtaattttatagtgaacaaaaaatttcttaacgt

SEQ ID NO: 647127 - DNA, 1278 bp, Homo sapiens
gttcatcaaacctttttggggggggtagcaagaagattctacatctgttcccacctctactgtgttgggaaagtaataagtcggttttcccccaccgctattttaggaaaccacactggcgggactcacagagttgttattacacgacgtccccaactactgtggttgtaatggggttttcaacccacatctctgggtgttaattcatcgcagaaatctttctttgcctctcttttgcgcgcgggccgggcggcgcgtttttttcaccacagcagaatatgattgtttgtttgatgatttgttaaacatagtgttcttttcttgcgacgaatcaacactgttaaatcctcagtaataattctttttgacacacatgtttttgtgcttcgttgtccctccttcctatactcccccttctcgcgaagattttttgaaggactcccctcttttctagatgaacccctcggaaatgttatactccttctcccacaaatttgttcagagcgaaagtgtctttttggggggtttcaaaatgttttatgctcccgtttctcctttttaccttttgagtgttcgggatttctggggggggaggccccctttggcgcgtgtcctgctccgcagttggtccccccgcccctccctctccccggtttgaccccgtcttgcgccctttgtgaaagtgatgagttcacagttttcaccccgcacaaatgtctggagacacctctcccgcgtgtttctcgtgtccctcgggggccacccacaggggacctctctgagaggacctctctcttgttgtggcctcttcttttgttttttcacatccctcgtggcttttttctaaatggaactttcacggaaattttgtaatcttcactaaactttctccaagctccacccacacttcctaaattcttaagaaactttataattgaccacgctttcacattgaaaggtgctgggttgtagagcttaacaccccacgtgagaagcccacgccactcactgagcacaatccctgaaatgttttcttatagagaaatgagtgctggtcactcgcacggttcagcactctcctgttttttgaatgcttggctccctctgctgatttcacgtttcctggcttttcctccctcagccccttttcaccccctttgctgtcctgtgtagtgaatttggtgaggaaattcgttgctgcacccttcccccagccccctttatgagtctccagattttattattgccataaaagtgctttatgccggcttttttcca

SEQ ID NO: 647128 - DNA, 307 bp, Homo sapiens
cacgctttctccctctttctcccatgaccccaaagccaagggcaacagatcagaaaagaaggtggtcagagtagacccctgaagtattttataatcctacctcaaaattaaacagtaacctgagagatttaacataatctagtccatggaatcatggtatgtgggtcagggataaatggcacacctgggaatccgcttcctaaaggaaatcaaatgaatgggaggaacttcccgaccaccacttaactggtgtcatatagccaatataactatctctactaaatggtgctgggggtaccggagctcg

SEQ ID NO: 647129 - DNA, 662 bp, Homo sapiens
  misc_feature (200)..(200): n is a, c, g, or t
gtgatgtgattatcataccttcaggccctggagctatggtgtcagcagagatgacaatgtggagcgcgcctgagggagatgtggagcacgatagtgccgacaacgttgagagacatagtttaacgcagatcaagaatggtgaggctcgcgagatattgctcgcataagctgtgagggaacgtgctgcgaatgagtgaganggagatggatactcggtgtaatggcggagaagaattagccacgattgggcacgactgatgtcagagagcagacgtgtgatgagcgagagctggatcggatcatggtgcctcgacgtcgcactgtcctcgtcatagaaaaccggcctgtcagtaccatatgcttagtctgaattcttactacctatcgtggtgagatacctaggcagatcgagaatgaatcaggtgacggaacaacatagtcagggcagcattgtgctggcatcgtgtgaggagcgaggcgctcataggacgatttgatgtggagatcaaagtgtggcctgtggtcatagagcttgatggtccctagatagcgaatgcatgagtgtgaaaacatgaagctgtggctataatgtgcgaaattggttcccatgggtgggaaggatatgacagagcgtcttatgctccctaggttcgtgagatggg

SEQ ID NO: 647130 - DNA, 391 bp, Homo sapiens
  misc_feature (72)..(72): n is a, c, g, or t
  misc_feature (82)..(82): n is a, c, g, or t
  misc_feature (100)..(100): n is a, c, g, or t
  misc_feature (253)..(253): n is a, c, g, or t
  misc_feature (269)..(269): n is a, c, g, or t
actctagagatccctacgtctataaagcgtaaagacagaatcataaagcagaaatttaaagcatagatgggnggagaaattnaagggatgatataaatanggtggtgggtgcagtgagagccaacatcccttctagaatattgagcttataggaagtgggttagagaagatgggagaccagttcacaaggacatttgattctttggtagggagtttagatttgaattagtaatcaggtaaaacaacacacatncacactcacacatgcncacacacatacacacacagaaaaagagacagatttatacacagtactccaagcccttgatctctgcctccttggcaaacaggattatttatatgaagattattctgatggttattttttaaa

SEQ ID NO: 647131 - DNA, 387 bp, Homo sapiens
  misc_feature (14)..(14): n is a, c, g, or t
  misc_feature (69)..(69): n is a, c, g, or t
  misc_feature (128)..(128): n is a, c, g, or t
  misc_feature (162)..(162): n is a, c, g, or t
  misc_feature (211)..(211): n is a, c, g, or t
  misc_feature (225)..(225): n is a, c, g, or t
  misc_feature (232)..(232): n is a, c, g, or t
  misc_feature (263)..(263): n is a, c, g, or t
  misc_feature (268)..(268): n is a, c, g, or t
  misc_feature (326)..(326): n is a, c, g, or t
  misc_feature (355)..(355): n is a, c, g, or t
tttttgtttgaganctctgattactgtctttccattctctcttgttggtgttgcaatttccactttttnagcagagagtttactaacatccatggtcttatttagtactttgatagctaaagcaagtnctgacttcaaggtcatttctccttttttatagtnttgtttcaaaattgaaacagctgcagcgctattatttccaatgcatgtngccttccatccccngtaattnccactagggtcactctgatagagctgaaagnatagnggttatgggagggaatgtagaggaatgaaaaaccaaagggaggttttcctccaaattntgtataagcttgtttgatatcacacagcnctctaaccaactcctcacaacccattccctcc

SEQ ID NO: 647132 - DNA, 373 bp, Homo sapiens
aattcattgccatctgcagaaacacttgacagctttgggattttgcttaaactttgataatctggatcctaagactgttgcctttaaatagcagagcagcctacctggaggctaactatgggcagcgggctggcccctggtgtgagcattataccaactacagtgcctgattggtataaccttatgcgctttcctacgcaatggaattggaggccgggcgcagtggctaacgcctgtaattccaccactatgggaggcctaggcgggcggatcacctgacgtcaagagctcaagaccagcctgacctacatggtgaaaccccatctctactaaaggtacaataatggaccacgtgtgatggtgcatgcctgtg

SEQ ID NO: 647133 - DNA, 362 bp, Homo sapiens
gcgattgcattttccttttgctctggagtttcactccccttctgggtcccaagggcccaatggcctgacttttagaattgcttgcaattggtgttttctcttgaatttgggggctgccatttaaagccaggtttccatgagctgaagaccagccattcaaagccaggtttccatgagctgaagaccagccattcaagaatctgaaaagtagacaagaggactccagttgcctcaggttggttctgctgtgctctggaaagtaactgcagccaccaggtatgaaaaggagcctggtggggagaccactgcacccaaaacaaatcctttcttcttctgagaatgtgactttttctggtgttgta

SEQ ID NO: 647134 - DNA, 492 bp, Homo sapiens
cagtgtgtgaacagtgggaaacgattagtagtcaaaataagtgtatatgaactactagatctcagaatcaaccccatgctgggtctgaggcacacatctccgagttactgtcttctgtgctgtcctctgcaggacttgggctggtagcaatgaatcaacatatgtgtgaatggctgcaatgagctggtcaataattatcattcactgttttgacaaatgtgtgttgagtgcctactataggcctggtgccaaccttagaaacatgaatccagccaaggagaaataatcaaggcaggcctgttctgttagatggagtgatcagggaagtttctctgaatagatgagatttgagcagagacctcagtgaggagtgggagtgagccacagaaatatcccgaaagaggcatctaagcagagggaataatcagagtaaaggccaaggctgtcagggtctgctaagagctgattgagacattgcaacacggtctctca

SEQ ID NO: 647135 - DNA, 188 bp, Homo sapiens
aaagcacagaggagggaacacgaaggctgggagggggcatctatggcccccactaacatctccctatttctgcatcctggatgaccgtcagacaagagatgagtcggggagaccctctcctggagttctagccccctccactgtgctgtccacctcctctgtgctgtccacctcctctgtgctgtcca

SEQ ID NO: 647136 - DNA, 927 bp, Homo sapiens
cgctgcgcgccccatgggccggctccgttgagggaagggaagccctgcccggtggcggctggggtctggctgctgggagtgaggtggtgtggctggttctggacgtgggttgagtgctgtagcagtgactccagtgtgagtgcctgaggaccactctggccctcgccgctgtgccctgtggcgtcgctgcctgagggtgcctatttacatccctgacatgcttgcggtctgacgtcgtctgcgtgcctggtcagtgaccatgtcggcgttctggcccctcggccggcgatagagttgcgtgctaaaatgataaggactgcccagttacatttgcatcgtagataacagaaagagcatctagtataagcatgtccgaaatgttgcgtgggatgtatggcatactaaaaccttattcgtggcctgtcttgaaatccaaatggagctgggtattctgtgtttttatttgctaaatctgtgcatgcctgtaccctgctgtgtcccctggtgcagggacgggatgcatgctgtggctcgtgcatgaccctgccggcgtctggggggcctgcgaaggtggaggggagacgggcatgccggtgcagtgtgcctggtgttccccggagctcggaccggttggactggactccgacgctaccggtccctctgctgaactattccggatgtaaaacactagggatcggagtttatcttggttttttaatctcatactagtgacccgagaagctttgctggcaggtgcgcttgatcttgtgtgaattaggccaatttattgtgacctcttcagtaaacactgtactaacctggttgaaactgcttttcttaggcattttctttaaaagcttggtgggttaagaagcacgggaattacgaggtcagaattccaatacttgggctctaatcacgtatacg

SEQ ID NO: 647137 - DNA, 457 bp, Homo sapiens
ccccgctctttttgacgacagtctcatttctgttgccatataacgccaccgctcctctggaactcctgcacctcagtgtgaccctacactcacctcattcctcccaaagtgtttggattacaggcataagccaccacaccctacctctacatattttttaaaatcagcctttacctatttacagtacctcacatcttatacaaactttatttgtcatagataacacttacctactggaaacaatctcaatatgtctcttatctgggggtatagtataaactaaactgtgatgcacccttacaacggattacaattctgccctatggaacgagccacctatgcacacagcaatctgcgttcatattgaagccgcactgattgaaatgcactgcgccatatgcagcccgatccaaaaggccacgtactgtattactgcacttttctaccttctggaaaa

SEQ ID NO: 647138 - DNA, 265 bp, Homo sapiens
acaggtcggacaaaggggcgttagatgatgatgacagcggacccaggtttcgccagcaaacaggaaaacaaggcttggtggaagggacaaggtggtgtgtcccctgttccctattgcatctcactgggacttcctgctcatcatagtacccagtgagcccacgcgactcctcctagactgggtcacgcacttctagacgacaccttccggaatacgtctgggaacatggtcaaggtggacaggggctcccctagagacgggtggg

SEQ ID NO: 647139 - DNA, 791 bp, Homo sapiens
  misc_feature (143)..(143): n is a, c, g, or t
  misc_feature (610)..(610): n is a, c, g, or t
  misc_feature (661)..(662): n is a, c, g, or t
  misc_feature (690)..(690): n is a, c, g, or t
agcggattattgttccatctcaggggcactgagcggcaactccaagtcccggatccgtgcagctcgttggccagtcactgctccacacagctttgccttctgggccagaggtctcaatagggccttccagcaccgccattttngtcgccctgccttgcccgccaccgaaagattccacgtcctaggtggcctggcgagtgtttgctgccgtccagccgatatgagtcgaagagtccagactcggggaggctactggggccatcagggcgtggagcctgcggggtctgttgcttctaggcctggactgggccagtgggtgcagccatccctgggcctcagctgatacaggttcctggggcacaggccttgcccactctggagctctatgcagcaattttgtcattttttcttgtttttaataaacgacagcaaaaataacacaatcaggctgaagttactagcattatataaccctgcgtttctttttattctttttttttcttttttttgagacggagtctcgctcttttgccaggctggagtgcagtggtgcaatctcggctcactgcaacctctgcctccggaattcaagcgattctcctgcctcagnctcccaagtagctgggactacaagcacaagccaccatgcccagctaatttnngtatctagagagagggtttcaccatgtnggccaggatggtctcaatctcttgacctcgtgatccgctgcttggtctccaaagtgctgggattacaggcaggagccaccatgcctggcataaccctgtgg

SEQ ID NO: 647140 - DNA, 782 bp, Homo sapiens
ttccacactgtggaagctttgttctttcactctttgcaataaatcttgctactgttcactctttgggtccacactgcttttatgagctataacactcaccgcaaaggtctgcagcttcactcctgaagccagcgagaccacaagcccactgggaggaacgaacaactccaggcgcgcaatgaacaactccaggcgcgccgccttaagagctgtaacactcaccgcgaaggtctgcagtttcactcctaagccagcgagaccacgaacccaccagaaggaagaaactccaaacacatctgaacattagaaggaacaaactccagatgcgccaccttaagagctgtaacactcaccgcgagggtccacggcttcattcttgaagtcagtgagagaccaagaacccaccaattccggacacattttggcgaccatgaagggactttcgcctattgccaagcggtgagacaatcgctgagcagtgagaccatcacctattgccgagcggtgagaccattgcctatcgccaagcaaatcgaggccatcaagctacagatggtcttacaaatggaaccccaaatgagttcaactaacaacttctaccgaggacccctggactgaccagctggcacttcccctggcctagagagttcccctctgaaggacactacaactgcaaagccccttcttcgcccctatccagcaggaagtagctagagcagtcatcggccaaattccaacagcagttggggtgtcctgttgattgaggggtgacagcatgctgc

SEQ ID NO: 647141 - DNA, 422 bp, Homo sapiens
  misc_feature (4)..(4): n is a, c, g, or t
  misc_feature (33)..(33): n is a, c, g, or t
  misc_feature (39)..(39): n is a, c, g, or t
  misc_feature (68)..(69): n is a, c, g, or t
gganggacgatggtcaaggtacatgtctcctcncctctnactctgggaatgagatttttcgggggggnncaggcttgaactctccttataggagtgtctccacatgccaaaatcagaggaagtcagaataaaacctcccaaggctgaaaactagagctggcacgtagtacatggtcagtaaatgtttttaggtggctggatgagtgaaggaatgagtgagtgagtgaatccaggatcgatctggaaacacagcagggctcagcactcttggtgctaagtgccagtctcagtcctcttgtggtgtgtaacaccacagagaacaagccaggctcttgtgcttcacccaatgtgtgcacacccatgctcacaaacacaaacacactgcacgcacacgcacaattgcacaaggctgcatatgaggg

SEQ ID NO: 647142 - DNA, 434 bp, Homo sapiens
cttaggttgacccacctcggctcccaaagtgcggggattacagacgtgagccaccgcccccggcctctctaacatttcttttggttctttttatagtttccatttctctgcttacattgcctacctgttcttgcatgctgtctactttatccagagcatctggttctgatgcttgctttgcctcttcaaactatgtttttttgccttttagtatactttgtaattttttcttgatagccaggcatgatgttttgggctaaagaaactactgtaaataggactttagtaatgtggtggcaaggtgtggagggaaaggaagcattctacagtccgataattaggtctcagtcttttagtgagcctatgtctctggactgtgaacttcacaggtgcttctcagtctccccctctccttaggtgggtcagaacatcag

SEQ ID NO: 647143 - DNA, 212 bp, Homo sapiens
aacggcacccctcagctatgatcacgcctccttccagtccatgggcttctcgccacacttctgcagccactcattggtcttatgacaagtgtctacatcctacagaacctctctcttacactgacaaatggggaagacatgagtcccgtctgtagatacatctgtgcccgctatcctagtcaagtcggcacttgccctatctatctagacgc

SEQ ID NO: 647144 - DNA, 149 bp, Homo sapiens
acgagctgaacacgccgcttaccgcgatcctcaatgcgatcaccatgctcgaggagcgtttcaccgccgagaaggaatatattcccatgttgcgccggaacgccgagcggctgcggaaaacggtggagaacctgctcgaaatttcgcgc

SEQ ID NO: 647145 - DNA, 137 bp, Homo sapiens
  misc_feature (15)..(15): n is a, c, g, or t
  misc_feature (70)..(70): n is a, c, g, or t
  misc_feature (83)..(83): n is a, c, g, or t
aaattccttgcttgnttccttcttctccttcaggagcgttttatccctgcgcacggtctcccgcactcgncgctcctcttctnctgccttccgcctgggcgctggccgaaagttcagctcctccggggcctcatcgt

SEQ ID NO: 647146 - DNA, 922 bp, Homo sapiens
gactcctatgtgctggatgtatcggtactactgcgtgctatatccattctctagctgtagaataatgaaaggacattagtagagagtaatgcttcatctagtaagtcctatatgagagttccatttataaagttccacgatccgtatagaaatagagagaattgcattgatcatcgtaatatgcactgataagggaatgggcgaaaggaaaagggctatgaatcgtgtgagagaaagagattacgcatggcgcatatggggggacaagtggatcactttgctggaagaataacattcctagatgttgttggaagcatgtattcatggggcaacattatatgatctttgtattaatgcctacacacatcaccatgccaaccaaactacccaatgcaatgactacatactgacaatactaccttccacaaaaggtggtaggtagcttacattagaagaaggtaaaattggagtcttgcaaatactgttactttacttcaactcgaacatgaaacctgtttatccctaacatcatgggacaggaaagttgaagaaagagagcaaagggtgaatatttcccaatgtgttaaggcgttaactgaaaatttcaatcagtggtaattatagtcggaaatttctcttgctagctacaaggtggaataaaacacgaactgaatttatatctggaccgcgaaaaaacgcacaaacgaaatctcgaaagcaatcgatagggtataataagggaaggataggttgtgaaacctaatgtacaccttggaatagcgagttccccttttcgctttggctcccgatctcactaaaatcgggggcttagtggagggtttatagctaacccttaatatcgaaatcgcgaaattgggtggttatcaataccttggattatagttaaaggggccccaatttg

SEQ ID NO: 647147 - DNA, 361 bp, Homo sapiens
cacgaggcagcgccacctcaatgagcttcctgggcacgggagtccttcctgtcgacggagaacgggggaattctccgcgggtgtgaacgggaacatcctacgaccgccctccgacacgaatcacacccttgaaccgacggtgagcctcgattcggtgtcgtaccggccggctaccctgattccatgactgcccctaccatccgcgtcctcgacctcttcgccggggcgggaggtctcaccgcggggttccacacggcgtcgtcccgcttccgcagtatcgccgcagtcgagatggacccggaggccgccgcctcctaccgggcgaccttccccaagacggaggtctacgcgggcgccatcc

SEQ ID NO: 647148 - DNA, 590 bp, Homo sapiens
  misc_feature (196)..(196): n is a, c, g, or t
aatgttggagccgtctgcaaagtgtccccggcaagaagaggctgcctaccacaaggactttagcttacttttgtaaagattgaagaaagaaaaaagaagacagaacaacagaagaactcaaagatacacaaagtaacttctgaaaccgaaggccctcaggaacgcttgttctggaagccgttgaggagatgacagncagttttggctccaatagttgtcgttaatcatttgctttcacagaccttaaatttcacgagtaggtctccctccaaggttgccacggcctttgacagtcctgtggcgatcggaggccaggaacccaacttggggaaaacctcccccgacaagggccaaggcaatggctaactaccaaaggaaaaaggggcctccagggcaaggggtcctgtattgtgccaagctaaaagctcttgagctggaacctcgtagcgtgcttttccccaaaaaaaattccccagagggttttcccaacggaaaaaagggtccccaaaaccctcccaaaaaaagaagggcttaaaagtttgggtttttaaaaaccaaaaagtttaaaacccccccccaaggggggccca

SEQ ID NO: 647149 - DNA, 1256 bp, Homo sapiens
  misc_feature (312)..(312): n is a, c, g, or t
cccctgcaggcggactcgcccgctcccaggcggaccgcgcccgggacatggtacccggccgcaagtctgagccgtcgcgccagcgctgcgccgccggtcgtgtgccgcctagcggatcggagctgcgtcgcggaacctggtgctgccccgccccgctccaccccgtgtaggggttggctcctgtatggcatgccgggactgacagctcttcccctagggaattctccttgtatgcctgtcttgatgacatacattggctctatgcagagtcctcgctggtaaagctcactggcctagtgattgagctctggntccatagagctgcgttccaattgtgttggtagaggctaagttccaatttccttccacagtgtggagatgaagccgaagggatatcgagtacgaggtcttaataattttaagttatgtcccacaatactcgcaagaagcaaaggagagggacgactcagttgtcgctcacattggtttagagagtccagtagaatgcaaatggacctctgtaagctccgttatgtgtccacactcttaggctcccccgggagatttcaggacacccagggtctatcacatgaccaggtccttgtacagcgtactctaataattctgggggcctcatacagatcgacctaattctgcgtataatgatgacgtagtccccattttgtgggatgcgcatacggagcgtgaggttgaggcgactcctggactcccttccctgcgcgattgcattaaggacgcgaatttctacctcaaatggaaatccctttgcgcaaatcctcacaaaagggaaactagttccccacgcaatgcgccttgcgagcgcttgccctgcctcgtctgtgggtggtttgaagttcccgttgggtgggaaaccgggggggcacagcccgagtttggctggagatagctacagacttcatcatggggagaaggaacttgcccaaatctaaaagctaaggcgtcagtttgattacggttgggtccctactcacaatgatttgtgaacagcaaatttgcaccccccaaagatatgtggctatggggtttcatttagagggggtgtttggacatgtgtttgtggggcgttcgcaaaagaataaaccgaaccgatttggccggttctgcgtgtacttaaaactcattggtaaattcctttgggcaccaaaatttaccgaaacccccctaagaaggtaagggaataagacaagccgcgaagaaaacgtcgtactacctcg

SEQ ID NO: 647150 - DNA, 408 bp, Homo sapiens
  misc_feature (1)..(1): n is a, c, g, or t
  misc_feature (121)..(121): n is a, c, g, or t
  misc_feature (142)..(142): n is a, c, g, or t
  misc_feature (149)..(150): n is a, c, g, or t
  misc_feature (152)..(152): n is a, c, g, or t
  misc_feature (179)..(180): n is a, c, g, or t
  misc_feature (183)..(184): n is a, c, g, or t
  misc_feature (186)..(186): n is a, c, g, or t
  misc_feature (190)..(191): n is a, c, g, or t
  misc_feature (195)..(195): n is a, c, g, or t
  misc_feature (205)..(205): n is a, c, g, or t
  misc_feature (219)..(219): n is a, c, g, or t
  misc_feature (327)..(327): n is a, c, g, or t
  misc_feature (333)..(333): n is a, c, g, or t
  misc_feature (335)..(335): n is a, c, g, or t
  misc_feature (352)..(352): n is a, c, g, or t
  misc_feature (372)..(372): n is a, c, g, or t
  misc_feature (376)..(376): n is a, c, g, or t
  misc_feature (397)..(397): n is a, c, g, or t
ncagtaatcaagtacactctaatgacaatgactttgtgatttgatatgtcttcactggataaacttctacttggacaactgctgaaaggaacgtagatatggggcagctgaggtcatttcnaatgaggttcccaactatgtnaaggggnngngtgttttcacacacgaaggacagctgnntcnntnctgnnaggntacagtgcanaaaattcctttctnatcactatgacatttactcaacgttagattttaatagcccacttgacctcctgggttcacagctggagatactttagaactctttccccatcctccaccataggtgcnaacgtnangcttgtgtgagcacctncaaggtatgcccttgaagtnaaanagaaaagggaagaaagggggntttttcttttc

SEQ ID NO: 647151 - DNA, 173 bp, Homo sapiens
gccacatttgcaggaggatggccttagggttccaacccttaacccaaccccacctcttctgtatgtttgaattctttccgtagctgttgatgctggttggacaggtttgagtcaaattgtactttgctccattgttaattgtgaaactgtttcaataaaatattcttttctga

SEQ ID NO: 647152 - DNA, 248 bp, Homo sapiens
  misc_feature (124)..(124): n is a, c, g, or t
  misc_feature (148)..(148): n is a, c, g, or t
  misc_feature (230)..(230): n is a, c, g, or t
ccatttggctctcaaaagcaatctggtgataatttaaatgatactttacgaaaggccaaagaggtgctacagtgtcatgagtcattgcaaaatccacttcttagcacttctaaaagtaccaggnactatgcaaaagcaagtagaaatntagaagaatctgaaaaagggtctttgaaaattgagtttcaagtgcacgcactagaagatgaaagtgatggagagacatctgncacgggaaagcatgggac

SEQ ID NO: 647153 - DNA, 142 bp, Homo sapiens
acaggagcatgctggcctggagacagaggatggcgatggggctacagcagaccctaagggacctggcacaggccgtcttgtcagactctgagagcgggtccagctgagcggctctgagcgcaccgaggatgcttccaacggc

SEQ ID NO: 647154 - DNA, 440 bp, Homo sapiens
  misc_feature (189)..(189): n is a, c, g, or t
  misc_feature (229)..(229): n is a, c, g, or t
  misc_feature (375)..(375): n is a, c, g, or t
tcaggtgtgcagtcctttgatgaggaggaaggcgaggcaacaactagtttcctcccccaatgccctgccttccactcccacctgagggccatggctgtgacccataccctccctccccccagctagtacagctgaaactgggcagacaacattggggaacccaggagcttccagtcctctcctggaaanggaggaccaggatgggattttatccaggcttacactctanaaacccacaggcctgggaactgagacctgggcaactagatggccgtgagcttggtgtggctgtggagaaggacctgggctgtgggcttctgggtctgtgccgacaaagcctccagtgtgtgcaccctgaggacgggggcagcgcantttgctcaagactggatctcagttcttcacgccccgatttcgtcttccaggagccgtagctctgc

SEQ ID NO: 647155 - DNA, 130 bp, Homo sapiens
tggagaagttctcagagcagagcagtgtagtgtagtgatggagtgcatatagtggggccagactgcctgggttcaaatctagttctacagcataccaactatataacccaagttagtcactccacctctc

SEQ ID NO: 647156 - DNA, 134 bp, Homo sapiens
tcgtctattcatcggcaccctattcatcggcactctattcatcggcacccgtattgaattcaagtattatattaagtatgcatggacctctagagctaatggtgccgataaagcgaggtgccgatgaatagcga

SEQ ID NO: 647157 - DNA, 236 bp, Homo sapiens
  misc_feature (104)..(104): n is a, c, g, or t
tctccgtgtgtcggctctgtttcacttttgtgttcccgtgtctgtctgtcttgcatccctagccctgcagtctttttctctgtccctttatctttcttgttttntgtcttgtgtcctaggtctggtttcttgccactggtctctcctgtcccgtgtgatcttgggtctcttgtgtggtctcctgctggcagtggggacggggagtagtgaggaaacatgaactacaaagtgcttgg

SEQ ID NO: 647158 - DNA, 491 bp, Homo sapiens
attcgcggccgcgtcgacggattcttactctgtcacccaggccagaatgtggtgacacaatctcggctcactgcaacctccacctcctgggttcaagcagttctcctgcttcagtctcccaagttgctggaattacgggtgcatgccaccacgcctggctaatttttgtattttcagtagaaatggggtttcaccatgctggccaggctggtctcaaactgacctccagtgatctgcctgcctcagcctcccaagtagctgggactacaggtgtgtgccaccacgcttggctaattgcacacctggctaaccttttaaaaaaaaattgtagagacagggtttcaccatgttggccaggctggtctcgaactcctgaccttaagtgatccgcctgccttggcctcccaaagtgctgggattacaaacatgagccactgtgctgacctgcatgtttttttagtagcgacaaggtttctctgggttggtcaggc

SEQ ID NO: 647159 - DNA, 334 bp, Homo sapiens
  misc_feature (141)..(141): n is a, c, g, or t
catacccttcagggtaggctccacgccggatcctttcaaacccagctcctgtgccaatgctattataccctctgccagccgccggcctatcatagggacctgtccgctgcatagccatgagctttcgtggggtgacatagngggttcgaacttcagctcggctactcttgaagatctcaatgtacctgtgccctattctttccttgagtttctttaaggccgtctcagctatctcctgtgaagcaaactgcacaaagtcttcccctgcgcttcgcccctgaaagaccactggcagtgtcatcccatttggcacaatttccaaccctgaaaagaa

SEQ ID NO: 647160 - DNA, 821 bp, Homo sapiens
  misc_feature (34)..(34): n is a, c, g, or t
  misc_feature (64)..(64): n is a, c, g, or t
  misc_feature (95)..(95): n is a, c, g, or t
  misc_feature (107)..(107): n is a, c, g, or t
  misc_feature (196)..(196): n is a, c, g, or t
  misc_feature (198)..(198): n is a, c, g, or t
  misc_feature (200)..(200): n is a, c, g, or t
  misc_feature (212)..(212): n is a, c, g, or t
  misc_feature (355)..(355): n is a, c, g, or t
  misc_feature (390)..(390): n is a, c, g, or t
  misc_feature (421)..(421): n is a, c, g, or t
  misc_feature (457)..(457): n is a, c, g, or t
  misc_feature (552)..(552): n is a, c, g, or t
  misc_feature (554)..(555): n is a, c, g, or t
  misc_feature (582)..(582): n is a, c, g, or t
  misc_feature (587)..(587): n is a, c, g, or t
  misc_feature (598)..(599): n is a, c, g, or t
  misc_feature (619)..(620): n is a, c, g, or t
  misc_feature (663)..(663): n is a, c, g, or t
  misc_feature (700)..(700): n is a, c, g, or t
  misc_feature (749)..(749): n is a, c, g, or t
  misc_feature (799)..(799): n is a, c, g, or t
gccttctccactgagtcccggtgatcccataccnggacccgaacgaatcatcacagtggaaagnttgtccagagactggatcccgaccaaccganggaacgctggtnagggagaaccgggtatagacgaatccacggatgcgccaactggctggtgggaatcaccatcttcaggagaaggccctccggctgtgccnantngtcgtcccgatnctcgacgaggttcaggaggttatggtgcttgtgggctcacacgacgaacggggcccggggtgacagggatccgtcggttctcataatgactctaccggaccggagaccgagcttcgtcgggacacacccgaggtcgtgggcanaaatgtctctggaaggacgatgattgggtaggaancggatgagtcccatgttctctgtcagcaatntatgaaaattgcatcaccgtctacggaaaacgtggnctggggaaagaccgaggacaggtgacgatgtccggccgagacgttccggggaactcgaaatggtcgaggaagtgggacactggcaaacccgggancnntgcacggacgcgacccccggcgccccntctangacatcccgannactcgggagcaactggggcnngatggaggaggacaattcacttctgacctacgctttggtggangacgtcgacgaggtcgagtgcccttgacctcgttccngagaccgatgcgtcggttgtgggcaaacctgtcgtggttgtcggcctanccttgggcgacgtggtggagggactgtccccgggacctgtccgggtcaancgggtggagtaagttgacgagg

SEQ ID NO: 647161 - DNA, 504 bp, Homo sapiens
agccaacatgcaaagaaacaagtgagggatcatcaaaaaaactctccctgcaaggtggccccaagcggtcagatttctgtttctgaacaccctctaattttaccacactcccttaagccctccccacacctctgaaattaatttcacttccttactgtggactgaatttggtgaagacagaaagttgcacagaaagtctgttgggggaaccttcaacagtctgacgttcagaaatgatgatcacaatggaaccgcactggtgccagctgccaatatctgccaccttctgcaggatggggccagtatcatagccctccgcccagatgcctcaagacaagctgagagcctctgctggggacttcttagatgctgctctcctctaccatgcctactcccacaccaaattgccctgaatttctctggagatcataagtggcccacctgtcattttcatcccaagacattggactaaaacataaattataccaaaagagtgttaaccca

SEQ ID NO: 647162 - DNA, 731 bp, Homo sapiens
  misc_feature (716)..(716): n is a, c, g, or t
cgagctcggtacccaatcagtttacacaaatcatattgatgaaatcgtaattcatggttgagtttcagaacaaaagatattcattgcacattaaccatttagaggtcatttaaataacaaaatattgtattgtaaaagaactgtacaattttaaaacaataaagatttgaacctgtaaatgtgtgtgccttttaaagaaggatacatttttaatatatttgagtgattgctgggaagtgtgaaaatattgttatgtatcatatcaaagagaaacatgtttattacaaaaatgttctttaactatatactatgtaacagggtaaacagtgttatgtagaatagaattgtgtaaactagatctttagagaagttgccattgagcaaagttatttaaatgagttagttgagttggatgagaattgtttgaggtttgttgctagagaacaataataaaataattctttttcagaaaatatttaatttcttcataaaaataagttaaatatttttttaaatatgtatatctaatagtacaaaatggaataaacatcatagtgtatagaaaactgaatttgacaagttaatgaataaatgaacaaatgatttcacatgtttctatttaatctttccatgacatctttatgcaaagactgttaaagcaataactttatatagagggtgattttgttaagcagatctggttaggtgtaaatatnccattccaggtaggt

SEQ ID NO: 647163 - DNA, 1822 bp, Homo sapiens
  misc_feature (1807)..(1807): n is a, c, g, or t
accagcattatgtctgctccagaaatattcataatgtgtctgaagaaaacacgggataatgctgttagacgaccattccattgaaagaaggaagaaaataacgggttaaatcaaagcctgatgtctcagagcatgtcttcagtatcttcaaggcattttgaaaagatagctattagagattttcagagtctctacctgcccctggatctcaaaccaggtgagggtgcttcaggtgcatctagaagaccctgggtacttggaaaagtaatggaaaaagaatactgtcaagccaaaaaggcacaaaacagatttaaagttcctttggggacaaagttttacagagtgaaagccgtatcatggaataagaaagtataacttatggacaaaattaatacattctatgacatttttttctgatttgtcctgcagtgctcattcatcactccaaaaacagcaggccatctttttatgcaaaagtcagcgtgacaatatacttcactggtgtacatcgtttactttttaactggcttcattttaggaataataaattcatcagaatccttggctgaattaaaatggtttttgttttttggtttttttttttacccagacaactctagaaatgcggaccaaactacttcattttctcaaagggcataccttgtgcattgtggcttatgatgagccatattaattgcctgttaaatatacactagcttgaacttagatgttaaatgttattattaccagcatttgtccttttgtgaaatcagtatcagaatacttgcactctttaacacattctttataaaatgtataaattattcagaactatttaaaataaagaggagtgttattgcatgctgataatcattttgagtttgcctcagtagatactaaagcaaattgtttcagtttttttaaatgccctttgatgtttcaaaaaaaaaaaggaactgtaatttgattgactgattttaagatcagccataagtaatcagcaatcttcaaaagcactttcagtggattggtcatctgggttctaaagggaagagtctgtgctactaaccatttcaaatgcagactcaaaccttcccaacatctttatgactctagaataatcatattgatgaaatcgtaattcatggttgagtttcagaacaaaagatattcattgcacattaaccatttagaggtcatttaaataacaaaatattgtattgtaaaagaactgtacaattttaaaacaataaagatttgaacctgtaaatgtgtgtgccttttaaagaaggatacatttttaatatatttgagtgattgctgggaagtgtgaaaatattgttatgtatcatatcaaagagaaacatgtttattacaaaaatgttctttaactatatactatgtaacagggtaaacagtgttatgtagaatagaattgtgtaaactagatctttagagaagttgccattgagcaaagttatttaaatgagttagttgagttggatgagaattgtttgaggtttgttgctagagaacaataataaaataattctttttcagaaaatatttaatttcttcataaaaataagttaaatatttttttaaatatgtatatctaatagtacaaaatggaataaacatcatagtgtatagaaaactgaatttgacaagttaatgaataaatgaacaaatgatttcacatgtttctatttaatctttccatgacatctttatgcaaagactgttaaagcaataactttatatagagggtgattttgttaagcagatctggttaggtgtaaatatnccattccaggtaggt

SEQ ID NO: 647164 - DNA, 425 bp, Homo sapiens
gttaatgctggaatgagttaagactttagggggctattgggaaggcatgattgtgttttgaaatgtgaggacatgagatttgggaggggccaggggtggaatgatatggtttggctgtgtccccccacccaaatctcatgttgaattgtgatcctgagtcttggaggtagagcctggtgggaggtgattggatcatgggggcagatttcccccttgctgttctcatgacagtgagttctcatgagatctggttaagtgtgtagcacttccccctttgcttgctctctccctgtgccatgtgaagaaggtgcttgctttcccttcgcccttctgccatgactgtaagtttcttgaggcctcgcagccatgcttcctgtacagcctgcagaactgtgagttaattaaacctcttttcttcataaatt

SEQ ID NO: 647165 - DNA, 1594 bp, Homo sapiens
  misc_feature (1579)..(1579): n is a, c, g, or t
gtgtgtgtgtgtgagagagagagaagtggtttaatcactctagtgattccatttttctttccctcttaggcacaaaacagatttaaagttcctttggggacaaagttttacagagtgaaagccgtatcatggaataagaaagtataacttatggacaaaattaatacattctatgacatttttttctgatttgtcctgcagtgctcattcatcactccaaaaacagcaggccatctttttatgcaaaagtcagcgtgacaatatacttcactggtgtacatcgtttactttttaactggcttcattttaggaataataaattcatcagaatccttggctgaattaaaatggtttttgttttttggtttttttttttacccagacaactctagaaatgcggaccaaactacttcattttctcaaagggcataccttgtgcattgtggcttatgatgagccatattaattgcctgttaaatatacactagcttgaacttagatgttaaatgttattattaccagcatttgtccttttgtgaaatcagtatcagaatacttgcactctttaacacattctttataaaatgtataaattattcagaactatttaaaataaagaggagtgttattgcatgctgataatcattttgagtttgcctcagtagatactaaagcaaattgtttcagtttttttaaatgccctttgatgtttcaaaaaaaaaaaggaactgtaatttgattgactgattttaagatcagccataagtaatcagcaatcttcaaaagcactttcagtggattggtcatctgggttctaaagggaagagtctgtgctactaaccatttcaaatgcagactcaaaccttcccaacatctttatgactctagaataatcatattgatgaaatcgtaattcatggttgagtttcagaacaaaagatattcattgcacattaaccatttagaggtcatttaaataacaaaatattgtattgtaaaagaactgtacaattttaaaacaataaagatttgaacctgtaaatgtgtgtgccttttaaagaaggatacatttttaatatatttgagtgattgctgggaagtgtgaaaatattgttatgtatcatatcaaagagaaacatgtttattacaaaaatgttctttaactatatactatgtaacagggtaaacagtgttatgtagaatagaattgtgtaaactagatctttagagaagttgccattgagcaaagttatttaaatgagttagttgagttggatgagaattgtttgaggtttgttgctagagaacaataataaaataattctttttcagaaaatatttaatttcttcataaaaataagttaaatatttttttaaatatgtatatctaatagtacaaaatggaataaacatcatagtgtatagaaaactgaatttgacaagttaatgaataaatgaacaaatgatttcacatgtttctatttaatctttccatgacatctttatgcaaagactgttaaagcaataactttatatagagggtgattttgttaagcagatctggttaggtgtaaatatnccattccaggtaggt

SEQ ID NO: 647166 - DNA, 1268 bp, Homo sapiens
accagcattatgtctgctccagaaatattcataatgtgtctgaagaaaacacgggataatgctgttagacgaccattccattgaaagaaggaagaaaataacgggttaaatcaaagcctgatgtctcagagcatgtcttcagtatcttcaaggcattttgaaaagatagctattagagattttcagagtctctacctgcccctggatctcaaaccaggtgagggtgcttcaggtgcatctagaagaccctgggtacttggaaaagtaatggaaaaagaatactgtcaagccaaaaaggcacaaaacagatttaaagttcctttggggacaaagttttacagagtgaaagccgtatcatggaataagaaagtataacttatggacaaaattaatacattctatgacatttttttctgatttgtcctgcagtgctcattcatcactccaaaaacagcaggccatctttttatgcaaaagtcagcgtgacaatatacttcactggtgtacatcgtttactttttaactggcttcattttaggaataataaattcatcagaatccttggctgaattaaaatggtttttgttttttggtttttttttttacccagacaactctagaaatgcggaccaaactacttcattttctcaaagggcataccttgtgcattgtggcttatgatgagccatattaattgcctgttaaatatacactagcttgaacttagatgttaaatgttattattaccagcatttgtccttttgtgaaatcagtatcagaatacttgcactctttaacacattctttataaaatgtataaattattcagaactatttaaaataaagaggagtgttattgcatgctgataatcattttgagtttgcctcagtagatactaaagcaaattgtttcagtttttttaaatgccctttgatgtttcaaaaaaaaaaaggaactgtaatttgattgactgattttaagatcagccataagtaatcagcaatcttcaaaagcactttcagtggattggtcatctgggttctaaagggaagagtctgtgctactaaccatttcaaatgcagactcaaaccttcccaacatctttatgactctagaataatcatattgatgaaatcgtaattcatggttgagtttcagaacaaaagatattcattgcacattaaccatttagaggtcatttaaataacaaaatattgtattgtaaaagaactgtacaattttaaaacaataaagatttgaacctgta

SEQ ID NO: 647167 - DNA, 117 bp, Homo sapiens
gatccccggaccgttggtgcgggaccatctcggggatctgggtgctcggcactagccgttgcgggcgcgtatgcgctgcaggtgagatccggggcgcacgtagtggtccgggggtac

SEQ ID NO: 647168 - DNA, 254 bp, Homo sapiens
aacatgtattctcgctaaataccagttactaaaggatgtgtagaaaccagaggtaaaggtctcgcgatatcttaagacatccggcgtagtacgcttcagtgagccaccagcgctagagacagtaggacgaacgctcgcgagactctgatgccgtatgccgaaggacgacctaggacgggggacggagacggggactctcgacgaaaaggaaacgacggtccgggggttggagtacccggagactgcgaacttcc

SEQ ID NO: 647169 - DNA, 445 bp, Homo sapiens
agctcgaattcctgaacgctgcctgctgaggaataatgctctaaaatttaaaaaaatggagcttccatagatttttgctaacttgatgttacttccacagaagactctagagatcatttttaaagagtttcaaatattatacttacagaaaggaggagcaataaaggctctgtaggctttctaagaattcattccagataacccagtctctacctatagagcctacatttacagatgaggagaatgctgcagctgtaatatatctagactccgatggagcatttgacagtccaccattctatacttgggagcatgacggagaggtgacttatagtacgggatagttattgaacaatggaactcaatcttgatttagttactcattggcagcctggcaggaagtctcttatgggctgctgttttttgaccctgttacactcatcag

SEQ ID NO: 647170 - DNA, 810 bp, Homo sapiens
agcgggaatggcggcgccttagaggattcagagcgactgggcgacaaggccctcaggaaggatgaaggggagggcctggctgagtctgtcatcccccaggaaaccatctttgtatggcagcctgacttgtcaaggaattggctagatggcatcccagaggttacagcttccagaatgatttactgtgaatgaaataaacaagaaaagcattcatattacatgtccaacaggaaactgcatcttctaagttttgacaccatatactactttttccacgaatttcatacaaaggagtataacatgcctggacatttccagcagaggaggtctatggtgtgtcttctagtacatgacgggagcatgaaaatctggcgaggcttccaatggagaactcaggagagtattgcaaggacatgtgttgatgtgaatcgttgcaggtttttcccatcaggccttgtggtcctgatgtggtgggaatggagtgcccagctgaccgatatggtcaggctgaaggatgctagctgcgtggtgaccttcatataaggtcaacaaaggaggtatccgtggatacagccatcgttgatcgggggaggaatgtggtgtctgcttctcgagatggtgacaagaacgaatttgggattgtgggcgctcagcactgcttgggagtccttgcagatctgtggttctcctatcagatggatctggcggtgggtgctgttgacaactccataaaccttggtcccctgacagatgccatggaacggcaggttgcaacagaggccaaaactgctgcttggcccgggaaatata

SEQ ID NO: 647171 - DNA, 157 bp, Homo sapiens
ccgggatggggttgggggacaggggaaaaaaaagctccaacctagtagcctgtagtcccaagggaagtgtggcactcttcccaattccctagccgggggaagcttcccttcaagttgacctgaagggcctattattgaggaaaactgtagcttgggg

SEQ ID NO: 647172 - DNA, 441 bp, Homo sapiens
gggggtttggttttatttatcaaataaaaaaaaaaaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaattcgttaccctcctcttcacccattctctttttacccggcgcccttatttttggggcgccctactatcctctcctttgccaacagccccctaacggggggtggaaaacaaaaccgtggcccctgttaaacaaccttgcctggggaaaaacccgggtggcccccccgaaaaactgtggggaaatccccctttgcccccagcggttaacctatcagaaggcccccccacggcctctcttcaacttttgcgcttcc

SEQ ID NO: 647173 - DNA, 889 bp, Homo sapiens
ggttttcctgcgctggagccgcagtgggcgtaggtagccatggcgtcccatacggaatgtggatggtcttgatagccccagttccatgatgactggcagcggcgcgtggtctcgtggttcatctcaatgccgtgtccttgtagtatccgtatacgtaaggcccggcaagccaatgtcgcgccgggattcgcctccgtcgtcgccgtcgtcgcggtcccatccggcccatcttgcgctggccctatggttcggtctcacacggaaggttcgcgccgggcgcggcgggttcaaggcgcttggggtgagctcagggttggtgccggaattcactacatgaacggtgggcccgcggaacggtctgcgtcattatctggtgagattccttaggatggcggcaattcctgtccagggtgagtccccgttgtgtgcgcaatcattgcacgcgtctcgaaggagtaccgggtcctaacatcgagtccgtcgttccccgaggaaggcccctcgggtctccctcgaataaggggatgacacgttccttgattgaagaacttgaaagcattgtgcaggcattcgtgatccgggaccaggctcatgcccgtcccgagaacggttctataggacatggttgaaagcttcgagtcattcaccttgaaggaaggagtaatgattttcaaatgcctttcggtagctctccgtatgggcccgtgtcccacgcttcggctctttcggcattacgggcaagaagaaggcaaaggaagccttgagagccggattgttgaacaaggaacaaataatgcgctcctggggacttggacatcctgacaacatagaacatccccggacccttccgggtggccgagcaccagggctctcgcttggggctcttgct

SEQ ID NO: 647174 - DNA, 600 bp, Homo sapiens
tcttctcccctgacactgtggacacagagtgtagctaaagaacagagccttccctcagggatgggttcatgtctccggaaggcggtactctgagaggacattatagcgcgtacttgcttagtaagtgatctgaagcgaggactaaaaatccaagcagcagaatttaatatagatgggcataatgagcgtccctccccagccccaaatgttgacgatccagttatgactggagagaagatttacgtatccttggatcaatcagagattcagttgtggaaattcttttcgaacaagataatgaagagcgctcagtggccactttaatattgggtacccttatacagtgtccgatagacaccaggaagcaactagcagagaatatggtacgtcataggtggcactttctatgtagccaggatttctccacagattgcttgcgtaaataaggcatctggtagaatgaccaagtatataatagagcactgggcactaagacatatcgaatccatactccatctgcaaaagcgaatggtgtggcctgcctgggaggggctactattggagccttacacgatatacttgggagccgtactgttccaa

SEQ ID NO: 647175 - DNA, 223 bp, Homo sapiens
  misc_feature (33)..(33): n is a, c, g, or t
  misc_feature (37)..(37): n is a, c, g, or t
ctatcttacttctctatcttaatctctctatcnttantctctctatccttaatctctctatccttatctctctatccttaatctctaaacacatagccagcaatggctgcggccacctccaccaacatgataagagatagaaagatggcaaacgtgatcataagacaatagttctccttgcaccgccatggctgccgggcctgggcttcccaaggctggctgg

SEQ ID NO: 647176 - DNA, 290 bp, Homo sapiens
  misc_feature (91)..(91): n is a, c, g, or t
  misc_feature (149)..(149): n is a, c, g, or t
tacaaacagagagactgtctgtgtaactcttcaaaatctgtatggtaggtactgagaccttcacagatgtcatctttttttctgtgtacantggaacttgtgtgacattagcattgtatcagcttgtactgtctcatactctgttttgnagaatatttggaattgttgtgtgtctgtgaaatacctcccaaatattagtacgtgtgtctactggtatttgcacctgttataacgcaattattctgtgtcttaacagtataaatagtgtagtttgatgcagaatggcgtct

SEQ ID NO: 647177 - DNA, 441 bp, Homo sapiens
  misc_feature (2)..(2): n is a, c, g, or t
  misc_feature (8)..(8): n is a, c, g, or t
  misc_feature (13)..(13): n is a, c, g, or t
  misc_feature (84)..(84): n is a, c, g, or t
  misc_feature (103)..(103): n is a, c, g, or t
  misc_feature (106)..(106): n is a, c, g, or t
  misc_feature (121)..(121): n is a, c, g, or t
  misc_feature (142)..(142): n is a, c, g, or t
  misc_feature (148)..(148): n is a, c, g, or t
  misc_feature (151)..(151): n is a, c, g, or t
  misc_feature (219)..(221): n is a, c, g, or t
  misc_feature (283)..(284): n is a, c, g, or t
  misc_feature (310)..(311): n is a, c, g, or t
  misc_feature (314)..(314): n is a, c, g, or t
  misc_feature (319)..(319): n is a, c, g, or t
  misc_feature (336)..(336): n is a, c, g, or t
  misc_feature (356)..(356): n is a, c, g, or t
  misc_feature (359)..(359): n is a, c, g, or t
  misc_feature (363)..(364): n is a, c, g, or t
  misc_feature (369)..(369): n is a, c, g, or t
  misc_feature (374)..(374): n is a, c, g, or t
  misc_feature (409)..(409): n is a, c, g, or t
  misc_feature (419)..(419): n is a, c, g, or t
  misc_feature (428)..(428): n is a, c, g, or t
  misc_feature (436)..(437): n is a, c, g, or t
gncgaggncatgnacgaaatggagttcaccgaggccgagagaacatgaacgacctggtgtccgagtaccagcagtaccaggacnccacggccgaggaagaggncgngatgtacgaagacgncgaggaggagtcggaggcccnggcccnggngtgaagctgctcgcagctggagtgagaggcaggtgccgccggggccgaagccagcagtgtctaaaccnnnggagccatctcgctgccgacaccctgctttccccgcgcccgagggctcccttgccgcccgcnngcagtatttatggcctcgtcctcccnnccnagccngcgtgtgagctgctccngtctctgtcttattgcagcnccnggcnngacgntttanggttttgttttttacgggtttgtgtttatattttnggggatacgnaataaatcnattgctgnnggat

SEQ ID NO: 647178 - DNA, 1210 bp, Homo sapiens
aatgctttggcccaacagcagaagcggctcagttagagtccagcaaaaggtttgccaaagagtttatggacagacatggaatcccaaccgcacaatggaaggctttcaccaaacctgaagaagcctgcagacttcattttgagtgcagacttccctgcttatggtatgtgaaggccagtggtcttgcagctggaaaaggggtgattgtcgcaaagagcaaacgaagaggcctgcacaggctgtacaagagcatcatgcacggagcaaagccttatggggcagctggcagacaccaattgtccattgacagaacttcttgacggcacacagcagagtgtcgttgtctgtgtttcacctcgatggcaagactgtggcccccatgccccacgaacaggaccataacgcgattactggcagggcagatggtggccctaaccacagaggggaaatggcgagccctaattgtcacagccacctacacggatttctacatgcatctactcaactacacacatcacaagcatacatgatcctatcagcacggacacagtgcgcatcggcactgccagccacaggcggggtacatcgcaataatcacagcgataattacttcatactgcctgcgaaatacactgcttgacacccaaagcacacactggaccccgaacaacgcttcatagcacggttcacaccttcggcccgtgcataggcttgaaatccagcaacctgcccgaaggttaataccatcccacaagcttcttaaacaaggtggactcctctgctgaactgttcgatatccagcatgcgagccctagtacaactcggcacctcgaatcagtgccaaaatcatcgatggccgagctagggcattcgaaccaagcgacacaccggcactaaacatcggtcgtaactaggccccacccgcaagaagagcgatataaacaccatgtgcgagcaaactaaatccccaaagggcgcattaagccagcactctaaccacaggcacgcacccgtgcggcggcctcacaacccgctacagagacgtgtcaacaatgctcccactgcacccggaaccaacgaccgcacacacatggacggaacagataacacacagaaaaggagcgacaacaatacaatggagcgacgacagcaaactacgcgacaacactcgagtacaaccggagatggacaagcaaccacaaagaacacc

SEQ ID NO: 647179 - DNA, 208 bp, Homo sapiens
cagcccccccttttgccccccccccccccccaacccttttttttttttgccctccgggggccccccctaagggggggggggttccttccccccctgggtttcggggggcaaagggagcccccccgggggggggggcccctttttcccccgcctggggggggggggggaggggggggtgggcccataaacggccccttcccaatgtcca

SEQ ID NO: 647180 - DNA, 388 bp, Homo sapiens
cggtgtatgtgtgctacttcaaagtaactaggaaatataatcttcgcaacacagggtaccttgttatgtcagaattgggggtgttaggttgccatttgtatcagttgttgattcatttcattacttcctacagatcaaacgtcagcgttggagttgcccacagtgaagtgaatccgaattcccttgtcatgaacagccggggtatgtggctgacatatgtcttgggagttggcttgtcttcatattgtcttactcagcattcccttcttcagttttcctgttgcttggactttcacatatattatacattatctggggatgtacgtctttttgcatgcagtgtaaggaacatctttcgaaactcctgaccagggttagtgtaggctac

SEQ ID NO: 647181 - DNA, 962 bp, Homo sapiens
aggacaggacgaggatgaggaggagaaggagaagtgtggacgccgggaaggcgagcgagctgacgcatccatcgaccgtggaggactgacctggatgatgtcgtccggatgtccaggagatgcctgtggtgatggcagtgggggtgctaagagtccccaaggctcagggataagaaggcgccgtcttggccaatggtgcggtgcggggagataccgaatgtaaggaacgaaggggttcagaggacgaggcccttcgaatggacagcagatgaatgaggtggcacttcgagggcccaaaggtaggtggtacatatcgactgcttcagacggtcatcggcattgagctcccagagatagcaggcctgaagaccaaggccatatggcgccgaatgcaagggaagtgaggggctcgaaaaggaggttggttcagcatagaggacttatgaggcgtacaagttaatgattgacgcgaatgaagtagacggaagggaacgcaacgactcgtctggaagtgatggccaccaaagggctgggaggagagacggaataacggaacggcgttctcccaaccaccaggtgggtagaatagtaaacgcgcctagcagtatcatgagcttggcgaggtcagatggcagttgctgggaactagcgtacaagaatggaagaaggaccgtatgatttggagcaaggcgaagggccgtgcccttcaggactcccttcgttccagtgaggccgagtgggaaagcaaatgagcgtcgcatcccatatgaagaaagtcgtctggtggcggcacgcatccagagaaagggtgaaggctgtctagggggacaaatcacgttcgtcctggcaagcctaaccgtgcccgaggcgacatgtaggggagtgacgacaagacatcccatctgttccatgcgcttgtcggggtcgggctgaccagttcacataccttcggtgtcgcatgg

SEQ ID NO: 647182 - DNA, 229 bp, Homo sapiens
ggtcacgaaaccctcagccacccgagattgagcaataacagggtttgatgacccccgcatcggcgtaaccggagtggacgtaccgctggtgtcctgttgtctcgccagaggcatcgcagggtagctatgtacggaagagataaccgctgaaagcatctaagcgggaaacttgcctgaagatgaggattccctggagacttgatctccctgaagggtcgttcgagaccag

SEQ ID NO: 647183 - DNA, 252 bp, Homo sapiens
ctaatttttcttttattgtgtttttggtgtcatatctaaggcataattgccaaacccaaggtcacaaagagttacacctatcttgtcttctaagaggtttatagttttaactcttacatttaggttcatgattcattttgagttcctttttgtgtatggtgtgaggtagggggccaactacatttttctcctgtgggtatgcaggtgtcccagcaccatttgttgacataaataggatcttaaaggacaact

SEQ ID NO: 647184 - DNA, 797 bp, Homo sapiens
gttattccttctctgcatcgaaggatcaggaagttggtgctctctgcgtggctaagttttagcacctactaggacgggggtggggtggggagaacaggtgtccttctaaaagtacagcacaagctacagcctgagtccagccataacccaggagtaacatcagctccttgtgtatttgcagagatatggctagctaggactagagcttgctaagtttagcatgactgtggaattactacactatgattgtctgaatgttatcgtctagacttgtgatctccataaaagacagggtgagaatgacgcacgtttagactcaccgggcccgtcgcactgaaataagcaaggaactcgtgaataagaagatggaatacgtgagggaagacagtaatttgggagaaaagtccagacaattgaagattctggcagactctaaggactatccgccttactcttatggataaggaagtattgcgtctctgggagctaagagagtccagaggggtacacatctttctggaatgactgcatatcatcaggcctgcgagggggcatcctgatagagctggccatgcggggtcgaatctatcttggaaggccccgatcatgcgttaagaagcgactactagacagacaaggtacctgtaaagtcagacagtccaacaggtgactgttttactggatgaaactctgaaagcgcatctaaagcaagtggaaccacagaaaatgtccaaacatggatgagagctactcacctggtgagactggagccctgcaattacagtaccaggtgagaa

SEQ ID NO: 647185 - DNA, 243 bp, Homo sapiens
attatgtttaacatgtgattcatataaagttagtgagatattttacattctttttctcattctcagtcctcaaaatatagtgtgtgtatttcccccccaaaacacatctcaattcggactaaaaactttccaataaagctcagcaggccccgcggggtggctcacgcctgtaattccagtgctctgggaggctgaggcaggtggatcgcttgaggagttcgagaccagcctgggcaacatgag

SEQ ID NO: 647186 - DNA, 146 bp, Homo sapiens
gactctagcacggatcccccatgacgtatcccacagccctgctggcttctttgatgatgtgcaatcgcgaagagaattctcatcgcgattgcacccatcaaagaagccacgcagggctgtgggatcacgtcactgtgctccgcgat

SEQ ID NO: 647187 - DNA, 402 bp, Homo sapiens
  misc_feature (262)..(262): n is a, c, g, or t
  misc_feature (360)..(360): n is a, c, g, or t
  misc_feature (371)..(371): n is a, c, g, or t
  misc_feature (396)..(396): n is a, c, g, or t
tacaattgtctttctcttacatttgcggttttggtgagagaataattccaggtatgatattcagggaaccagaaagcagaaagctgaagggaccagagattagggcagccaggagtagacagagaacccctatcagccagacactctcccaatctgagcaagggacaaaaggaagcttggaggtggctccagcccagaagctacagagggccagctgctctggccatgaggtgatgccatgcttcctgcctatccccaactntgcacctgggccaccaatgagtcctatgtgtccctcccccaatagcatcccgacacatttttttttttttttttttgagatgggagttttcaattccntttgcccgggnttgggagttgcagtgggcaaagttnttcagt

SEQ ID NO: 647188 - DNA, 125 bp, Homo sapiens
  misc_feature (28)..(28): n is a, c, g, or t
  misc_feature (58)..(58): n is a, c, g, or t
  misc_feature (105)..(105): n is a, c, g, or t
ggggtagcacaggcctttcggggagggngagaatacccagggttgcagagccttgagnccgtgttatcagatgtacgagagcttagcgcgactccattcaaactnctacaaaacacaagtaccct

SEQ ID NO: 647189 - DNA, 228 bp, Homo sapiens
  misc_feature (104)..(104): n is a, c, g, or t
cagcttggcggtgcccgcagtagcgaccacttcgaagcccaagttgatcagatcacgggccacgcctgcaaccagaggcttgtcatcgtcgcgcacgctgatgnacgcagtaccgccggtcggcagcacttcgctggcacccatctgggccttggcaaaggcttcgccgaaggtgtcgcccacgcccatcacttcgccggtggacttcatctctgggccgagggtcgg

SEQ ID NO: 647190 - DNA, 184 bp, Homo sapiens
tgcagtgagtctgacgatcgcgcactgcactccagtgtggcaacagagcgagactccgtctcaaaaaaaaaaagagaaaagaataatgaatgcatggataacttggacggagaatatatatctttacaacttacaggtttcacattcatgaagatgacatatttcaccacaaagtcaggttctg

SEQ ID NO: 647191 - DNA, 517 bp, Homo sapiens
  misc_feature (349)..(349): n is a, c, g, or t
tcagatactcaaaaaaaaaagaaaaagaacaaacaaaaaatcaaggacccaaggactcatttcctctctatctgcctaaaataatttcttaataactcctacaacattcccccctgtggagatgccacactaactgctgttagggagtttggggcgacgactccttctggctacttcttgttgcaaaagggcgtcgaatggggaagagcagctagggctcctccgggggtcaatctaagggtcctcagaagaatgatgtgtctatgtgtggttctgtttacagcaccattgggagttggatggcttctagatgagaagaaacaatttgagttatagtatggtgtatacnaggtccaaatatcattacaagacacataagcaagagagggcttaataaaggggttaaccaatttcataaagaagactggaatttattaaagaggcattgtagccactcggggatcaataatttcgattggatttttaagtacttgtagattttcttttaacttgaggt

SEQ ID NO: 647192 - DNA, 415 bp, Homo sapiens
  misc_feature (1)..(1): n is a, c, g, or t
ngcgctcagcagtagcaatgatcttgatcttcgttgcgctgggtgccaggacagtgatctcctcatgcatccagtcgccaatcccagggtacatgctggtacagccagtcagcactgtgtaggcgtacaggtctttgcgtatgtccacgtcacgcttcatgatgtagttcaaggtagtttagcgtatgccacagcactccatgcccacaaaggaagcctgtaatagtgcctcagggcagcggaaccgctcattgccaatggtaatgacctgtccgtcagccagttcgtagctcttatccaggcaggagctgcgaacacccgtggccatctagggctcgaagtccaggacgatgtagcacagcttctccttaatgtcacgcacaatttagcgctcgaccgtggtgttaaacctgcc

SEQ ID NO: 647193 - DNA, 547 bp, Homo sapiens
  misc_feature (7)..(7): n is a, c, g, or t
  misc_feature (63)..(63): n is a, c, g, or t
  misc_feature (77)..(77): n is a, c, g, or t
  misc_feature (104)..(104): n is a, c, g, or t
  misc_feature (108)..(108): n is a, c, g, or t
  misc_feature (115)..(115): n is a, c, g, or t
  misc_feature (128)..(128): n is a, c, g, or t
  misc_feature (142)..(142): n is a, c, g, or t
  misc_feature (149)..(149): n is a, c, g, or t
  misc_feature (161)..(162): n is a, c, g, or t
  misc_feature (256)..(256): n is a, c, g, or t
  misc_feature (276)..(276): n is a, c, g, or t
  misc_feature (302)..(302): n is a, c, g, or t
  misc_feature (539)..(539): n is a, c, g, or t
ccggatnttctgcaagctccaggccctctgtgtgcggtttgggcctaagccaggatgtacggnggcagggggtccantgagggcaagttcttcatgttcaagcngtanctgtagnacagatgatcctnaatgtaggtttggnggttttncctcctgaaggnnccctgggcgcagcggtggggccagcccacccctggagaaaagaagggcaccgggggtgttcgggttttagttagggggatgggtgaatgcatcngggagatacgcgaggtggtntgagacccaaaagctgtggtactgtnagcggcgtcgacgtccaaggcacacatgcagaggaggcaaagggggctggagttgccaaagcagggacatcccgggggccttcaaagttacttacttgttctgtacacagtgctgacagtggaggggaactgggtctgcagcctgaggatgaaggcctccatcagccggtggatgctggccttttcaggggccttggtgtcgacggctggtgtgaagacagaaggaacggagaacangcggttgt

SEQ ID NO: 647194 - DNA, 777 bp, Homo sapiens
  misc_feature (170)..(170): n is a, c, g, or t
  misc_feature (173)..(173): n is a, c, g, or t
  misc_feature (210)..(210): n is a, c, g, or t
  misc_feature (214)..(214): n is a, c, g, or t
  misc_feature (221)..(221): n is a, c, g, or t
  misc_feature (468)..(468): n is a, c, g, or t
  misc_feature (543)..(543): n is a, c, g, or t
  misc_feature (568)..(568): n is a, c, g, or t
  misc_feature (571)..(572): n is a, c, g, or t
  misc_feature (592)..(592): n is a, c, g, or t
  misc_feature (666)..(666): n is a, c, g, or t
  misc_feature (711)..(712): n is a, c, g, or t
  misc_feature (749)..(749): n is a, c, g, or t
agcggagtcgcgagaggggctgagaaagtggtgacaccgccggggtgcggagggagtccctgaaacttctcccaacagccccagggccaatcttccctcagcccactcccctcttcgccagctcccaggtccccactcctgtaccgggggtggggtggggagccaggccngtntcccgctgggaccacacaggggccagggagcggggcngggncccccgnggcgggggggccgaccgacacgccacgccggctgggcgcccgccccacgcgggcaaggcacggacggcggaggcggaggcgggggtacgacggggagcactgggtctggggagtttcctctcaacaatcgggcgcgagaaactccccgcagcccgcgcaggaaagacccagacagtgttttcctcccggggcgccgtgctcccccgccccgcgctagccgcgctcgccgccaccagcgcgcctccanctcttaccatctcctctttctgccaccactacggggccccggtgttccccggaccagcactcatggcccatcttnactggttcctagatatgacactgtntgnngtctattgaaccagccgcancaatctgggggcaccaccctacccttggacacggggcaaaaggcgcaggtagagacccttcaatgaaagctccngtgccccgggacccctgcccagcaagaaggagcacagggtatatnnctgggtcacttttcgcagcagccgcccctcatgctantcaagggctgggatgggaaagaaaaacc

SEQ ID NO: 647195 - DNA, 812 bp, Homo sapiens
  misc_feature (667)..(667): n is a, c, g, or t
ggccttggtctctcgctgcagtcgcagtgtccaggtctcgtcttcactgctctatgtcccctgctcctagaggtccacctgtctgtggtcccgtgtacctgactaggtattggagagatccacgaggctagagacgccaggacctccctggtagagcctagcaagatggtgaccatctggatcatttacggcgatgtggccgatagaattactcttctggaggcagtgtgcatatgcctggtacatcttgccactagcagacatttgtatgaggaatgctgatgttcacgataactacgagagagacctggtcttgcctgggtcattgctgtgctctacatgccatgactctgtatcacgttgtctcggagcaacggaacaagaagccctggaatattgaacgagagtatgctgatgcgttagtccaaactccccaggttggagtgcatgtggcgtagatcttgggttacttgctaacctctgtcccctcgggattcaagtgattctactggtcctcagacctgcccgagtagctcgggattactaggcgagtgccatcatgcgctggctaatttgagtcattttttgagcagagtgagggtttcaccagtagttggcgcaggctggtctcgaacggctggagctcgatgtgatccgcctcctcagnctcccaaagtgctgggattacaggcatgagccacagtgcccggcaaagtatttttatatttcagatcatatctactgaatgattgggtgacagaaaatttgcgattgcttttacctatgggtttcaggtaaccaatggtataata

SEQ ID NO: 647196 - DNA, 698 bp, Homo sapiens
agcggagaagagaacggacggcgatggcgacggtcgcgagcaaatccagctgctgctgcggcggcgtgtggcggcggcagcggcggtgactgacggatagatttgcctacaggacgaggagctgccaggcctggacagtcagtggcgccagatagaacaacggcgagagatgggcgaagaacgtaccactgcgaggccaggcgaatagctggttccttgtggagaagcactgagtataagcagtgggaggcatacgtgcagggaaggggaccaggactccagcgacctttccctggcgtgcgatcaagcaatgccactactctttcaagatgagataaactgggcgctctcaagggagggactggtggaaggcgaggattatgtgcagctccctagcagctgcatttggcattaccgtggtcgaagctgcgtactggtctagaagcatgagccaaggcaaccattgaactgcaatggtcaatagaggcttaccataatccaagaaggtccgaacgtgtaccccagtagaactgtctgcttgtaccggctacagatcgattacgtggcgaaatctcacacatgtatcagttcagccatagccgattctattggcgctagtattgcgcacagatcgggagcgggtgtctggtggagccccaggaagagactcggggttgggggccgagaatctcaggaag

SEQ ID NO: 647197 - DNA, 204 bp, Homo sapiens
  misc_feature (184)..(184): n is a, c, g, or t
cctagttttagaagtttcaatagcacattatagaaaatagaaaagaagaataattaagctgtaattccaccacctcagtatagaatcagatctgtaaccttgcttctagtcttttttccattttccgtgatatgtatcagatatatttattttacatgagattgagaattacatcacgatactnttatccattagtacttcgtg

SEQ ID NO: 647198 - DNA, 535 bp, Homo sapiens
catccgatgtcgccacctgcaggtagctgctggaggccgaggagagccggctgtagtctggcatgcagcacatcagtattcgtacgaagaccaccaacggctatgcaggtggtctgagctcgccctatgggggcctcacaagccgcggcctcagctacagcgtgggctccagctttggctctggccggggctccagctccttcagccgcaccagctcctccagggccgtgggtgtcaagaagatcaagacacgtgatgggaagatggtgtttcagtcctccggcgtcctggccgagtgtacagctggggctgcccctcccagccttcccctcttgcgttgccccagagcttgggaaggaggccgctctccatggtagctttgggaacagtagccccccctgagggtcagcctttgcccccagcccacttggggagtttgctccctggggcccccccttgcccctgcctccggtttcagctctattggcctgggttttttttttggtccaaggtagaacctcagctagctctgcca

SEQ ID NO: 647199 - DNA, 133 bp, Homo sapiens
atatccaatggggcatacattgatgcgtcattcagcaagtcatccaaacagtcacccaaacacccatacatcatccatccatccatccatccatccaattacccatccattcatctacccaaccaaccaccca

SEQ ID NO: 647200 - DNA, 381 bp, Homo sapiens
  misc_feature (34)..(34): n is a, c, g, or t
  misc_feature (42)..(42): n is a, c, g, or t
  misc_feature (46)..(47): n is a, c, g, or t
  misc_feature (55)..(55): n is a, c, g, or t
  misc_feature (60)..(60): n is a, c, g, or t
  misc_feature (65)..(65): n is a, c, g, or t
  misc_feature (83)..(83): n is a, c, g, or t
  misc_feature (92)..(92): n is a, c, g, or t
  misc_feature (104)..(104): n is a, c, g, or t
taacgagactgtgctgaagcccagcatggtgganagaggcancccnnggtgactnacgtntgcanagtgagctctcgggggtnagcgcccanactggggattancagtcctgggcctcgagccctgtggctgactccatccctgcctctggcagcctggatttgcacctttgtataaacggagccgcctggcatggcgtttgcacttggctacttccctccatctgctggtgagctctggcttgtgctctgtgtggcgagtgggtccctgcttggttgggactcagccccgcttcaggaccccgtggccactgaggacccaggaacctgcctctgctcgagtatccggcctctgtcgtgagtgccttgcgtggccagggcc

SEQ ID NO: 647201 - DNA, 1467 bp, Homo sapiens
  misc_feature (400)..(400): n is a, c, g, or t
tgtgtgaagtctttctttgtgtgtgtggtggggggaccggggaaaaaaatatttcgtgggaaaaaaaaaagcggttttattttattgttggctttggtggtggtggagggtattattttataattattttccgcgtgaaatatattttgtggttatattttttatgtgtgtgagagagagagaatgtgtggctctcaaaagtgtgtcttttcttactatatattcaaggggagcgagatatattgtgtgtggagaaaatattgtgtttcacaatatattgtgtggatataaaatatatatattttccacacatagaggaactcataaattttcagagaggtatgtgtggtgggagaaaatatataaatataagtgttctcatatacaccacaacaaaagnacaaaacaaagagagggggggcgcgcccctcataaagatatatctctcccgcggggggcgcccaaatatttaggcggcttcacccgcgcgcatattttatgtgtgacacaagagggggcgccccccaaagagaagggcagacgcactttatacaaacccaaagcggggcacggagggcgcggaggatataaaaacaacgggcgctgggagcagcggggaacaaccgtgcgacaaaaagagggggaacacccttggcagaaaaggagaacccaccatcacacccgggagggaggaggggcgcaccaacaacaagcgggcacaacaaaacaccccaacacaagaagagacactaaacaggcgactataggagggacaaaacaataacaaacccgctacaacggcgacgatacacacggtggggttcaaacacaaaaacagaaacaaacacacaaccgaggtgcgagaaaacacaatatgtagagcacaccagagaggaaaatataaataatctgaggcgacaatctttcttatcccaccgggggcaagtagttatagtactctctacaccacacacagaacacccaccagccaaacacaaaaagagcacaacaagaaacacaagcacagaaaagaaaacagagaaacgacagatagaagacggagcaacaggagcaggaacagcgacacgagaagcaagggccacagcgggcgagaaggaggagacgcgaagaaacaaaaagatgcgcagacagaggaacgacgcacgaagaggcgggagacgcacacacagaacaaagaagaacaacaaagacatgcagacggaagacaccagcgacagcgatcgaagagatgacagaggacaagagcacgaagaagaggggcacgcagtgaggtaggcacagaaccgaagctgcaaagcagaccatcacagagagccagcgaaagacgagatcagacgagagaagcagagtgagaacgggcagcggatagcgagatgacgaacaaagcacaggaagtcggacaggaagagagggcgcagcgaacgagagctatgaagtgactacgaa

SEQ ID NO: 647202 - DNA, 171 bp, Homo sapiens
gatcttaccggtaatatgtaacctggctcactgtatatgtgcacagactccaagcacagctcctgtctttcgggcttgagtttagagacaaaggttcgccatgcttacaggctgaatgttttccctactgaacaaactagccagcctttatttcaagccgaatcactttgt

SEQ ID NO: 647203 - DNA, 1357 bp, Homo sapiens
gtcgtgcttgttctgggtgctctctgtcttccctttgttcctgcttcgtgtctcttcatcttgctgtggctactgttgggtctcgtcgcctgtgtccccatgtgttgttaccggtctctctcactgtgtgtcctgctcgtgcgcggctctgcgctgctgtaactcttcgttccgtgtccttcatcttgtccggacgtcctatattgtttggtgggtcgttggtgtcctgtctaatgtttttctcccgatcctgtggtcacggcgttccacactctagatgtggtggtgtcgttcatcggtatttcctccctctggggttttcgtcgttcgtgtttctccttggttcgcctgctcctgctctgttgtggatgtgttctatgtagtgtcggtgctctgtggtgtgctgtccagtccctgtcgttgcgcgggatgatgtctgcctcttgtcgattgtgccacgctctggtcgtttcaatgcccatgtgttgcgactacgagtgcctgttccgttgctgcggcggaggtgccctctctgcagatttcatgagttaccgtcatctttggggtctgctggagggtgatcctctagggactctgttctctgagaccccatgtgcttgttttcagccgacactgtcgtgtctccagttattcgcatctgactcgtccttcttaccgggctgttccactaagctttctgcttctgctttacgtggcttctcctctctccctggcaccctgctgcgctgcctcactgtcttacagacaggtccctccttaccctcacacctgtcctatgggctatatgggtctctctgtctgatccccaggaacttttcagaggatagcagctcatacgtaacatacaataagcacacaagtattttgggatataatcctataatgcgtgacttaatctcgatgccttaggattcacaagtgtaggaagctaaggcctagaaggttaaggatgtccccagggtcacacagtgagcggggctcagagcttgagtgtcttgtgtgctttgtgtacacttgtgcttctccctagggtgctttagaccctgtttgcttttcttctgcatgaggctgatctccagtttgtcatcaacctcgtttatcttataattgtacggatagagttgaacgttagtcttgaaagattttctaaagctagtctttcaaatctgcttcctcagaggcctaggattttgccaaaagtaccctatggaaccttgtaggaaatgcagtgggggtgtggcgatagagcaggcggcagggagacagggctgcagggcctcccaccttcacaacagacaggctctgctgtatcatggttgtacatacagggattctg

SEQ ID NO: 647204 - DNA, 305 bp, Homo sapiens
tgaactctctactgtcacaggatatatttcgtgggtcaagtcgtccagacacgccttgtctttactgaggactcctttccacccccggccaggacttatcaactaaagagagaaattactttttcttgtactccggcctacgccaccgagtgcggacactagggttgtgaaaccctccggctccgtccacctaacgaattcgagtcctcaagttctggtcagacccgttgtaccactttggggcggagatgtttttttatgttttttaatcagtccgcaccaccacaagcgaacattagggtcga

SEQ ID NO: 647205 - DNA, 110 bp, Homo sapiens
aggatccgcctacctcagcctgctgccctaggtcctgcctccaggactcttgcctttctgacacttccctaaagaaagcgagcctttccagagcctcatcccctccctgc

SEQ ID NO: 647206 - DNA, 985 bp, Homo sapiens
  misc_feature (847)..(847): n is a, c, g, or t
gagtgtctcttacgttttaaccagatgataatggacctgcccgtgaagaggcggtcatgacacagtgaagacgagaagaccctatggagctttaattttattaagtgcagaacgagtacctaatcaaaaccacaggtcctaaactaccaaacctgcattataaattaacggttggggcgacctcggagcagaactccaacactccgagcagtacatgctaatacttcaccagtcgaaagcgaactactatactcaatgtgatccaatagcttgaccaacggagcaagttaccctagggataacagcgcaatccttattcatagaagtcctaatatcatacaatagggttcacgagcctcgcatgttggatcaggagcatcccgatggctgcagccgcctattaaaggttcgttcgttcaacgattaaagtcctacgtgatctgagttcagaccggagtaatccaggtcggtatctatctacttcaaattcctccctgtacgaaaggacaggagaaatcaggcctacttcaacgaggtgcgccattcccccgtaaatgatatcatctcaacttagcattataccgcacacccatgccaagaacagggttggtaaagatggcagagcccggtaatcgcataaaacttaaaactttacagtgcagaggttcaattcctctttcttaagaagatacccatggactccgatgactcttttcaccaaagtggtccctggccaaggctggcctcatgtggtaactgggggcgcgggaaaaatactgcacacgacgaggcccgggttagaacacccaccattacggacaagagcggcccctagaggacagagaanaaaagacagggccgggggtaaaaaaactgagccgaaaactacggatttcgagggaccatcgtggggggaaatggcaccccaaaataggcggaaaaacacgctaagctcaacactcgcgatcccgtctaaacacaaagc

SEQ ID NO: 647207 - DNA, 194 bp, Homo sapiens
tgtctgtgtgagacagaagagtgtgattagctgtagcagatcggtaagatcaatatcgaggaggcatggtctgcactagaaaatttgtgtgtcagttgcttctagtccctcttacgctggtcatcactagaatatatattgtccgtatactaacacacatgccacatgcctgatctgtatctttatttcgcctt

SEQ ID NO: 647208 - DNA, 176 bp, Homo sapiens
cgggtgatgatgtgtagggcagggatatatgagaaatttctttttgtcacttttgtgtgaactacaatgatttaaaaaaataattatttaaaataattttttaactacactctgaagatgaaatcaagagtaataggaggggtctctggactcaaaaattgaattttttttttctt

SEQ ID NO: 647209 - DNA, 372 bp, Homo sapiens
gtgtcgcagatgagggtggcatcagagcttcgattgccaagcttagtcgtactttaggggaagcttgggtggggagctggtttatctgctgagctcggtacagataggtggtgatctggcaaatgtaggtcccctcgtcctgtatagtgaggccgggcagggtgagggaggcatccctggccatgcccagctgtgcaggctccagggtagcgccctttcgcacagcctgcccctgccctgcggtccagctgtacaccaactgacccctgcccttgtgctgcagtcgccactccacactgatgaggtccaagcccggtgccatggagaagccacagtccaaggaggctgaggaccccagcaggaagctcaggg

SEQ ID NO: 647210 - DNA, 190 bp, Homo sapiens
  misc_feature (32)..(32): n is a, c, g, or t
  misc_feature (39)..(39): n is a, c, g, or t
  misc_feature (63)..(63): n is a, c, g, or t
  misc_feature (174)..(174): n is a, c, g, or t
  misc_feature (176)..(176): n is a, c, g, or t
  misc_feature (180)..(180): n is a, c, g, or t
ttgcaaccgtcccccctatctaacttaagaanattttgncccaggcatggtaggtggcacgtncctgtggtccatgctgcttgggaggctgaggcagggggattgctcgagcccgggaggttggggctgcggtgagctatgatcacacccactgtacgtcagtctgcttgacanantganaccttgtttc

SEQ ID NO: 647211 - DNA, 759 bp, Homo sapiens
tggcatcattactgccgtcatgggcgtcatcaccgttcctcttcctcatcgaacacccagaagatgtggactgcgccccatcctcagcaccacggtgagccagctgagaaccaggacaaccctgaggaccctgggcaacagtccctgcctctatcagcggagagcggccttgagactggtggccaaactgctccaaggggaccatgccgcactgcagcctgcgtgccatcagcctctctttggaggcgctccgcgatcccaggccgtgggtcgagcttctcatctgcgttctgctgctttgccacgctggtcagttacacctttcctctactggctgccccctctaacatcgccaactgtggcttcacattttagctgccaacggaggcctggggaccctggtctacacttcttccgactgctcggctgcgcatccatacggcggcctccgtgcccgggcctcgccctctgtcctacacgcccctggccaggggccaccaacttcgcctgtgctcactgctcactccttggggctggcccccccattaatagtcaccctgtcccctcataccactttggccccttgccgcccgctttgcccaaggatccacatcgcggactgcctggagcaaatctagaggacggcccatgcaccaaagcgccgagttaccacgcccaccaccaacaacttgcttgccaacctgacgcgtaacccctcgagaacccacaacaagaaaccacgaaaaagcgcaaaccgca

SEQ ID NO: 647212 - DNA, 295 bp, Homo sapiens
cgatctagaggtccccggtggagacgggggtctcacacggaataaacagcatggactttatcctgggtacaaacgcagagtggatgaatggggagggaacagaatcgaggttcaaatcaaaggtaggaggctagaggcttatctatcttttgctatcacccggcaatagccagtattttatgtagcccactcctcaaaacctcttcaagaaaatctatttcgacttgtctgagtaaaagggtgcgtgaacagaggcaagactcaggtctaaaagcaaaaccagataaaagccttg

SEQ ID NO: 647213 - DNA, 309 bp, Homo sapiens
  misc_feature (309)..(309): n is a, c, g, or t
gtggccatgcatcttcagtcagaatttataatataaatgtatgcacccatttttttggagtgcatataatttggacctaaaaatccttatgattagatgaaacaccaaaattatagggaaaataacacagcaggggatagctcagcctgaacagtgttatggtccagctactacatcagatgcggtttttgtgctccctagtgttctggggatatggttgtggcatttggggctgggggtaaagactgagatactggtctgatggggaccttatttttaaggaggcacttctattttttacaaggtatn

SEQ ID NO: 647214 - DNA, 644 bp, Homo sapiens
  misc_feature (72)..(72): n is a, c, g, or t
attctgtttctcacacatttgctaaaattcctcgtgtaatttttctttagtatccttccactgtagaacagnttagagagacttttaaaaatgttgttgtctcttaaactctgtttctgtgcacactatccctcatgagcttaataatttctatgcttatacacgcctataagagaatatagcttgtctcttacacccacactgttcggagaagaacaccgtgagaaactgtgtttctagctgttgtgggccacttgctttctttctaattaattgcttagagttcttatattgcaccccactaatttcttcttctgtttgaacactgtttatgaaccacacacactttctttggtgtgaaaatagacacaaatatgtttccacgacataattggaataatgtttaagctggtcaatctatttaaaatgtctgggtggtggaaccccacgttgtccactgacacacccataaatatcacccgtgcaatttcagaaaaacttttggcaagttaatgctactattaatctgatcaatagtcactttcctttttacccaatttttaaattaagcctgtgacaaagtcattgtggctaaaaagatatgagttttttgggggctccctaaaaaagttttttttgctata

SEQ ID NO: 647215 - DNA, 102 bp, Homo sapiens
  misc_feature (79)..(79): n is a, c, g, or t
ggtatggatgaaatgccgcccttccttactgttaggaggccttgcaacaattggatttcttcacaaatacatgtaaacngactgcttgcttgaaattgtact

SEQ ID NO: 647216 - DNA, 155 bp, Homo sapiens
taggtagaaggatggattctcaggtggcttggttcgaggtctcaaaggtgtctcagctctagtggagtcttctcacagtctcgatctgtcttcagctccaaagtgctggttacaggcgtgaacactgcaccaggcctgaattaagtttttttggc

SEQ ID NO: 647217 - DNA, 654 bp, Homo sapiens
cctgaaacaatgctgttgccttatttgacgaagaagcttcgactcacaggaactaagtatggctgtggaggaggacgctgtggtgcttgctcagcgatgatatcacgatacaccctcatctccaacatgatcaggcattacccagccaatgcctgtctgatgccgatctgttctctgtatggagctgccgtcaccatagtagaaggcataggatgcacccacaccagaattcgtcctgttcaggagacgattgcctagggacatggcacccagcgtggcttatgcacacctgggatggtgatgtccatgtacacactggtctcgagccagccagagcccactctggatcaaactgctgatgccacttagcgcgaacctgtgaccttgcactggatgcagccccatcattgatgcatgcaagcatttttgcaagacatcagactgctgtcaattagctgaacgaagccctactagatctatacgctccggagaatacgagtacgtgccatcgtatccagcgcatgatcggatactaccttctgaactaaggataatagcttataaacaatatgggtggacacctgtgtcagcgtctcagacaatgaggcccggatccccgttaccctggactgctgaagttttcagcctcacagc

SEQ ID NO: 647218 - DNA, 348 bp, Homo sapiens
acctccataatgtgtgcccagtgatgcaggatttttctcagcccccctgctggacttgcggaaggggcaccccctctacttgggtgaccccactcaaccaaccccttgtgggagggaccacatgagtgagcgagtgtgggtcctggccagatgctccaggcaccaacacaggagcaagctctatgtgaggccacagcctgaccaggcgtgtcatctcaaggggaacacggcagtgcccaggtgagggtgcctgtgaccccgaagcccaagagggggcattacagtgctcctctagttttgccatccatggacgggggtgtggtagctcagttagccccttgtctcatt

SEQ ID NO: 647219 - DNA, 142 bp, Homo sapiens
aaaccctctcctcacttgtttgtaaaatgtcccgagttttcccagggctgtgtttgtttgctgctattgtttgggggggatgtggggggatttgttttatctttagcttttgttttcactgagactcagggctacgcattat

SEQ ID NO: 647220 - DNA, 226 bp, Homo sapiens
tgtgtgaattgttttcggtctggcaccccatgaaacatcttgtccacagtatacactctcatgttcaccaaggcaaggaatctctaaggtctggcgctagcgatcaattacctcatgtagggcaaggtgggtccgcaaccgaggtttaaataaaaaaataaaattgatggcagtctcttaccagaagcaggaaaagacgtcatggcaacccgggagacctatactg

SEQ ID NO: 647221 - DNA, 156 bp, Homo sapiens
taaacacaaataataacaacacccatagaaggcgtaccacctgcatcaagtggtgacatctcagagtcctgcattagctatcactccagtagcactcatgtcctcacctatgtgacccacctcagcaggtcattgtgctaaggcagaaccttgctg

SEQ ID NO: 647222 - DNA, 81 bp, Homo sapiens
gcggccgcctactactactactactactgctcgaattcaagcttctaacgatgttcggggacatgtggatcctcgttttcc

SEQ ID NO: 647223 - DNA, 801 bp, Homo sapiens
gcccagttttaacctctagtatccatgaccaaactatccctgacacatgaggacaggggcctcttctggctgtcaggagcaaagcctgaagacttggagctgcaggactggaagaacagtggagccccgtgggtctcaccctttaaggatgctgaggcctagagatgggaagtgacttgctcaaggtcacacaattggatagtgacatagctagagccgcagagttcctgattccaggtacaccgtgtgcttctcgtgggagaccaagagagtggggccacctggctaggagctccgcagcagatgcttccatcagttgtgttagctactcacagacactcaccgagtaggtctggggtcccagataggacaggcgtcagggtcgtgtgccagccactgtaggtgcatgctcaagaccttcatagcgctctcttgtcattctttgttgccccttttctgtcaccagccaaccacatagccttgggaccagcctctctgggggaccagaagtagtgagagaaggaacggggatacggcagctttgacaggtgctgctttcaattcctctgcaactcctccaccttaatatccccaatataaacaaagattctgccaactggtggcaaacctacagacaccatccacggcctcggcaggccactgcccaagataaccctgaccatggcgaggtgggagagagtggccggcgcaagccagtgagcggaagggtgaagacgggcaaacggaggataccaagggcccagggtacacacggataccctcaacaaggacagaggtgac

SEQ ID NO: 647224 - DNA, 789 bp, Homo sapiens
  misc_feature (30)..(30): n is a, c, g, or t
  misc_feature (64)..(64): n is a, c, g, or t
  misc_feature (70)..(70): n is a, c, g, or t
  misc_feature (118)..(118): n is a, c, g, or t
  misc_feature (129)..(129): n is a, c, g, or t
  misc_feature (132)..(132): n is a, c, g, or t
  misc_feature (136)..(138): n is a, c, g, or t
  misc_feature (142)..(142): n is a, c, g, or t
  misc_feature (146)..(146): n is a, c, g, or t
  misc_feature (148)..(148): n is a, c, g, or t
  misc_feature (152)..(152): n is a, c, g, or t
  misc_feature (161)..(161): n is a, c, g, or t
  misc_feature (230)..(230): n is a, c, g, or t
  misc_feature (235)..(235): n is a, c, g, or t
  misc_feature (238)..(238): n is a, c, g, or t
  misc_feature (242)..(242): n is a, c, g, or t
  misc_feature (247)..(247): n is a, c, g, or t
  misc_feature (252)..(252): n is a, c, g, or t
  misc_feature (294)..(294): n is a, c, g, or t
  misc_feature (399)..(399): n is a, c, g, or t
  misc_feature (415)..(415): n is a, c, g, or t
  misc_feature (475)..(475): n is a, c, g, or t
  misc_feature (483)..(483): n is a, c, g, or t
  misc_feature (492)..(494): n is a, c, g, or t
  misc_feature (497)..(497): n is a, c, g, or t
  misc_feature (539)..(539): n is a, c, g, or t
  misc_feature (576)..(576): n is a, c, g, or t
  misc_feature (603)..(603): n is a, c, g, or t
  misc_feature (609)..(610): n is a, c, g, or t
  misc_feature (615)..(615): n is a, c, g, or t
  misc_feature (625)..(625): n is a, c, g, or t
  misc_feature (632)..(632): n is a, c, g, or t
  misc_feature (637)..(637): n is a, c, g, or t
  misc_feature (662)..(662): n is a, c, g, or t
  misc_feature (678)..(678): n is a, c, g, or t
  misc_feature (687)..(687): n is a, c, g, or t
  misc_feature (697)..(697): n is a, c, g, or t
  misc_feature (715)..(715): n is a, c, g, or t
ggaccccgggagtgagagcagcccaaggancccagggtgcagggaactccagagcggcccaccncccacngccccctcagcacacacacagtccccaggcggcctagggcccaaggcnggggcggcttnggncccnnngccnggcncngccngccccactnctaagccaaagaaaggagaggcaggtgctcctgtaccccagccccactcagcactgacagtccccagcncctantantaanctggnaggcncttcctaagaccctttcctcagggctgccctgggagctcatncctggccaacacgccctggcagcaccagcagctcttcccacctccagctgccaaacagcagcctgccgggcagggagcagccccaggccagagaggcctcccggnccagctcagggatgcncctgccagcacaggggccagggactcctggaacaggcacatagtgagcccgggcagcccngcccagcncaggccccnnnccntccccattgaggttggggtaggtgggggcggtgagggctccncgttgtcagcgctcaggaatgtgctccggcagagtgntgaagccataatccccaaccatttccnttgtgnngcccnggtactcagntggcccnctccncagccaggcctggccctgcccttcnccgtggatgttttcanaagtggccntcgagaggtntggatggttttatagcanctttgctgtgattccgtttggttctgtaaatatttgttctatagataagatccaaattaattttttccccctta

SEQ ID NO: 647225 - DNA, 331 bp, Homo sapiens
  misc_feature (291)..(291): n is a, c, g, or t
gagcagcatccctgacagcatcactccctatgatttcatccctgaccaatcaacactcctgggtcgctggttccccccacccaccaagttatccgttaaaaactctgcttcccaaatgcgtgggaagactgatttgagtaataataaaactccagtctcctgcacagccagctctgtgtgaataactctttctccattgcaatttccctgtcttgatgaatcggctctgtctaggcagctggcaaggtgaaccccttgggcagttgcaaatttgggggctcttccaggatngcccttgtggctacctgcccctggttcagtggcccctctt

SEQ ID NO: 647226 - DNA, 115 bp, Homo sapiens
tttatgaaacctgtcatcaaacccttcatcaaaccctgtgaacctgcggaaagctaatataagaaggcccccaaatggctgtagtggtctacttgtatacggagggtttcgatga

SEQ ID NO: 647227 - DNA, 144 bp, Homo sapiens
agtttgggggtgggggggggtaaaggaggggatggtttatttttaaagtttagttttttttttgccttaaacgtcctgttgtggggtttttaaaaaacttcctactgtattaataaaaaaataaaaaattttaaacctgcttta

SEQ ID NO: 647228 - DNA, 922 bp, Homo sapiens
gtactaggacaaagtccccttgtgttatctctcgttcggaacggtcagtatcatcattccagacagacatagagagaatgtcaacgtgaattccagtgtgaccccaaagaggttccctgaaccagtatatgaggatgtccgtggttcgggtgcctggtatctaacgatggatgtgtatcttctgctggaaactgtgtatcttagtggagcttatccagatgagtgagaacagcgcgaggaatcccatcaggcaacggatccatctggctaatgtagccagtcgtcagatagaagcagccaacagagaatttgtgcaagacggcaacacttgtgactgagttactgtccgagcacaaagagaagatgaccgagagactcttgtcagccaatgcagggacacactctggtgttaccaacgaactggctgtctgcagatactattcgcctctggcaaccctgatgcttgctacaaacctataggaaagccttacactggtaaattgtccatgctatctagaggtttggatgtcatcttaagaaagacacttaaagagcgatcagatttactgattgcattgtatgcttgtaagtcacgaaaggggtttgcgcccaatattcgctacctattatgcagatttgtatctttcgcttgtcagacttagctgattctgtcattcgtcagggatgagtaatacctgctaggttgattgcaccttatttaaagcccattgctaaacgatttcggttccggcaattttggaatcgaaatcgggcgggccgggagtggctctagccgacttaggggggagaacccctcctcggtgaaggggcctggcggacatgctggacagagtctccaccagcggagcacacaactaacggacaaacggcacgcctaaaaatatatccactaacatacagg

SEQ ID NO: 647229 - DNA, 124 bp, Homo sapiens
aacgaggtcctctagcttcctcacaggcattcactatcactcccagctaataaaataattgtagacgggtctcgttatgttgcccaggctggtctcgaactcctgggtttaagtgattcccccg

SEQ ID NO: 647230 - DNA, 196 bp, Homo sapiens
  misc_feature (125)..(125): n is a, c, g, or t
tccgtggaccctaccccgccggctgagaagcgtcacgtggggcgcctacggaaggcgctactgaataagtaccgaccgctcttcaaacgataccgcgccatgttcgccctgcgcaacgcgggagncgaggaggtgagcctggcgctggccgagggtctgcactgtgggagcgcctcttccgccacgggtcggtacg

SEQ ID NO: 647231 - DNA, 100 bp, Homo sapiens
gaccatcttggcctcggaggcaaggatatccaatagctttacaatttgttgaaggagcccacagaaaaggttacccttttccccatccatcgatgatagg

SEQ ID NO: 647232 - DNA, 181 bp, Homo sapiens
ggtgtctagaggatcccgacaacatagaatgtgtggaagggtggtagggcatacatatatgtcactccagtgtttataggacgggtactatctactatataggacttttcgctatcgaagcgaagggttctcaaatcatgaaaattattaatattactgctgtaagcagggtaccggagct

SEQ ID NO: 647233 - DNA, 1014 bp, Homo sapiens
gaaataattatactagcatttaaccatctcgaacttctaggaatactagtatatcgcgtcacacctcatatcctccctactatgcctagaaggaataatactatcgctgtgcattagtagctgactctcataaccctcaacagccactccgctcttagccaagtatgtgcctattgccatactagtcttgccgcctggaagcagggtgggcctagccctatagtctcagatctccaacacatatggcctagacttacgtacataacctaaacctactccaatgctaaaactaatcgtcccaacaattatattactaccgactgacgatgactttgccaacaaaacacgtaattgtgaatcaacaaaaccacccacagcctaattatcagcatcatccctctactattttaaaccaaatcaacaacaaactatgtagctgtaccccgaaactttgtcctccgaactccctaaagaagcccgctcctgagtaaataaactacctggagtcctaacgccttcgacaatcgatgggcgaagacaaggccaacgttaataccaggtgaagcactataatgaaaacaaactctaacttctgctataatagatctcacctacggaattctacctcaatttataacccgttcagaggccgaagacaaagttaattcatatgaattatgtggttcgaaagcacagctgatgcccgacttggctatcaccaccgagaggcacacggcacggaaggcggaagtggagccgtaggagtaatgtacaggcacaatagggcgatgcccaccatggcgggatggacgacagaaccaggcacacaagtgacaaccgactacgggccgaaagtgggacgggagagcagaggaagtacggagcagggaggagacgcggaccaggacgagccgagagcccagggcaggcgcgaaaacaggagacgatcccacaccagagaggagcagaggacacgggagaggggggggaagaggggcaccagcaaccaccagg

SEQ ID NO: 647234 - DNA, 103 bp, Homo sapiens
ccatctgattcgcgctaagacactttatcctttcaaattcctaccttccccctccctttagcgcacacatccagtttaatagatactatccctcgtgtctcat

SEQ ID NO: 647235 - DNA, 109 bp, Homo sapiens
cttacctgggggggactgctgagattgtatgggtatggagacatgtcatatagtgtgctagggttagtggtcccggagggttagggctcccggaggttagggctcccgg

SEQ ID NO: 647236 - DNA, 254 bp, Homo sapiens
agagaaggatgtacctcatttttggggataatgtaatgtggttcggagcagggcgcgatagggtctagaatcagactgtgctaggtggtacatgcaggcgggctacttaggggctggatcaacttaggcaaataggtgctgtaaaagtagtggctataatctttattaacttcatattttatattttaatatgaaattttatatgtgcaaagagtcttggggcattggtcttcttcggttcccgcggggtaccg

SEQ ID NO: 647237 - DNA, 416 bp, Homo sapiens
atcaataatcatgctggtgcctcatgaagaccagccttggtgccctgatgaaagtcgtcgatggcccgcgagcccataaagaggatccgcatgtgcgtgtgtgtgtcgatgcctccgggcagaaagagctagccggcggcgtcgaggactcctagctccgcaggagcgcctccgaaagtcagcaggtcgtgccagagtgaccgtaccacgccgtcctcaaccagcacgtcgaccacctccgaaaagtcatcgttgaccacgcgacctccacggatcaggagacgcgagggcgccgccatagcgaggggcgcgcggggtcctactcggaccggactgcgcacagggtctgggttgggcggcccggacgggcttggggtgccctcctgcaaggtccccaccgacagcccgcgagctct

SEQ ID NO: 647238 - DNA, 352 bp, Homo sapiens
tgtgagtgagagtggcaatgtaatggagagaagctgactgtaacatgaaatcgtatgttgtcacctggctgagtgaagaaaggaataggggaaaatgtaacaaattgtgaggctctatgactcaggtttaacatttagagagtcacaaggagaacagaaaagaatggtgggctataaggtactaggtacagggtgtgtttaccatgacatttcacttaaaagtaacacgaggacagctttttggtggaaaagaaggacctgaactggtgaccttcatcgctgttcttttaagaagacaagtgccgcatttcttgaggcctagagctgcagaaggacattccccatcaacacg

SEQ ID NO: 647239 - DNA, 247 bp, Homo sapiens
ggatcccctaaatctccgccttacccacccaacctcaccaagaagatgaacaagattgtgtatgccgtgatcaagtacaaggacagcagtggacgtcagctcagcgaggtcttcatccagactgccctcgacgaaaggagctgcccgagctactacgagtctcatccgaaagacccgatggacttcaagtaagataacaggagcgactttcgcaacacacaacgtaccgacagcactcaagcgacct

SEQ ID NO: 647240 - DNA, 468 bp, Homo sapiens
  misc_feature (28)..(28): n is a, c, g, or t
  misc_feature (30)..(30): n is a, c, g, or t
  misc_feature (75)..(75): n is a, c, g, or t
acagcagaccacggtgggcggcaacagntntcttcccagatgctggcgttaccgctagaccaaggagccctctgntggcccgtccgggcataacagaaagctcgcactcttgtcttctggtcactcctcactgtcccctcagctcctatctctgtatggcctggtgcctaggttatgattgtagagcgaggattattataatattggaataaagaataattactacaaactaatgattaatgattcatatataatcatatctaagatctatatctagtataactattcttaatatattttattatactggaacagctcgtgccctcggtctcttgcctcggcacctgggtggcttgctgcccacatccaccaagtgcactttgggaggctgaggctggaggactgctggaggccaggagttcaataccagcctgggcaacatagggagaccccccccccaccatctcc

SEQ ID NO: 647241 - DNA, 218 bp, Homo sapiens
  misc_feature (4)..(4): n is a, c, g, or t
ttgntgtgctctagcggatcccttcagacagcggacccacccactgcttgtttagtactcttggctttgacatactgacaggtgctttatgagaccccaatcaagacccccatgtcacaggtacttagtagagacaccagaccttttcaaacaagggacaacaaggaaaatcggctggcccattgtctctcctctgtgctaagtgagatgaagggggg

SEQ ID NO: 647242 - DNA, 415 bp, Homo sapiens
ggaggcaggcctcgctggatatgcgaaggaaggttgaagtgcaatgttgtgatctcggcggcactgctaccttctgcctcccagggttcactgcgattctcctgctttgtcctcctgagttactcgcgattgctgtgctcagtggctctccctgcgaaggaagagtgttctcgcgattcatcgttcaaggacggagggctgtcccatactgaactagcacttcctgtatatccctgaggcgagagatgccaaccggacccgaggcatcgactggcactctggttccatccctggtctcctgggaatcagctggatagcagcccctgccgccagagcagttctgggcttcacggctcgattttatggaaagctgagtcacgggagagactccttgttccgtccaggaagcttccga

SEQ ID NO: 647243 - DNA, 149 bp, Homo sapiens
ctgggtttcctcctgttgggccggctggtctcaaacttctgacctcaggtgatccgccgccttgtgcctagcaaagtgtgctgggcttaccggagtgagccaccacgcctgggctttaaaccatttaaaaaccagttaaaattcacggt

SEQ ID NO: 647244 - DNA, 357 bp, Homo sapiens
gtgctggtcgtactctacaggtatcccctccaagtctttgctattgtgattagctgccacaatacccatgtgctgcgtctgtgatttatagcagactatgatttatactcctttgggtatatacccactaatgggatggctgggtcatatggtatttctaggtctagatcccttgaggaatcgccacaccgacttccacaatgtttgaacttactttacatttccaccaacagtgtaccagtattcctatttctccacatcctctcctgtctcctgcttgtttcctgactttttgctgatcgccattctaactcgtgtgtgttggtatctcattgtggccatgggcgtgagggtacc

SEQ ID NO: 647245 - DNA, 934 bp, Homo sapiens
gaattcagatgtttatgcccaaagaaaagcaggatttcgttcagcacttctcccagatcgttggggtgctgactgcggatgagatggggcacccagagctaggagatgctattgccggctcaaggacggtcctggagtacaattgccattggagggaagtataaccggtggtttgacggtggtagtagcattccgggagctggtgtgcgccaaggaaacaggatgctgatagtctccagacgggacctggactgtgggctggtgtgtggaactgcgtgcacagcattcttcctggtggcagatgacatcatggattcattcccttacccgccgaggaccaggattctgctgattatcagaaagcccggggcgtggcgttttggatagccatcaatgatgcttaacctcctggaaagcaatgtatctaaacgcgtgcttgaaaccctctacttgcccggggagcacgccctattagcgtgaaccttggatcagagctcttcctgcagaggttcctatcagacttgcagattgaaacaaaccgtggaagctcctcagaaacccccaaagcaatgtggatcttgttccagattcactggaaacgagcgtacaaaaatctaattggtcgatctacaagaacagcttttctaactacttctaaccttgcctattagctggcgcgcaatgtacattgcagggtgatagtgggcgagcacggtgcgcaacgccagtgccaagcagatcctggatggaagaaggggaattacttcgcagatacagaagggataacttgacccagctttggagaccccatgatgaccggcacaattgtgactgcaacttcaggagacataaatgcagtgactgtggctcaaaggttgtacagagccctccaaacacacgaactgaagacaactcgaacaaggtctaaatgcct

SEQ ID NO: 647246 - DNA, 663 bp, Homo sapiens
ggcaaagccatttatcacttggaaagcgtttgtggccaaagttcatggcactgttataatgaagttcatgtgatggatggatggaaggcatgatgtactagacgttctgtcagtctagttcttgcaaatgattgtcgtcagtcatcagtattgtaccataccagcgttatattaacaatgagctggtgtggtacaattaactgaacttcaatcatgtcgtatttgcgtttatttggtaataacttctctgtgaactattaatcatcctctgagttaaataattgctcctatactattgaagtatgtagtttagtacataacttagagactttagagtctaacgaaaatgcatcttaattgactttaagcattggttattcaagtattcattgtggatcctcctattctcttccgtactaatactctcacctgctaaaggagatatacacataagaaagcaaagattatatctaccattttatccagatgaccatttactgccacaggtaacatgatagtagacacaccattatatttaactactagatactctcaatgaataactggtataacagacaggacaatgtaaagataacattctgaacaaaataaaacactagagatggacaaaaatcggcagcatacacaataacaagacagaaa

SEQ ID NO: 647247 - DNA, 227 bp, Homo sapiens
gtcttgactaaaaaaacctttggcgctgcgactagatgcgttagtgtatacaagtgaaatgctatacaagttgaatgctggccgagcgcagtggttcacgcctgctatcccagcactttgtggatgctggggcatgttggatcacctgaggtcaggagtttgagaccagtcctggcctaacgtggcgaaaccccatcgctacaccaactagaccttagcaagccatg

SEQ ID NO: 647248 - DNA, 399 bp, Homo sapiens
tagaatgaaagttaaaatgcatctgctttctatacgctttattaaaggtattgtacttttattcccagaagaatcttgtttgtgtggtttgatggaccccttatgtaaatattttaatctgtaacacctataaaacatatcctctattcatttgcagatcttttcgttgtaggatctaggtcacttttttcattaaaggtcagttgatcagatgtactggccaacatttccaattttagttcctttaaaatggagcacgaacttagacacttgtgaaacaacatgagtacgcctatctagatcttataattattttttattttttagattattttttccaattgaattcaagagcagtttttaaagacagcctgggtaacgagcgagactccatctccc

SEQ ID NO: 647249 - DNA, 292 bp, Homo sapiens
cggcacgaggctaaaataagagttgaaaaaaaagaattatttgctttgctgtttagaatggtttggcatacttttttttagagggccagagagtaaatattttaggtttgtggacctatgctctgtgtcttagctactccactctgccactgtagccctaaagtaaacacaatctgaaacaaacaggcatgggtgtggtccaataaaactttatttacaaaaacaagcatctggtctgagggcctgtttgccaacccttggtttaaatatttgttgacctaaaaaaaaaaaa

SEQ ID NO: 647250 - DNA, 651 bp, Homo sapiens
  misc_feature (542)..(542): n is a, c, g, or t
cttttttacacctcttgcctggacatccaggcatttccgtacatctactgaaatctaggcagaggttccaaaccttcatttttgtcttctgcacacccacaggacgaacaccatgtggaagctgccaaggcttggggcttacaccttccgaagcaacagcttgagctataccttggccccttttagctacagctggagtggctgggacgcagggcaccaagtccctaggctgtacacagcagggagcccagtgccttgtccaagaaaccgtttttccctcctagacctctgggcctgtgatgggaggggctgccgccaagatctctgtcatgccctgaagacattttccccattgtcctggctcctccttacttctgcaaatttctgcagctggcttgaatttctccccagaaaatgggtttttcttttctacagcatcatcaggcttgcaaattttcaaacctttttgctctgtttccttttaaacataatttctaatttcagatcatcacactcaagtttaaagttccacagatctttanggcaggggcttcttctagtctctttgcttaagcattacaggagtgacctttgctttagtctcgataagtactcatttcatctgacttgacttaattgtcttattgcttt

SEQ ID NO: 647251 - DNA, 281 bp, Homo sapiens
gttggtgatctagaggatcccggccgccactgggtggcggggagtcgagatcacaccaccgcactccagccggggtgacagagtgagacttcatctcaaaaaaataaaaaataaaaaagtttagagcaggaatgaaaggaagcaaagtacactgggacagagggtcaagtggggcaacataaagagatccaagtgcccggttcagccctggggctgggggatttaatacattgggcattgggttccgggggcttgggtgttttttctttccctttaacttt

SEQ ID NO: 647252 - DNA, 1573 bp, Homo sapiens
  misc_feature (354)..(354): n is a, c, g, or t
taatcacaacaataagcgcctgtactgtgggggatctgcaatttgaggaggccccagctcctcattgtaccggggtctattgggacagtgaccttgctcgtggaaacagattagattttccttttacagcctgagggacattgatgtggataggaaccccggtgtggcatctcagttgggccctcatataatcacccctgacaagcgttctcattgtctcacccaggtctcctacattgtgttcagagacgacagtgtgtggagactcctccgctggccagatggattgttacacactgtggctccttataaagagaccgagaacacctgtgacagctttctcccttctcacanctgtccgcctcctgtggagaccttgtgcgcaaagtgacaagggtgagcgagaccacaatttacaacactctcaggggggccagtgttcgccaaagataaacgccgggttataacaccacaagtctacgaaggccacatatcttacagacgcccccacagggactctttgaatgtgtgacatatatggtgagcgccaatatttacccgcggagtcacactagtgaggtttgaaaagatgcggcctcttagcgaagaggataacataaaagtagtgagacgactcatgtgggtttacagagggacagtgtgtgtgcgcccgtgatcgatgagagagatactcacgagaaaacaattacacccctgcgggggcgacaatctctacgaattactactcaagtagtggcaaaagggcggagatcatcactccccccacaggagcagtgcttcaacaatcaaagggagcgaccaccaacggtcgcagtgtctgtgggccccgccgggcgaacacttctgcggtatacctccgaggttaccccttctgacagaagagaagatccttccccagaggggagaaggcatccgtggcgcgtggcggttgggtgttggccccacaactcactgtatagcgaacgagttagggcggccacaaaacatattttccaagaagggagggacaaccccccaccctgtaatatatgtatagaaagaaccttcagaaataatccttccagcaacacacaactgttgtctccaagggggagggactataattaacgcggaagagcagaacaaaatagaggcgaatgtagcagctcccacaagttgggaagcgattctctacatcagaggataatatagacaaaagacacgccttagattagacaagagggcggacacataagggagaacaacaatgtgagagggagaacaaaccaaccacagaaggagaaatctaccagcaacgcgaccactgcagtggaagaaccgaaagaaaagctaggatagaccaaaaaacaaggacgacaatccactacaaaccacaacaagtagatcaacccaagggcaggagaaattcacaaagcagcgacaacagtcagacaaccgcacgaaagaagtgaggcaacaagccacacccgcaatgtacgagcacagagatgagcgaataaaacacacaacaaataagaggaacacacagggacgggccccccgtagaacaccg

SEQ ID NO: 647253 - DNA, 114 bp, Homo sapiens
  misc_feature (25)..(25): n is a, c, g, or t
  misc_feature (80)..(80): n is a, c, g, or t
atatgctttgatgcatagttttganctaatgtaacatgatttttcttttttaaaacagcctgaaaatgtactagtgtttnaaaataaagatttccattttctccaaaaaaaaaa

SEQ ID NO: 647254 - DNA, 473 bp, Homo sapiens
taagtcacaggatacattaaccatgtcacttcccatcatggaaccactcatggatatgctagatggaacgcccggattcgctatcataacctatgccaccaccacctcctagaggtgaaaatttctggcctcctgaaccatagggatctcccatgttcattgctcctccgacacccattacgcatgtctcttacccgtggatccatgtagcccatacggatgtaacttatcctctctttggcgcctcatttgttattccatctcacgtagacgaatcatcatctcttcctctctactacgtcgtacctcctcttgcctcaattgcattatctttacgtatctgcattactatgatagtgaagttcttccatgcgtcttaatacttcccgtcgtctcatcaggaatcttggcgcacaagattggccagatgttcatgataggcatcttccatttcacttacacatttggcgcga

SEQ ID NO: 647255 - DNA, 646 bp, Homo sapiens
  misc_feature (448)..(448): n is a, c, g, or t
ggaatggtggcaaccaacctaaggtggcctcaggatgcttggatattaattgtcatctgtgaaaggggctcgttgtgtcgagattctgtgatgcattcatagtattccactcatcacttttgttgatgtcccttgtgcttttcgtagcctggcactagcacaagagaatacgggggctatcatccggcatggtgcacaagcttctcatacgcgatttgcttgaggcaactgtaccgcaatagtcacagttcatcaccaggaaggcctatggtaggtgcctagtgatgtcatgagctctagatgcacccttgtgtggtgataccaacgtatgcctggtccaccgcatgagtatgcatgtcatgggatgctaaagggcgctgtggagatcatctttcaaagggcatgagaatgtggaagctgttgcaggcatgagtagcatcgagaagtntgccaaccctttgccctgctagcagttgcgaggcgtttgtgggatgcactatcatccaaccttcttccacacgtgcccgatatctgctgtgaccgggatgtcttggtccagcatagaaggtacgacgtccttggtagaaaacatgtcgaatattccatttgttaaacaaactcaaaggaataggaacaccaagaactg

SEQ ID NO: 647256 - DNA, 745 bp, Homo sapiens
tttttattttttaaaaagtcatggaggccatggggttggcttgaaacccagcttgggggggtctcgatccctcccttttttggtctaaattttatgtttacgggtccttcaaatgtgtggtagggtggggggcatctccattactagctcacctccaggtttatatggagggttctctctacttatctaggaactttctcagacatatcgacaagcagaaagagcttctcctcaaaactccagtgcaacaattcattaaatatatcacgtgcgtgtacagaagaaagtgaatgagcctacagagtgatagagatgttctcagtgtggtgtatgcatcggggtagcccgagataacgtcggggcatcccggcataggccgaacaaacgtgttgtcggcgacagacagttagatttacgccgatgaatatgatccgtgaaagggatttgggcgtaggtaagggccaagggtgtacgcctgagaactcgggggacacactcaagtgaatgaagccgaggaaaaccgtgtacatattagccagggtcaaccccaccggtgtcttcggacatgtgacgtcgacgggcgagccctatgggccgggaccccttgagagctgttggcaacatggtcccaaaaacagcagatattatcgtgccctgaaccctggacaaaaaagggattcggtcacaggggcccagcttaccaaatttcccgggataagttcccgggtggacataccccgcaaaa

SEQ ID NO: 647257 - DNA, 638 bp, Homo sapiens
  misc_feature (562)..(562): n is a, c, g, or t
caatataaaaagcgggctgagcgcagtggctcacgtctgtaatcccggcactttgggaggccaaggcgggcggatcaggagtttgagaccagcctggtcaacatggtgaaaccctgtctctactaaaaatacaaaaattagctgggtggcgggcacctgtaatcccagctacaagaggctgagagaggagaatcctttgaacccaggagttggaagttgcagtgagccaagatcgcatcactgcactccagcctgggcgacaaactgggctctatctaaacaaacaaacaaacaaaaaaccccacaaaaacttctgaggggaatggaaagagagctcaacaggtttgctggacagctctgagggtgtccagaatggagcccctgaatctgttatgccatctgctgttaatggttgtgtggttttctccttggtgttgagtatcctgaggagaggaacagagaaggtgataggtagaaggatctggggttgggatttggttgagtgagtgtttaagagagtgtgagggagttgagatcattggttagtgggcagttgatgtangatggaggagaaaggagatgtagacagaagaggcctgtcagagaagaagaaaatagaggtgctagcaaattggagc

SEQ ID NO: 647258 - DNA, 132 bp, Homo sapiens
catggaaagtatgaatggaaagactttggtgcaccgaatcctcatgactgcctcagagccaatcttccgagtaaggtatctctgtatgttccttctgtaatgtctgtacttggacatgggtcatgttcggtg

SEQ ID NO: 647259 - DNA, 105 bp, Homo sapiens
tctgacgagaggagtgagtcagctgagtcaagaagcagctgtcattgttcagtgcactccccagagttcagtggcagttctgaaagtgaggagaggaatgtggct

SEQ ID NO: 647260 - DNA, 1178 bp, Homo sapiens
  misc_feature (529)..(529): n is a, c, g, or t
  misc_feature (531)..(531): n is a, c, g, or t
  misc_feature (613)..(613): n is a, c, g, or t
  misc_feature (634)..(634): n is a, c, g, or t
  misc_feature (656)..(656): n is a, c, g, or t
  misc_feature (726)..(726): n is a, c, g, or t
  misc_feature (732)..(732): n is a, c, g, or t
  misc_feature (738)..(738): n is a, c, g, or t
  misc_feature (748)..(749): n is a, c, g, or t
  misc_feature (756)..(756): n is a, c, g, or t
  misc_feature (767)..(767): n is a, c, g, or t
  misc_feature (769)..(769): n is a, c, g, or t
ctgggcgctacgtcgtcacctctgtgtcctggatgcagccataaggttggacaacgcgtacgggctgtgagactttccagccacgcctcctgcagaagaacaacaaggactcgtttctgcacagctgctgtggcggacccgggctcccagcactcctgaggccatagaacagatcaagcaaattaaaaaggatctgaagaaatactctaagatctttgatagcagaaggatcgctttagagctcagctccataagtcctcagaggagtgcaatttggtgcgcatgtatgaagcgcgcatccatgcatggaagatttccggagagtaccggaatagatggtccctacggtagtctctatagttggatgccagaacaacacgagcgcctggagttgcgaggaggggtggacactgacaagctgcgacagcaacggtggacgtactggtgcacagaggagaccggattgatgcttcttcgtcgactgtagagatagcctcattcccctcgtgtgcactcacggagtgaccgngngcactgtggggacggactccgcctgctgttcccgcgctgagctacaggactcccgagtgtgagccgcggttcctctgttgcngcgcagccgtgtgtgctgtgnagccgaggccgtcctgcaggangccgcgtgactcccggctcctccctgtgctctctggctctggactgtgactgcgcctggattctgccatngcgacncatttntgtgcctttnnagccccntggtgtctgcngngggggatttaaggcacccgcattccacttctttcgtgttggagttgttctgttggaaccgtcggcggtggcgtccgaagacttagcgacgccgactggcgtgcaagcttcgtcctgtcgcccagtgatgttgtccacggtgcctgtacgacagcctgagcatgcatttccgttgaaggacttgcatcctcgcattgcgggctagtgctggacgtgtcccggagagccatgcgggagggcgccgacatgccgttgtaccaccgcatcgtgcaggttgtaggccggtttgctccgcaggttgaacatgtgaaataacaacgcaaaacttgtcatgaaaaaaaaacccaataaaagactcggggggcataatgagaggcgcggggaacaaagggtcttggacctggcatagg

SEQ ID NO: 647261 - DNA, 702 bp, Homo sapiens
  misc_feature (250)..(250): n is a, c, g, or t
  misc_feature (256)..(256): n is a, c, g, or t
  misc_feature (262)..(262): n is a, c, g, or t
  misc_feature (272)..(273): n is a, c, g, or t
  misc_feature (280)..(280): n is a, c, g, or t
  misc_feature (291)..(291): n is a, c, g, or t
  misc_feature (293)..(293): n is a, c, g, or t
aactcacagcggctggacttcatgtatacagagatctatctccaagccctcaaagcgggagatgaagtccttcagattaggagaaggcgtccaagcacttggactcaaatatacggtggaggtcatggacatcatagacgagaaaatctacaaaagtgatcttgtatcctgcaaaccatggccgcgtgactcccggctcctccctgtgctctctggctctggactgtgactgcgcctggattctgccatngcgacncatttntgtgcctttnnagccccntggtgtctgcngngggggatttaaggcacccgcattccacttctttcgtgttggagttgttctgttggaaccgtcggcggtggcgtccgaagacttagcgacgccgactggcgtgcaagcttcgtcctgtcgcccagtgatgttgtccacggtgcctgtacgacagcctgagcatgcatttccgttgaaggacttgcatcctcgcattgcgggctagtgctggacgtgtcccggagagccatgcgggagggcgccgacatgccgttgtaccaccgcatcgtgcaggttgtaggccggtttgctccgcaggttgaacatgtgaaataacaacgcaaaacttgtcatgaaaaaaaaacccaataaaagactcggggggcataatgagaggcgcggggaacaaagggtcttggacctggcatagg

SEQ ID NO: 647262 - DNA, 261 bp, Homo sapiens
gtactggagaatgctagaacttatttactgcatttatgtagtactgagcggaaaaagtgaaagacgttcataaatgcttattgaagattagtgtagaagaaaatagattttaaatgaatccccaaaccataatgacagattcggaattaggtaaaaccaaggtttctaaaagcaaattttgaggggttgccaacaaagtttgtctcttacattcaaccaaatgtgtttgcatttgaaaattcagatgagtggattggtcat

SEQ ID NO: 647263 - DNA, 175 bp, Homo sapiens
gactcaggccctcagaggagcctcgtggtgtcggcatctacaggtcctatatatataaaaaaaatttaatctttattttatttatatatattctctcagggtgtgtaattttgtggctggatttaattttatctttgtgcttggagatctttggccctcatatgccggggccctt

SEQ ID NO: 647264 - DNA, 529 bp, Homo sapiens
ttttcacaaagctaaccttttttaaaagcatgtaaaaattggacatttggacatatacccattacaattttacatccaaagatcaaatagttaacagttcatttagggctttttggattggttgattttccaaattctggcactcccttggctttgacctaacctgacattattttgtcacattattttctaaatcaagtaaacgttcatttgttttagtaagcacaatttatttgggtgacaccagagaggtttttgaagggtctggtgtaccctgaggcagggaaataggtctgttggcacaggtaaaaaggaaggggcttgataaacattacaaccccggggaacagccttccagaggggcacaagcactcccaccgagatgggccagggcccacccgttaaagagtcaaaacccaaagtttcttggtgtcccacaaagcaagtcacacttgcctttcaaaggaaagggaggctgtttcagggcttaaatgaaaacgggggcacttttgaacactggggggtttgg

SEQ ID NO: 647265 - DNA, 256 bp, Homo sapiens
tgtacacgggactcctcatcccctttctccaccaaaggcttcacctcagcgagtctacatcctgcatctcccgagacatgtccctgctgtcacctgcctgcaaggaaacaagggccaacaaggtcacacacttcctgctgcagaggtttcctaaccggaagcaaatccaaggaccaagtggcaagaccggccaggccttgcgctctgcccatgaagtttcacctaccctcgtgatgcacgtggggtacctgagctc

SEQ ID NO: 647266 - DNA, 801 bp, Homo sapiens
  misc_feature (40)..(40): n is a, c, g, or t
  misc_feature (94)..(94): n is a, c, g, or t
  misc_feature (147)..(147): n is a, c, g, or t
  misc_feature (242)..(242): n is a, c, g, or t
  misc_feature (270)..(270): n is a, c, g, or t
  misc_feature (284)..(284): n is a, c, g, or t
  misc_feature (293)..(293): n is a, c, g, or t
  misc_feature (297)..(297): n is a, c, g, or t
  misc_feature (302)..(302): n is a, c, g, or t
  misc_feature (306)..(306): n is a, c, g, or t
  misc_feature (394)..(394): n is a, c, g, or t
  misc_feature (420)..(420): n is a, c, g, or t
  misc_feature (424)..(424): n is a, c, g, or t
  misc_feature (438)..(438): n is a, c, g, or t
  misc_feature (451)..(451): n is a, c, g, or t
  misc_feature (458)..(458): n is a, c, g, or t
  misc_feature (473)..(473): n is a, c, g, or t
  misc_feature (488)..(488): n is a, c, g, or t
  misc_feature (542)..(542): n is a, c, g, or t
  misc_feature (555)..(555): n is a, c, g, or t
  misc_feature (561)..(561): n is a, c, g, or t
  misc_feature (579)..(579): n is a, c, g, or t
  misc_feature (597)..(597): n is a, c, g, or t
  misc_feature (619)..(619): n is a, c, g, or t
  misc_feature (625)..(625): n is a, c, g, or t
  misc_feature (676)..(676): n is a, c, g, or t
  misc_feature (682)..(682): n is a, c, g, or t
  misc_feature (729)..(729): n is a, c, g, or t
  misc_feature (740)..(740): n is a, c, g, or t
  misc_feature (789)..(789): n is a, c, g, or t
taattcccatgggcaatggatctgggagcgaacaaaagangggagaggaggatcaaaatgcccccaggacccagggttgtaaggtaagggagtnagggaggaaaatgaaagtgacatgcttttatagatacatcagcggctgtaaanacagggctgagggggaaataattgctatggagggggtcttcgtccatcattgagtgggggggggtgacagccactttttaggcataaagaaaagnatttaaaagggttaggagaaatgggaanaagataagaaagantaataaaanacgnaaaanaaantgagcaaaaggattgataaaaaaaaaaataaaaaaaaaagaaaaaaaaaaagaaaaaaaaaaaaaaaaaaaaaaaagagtgaaatatnagagcattgggccaggaagatagaanaaanggatgtagttgttnattttggggcggnggaatgngagataaattaaganatacacaagatattnagaaactaatgataattgagcttcacgaaggcatagaagacaacaaagtggaantgagttcaggaangccaanttgttcagctttacctcntgctcaaagaatcggtcntccagcgtcttgtctccagggntgctanctgcaccctcgaagagcaagcttgtactccgggtagtaatcggccacgttnttgacntgttcataagtcgtcagcccgagccaactgcgccaggccctcagggnagagccgcccncagtgtggaaagagcttggcacggtcctctttggacagctctgtgccgnaagaattgatgg

SEQ ID NO: 647267 - DNA, 392 bp, Homo sapiens
  misc_feature (75)..(75): n is a, c, g, or t
  misc_feature (88)..(88): n is a, c, g, or t
  misc_feature (135)..(135): n is a, c, g, or t
  misc_feature (154)..(154): n is a, c, g, or t
  misc_feature (167)..(167): n is a, c, g, or t
  misc_feature (189)..(189): n is a, c, g, or t
  misc_feature (318)..(318): n is a, c, g, or t
  misc_feature (338)..(338): n is a, c, g, or t
  misc_feature (366)..(366): n is a, c, g, or t
gcgctgatgacactcagcgtgccacctcgaaggtgtgcgtaacgagctgcagcgcagtacgtggccagggccgcnaccgggcgaaggncgacgccgaagtggtgccgcagcgcgcaaccgtgtggcgctgaagancaagaacaacgaagcacgncgcgccacagcanacaacacgtggcaacaactgtngagaaaaccctggggcagctgttcgagctgaagaccaccaactggctgtcgttcttcaagaacgatgaccagtaccgcccgtgaaaaactctccgggtgaccctgggagcgcctgcgttcctactaccnggaccgcggctacatcaacntggacatcgcctccacccaggtgtcacngcgccaatggggtaccgaggctcgga

SEQ ID NO: 647268 - DNA, 829 bp, Homo sapiens
  misc_feature (829)..(829): n is a, c, g, or t
tgtgcccctgcagtgccctggggctcttgtcctgctggtgccctgctgctgctctgcccctgagccagtgagaactgatgctcgagtgagtgattgccatgtgtgccctgtccctgctgctgtgcccctgtgtgttgatgtgcactgccctgctgctgccctgcctgtgctgccgatgtgtgaatgtgatgctgtgtgctgcctgcgtagcttgtcctccctgcctgtgctgctgctgcatcttatctttgatgaccctttggccactgtgtgccatgcccctcctgtgacctgactgtgtgttctccctgatgttgacttgcttgtgctgtgcaactctatagtagaatgattgttgtggctgctgtgtgcctcctgttgtttgtcccatctgcaatgctgtgatggctccatggttgttcccatcgcttgatattgctgctccttcgattgtagacttctgccatgcccttggttagccatgcgctagccaaattcgcgttcgactctcgtccccaaatatgggcaacacataaccagcaggtataccctcaacccgcttgcgtttcatgcccatgagccttttccttttgtggcatccactctttgcgccgtgttcattcagagtcctggttcactatttggcctccatttggggtttcgcatttttccttgcccatggccctttcacctttgccgcggcgcctggaccagggtccttccaaaacatctcgtggcatagccccatcggtgaacgtcgagatgctagatgcgtttggcagcccagatgccacagaacaaccctttgactggccggcgcgcgatagcn

SEQ ID NO: 647269 - DNA, 468 bp, Homo sapiens
ttgattattccgcggatttttactgagcgcccactgtttgctaagcgctatttttattctgagaatgagtagccatgcataaatgctgcaatagccatacaagtctgactaaaattaggcacataatagacatttaaatatttcttattgcccaattgtccatattctcagcgttcagggttcaacaaacttgggtgtgatcaactcacaatagctatgagtcctccccgatggcacattcttagtccagccttggtgaaggtggcatggtcccctgcccacactgctttttgtttttcaatgagaaataaaaaccaaaattaaaaactaaaaaagaatcccactcaacctggaaaaaatggttgtctcattttgcggccttaaaaattgattaaatatgaaattacttaactatagtggaaattagaatgaaacagggctgatttttccagtttaatacactgttta

SEQ ID NO: 647270 - DNA, 161 bp, Homo sapiens
cggtaccccagctatatgccgtgggatttgtccataggattctttcccgagattgtctagagcccatttcgtgtacctctcccctcagacgtgtgaggcacagacccttagtcatggcaagagttactgcataattccctgtctgctcaaatagctgtcaa

SEQ ID NO: 647271 - DNA, 413 bp, Homo sapiens
tgtcgtaggatatgaaatcatccaagaatcatgatggaagtacgggtgaagaaagtaactagtaagctagtggcaaaatgttttcaaaaagccaaaaagaagccaggcatggtggcatgtgtctgtagtcccagctactcgggaggctgaggcaggaggatccttggaccccagggttctgaagatgcagtgagctgtgatggctccaccgcatactccagctccaacctgggcaagataacaagaccccatctctaaaagaaaaaaagaaagaagaatcgaaagaggaagacgagtggggatatgatgatgatttccctgtgtgcagttgaagtaatggtgggtggtgtcgggatggttaacccttcagcattggtttggatctctcagaatgacatcccgggtcctcagag

SEQ ID NO: 647272 - DNA, 891 bp, Homo sapiens
  misc_feature (3)..(3): n is a, c, g, or t
  misc_feature (397)..(397): n is a, c, g, or t
  misc_feature (417)..(417): n is a, c, g, or t
  misc_feature (467)..(467): n is a, c, g, or t
  misc_feature (809)..(809): n is a, c, g, or t
  misc_feature (868)..(868): n is a, c, g, or t
gcnggaaagggcctctggtagctgcatttctgtttgagacacccgcctcctgatgcccacagtagctgccccagtttactgtcccagacagtctgcctacacatacacactgcgttcatttttttgacataagccattctgtccggggtgaggacaagcctcacttttaagatgcatttccctttcagggtttattgtccgtttgcttctcctttcgagaactgctgttcaagtcattagcccatttactgacgagatttgactgtttttgtttgtttgtttgttttgccttcaatatttagtaccaacacaagaatgttaagcatattaactcttttttcaagatagggtctcattatgtagctgtccgtcctggagaatggccttgaactcaganatctgccacctatgcctccnaagtgccgagactaaaggcatgtgccactatgcctggcttaatttcttcntcttcttttcttcttcttttcttcgctttcttttcttcttcttcttcttcctcatcctcctcctcttctcttttttttgagacagggtttctctgtgtatcctggaactccgtagaccagactggccttgaactcagaaatctgcctgcctctctaattccttaccaagcaattttctgattatatgtttgcccccattttacagatggaaaacaatatatctagatgtggagatcttgctcaagatctaacctaagctctttaggtgtagatccacgagctcttagggtcttaatcagcttagaacattcttttaaccacatggaggcttgttatacaaancagcattgcagtgtataatgtaatttgtcttcaccctggtcagaatggcgaaagtcaanaaaatggatgcaggtgaggttgt

SEQ ID NO: 647273 - DNA, 276 bp, Homo sapiens
  misc_feature (13)..(13): n is a, c, g, or t
gagagagagaganagagagagagagagagagagagagagagagagagagagagagagagagagagagagagagcgagacgtagaacaacgcatgcggaatcagttggagctagcagccaggggtcctttacgacagacctttacccacaaccctctcctacaacctggaaaggataaccctcccaatatctcgccgtccctccaggagaacgggggtgtgcagtgggagccggcactgtgcctcctctgtgctgtccacctcctctgtgctgtcca

SEQ ID NO: 647274 - DNA, 1322 bp, Homo sapiens
  misc_feature (1233)..(1233): n is a, c, g, or t
gctcaggcttcgggcccccggggccgagccgccgtcctgcgaacgcgcggcgcccgggccgctgcccccttccggccccggggtggtcccgtgctcctcccccgaggttccttccctgagcactgcggcggcgggtacagagcaccggcctacgtcgcggcagccgtgcagccggtagtggctgggctggtggtgccagtccgtgcggacccaaacatgatgtgacatgtttacctgcaagaaaacctgggcatcgatcgtatattggacatggccagacgtatttcactggctgtgcgccttcgttatcagacacacgcagaagcaagagatccaaagttcccaagctcgagcacctgcaatcgatgaagtatcaggaaagacaaggattgtccggggacttggggatacaagtggtgatgccaaaatgggagcatgcgatgacgtgatagcctctgtgatcgcaaggacacgcaggagaatacagctggacaccacaatacccggtagacgtgtgccaatgcccgagagcgtgagagtgcccattcatgaaagcaaagaagatatccgacctgatagtcgagaagggtcgtaacgtaagggctagtgctccggccgtatggtttaccactttggataaagttgacacttgtcggcttgacagtctactactcaagttcgcaaagggcgacggataattcagaacaggcaaaggttgcacttttccaataggttcatggacattaaatatttaccgcacgcgagtacacggtcgcaccactgacagcgacacaaacgcttggccaaacgcctcaagggcatttcccctaggatatatgacagcgcacattggtgccgccgtgaagcgtcttgaaacacatttgtccaccgggcgcaaaattctatccagtatacccccagggaacgaagctagccatggcaccaccgaactttcggtagcactacagaacccatctctccgacgtgctcccaacttgtacgagccattggccacagataacacccggaaccgtgttgccacagaacacgcgctatataccaagcctgcgaggcgtttaacacccaggctcaactttccaggttcatccacaagagttactttccccacaacggacacgagggacattaggggcggacactatgacactccgcgatccctttgccatacacgcaaaagcgatcatgggcgccacaatttcgcaccgttgtttnaccacacctctttggtagcacaagcggtttatacccaccaggttaacgctttcgtttacattaggcccagaggatagtggggcacacag

SEQ ID NO: 647275 - DNA, 302 bp, Homo sapiens
ccgatcacagctcactgcagcctccgcctgccaggttcaagcaattctcctgcttcagcctcccaagtagctgggattacaggacattgccaccatgcccggctaatttttatatttttagtagagatgaggttttgccatattggccaggctggtctcgaattcccggcctcaagcgatccacccacctcagcttcccaaagtcccgagattatttaggtgtgagccacggcacccggcccagacattgtttgaagccacccatttcatggttctttgctgcagtgatcgtggggttgtaa

SEQ ID NO: 647276 - DNA, 150 bp, Homo sapiens
gccaggaagagtcccctgcattgggtgatgacattctgtctatactgaaggcgggcagtgcacagcggccttcctctctgggaatgccaggtcacacagtccacttcagcacactggtctcctggtgggtccccagacagcgcacagtgc

SEQ ID NO: 647277 - DNA, 122 bp, Homo sapiens
gggccgactgcctcctcccaactcatcccggatctcgacggtgagccccgtggcaaggtagagcattgtggcaggccaaggccccgaacacgacttacccagtgcgaattcaccctccagat

SEQ ID NO: 647278 - DNA, 272 bp, Homo sapiens
  misc_feature (30)..(30): n is a, c, g, or t
tgaaagttgggttcccccttgggccccccntgtttttttgtggatttatcttcatcaaaccaccccaataagattttttagaggccaaaaaaagaaatgggctggaataaacttttgaaaccctaatgtagtatgctccgtatagtgattggagctgttcctctggattccccctttgttgagttgtaaatgtgaaagaaaaagttttatgtgaatatatatcaagccagcctttgttttttgcctccttaaataaaaaggaattaaaatta

SEQ ID NO: 647279 - DNA, 444 bp, Homo sapiens
cgatttctgagaagctccgaaggaacacagacccacccacagcttggtgtatactagtgagacactaggattcttttggacttctgacctccagaatggtactgacaataagttgcatgtgtttgaagccatgaagttcgtagtgatttttttacgagcagcaaaatcggacaatgacacgttcaccaggaccatcagaaaaccccacatggagtctaagccatctgctctctctttgtactcctccttctcaactagacacctgcactgtcccctcatcttctcaggccagcatcttaggatatcaacctttcatcagtctttttctcttagatatccaataaatacatgctcagatggcacatgtgcagcaaaacgagtgacttgtgacgatgacatattctatagttaggccgccatgactggagcccaggtgaaaatgac

SEQ ID NO: 647280 - DNA, 442 bp, Homo sapiens
ccagtgtgactcaggcagagcattgagaattcgcagggcagaaattcttcctgctcaggctttcataataaaactactgtcttcattaaagctgaactttctgagtttctgagcttatatgcccggcatctgaatgagagctctctatgtaactgtatgacttgagatctagtttgcaagctcctgggaaacaatacatgtgtatctagtaggtgtatgctcagaaagcagatgtctgagatgtaagaagcttttctattcctgtggcattcgagttctgacttagagctgaagttaagatcactgaaccatcacgtcaagttgaagtcactcataggtctatgtcctttatgcagggaacattttttagttctcagaagcatttccactcttgtcctcttgtttgtttgtttgttttatgctgggactttcttttcccttg

SEQ ID NO: 647281 - DNA, 133 bp, Homo sapiens
actcatctgtaagttagaacaaacgtaaagggatgcgggtgatcaggcagacgtagctcctggcagcctcttgtaatttcacggggctgtttgagactagaggtaaatcaagcaggcatcagccactttaatt

SEQ ID NO: 647282 - DNA, 445 bp, Homo sapiens
  misc_feature (440)..(440): n is a, c, g, or t
gaattccagcttggttccctagccaggcgtgttgccatgtcaacatagcccagggaagatagtagagcatcacttgataaacaatgctcatcccagacctttgggagtgactaacgagctgattatatgtactcggtaccctcagtgacaccttccaacccccaaatatcactttccttcccgcacacatacatgaactcttttgtttattttatatacgatgcacatcgccagctattttttcattctaacctatactggggacccattcacttcctcttcctccagcattatcggtcacttatttactccctcaccattagagaattgttgtgggctgtttgtttgtacaattatcctgcctcagcctcccaagtagctgggattacaggcatgcaccaccatgcccggctacttttgtatttttagtagagattggngtttc

SEQ ID NO: 647283 - DNA, 601 bp, Homo sapiens
gcttcctgaccttgggtctacggtctgaccgttttttgtggtagtactccggtgccatacatgattcgttcctgacgccgttgcgtgactgctgtgggacttggacatgggctctggaccctggtcgcgctcctcgatggtagctctgaagacgacttatgcatcctattctgttagccggccggaggggaagcttgggatcatggaattggccgtcgggcttaccttcctgcttcgttgatccttcctccatgccagccggtgtcgtggatcctgttcatcgaccttggtagtacctacagggagagcccaagcagtgcaatggcggctccgctatctgatacccttcacaactgtgatctagactcagccccaccgggcccatcctggttcatgttactggcattttggttgtgcctggctcgtctcccgtgagatcgatgtcatatcaattccagtcaccatcgtatctgcaatcatgacctcttgatgatttccatggtgaccatcctatgggggtcgactgacgcctgacttgggtggggtacccccttgtaacaatataaatctatttcaagctttactaggaaaaaagaagaag

SEQ ID NO: 647284 - DNA, 355 bp, Homo sapiens
gtgagctggagtatcttaaataagttactcagaatccatgaacaaaggaattcttactagagcaacaatctcataagtcactgatgggaagggcagaaaaccatcaggttacagatgaatcaggttcgggtaacatgactacttagtaggaaattcatttcccataaagattacaaatcacaagtctcagggccaagtgtgctggctcactatctgtaatctcagcacttgtggtttccaaggagcgcaggatcgcttgagcccgggagttctagacgagcctggggaacatagtgcgaccccgtctctacaaaacattaaaaattagccggctcgttggcatgcgcctctagtt

SEQ ID NO: 647285 - DNA, 174 bp, Homo sapiens
gaatgacacagtttcacaaaagaagcctacaagaagtacatcaaagattacctgcaaatcaatcaaagggaaacttgaagaacagataccagaaagagttaaaccttttatgacaggggactgcagatacaaatcaagacacatccttggctaatttcaataaactaccagatt

SEQ ID NO: 647286 - DNA, 887 bp, Homo sapiens
  misc_feature (474)..(474): n is a, c, g, or t
taaaaaaagaaataaattttttgggtcaaaaacgaagggggagaaaaaggggggggggggcctttgggcatacatgaccgggaatcttgtgaaaaaaagggtagtaagaaatatctgggggggtcccgtgggcgcgtccccctgtgcgggtcccctctttatgacgattagccccctcattccacacttgttggtagcacaacgcttctcacccacttcactaaatagaagataacacaacatatagtgcccacactcacaggactacacccgcccacgcgggcgcgcggacaacgctgcctcgtgaacaaacgtgctattgacagcccccatcttttctattcacgacactcttcaacccgcgcagacaccccagtcatctctcgtcggcggtgcttccctccgactgagccggaatcattatccacgacacacaacaagaggcacccccgcggtgtttgcggccgcgcgcgnaaccccacattcattacccgtgggggtcggcacaccaccttccacaacgaagcatggcggtgtcccctgcatctccccaggtgctgcgcacctacaatcacaccaccgtgatcaatgaccccctcttgtacagtcggcccacaacgacactcccacgacacttcctcgcgggctcaccccggacgccgcgccaccaacaacatacttcatccacgcggcgcgcccgaaaaacccttcgggccgaaacccggcacacaacccccagccactacaccagctcgacagaccagcgtccccgcgctccgaaaccaacaagcggacggactacacaagcacccccacagcaaacagcaccgacgcctcaacacgcgactccgcaaagacccctaaacgaaagaaccatattcaccgct

SEQ ID NO: 647287 - DNA, 468 bp, Homo sapiens
  misc_feature (16)..(16): n is a, c, g, or t
  misc_feature (43)..(43): n is a, c, g, or t
  misc_feature (143)..(143): n is a, c, g, or t
  misc_feature (197)..(197): n is a, c, g, or t
  misc_feature (213)..(213): n is a, c, g, or t
  misc_feature (227)..(227): n is a, c, g, or t
  misc_feature (245)..(245): n is a, c, g, or t
  misc_feature (248)..(248): n is a, c, g, or t
  misc_feature (258)..(258): n is a, c, g, or t
  misc_feature (299)..(299): n is a, c, g, or t
  misc_feature (301)..(301): n is a, c, g, or t
  misc_feature (465)..(465): n is a, c, g, or t
ttcttgttcatctggntactggaaacgccgtctggattggtgncgggccatggcgggttaccaggccccccccatactttcgttctagcatctccacctgcttgtcctgcaggtccggaggagactcatagctctcggagagntgcggtgagcgcttgatggcctcctcctcagcttgcgcaggatggaggtcgagntctgcagcttgggccntcgtgcgctgctgnttcccggcggccccgagntancaccataggnctccacgacgtgtgctcgtagtgatccgggctcaggctggnanaggcaccaaggggccctgggggtaggctgaggggctgtccagggatgtgccagtctcactggctgtgcctcgccctcggactgtagcggtcagtggagaggctgcttccggtgtccagggagctcctgcgcaccgagctttctccttcagacttggtcgggcgnggc

SEQ ID NO: 647288 - DNA, 392 bp, Homo sapiens
tatttggacgtgggaggaggacactactgtgagccctattaattcatggagatgacactcctggtcattatcttctcatgcccatgggaggtgagaggtcagctgacactccttcccattccaggtgggtcaccaggcccaaatcaagaagtagctaccaaactccaagaggcagagtccctgtcccagcacagaagatcatcctggggcagagagagcccatgggatagtggaggggatactagtaagatgagccccagagacagaggatggaggtgaagtgaaggaagcacagagacaccagtgctgggcccagctggacacagtgagctgcagggacctcgtctcctctatcgtctcttgttcagggtggtggtagagatgatcttgct

SEQ ID NO: 647289 - DNA, 161 bp, Homo sapiens
attgacagcgtacttcctactagcggtggctggactccacccgacggggtgtgtgattcctgggggggtctttaattctggctccttccttcctcggaacatctctattctgctggacccctctgtcttgccagggctcgcccattccagctggatgtcgt

SEQ ID NO: 647290 - DNA, 127 bp, Homo sapiens
atacccgtaaatcatcaggagatttaacatactatcttcttttttttttttctttctgagacgggatctcactgcatcacccacactggagtgcggtggtgcgatcatgactcacggcagtctcgac

SEQ ID NO: 647291 - DNA, 134 bp, Homo sapiens
gcggccgcctactactactactactgcttgaattcaagcttctaacgatacggggacatgtcaagaaacattagtcttaggaattcttcaaaaaatggcatcccaatgaaaataaatttgatgactacaaaaaa

SEQ ID NO: 647292 - DNA, 401 bp, Homo sapiens
  misc_feature (6)..(6): n is a, c, g, or t
  misc_feature (76)..(76): n is a, c, g, or t
  misc_feature (95)..(95): n is a, c, g, or t
  misc_feature (190)..(190): n is a, c, g, or t
  misc_feature (280)..(280): n is a, c, g, or t
taatgnttccctatctcccatgagttcagtttttttagcctcccacatatgaagtaagaacatgcagtgtttaaanttcctgtccccggccttantttgccttaacataatgtcctccagtacccaaaccgtgttgccacgaatggcaggatttcattatttgtatggccgaatagtattccattgttantgttgttttcaagacggagtcttgctctgttaccaagaggtgtagtggtacaatcttggctcactgcagcctcaacctcctaggctcaancgatcctgccacctcatcctcctcaggagtctgaggcaggagaatggcgtgaaccggggaggtggagcttgcagtgagccgagattgcgccactgcattccagcctgggcgacagagctag

SEQ ID NO: 647293 - DNA, 427 bp, Homo sapiens
atgcgctgatggacaacccgacgcatctatctagaaaaagtacgtgcatgagctgattccacgctgtgatgacctgcatcgtgagcagacagttgtgccgtgcaaccagatgtggacaatcactgggcactccgagactgcgctgcccgcctggtggcccacatctgcaaccctctgagcacaagcattaaacaccatccatgtcccggatcaccaagaccttcatgcaagagctgggtgtacgagatgacgccctggacgactcgctttggctccatcgcaggtcttggctgagctgggactcgattgttctcaagactctgattctgccccggctgccgctggagggggagcggatccgctgtgtgctggacggccctgtgctgtcctgcatgtcccggattgccgcagaccatgtgcaggtcct

SEQ ID NO: 647294 - DNA, 472 bp, Homo sapiens
gaggatccgaacaggtacacaatgcatgcgtctatcatgtgaagacgtgcattagacacaaatacaaaaaccatgaaacaagccatcattcttcaacaatttgagccagcgataaaatgcctaagtaacaagcatggatgacttgcataaggatgggctctttacatttaagcaccataaatagaaaaacaaaagcacaaatggatgagtgtgttcagttatatgcactgacatgaacctgtggcactaggaatcagagcatttcgtcatatagcattaacatgtattataaaagtgcgtagtggtcaaaggaatagaaccaccagcattcaaaagcagcttggtcagctaggcgataaaagactctacagcatatccctctgtagtccatcattgaaaacactggcaggaagtgtgaaatgacaaaaaaaaaaaggaagaaaaagggagtatataacccccttttaatttt

SEQ ID NO: 647295 - DNA, 174 bp, Homo sapiens
gactcacggggcttctggagccacaggcagaactaaacgacagctcacacgtatccacaggcggaacggcaaggtggggctgtctgacatggccatcgcggacgtcaccctcctgagtggattccacgccctgcttactaacctggagaagctaacctccctctctaaccgtta

SEQ ID NO: 647296 - DNA, 161 bp, Homo sapiens
gacggctcagatctatagatccccagtgaaagaagagaggagttgtaaggactgggcctggggcattctagcttcatgaggagcataagagaagaatgcaggggaggaagtggagacagggattgtggacaaatcagttgagctttgcgtcaaaaagggca

SEQ ID NO: 647297 - DNA, 239 bp, Homo sapiens
cagactttatgactgagtaaatcacgatgtaaccccaatcataaatcgcggagcatctgtatatctaatctaggtccaggggggaatatcagaaaacactatgaggcaatagtcaaagataatcaccgagaattttccaaaacacttcaaatacacattgatgtgtacagaaagcccactgagtatttgacgtgattgtaccccgctaagtgcttgttccccgctaagtgattgttccc

SEQ ID NO: 647298 - DNA, 238 bp, Homo sapiens
gaaaaacccttaaaaaacgggcccccaaattttccccctttcccctggggggtcggttttaaaaaattttgggaggggttccctagggggccccccggtgttttccccccccccccccctttttttggggggtaaaccccagggcccccccggggtttttttgggttccccccccccccccggggtgttttccccttttccggggttggggggttttaaaatacccttggggttttta

SEQ ID NO: 647299 - DNA, 98 bp, Homo sapiens
cgaggcgactcataggatcccccagtctccactccacctagcattacttatatgaagctccatacccattacaatctccagcattccccctcaaacct

SEQ ID NO: 647300 - DNA, 577 bp, Homo sapiens
ctcggctctgtcagtttacagaatacaaacctggagaaagaagtagtactgcaggtatatacgatgtacaactgtgcgtttcttgggtctgtattcagtagtcatagcacatgttgattgaatgcctactatgtgccagacactgatttaggcattagtggcaatgtagcaaacacaacaaagttcttcctttcatggactttacattaagcaggcaacatcctaaacatcattgcatcagtcaatagtcactcatggctctaagtgctttacaaatattaactcatttaatctttataatgatcttcacagagtaacattattctcagtttagcaaatggggaaactgttataccagagtttaagtcaacttgaccaaggttgttccagcttatgtgccagagccaaactcgtgtagacttggccagtgtgaatggctagatgcagctctcacagcatctttgaaataaggtgaaaggggaggaatcatcagcagcaacagagttagtgaatggtcacctcttgcagtttagacagtaggcaggagtctcacgcagggctagtatcagtctccaaa

SEQ ID NO: 647301 - DNA, 256 bp, Homo sapiens
cccaatgagaaaatagagactcgattggctgcaggaacagctgggcctaggcaacgaacacacgaggttactgggggtggggaggaaactaggtctcgctgaaggtgacagatcccttgggtgccagctggagagggcccccaagctcacacgccacaacatgctgcatgccagtgtgatgtgtggagacaagaacagacacgcaggcagaaaccaaatgagaaacctggaggcttcagggaggacatgccgggag

SEQ ID NO: 647302 - DNA, 371 bp, Homo sapiens
catgtgcttactatagggcccagtgtcagtttgtgattcacgtgtgagccttctggaggccccagagctgggtaccatggcactgtactcactcttatgagaaacttcagcttcagatcacagtgtgccttcagctgctctgaaggaacaaaactaactgggattgaagaaaccacctgtggaccattaggacactggtcatctccagaaccaacctgtcaagtgatacagtgtgagcctctatcagcacccagatttggggactcctgacctgtagccatcccctggccagcttcagctttacctctgcatgtaccttccactgctcagaaggcactgagtccattgggaagaagcaacccatctgtgac

SEQ ID NO: 647303 - DNA, 154 bp, Homo sapiens
cgcttttgaaatcataaactcttggatcattcagtgaaacttgtgctgtcagtgactgaaccctaccaacaataggttcagtgttcaaagctcaaagtatacggctccaagagttatcccactaagagcatgggcctttatcggggtaccgagc

SEQ ID NO: 647304 - DNA, 272 bp, Homo sapiens
cctgcattggtcctgagaagtacaatagctcccccagatacagacaaatctctatagctttgcgttagtcgaagaagaatcgcaagaccaacccaaaaattttttgagtaatattcatctctgcagatctgagtgacagtccgcttgaaacaccgctgtagaagtggtatccactgatttctttgtgattatgttaaaattactgatgtctctttgacttgttcaggaaatctgtcttctgacatatatactggatagtactcttcctgtat

SEQ ID NO: 647305 - DNA, 126 bp, Homo sapiens
gaggtagcgcaagttgaaaccagctgctaaaaatgaaggtggattcgtcccaagaagccaatgctgaggtgatgcgagagatgaccaggaagctgtacagccagtatgaggggaagcttcaggaag

SEQ ID NO: 647306 - DNA, 489 bp, Homo sapiens
  misc_feature (4)..(4): n is a, c, g, or t
  misc_feature (65)..(65): n is a, c, g, or t
  misc_feature (480)..(480): n is a, c, g, or t
aatnaggtgttcctgacttctgtacgcactgtctactcaacattatccatatgattcttaccctngatcccatgccattttatttatagttactgcaaatgtgaaattactgatccttttgctctgaacttgacatcccagacctcagatttctcatttattcacaaatgtcacagttcttagaatgagcagcaccttagttaagtgcattttcatgagctataaattattgcagagtggttccttagtgaccagtcctgccgaaagtctaagacaagttgcatattttacttaaatttgctgttaacactaaagtccaacatgtgactgagagccatggggcccaactgtccaggcactgaagttcagagatgtgcattccgtcagcattatcttaaattcaaatgaggataagtttcttctgtttcggaatgctctttgaagcaagaaacaagtctttccttaacatccctccacccncgctgccac

SEQ ID NO: 647307 - DNA, 307 bp, Homo sapiens
agcggccgtccttagcggcacaagaggaatgaatattccttaagaggcagattattagacccagagtatactttctgaggtaccctacgcgaaggaaggatcattgcaccattacggagaacgagaatacaaactgtcaggcctctgagcccaagctaagccatcacatctcctgtgacctgcacatatacatccagatgacctgaagcaaatgaagaaccacaaaaaataacattccaccattgtgatctgttcctacccaccctaactgatcaattgaccttatggcaataccccctccccgcta

SEQ ID NO: 647308 - DNA, 119 bp, Homo sapiens
attattatgatacagccactatagattcaaaagggtcatcagaaatctgaggtatatgatggggaaagaatattttgactaccacgtttaacaggtctgctatttaataatattagttt

SEQ ID NO: 647309 - DNA, 147 bp, Homo sapiens
  misc_feature (143)..(143): n is a, c, g, or t
cttctggtcactacacttgcctgaatgagcggtcgaggaattggcagccgtgtgtgagtccccgagttttgaagggtgctgttgaaacaagatgcattgttgtctaactcttggcagctgcgccctctgatgggcagatgctngaaa

SEQ ID NO: 647310 - DNA, 337 bp, Homo sapiens
agtgactctacaggatcttaaacgacccgaagacatagaaggcatctgctcaggcgaaagtacagaatcttctcataaagtctactgagaactgtaccattataaacatatttttcttgctctagggagcagttaaggggacggaatgggagctgtcagggtcccagggctgtcctacctgccgtattggtcacagtgactgccacgtgctcttccatgggcactgcagctggagaacactactcttcttccaaaggggtctaaaatggctagttagtataccgatctgtgagctgatggatagttgattggtgaatccctggtcttcgggtcgata

SEQ ID NO: 647311 - DNA, 477 bp, Homo sapiens
  misc_feature (29)..(29): n is a, c, g, or t
  misc_feature (367)..(367): n is a, c, g, or t
  misc_feature (451)..(451): n is a, c, g, or t
agtgaaaaaggaaccccacaggaatgggnggaaaatattttcaaaatcaccgtacctcaataagggatttggtacctaaaatatataaagaactttaacaactcaaatacccaaaaagacaaccccaatttaaaaataagtaaaggttttttattttatttaaatttttttttgagacagagtctcactctgtcaccccaggctaaagtgcagtggcccaatctcggctcactacaacctctgcctactgggttcaagccattctcatgtctcagccttctgagtagctggaattataggcacacatcaccatgcctagctaatttttgtgtttttttttttgtagagaccaagttctgccacattncctggctggtctcgaactcctggcttcaggaatccacccgccacccaaagcgctgggattacaggcatgagccaccataccagnccgcaaaagttattattaaaaactaa

SEQ ID NO: 647312 - DNA, 372 bp, Homo sapiens
cattttggtatagcccgaaccgaactggccgccgtcttggcaaggggcaggaacgtaatttgacggtcgcgctttaggtcaatcgcgcacaaccagccccagcctggcgcgctgccacaaatatagacgacgagcgtgtccgttcctttaaaacccttgcttgacctgtagaaggatggaaatttccccggctgtgacaaaatgccatgtgcaggctctttagctatggccgctttctcaaaaacgaaatggactctgtcgctcgataatcagttatttcggtatatatcccgacaaccattttcgtccatctgagtgtcgatcattacctttctgttctgatccaggtggaatgtcgtggggtcacgagct

SEQ ID NO: 647313 - DNA, 584 bp, Homo sapiens
cggagataggggggcccccttttgttttctaggggggcccccgccccccctctccgaagaggagaggggcatataaattaaggccccccgtggcccccctgtgtgggtaaccctcccggggggggggggagaaaaatgggccccagaccccccgcggggacccccggcttttgttttccataagggcccctctcccccccccccctccgggcttggggctataaggggtcccaggccctggtagtggttggccccggggtgaagggggtgtaaaccccgggtttaaaagggcccctcccccccccccttttaagcccccggggggccgggccccgggagaaaccaacccggtttttctagggcgggggcacccccccccgggggttttccccccccggggggggaccccttttccccccaggggggcccccccttgcctggggaccccggcccccccccccccctttaaaccccccccaaaaaattaaaaaaccccccccccttggccggcccctttttttttccccccctttggggccccttttttggaggggtttttgggatcccccggttggggcccttta

SEQ ID NO: 647314 - DNA, 233 bp, Homo sapiens
tgctgaagaccagttggttactttgggtttgtcaatcctatccttttaatcttcacctaatggaagtgaagtttatatcattaagaaattttatttaggcaaaattaaggactcatgagaacatccacgtagaaatcattcacgtataaccaagagcttgccatcactgaaaaacctgactcaaagcctgttaaacagcaaatggcttacatttctttctctacattaaaact

SEQ ID NO: 647315 - DNA, 325 bp, Homo sapiens
tcgtggattccagcccgatcttcgttcatggcataggctagcacggaggagagcgtgagcgactcacccccatttagcagtgaacaaggcattgagctccatgtttctttgctatagcagatgaatgtgtaagtgtcattccagtgcgccaggagatccgttgcctcttcatcatatagcgccgacatgttatgatactcaaagaactcctgggacgcagttatctctctctcgagtgcctttcaagatactaccgtacccctcggttctgtaacgtcctctaagttggaggcacttcccttctgagcccaggaacacatgctca

SEQ ID NO: 647316 - DNA, 1011 bp, Homo sapiens
agcggcggggtgcagactggtgctgcaagagggagcctggcccgacgcggaccgcttccctgcagtgccccgagtccctgtggtgccctgctgcctgcgcgcctggctcctgctcgcgtgccctctgtctgcaggctgtgccccggcggcggcggatgagccgtcctcggccgatggaggctgggaaacgctgagcgcagggcggcacgagaggcctcaacgccgtccctttcgccaccgtcttttccttgcctcgcgccgctgtgcattaactctcctttatccttatgtctccacgcggccccatcgcgggtgatgggcatagtatggttacgcaaaagtgcagcactcaagatggctgatggcaacgaggatctgcgggctgacgacttgcctgggccagccttcagagaagctatgagtccatggacgcttgcctgccccgactgagcgcagcggccaccgataaccgtacagcagacgggcggccacatgtgcgtctgggcgcggctacaaggagtaactcacacgtcacgagcgatcatattgacttttcactctgccctagaggcacccacctactgcgatctaccacactggacgacatggcaagactggaacacacactcaacacttgcacgcgtgactgtccatccttctattgttccacggaccccctggctcgcctggtcgctcgtgcttagaaccgcgcgtggcctggtaacctagttcggcacgctgaccacccactcacgcaggccacaataaccaaaagtaacgctcctaccccttgcacgggtacattccaacggaccctaccacgacgagaaggcggtacaactgcgcgtcaacacgacattcggatttgccgtcaaggcactttccgctcctagtcacaatcacaaccgtgcccacagccatagggcgtccttcgggccttcctctacccgaccccacccactcaccgctctccaacccccgtcacggccactcgcaccaaaccctacaccg

SEQ ID NO: 647317 - DNA, 140 bp, Homo sapiens
acgcggtgctgtgggatgctgttgattcctcacgacggctgaggttgtggagctgtcagtgaccgtgtgttgtcgccgttgagcccgggctgcctgggggttctctgttgtaggtgctattgaacacttctaaaactagg

SEQ ID NO: 647318 - DNA, 236 bp, Homo sapiens
tgtcgcgctgtggtgtccaggtgagagcgccctgtgctccgtcccccccggtggtggtctggtgaggatgccctatgacctgagggctctggtgcctcctaggctgggagctcttcctgggggctccctggaccacacagtcctgttttatggcctcacgtgttttcgggaacagggagcgagctttcttctgggcaactggctgtcacccaccaggggttagccccctgggtgat

SEQ ID NO: 647319 - DNA, 567 bp, Homo sapiens
tggggagtgtcaatttgcattatttgcatattgatttcaagctccctaatttggaatggctaaagtacaaatgttaatgcaacatagtacagttgtatttgtccttcatattcaggatgcgatatttacaaaatgcagaacagtttaaacttgttaagtcacattccagattaggagtggccaataatcatctctgctttgcccccattctactacccaccactgcccaccccatccccacattacacactcttcgatgctttcccacagtctctgcttcgctcctctctgatgctcactttactgtttttcacttttcacttctgtccttttttgtgccccaagtccactattgcttctattattgtgttccagctttagccatgaacgtactgctgtccatcttttctcctttctttcagttcatatagtttattccttcgatttcctcacgtttcgtttctctttccacttttttctattcctcgttccacttctcatttctataatactcgtcttccaatatcttccttacctttctctaatctcgctgtttcttttgtcccc

SEQ ID NO: 647320 - DNA, 519 bp, Homo sapiens
  misc_feature (1)..(1): n is a, c, g, or t
  misc_feature (19)..(20): n is a, c, g, or t
  misc_feature (24)..(24): n is a, c, g, or t
  misc_feature (61)..(61): n is a, c, g, or t
  misc_feature (75)..(75): n is a, c, g, or t
  misc_feature (88)..(88): n is a, c, g, or t
  misc_feature (96)..(97): n is a, c, g, or t
  misc_feature (129)..(129): n is a, c, g, or t
  misc_feature (135)..(135): n is a, c, g, or t
  misc_feature (150)..(151): n is a, c, g, or t
  misc_feature (219)..(219): n is a, c, g, or t
  misc_feature (505)..(505): n is a, c, g, or t
naccgaggggggaggaggnnaganaagggggagaaaggaaggaagaaggggggaataagtnaaaggagggggganaaaaaaaaaaganaggggggnnagatagaaaagagagaggaaaccgcaccggangggggnagggaagaaaaggannaaggagaggaaaagacaaagggggggcgaggaggggagaaaggagggaagaagaaagaagggagaaanaaaaggggggaaaaaaaaaggaggaggagcagacagggacgaggagggaagagggaagaagggcagagggcagaagggaaggaggagcgaagagagaaaaggggaaaaggggggaagggaaagaaagggacaaaagggagaggggaggaacgaacagaaccagaaacaggcaagcagggggaggaagaaagggacccgggaaaaaagggaagaaaagaaggggggggaggaacgagagaaaaccaaaaagccccgaaagggaagaaaggaaaagagaaggaagganaaaggggagccagg

SEQ ID NO: 647321 - DNA, 445 bp, Homo sapiens
  misc_feature (365)..(365): n is a, c, g, or t
  misc_feature (417)..(417): n is a, c, g, or t
  misc_feature (432)..(432): n is a, c, g, or t
taattagacagagtcttgctctgtcgcccaggctggagtgcagtggcccatctcggctcactgccaacctccacctctcacgcaattctcctgcctcagcttcccgaatagctgggactacaggcatatgccaccacactcagctaatttttgtatttttagtagagacggggttttaccacgtttccgaggctggtctcaaactcctgaccttagttgatccacctgcctccacctcccaaattccggggattacaggggtgagccgctgtgtccggccagcttacagattttttaatgtaaaaggcacatcaagagactatttaggaggccaaaaagggagcctgaggtatattgggtggggntatctgtcaggggaccattaacaagcctgctattaggctggggtaaaaaggntacaaattttggggnctggttttacaag

SEQ ID NO: 647322 - DNA, 1126 bp, Homo sapiens
aaacaaagaaggaaactctgttatttgcagcaacatggatgaatttggatgacattatgttaagtgaaggaagccaggcacagaaagacaaatactacgtgatctcacttatatgtaaatctaaaaatggtaaactcatagaagtaaagaatagaatggtaattaccaaataatatggtttagctctgtgtccccacccaaatctcatgttgaattgtaattcccagtgttgaaggtggggcctggtgggagatgattggattatgggggtggtttctaatggtttagcaccatcctcctagtgctgtctcatacagttctcatgagatctgatcgtccgaaagtgtgtagcacctcccccttgttctctgtctctcccctgtttgctatgtgacgatatgcttgctttcccttcgcctttcgccatgattgtaagtttcctgagggctccccaggaatgcatcctggtacagtctgcagaacttgtgggtcaattaaaacctgttatccttcataaaaacacaaaaaacaaacacacaaaaaaagggggagtaagccaacataaaatatacccccggagagagccacacaccaacagcgtacccacgattcggtgcaacaaaggggcaccataaagagagccacataaaaaccaaagacatgcccacacacatcacaaacgctcgagagacggcggcacaccgtcgccaccacgggacccactcggaacaggcaacaccaaacctgcgaggataacacacatagggcacacacacccacaaactagtaaaacgcaaagagaaatatcacacccagccaaacgcggaaccacagccccacaccacgacgcgcatacaacccccacccaagactagacagagaaaaataacgagaacgtaagaaagggggcaaggacagaaaagcgccacgaagagggacggagaaggcagggcggcgaagaggagagacgaagggaccggcgaacggaaacgaaaggcgtaccacccgcgagaacgaaagaccacgcaacgaggcacagtcgaccgacagagcgataacagggaaaagagaagaaagacgacagcaagaccacaaacgaaagaaggcaacaagaacacggtcggac

SEQ ID NO: 647323 - DNA, 968 bp, Homo sapiens
  misc_feature (5)..(5): n is a, c, g, or t
  misc_feature (92)..(94): n is a, c, g, or t
  misc_feature (97)..(97): n is a, c, g, or t
  misc_feature (99)..(99): n is a, c, g, or t
  misc_feature (142)..(142): n is a, c, g, or t
  misc_feature (151)..(151): n is a, c, g, or t
  misc_feature (205)..(205): n is a, c, g, or t
  misc_feature (241)..(241): n is a, c, g, or t
  misc_feature (251)..(251): n is a, c, g, or t
  misc_feature (255)..(255): n is a, c, g, or t
  misc_feature (272)..(272): n is a, c, g, or t
  misc_feature (275)..(275): n is a, c, g, or t
  misc_feature (279)..(279): n is a, c, g, or t
  misc_feature (283)..(283): n is a, c, g, or t
  misc_feature (286)..(286): n is a, c, g, or t
  misc_feature (294)..(294): n is a, c, g, or t
  misc_feature (298)..(298): n is a, c, g, or t
  misc_feature (378)..(378): n is a, c, g, or t
  misc_feature (402)..(402): n is a, c, g, or t
  misc_feature (437)..(437): n is a, c, g, or t
  misc_feature (487)..(487): n is a, c, g, or t
  misc_feature (495)..(495): n is a, c, g, or t
  misc_feature (529)..(529): n is a, c, g, or t
  misc_feature (577)..(577): n is a, c, g, or t
  misc_feature (585)..(585): n is a, c, g, or t
  misc_feature (659)..(659): n is a, c, g, or t
  misc_feature (774)..(774): n is a, c, g, or t
  misc_feature (809)..(809): n is a, c, g, or t
  misc_feature (845)..(846): n is a, c, g, or t
  misc_feature (849)..(849): n is a, c, g, or t
  misc_feature (874)..(874): n is a, c, g, or t
  misc_feature (877)..(877): n is a, c, g, or t
  misc_feature (892)..(893): n is a, c, g, or t
  misc_feature (896)..(896): n is a, c, g, or t
  misc_feature (900)..(900): n is a, c, g, or t
  misc_feature (903)..(906): n is a, c, g, or t
  misc_feature (964)..(964): n is a, c, g, or t
aaagngtgaatggacccctctcctcagtgccaaagagacaagaatgaagcagccccacctagaccatggttctgcagaactctgcaacctcnnnaangntgttacacacgatggacagaaggacgttctctcaacaccaggnttgattttngggaggctggagggaaccacgtctaggacctattaatactagctccttcctggnggctcccaagttctgaaaagaaaacaaaacgcagtnagcccacgtnaggntctccacgttcctgcangtnaaanccanganaccactgnagcntcagcatgggctgcacggggtgggcaggactgaggaggggagggcaggactgaagaggggcggggacccgcactccctgncagcagcccaccacctgccttttntactttggcaaaaacaaaaacaaaacctggaagcntcaagacaatgaagtaaactttaggaaatggaaaagacagcaggctgtgntcaaagcntctcttagcctcccagcaagtacttcccaagaantgctggtgactcttcagggccacaatggcaggttttcttcacagcagncccaaccncagcccagctgaagacggctcttctgagcttccttcatcagctgccttggcttccaagctgggaaggcattggnggtgtggtcggggaaggcacccagttgtttacagatggtagagggtgacacaggcagcatcgtcatgaagcagggccccaaggaaaggtcctccgggagaaccaggctgcccaangggaggagctgcagacgcacccgctgggaccgcanctgctggtggacaggctcctgtcgaggagacaacanncanacatgtggcaaaggacctccagagnagngctgatgagatgagnngcnggtnggnnnntgaatgtgattgagtacggtctgtccatgactggcactttggactgaggaataggacncaga

SEQ ID NO: 647324 - DNA, 428 bp, Homo sapiens
aaaacctcccacggtctacatgcacagttcaggaatgttgctgactgatgcttatgtaagttatcacaagctgtgttcatattggccatgggggacatactgtacgcttgtgtgtatgtttttaaacggagtcttgctctgatgctctatgctcgagtgcagtggtgcaatctcacctcactgcaatctcagcctcctgagaagctgagattacagtcatatgccaccatgcctggctgatttttgtattattagtggagacggcgtttcaccatgttgcccaggctggtcgtgaactcctgagctgaagcagtcctcccgcctaggcctcgcatattgcaaggattataggtgtgagccattgcatctgtccaacaaatcagacagcatatgaggagcggctcttgtggagagagaatgcgttagga

SEQ ID NO: 647325 - DNA, 255 bp, Homo sapiens
actacatacttccgcaccttaggtacatggaactcctttgaagttcttgttcctgtatgtgtaaatgggtagggaaggaggagcacatttacaactacggctacatcacattttaaacatgaatgaaagggcacataaagcccttttttcagcagtcacttaatggttaatatggctaaaaattttgaaaggttttatgtgagagagcattccagactgtcagaaaaaaactagatttcttgctatttatggact

SEQ ID NO: 647326 - DNA, 132 bp, Homo sapiens
tcttaattttgctcttgatagctagatgtttcttttaacttttatttcgtaagtaaatatacacaaaggcattcatctttgttgaatctgttgtgcagatttttcttgatgagcattctgttttattttctt

SEQ ID NO: 647327 - DNA, 469 bp, Homo sapiens
tatgagttgcacaactgcccgctctgtccctttccggcatgatcggataatgaagcttcctggccggtacaactacacggcctgtggttgtctgggccataactgatgatgtgcgggttcaggagggtcccaaacttaaggtatgtgcactgcgcgtgaccaaccgggcccgcatccgcatcctcaaggcagggggcaagatcctcactttcggccagctggccctggactcccctaagggctgtggcactgtcatgctctccggtcctcgcaagggccgagaggtgttccggcatttcggcaaggccccaggatccccgtacaacctctccaaaccctacgtccggtccaagggccggaagtttaagcgcgccaaaggccgtcgggccagcctaggccacaaaaactaaccctggatccttctctcttattaagaagatttttgcttgaaaaaaaaaacaataaaaac

SEQ ID NO: 647328 - DNA, 437 bp, Homo sapiens
gaatgatatgtaagacagagaatgcaggaaagatgacatatctgatgtcacaagtagagaaatcagactgtggggaatggtctgcgatgacaaatgagaggaagacagaataatgaggactatggctgactattttgtagaattggtgtggaaaagatgatgagagctgcatttaatttctcagtaaagtctgatagtgaacttccacagatagtagtgggagctgtgacaggtttgcaatgagtggaggaaatgaataatttttatagtagctggagatgagattctcttcctgttgtcaaggtcagagcgcagtagtgctatgttggtacactcgcagacctctgcgtgctgtgatcaaaggattctcgctgtgttggccctacaaagtagtgggaattatagcggtgatcctttgctcttgtccgaaccttgtg

SEQ ID NO: 647329 - DNA, 289 bp, Homo sapiens
gcacacaggtcagactttaggacagggcctttctccatctcgactgtagtgttttctgtcactcacttggtgggtaaaaggaccaccctaggccaggagtatatagatacatggtttctgagtcttagagtgagacttttctctaacaatcaaagaatggcgtagaatattcttgttgctgccaggttgagggaaaattctctctcatgctacattttatattgaaaaaatctcatgtagattcaagcttcaacgaaactattgtagtagctaaaatatagctgaattt

SEQ ID NO: 647330 - DNA, 273 bp, Homo sapiens
cgtacacaagagatgtccaatggggcattccatagcagagacagactcgggtatgtttaattccagaggctttgcttggtgataataaaaggatgggaaatagaggaaattagatccaggaaagggcaatagacaggtaacccagctagatgtaagagtacggagcaatcgaagaggcatatccacactgggggtggctataggcctgaaaattgctgaagatgactgctttcactgaggtcaaggattgtaatattgccagcttttgaaagc

SEQ ID NO: 647331 - DNA, 227 bp, Homo sapiens
  misc_feature (213)..(213): n is a, c, g, or t
gtccaattcatccgcgtagggttagttaatgtcttgagtatacttgaggagggtgacgggcggtgtgtcgcgcttcagggcccgtttcaactaatgcactctactctcagtttactgctaaatccaccttcgacccttaagctttcagtaagaggctatcgtagtttctggggtagaaatgtgccatttctgccactcatgggctacacctgnactaacgtctttac

SEQ ID NO: 647332 - DNA, 110 bp, Homo sapiens
catgcttccaggctgttgatgcagcggtagtgagcagatgtggcccccggtgggacaggcctgcactcgctcgatgtctctcacaggctgactcccatcacacatctgct

SEQ ID NO: 647333 - DNA, 259 bp, Homo sapiens
  misc_feature (191)..(191): n is a, c, g, or t
  misc_feature (255)..(255): n is a, c, g, or t
gttatagttttgggtggctgattagcttataggcttgcttcctcttagagggaaaggtgaacggtatctgagttattggtgacgaatctgtacgtgtctacagcgaccttaatacctgccttctcattagaaagaattcaaccgaggggcgtaagagagaaaaagagacgggcaagtttcagaggatgagnggaagtttatgtaaaaaggctttagaacaggaaagaaaggattttgtgtgcggtgctcgaattncgaa

SEQ ID NO: 647334 - DNA, 114 bp, Homo sapiens
  misc_feature (36)..(36): n is a, c, g, or t
tgaagggagtatctcagtggtcagcgacagtgccangtctgatgtgtctcacagttgaaagctgagacagtgtcttgtgagggactgagatgcaggattcttcactcctcccct

SEQ ID NO: 647335 - DNA, 650 bp, Homo sapiens
  misc_feature (17)..(17): n is a, c, g, or t
  misc_feature (69)..(69): n is a, c, g, or t
  misc_feature (87)..(87): n is a, c, g, or t
  misc_feature (90)..(90): n is a, c, g, or t
  misc_feature (95)..(96): n is a, c, g, or t
  misc_feature (122)..(122): n is a, c, g, or t
  misc_feature (127)..(127): n is a, c, g, or t
  misc_feature (129)..(130): n is a, c, g, or t
  misc_feature (134)..(134): n is a, c, g, or t
  misc_feature (141)..(141): n is a, c, g, or t
  misc_feature (165)..(165): n is a, c, g, or t
  misc_feature (171)..(171): n is a, c, g, or t
  misc_feature (177)..(177): n is a, c, g, or t
  misc_feature (197)..(197): n is a, c, g, or t
  misc_feature (237)..(237): n is a, c, g, or t
  misc_feature (254)..(254): n is a, c, g, or t
  misc_feature (264)..(264): n is a, c, g, or t
  misc_feature (320)..(320): n is a, c, g, or t
  misc_feature (396)..(396): n is a, c, g, or t
  misc_feature (402)..(402): n is a, c, g, or t
  misc_feature (542)..(542): n is a, c, g, or t
  misc_feature (600)..(600): n is a, c, g, or t
caaaaatcaacccatcngccaataaaacttgttccttaaagtcttttacagtattttctctcgaaaatnaacttttttttaactgcntanatgcnntcttcacttcatttttcagtaaaganaaccnanntggntaacagnctctcaccactcgacaagaccagncgaggntttggntaggagccagccgtcttccncttgcctgaagagaatcttgttaatctgtagtccagaggnaattctgcgagtgcctnaatacttggnattgcaatagtgcggtgagtgctgagtctcttacaagaccatgtttaaaccaaggngttttctgttttttccagtgccaaaactgaatcaataaaaaaagagccccagtttttagatgaagtttttaaaggntttgcnttggggcccccagattttcctttcttctctagaggcgctgactccccaggcctctgactccccgggccttcatcccccctgagttcttccaggatgaggactgttttccaattactatagttacgagctgggaaaatatnttaattcatgctgttaccaaaaaaaacaaccttgggttcaggtttgccagttattttnttcagaagttcatagaggtggacagcgttcccttgggagttccagccagg

SEQ ID NO: 647336 - DNA, 379 bp, Homo sapiens
  misc_feature (52)..(52): n is a, c, g, or t
gatttggttggaatttttgctaaattgggaatgttgcctgaactttatgacnccattttcttttaacttttttcatgggcttccctatatggacataaaaattaaatgttgaaatttatgaaaaccctttatgaatttagataatttttaaaaattgttaaaattttttgcgccaaaaaagtaatgtaaataaaaattattccttttaaaaatgggcccaaataattacctttccatgtttggtgaaacaaaacccaatgttttttaaatatggagatgttgagtctttttcctttcctaaaggggctgaaaagcattaaattccccattttccttttttgttttccttgtgaaaataaaaatgccctaaggttgggta

SEQ ID NO: 647337 - DNA, 1146 bp, Homo sapiens
ggtgacgcctgagacagcaccactgctgagtgagtctgaggactgtcctcccacagacctgcagtgaggggccctccatgcgcagatgatggggccactgacccacctgctgcttctgctggaggaggggaagctggtgcccaaatggcccagtgcaggcagctgtggtgctctgccaaatgtgggcttgcccctcgcacacagggctcacagtggcatggccttgcatggggtccagtggctgtttggatggacccctgagggctgagtgatgcagccatggaccctgccttgctcccatcctcacctcagatcagtgaaccagggcctccctgttcactggttgacaacatggtcacgggctcagacgtgaccctctggctgtcaccgtgctcacagggatgctggtgtgcttggtgagaccccgcactgcacactgggaatgcctaggtcccttcccgaaccagaccagctgcagcggcacggggacctggatagttcagggcttttccaaacatgcatccatttactgacaacttcctgtccttgttcatggcagagctgttcgctcctcccagatggcttcggagggccgtagggcccaccttggaccctggtgacctcctgtccactcactgactgcctcagcggcctgccccagcgcctgcacgggcctccttccctcctgtgcgcaactgcatcgccgcctgtggtctacggcctgatgacgggcgaacacgccacacgggtccctgccggcggcatgaagaccttgcacgattctcgagtcagcgtgtccataacgattgaccctaaggaagcccattcagttgtttcgcctttcactaacggtccgcaaagttcacgcggcccgagatatggatcaaacacccagggggtaccgggacacgcaaaacagcgaggggcaacggacccgcacaggcaagcacgccccaaaaacgcgatacgaagtgagaaggagacacaagaacacatgcgacgaccgagaaacaccacgacgccagcagtggaagctaagcaccacacgtgcagcgcaccccacgcgccgcccccactccaaaaaccaccaaagccgccgcgctgacagcccaagcccccgcctcccctggctacccccccctctcc

SEQ ID NO: 647338 - DNA, 127 bp, Homo sapiens
atatatctcactcttacagtcagagtggcacatcttgaggtcacggcaggggtggcgtggttcttgcggctgccctctgggctccggatgtactcgatcttgctggctccaggctcttgaggggtgg

SEQ ID NO: 647339 - DNA, 682 bp, Homo sapiens
  misc_feature (475)..(475): n is a, c, g, or t
  misc_feature (682)..(682): n is a, c, g, or t
cttccccactttgaaaacctttattttgggccccggaaaggggggcggcggcccccccctaactgggggtggagctttttagggccccccccaagagccctaaaaaagctaaccttgaagctttccacaacgggcagaaggccttgggggaggtcctcaagcgcgggcttggccttttcgatgagcgggccaaaatgctcgggggccttggggtggaactcggccaatttggcccccccgttttctttgaaagcctaaaggggcgcggccaagccctggcccaatttgtttttttagggggccaaattcttgcccaaggcttccacatgggcgcgccgcgcggcccgcatttccccgcccagggggttaagttttttttgcagcttgggacatttttggccccccccccttttgagagtttggcccccaggggtccacctttgggggggagagctccattttctcctggcacttntttatggaagtcgccaaggtagggctgcaccttggccctaaccctcctcaggatctttctaattctcctgctaagggccttggtcttttttacaggttaccccaaaactcctgggtacagggcccactttttccccaattgtgtaaggggaagtcaccctcccccatttaaaggactttaggttagttgtttccaaggggaccttan

SEQ ID NO: 647340 - DNA, 381 bp, Homo sapiens
  misc_feature (85)..(85): n is a, c, g, or t
  misc_feature (127)..(127): n is a, c, g, or t
  misc_feature (152)..(152): n is a, c, g, or t
  misc_feature (193)..(193): n is a, c, g, or t
  misc_feature (281)..(281): n is a, c, g, or t
  misc_feature (284)..(284): n is a, c, g, or t
  misc_feature (325)..(325): n is a, c, g, or t
  misc_feature (344)..(344): n is a, c, g, or t
  misc_feature (349)..(349): n is a, c, g, or t
  misc_feature (354)..(354): n is a, c, g, or t
  misc_feature (366)..(366): n is a, c, g, or t
tcccccatgaaaactgttcccacctgatggtggagcacacgccccaacgaggagagcatcgactggacccaagatcgagccccancgtcaaccttccctcaagtcgccccaaagacaacgtggacgnaccccacggggaaccttcccgcagncggggcctgacggggtggcgggtgttcctgctgctgctgtncgctctccctgggcatcgttgtctgcgccgtggtgggggccgtggtgttccagaagcggcaggagcgggacaagcgcttctactgagntgnccttcggcggggcctgtccctgggcccaggagccaatgtgnacttttttttttaccgggnttatnaaagnacaacaagatgnccttatttcttaact

SEQ ID NO: 647341 - DNA, 1458 bp, Homo sapiens
tccacgcacaggggggcttgttaattccccccggggccgggcggggggggaccaaaatataaacaaagggcccgggggcgccccgggggtcgtgggcccgggtcgtggagacctgggcgcccgccgggtgtacacacccgtgtgagaaggggtgtgtgcccaggggcgtgtgcgcaggggactggagatgtcatccccccaaaactggagagaagagggcgccctctgggggacttgggaggtgcttcacacaagtgtgcgcataggtcgttgggcgcaccaggtgtcccggggagaagagtgtgtataacggagaagagggggtggtgtggcgcagcggcgccggggtgagagaagttgtgtgagagagaagaccccggggagacacagagaggcgtctgtgtggaacagagagtgtggctcaaaaaaggccacagggggtgagaatctccacagggacaggggggcacaaactggggggcggccgctgggagagtgtgtgcgagaacaaacgcgcgggtgacacacacaagcgtcccctgtgagagagacaccacaaaaagcctctgtggtgtggcgtctcaccacgggcgccacacacaaaaagagagccgtgggcgaccggtgcacacaccagagcgacccggcgccccctgggagagagaacaccggaggggccctaacagagagggggaactctctccatatatacgacaaagggtgcggcgaagagagtgggtgcgccgagagatcaccagggggggagcttcacaaaggttccagaggagaaatatcacatataggtcccccgtttgcgccacgcaccccctcacggggagagtgtctaccaccgcgtgggacacatctgtggacaaccacagagttgcgccccacatttcttgtggtgtgttcccacagcgacatcattttggaaacgggtgcaccggtgtgacaccatctagtgggtgctgcttctccaacgcctttgtggaacaccccagaacgaccctactcttgacattgtacaaacattttggtctcccaaacaatcatccccgtgtttttccccacccaaagtttatcattcccactgcgttgcgaagtaatacccgcggacgcggagcaagcgcaaccacgcagcgtgatataaaacaagaagcacactggccacacaaacaccaacagggctgttagactaccaccccctccagcagcaggcgctaccacacaagacggccccacctgtggcaagacagcttaccaccaatacatcctgtgctagcgctttgcgtccccccgttaacaactggaagtacaacataggtcacaacaacactgatggtatggaacaaatatttgatccccctctgtccccgccccctatcattgaacagtgatggcactacccacagacgagctagtgtagcataaactaacttcttcaacaaatagcccagg

SEQ ID NO: 647342 - DNA, 186 bp, Homo sapiens
ggctagactgtctctatggagagtgcgctacggggtatgcactattcacaccatcaccatgagcacaagtaaaaagaagaagaagcataaaccagtaatacacaaacatcaagtcataatggcatgacaagtaaaagaaaaggacaagggatgccttgtcacgtattacgtccagactcctgtcca

SEQ ID NO: 647343 - DNA, 672 bp, Homo sapiens
gccggcgctgagggcggcgcggcgggccctgacgacggggtgggtggcctgtggcctcctcgtggctcgtgcccagtgctgcttcatctcctgctggcctcagtggtgcactgtgatgttgcctgtgtggtgcgcagtatcgactgcctggctccacgctccatgcctcggctccctgctccgggtccctcgtgcatgggactgcctcctggacctgccagcctcgctcctggacacctgcgccgtgtgtcagcagagcttgcagagcctggctgtgaggctggagcccaagctgcttgccctgtctatcaatccttctgcctgctgcatgcctgcccgagcctggagctgccagctcagctgtgcccatcccgggggggcagcaacggcggaaatccagcaagtaggtgtaatactggtgcccagatatgcctgccaagaatgcagacagatagaccttgtggataattattttgtgaaaagacacaatctgaagctcctagcagttctgatgaaaaaatcagaacaggtatgtactagttgtgaagacaattgcaagtgcagtagggtaagggtgtaaaatgtggaaagtaggtatgtaagacatgtatcgaaagcaccatacaaagagaaaaattaactaaagatcacttgatcaggcagaaagacgat

SEQ ID NO: 647344 - DNA, 822 bp, Homo sapiens
gatccggcgctgccccaggaccgcgccgcgctttgtccgcgccgccaccgccgtcgcccgccgccatggagcgcgccgtgccgtgcgccgggtcccgcttccgctgtgtgttcgggggcttgcgctgtggcggccggagtggacgcgggatgtcctcctggaggcctgctgtgcgtgacggacacggcggatggccactcatcagaaggactgctcgctgccatatgctacggaatccaaagaatgcaggatggtgcaggagcagtgctgccacagccagctggaggagctgcactgtgccacgggctatcagcctggcaaacgagcaaggacctgcgtgtgccaaacggccccacggtgacaaggccagcctggaggccaccatttgtgaagaggtgctgccattgcgtgtctgcgtggggagggcggcccaggccaagggccagagcgtgcgagtacaagcctcatggttggctaccagtgtggacaggtctccgggcatgctgtgtcaagagccaggagaccggagattggctgtcgggggcctccaaggaaaccggatagcgatccttggggttgaggcggaccaagaggacccatatctgaatgaccgctgccgagggaggggggccctgccagggcaggcagtgccgagacacggtgtgacgagggtggtctgctcctgcttcgggggctaacagcgtggtgctgggggtgtctcctgtgacagatgctctgagtggctccgggcggcccagttgccggtttggggatctgctcacccgtgggtctttcgcgccaccggacatgcggctggttagg

SEQ ID NO: 647345 - DNA, 826 bp, Homo sapiens
ggacgcgtgggcaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttcaggtcaggcacaagcaaatctggttcatttcatgtaaaaaactcagtctcacatcaacagttcagttcagtggctttcatccagtcttacaatcgtttcagtagtccaaaacagtaggtagtattcaaacgtcaatcagcaccatccagaaaaccttgtcgtggacaaaactcagttcactcactagcttctagcacctgcaagttagctccctataaagggttcatacaaataatgacccaaattgttacatgtgtagatattaataactatgtaccagttactagatgtactgtggatatcctaccctcatctactgaacagggataatactgacatacattattagacaaactatcaaaacttcacactttgtaccatttaaaaactaaaatattaactcttgttccataacagactaatcgggatcagtagggacactcgggaacaaggagcaagggaaacaacagcaaaatatcattcacatgtcctaggttcatacatatattatacactaatgtccatatcaatagcacagctaatgcatgata

SEQ ID NO: 647346 - DNA, 1320 bp, Homo sapiens
ggggcggtgatgaccccaacatgccatctgatgtgtcggtgctgaaatccagatggctgtttctgagcctggagtggaggcaggcttgctgcctctacatcgccactgtctccacacccgtactaccagccctcctcatattatataataagtactgcacacaagattattcgaaacactcataaactcatatttaaccacttatagataatcattccaccacatcaacctccaaatagaaccactcgttatcaactttgttctttatacttacataacacacacacaacatttctctttcatcccacatttatattaaaatcatacataccaacacaaattgcatcaataacacccacgacaaacatacactatcaccataatacaataaacatattgtaaccaaatttatcctataacactacaacatacataccttgcacgtgaatataccaattcatctcttccacactagcatttcctcaaacatctttatctacatccttccctcttcatatactatctaatcgttcaccgacactcttcgcatatctcaactctaccaaccttcatgtctcccatcaacatctgaatcacaccctctgctattctatcctactactaaatgatatactctcgtgcgttagccatatacttacttctatattaatttcacagcatactctaccacaaaactcgtttatgcactacccatcgttaactcccccaaattgaaacaccatcacatcttatgacccacccccaatacataccagatccactgaatcttcatattagttaaccttcacgatgacatcaacactctaaactatgtttgttcctatacataccaatagtttctttgtcgtcaacaccaatcttatatcaccctttctatagaaattactcacatcctaatcttttacctacaatccaattcgtattttactcaccaactttcttataatattataacatactaacatacttagctcacccaccactgaatcatacacacaatcacatcatactcacactcatacaagatctcagagaaaaacaaaaatattcgaaataacatatctcaaatcattctactcttgagcaataataaaaccaacaacactctcttacccgctactatgaatcagaccctacaccattccgtgactacagccaagctcacacatcatagacacactaccacacaaccatcaccctcacaacccatccgaaacataacacactaaaaaaccatatcatacagtcaagcaaacctagaattatccttcagcgaacatcctactcagcatacaacct

SEQ ID NO: 647347 - DNA, 947 bp, Homo sapiens
ggtttcggagtgtttttctttgatacgggagttcctcctgctctcgcccctactctttctggtgttagatcgagcaaccctctaaaagcagtttagagtggtaaaaaaaaaaaaaaaacacaccaaaggctcgcagccacaaaggggatgaaattttcttcgggacattcctccgggttctcccggttaactggatcggtctggcgcccctaaaagtccttcgtggaaagcttttaattcctaaagaggacgaaatatcagtcaccgggcggaaatcggtggctggattcacaagggagctggggcatgggaattggggcagactggactggcgctcatgaattcggcgtaaccttcaaagagcaagctgggtcctcggggatcatcacaatcaagccttgggcactgggcgcgaaacagctggccaaaatggcccggggaccggggtcgccaagggctccatacctttgggggcagactggccagcaacccggagaaacgtatctttctaccagttctctggcacaatacacaagcgtcgccagcggccgaacatcggggcccattcgtcaccgcatcctccacgtaaactcactggggcgggtgcagtcaggcctcataaccttcacgcatccgctgttgcgtgaacccaccacaagattcccctccgagaatcttggccacacagcgacacctttctgtgaaaacgcttaaactggggctcgccttgggcccccattttgtcggggagcatataccaaaagggggccacatatactagtcctttggccatcgtgaacccgctagtacaattatcaccaaaggggcgccataaattgggttcatctgggggctgccctttccagagacagactgcgggaacaacgggtctcagcggttccccccctttctcctaaagcgggggtctacccgctgttccaccggca

SEQ ID NO: 647348 - DNA, 216 bp, Homo sapiens
cgtgtgtatatgagtgtgtgtgtgagagcatgtgagggcgtgtgtatatgagtgtgagtgtgtgtgtgagggcatgtgtatatgaccatgtgtgtgtgggagagcacgagggagtgtgtatatgagtgtatgagtgtgtgtggttgtgtgtgaccgtgtgagtcaaagagcatatgaaactgtgaatgtgtgtgaaaacgagtgtgtggtagtgtg

SEQ ID NO: 647349 - DNA, 110 bp, Homo sapiens
cccatttggcaccagtgttctcccccttgtcttgagcaggtaggacacgctgtagacgcggctgcccacgtgcttcaccaggatctcctcgcgggggtccggttgtctga

SEQ ID NO: 647350 - DNA, 509 bp, Homo sapiens
  misc_feature (453)..(453): n is a, c, g, or t
actcctatatatcagtattgaccacctctcctcaacctgtctctaaaggtaggagaaaactgatttattctccttgtattctcttctttctctgctccgtcattagtttgctgatattttctgttcggaaagggggtgaagaaccttcccccctttgagggagataagttttggtttccctgtaatatggaacaaacttcatacctggcaagcacaaagaaattattattttgccaaagtatgttctgcagaccacatattccagaaattacacttctaagcaaaataatctttgataatttgaatttgggaaaaaaactgcttactacattctttgatactgatatgcaatacacattaccatgttacagtctcaagaagttgttcagttaactgttaattttatttaatctggtatttaccgtatttaatttatgaatcactgtaagattntaatttttttttaattaatgttccatgcaattcatggaaaagactgatctatagga

SEQ ID NO: 647351 - DNA, 363 bp, Homo sapiens
tgcttcctttcccagattggtaattccatcatggctgggacatttagaatccatcttggggagctttaaaagtcatgggcggcaggagagacagctcatgcctgtaattccagcactttgggaggccgaggcgggtggatcgcctgaggtcagtagtttgagaccagcctggccaacatggtgaaaccccgtctctactaaaaatacaaaaattagccgggcatggtgatgggtgcttgtaatcccagctactcaggaggctgaggcaggaaaattgcttgaacctaggaggcggaggttgcagtgagcccagatcacagcacttcactccagcctgggcgaaagagcgaaactcccatctca

SEQ ID NO: 647352 - DNA, 163 bp, Homo sapiens
  misc_feature (145)..(145): n is a, c, g, or t
  misc_feature (154)..(154): n is a, c, g, or t
agggaggatatacggccaaatactcaagtggtcttctctgtgcaggtgagctacagctgatcttgtcagagacaacgttagttctactgagtcacccagagccctgtgctggtcgctgagggtttagttccatgtggacagtctnccacaattncctctgggg

SEQ ID NO: 647353 - DNA, 156 bp, Homo sapiens
ctccgggacgcatataagtgattagagaatgatcaaactctgtagggattacatcaggataaccttcctgatcctgaagttcttgaagactgtgtctgggtccatctttgtagctccttttagtacctaacacatactggggtacctcaagggtat

SEQ ID NO: 647354 - DNA, 871 bp, Homo sapiens
ctcggagaacaacgtggtgtacctgggacctcaagctggagaacctcatgctggactaggacgggcacattaaagatcacagacgttctgggctgtgcacggatggggatcaatggtcggtgccaccaatgaagaccttttgcggtagcatctgagtacctggccccgaggtgctggaggacaatgactacggtcgtgcaggtgtactggtgggaaggctgggctgtggtcatgtacgagatgatgtgcggtcgcgccgtgcccttctacaatgcaggaccatgacgaagctttatgagctcatcctcatggacggagatcctgggttcccgcgcacgcttggtcccgaggccaagctccttgctttcagggctgctcaagaagtgaccccaagtcaggaggcttgagcggggtgcatccgagtgacgccaaggagatcatgcagcatcgcttctttgccggtatcgtgtggcagcacgtgtacagtagaagaagctcagttccacccttcaagccccaggtcacgtcggagactgacaccaggtattttgatcgaggagattcacgggccaggatgatcaccgatcacagccacctgagcaaggatgacagcatgagagtgtgtggacagcgagcgccaggtccccatggttcccccaggttcttcctactcgcgccaggcggcacggcctgatgccggcggtgggactgcgctggaccgatgccttgtgacgggactggccacggcggcctcgtgcgcatgatcctgtatttacggcttccactctctcgcggtgcgttttgggaaagccagctgtcgttttgggccccatggaaagcccttttggtctcggtggcggaccccccccgg

SEQ ID NO: 647355 - DNA, 144 bp, Homo sapiens
gattttttggaaccgctgcgcatgagagccaagttgaggaagaagcgaatccaggccgtaagcgcaaaagaagaaagaggatgcagagggcaaggaaccgcaagctgtttcaccggggaggccacaggagcagaaacaaggaat

SEQ ID NO: 647356 - DNA, 507 bp, Homo sapiens
ggtccccttcctgccagagcaccgggcacacctcactgtccttcctccctccagcggcggtgctctcttctagactacgggcccagggaagagggagggccccactggtgctgccctgtccctgagtagggctgggtgaagggcaggggtgcgacaccggctggagcaggaggtggcagccatcgggggcacacggacggaggggcagccctcccccaagcacacggcacaccggggggacagagcggggtgtgcccttgattatatcaaataaaagaagcagccccatcaccagtggaataaaccacagacctgaagcccctagggccgcccagttcagtctccagggggcagtgagtgagggtgggagacagcgcggccgtaggggcctgaggagccactcccctctatggggggaagggagaacagctccagcggcctcctcacctccttttcggtgaatgtcttgctgagaggagacaatattcttatattcttaacagaaca

SEQ ID NO: 647357 - DNA, 129 bp, Homo sapiens
tcgtcaggctcggctcggcctccaaagccccctcttccccgacctatcataccccgacctctaccaccgattccgacacgacccatagctccacgcctttcgtacccccgggggtatcctactagtagt

SEQ ID NO: 647358 - DNA, 1674 bp, Homo sapiens
  misc_feature (1188)..(1188): n is a, c, g, or t
agcggctcggccgcgcgcgggtctggccggctctatgtgggaaatgctggctgtgctcctgagcctgatggctgtgctgtgctgtgtgctgtgcctgctccctgctgggctctctgtctgctgttcactgtgtttgtccccatgctctgtctgtgccacactggctgtgctgcctgtgtgcattgatgctgctatccactgtcctgtgctcctgtgtgcctgtgatgccacaatgcacccatgccccatgccctgtagcccctgaacctgtgagctgtgtgtgaccctgcttgtcatgacacatgtgttgtacgtgagtgcatgttatctgtgatgtgcatgttgccaatgactctgtgaacctagttgtcctgacgactgactgtcatatgacgcctgtgagaccagtggtgacttgtggacaggcaatacggcaacttgcattgcaagtggtgtctgcatggcctgtgtgtgtcaagacgtacaatgcatcagggttgtaagtgtgtgcattgtgtgcgcacttttcgacgtaaggtgcgctgacataccggacgacctgcgtacatcacctgagatgcatggatgtgtgtgaagctgcagacaccattatcatacaagaaccacaggaagtccatgtgaatcagcgatgccaggtgataaagatgcccccatgacccatcgtatccttggcagacaacaatgtgaaccaatggggtctgacagatgaaccatcacctacctatcagtggtggtggtatacccaacaatttatacaaggagggaaccatgaagcaaagcagaacaacaatacccaaggatggcaccaccaacatatgagagagaccatataacattggcactaccgtcgggcagcaagaggcattcctgcatagtggggcacttagtgggcatatacctataccaaaaatggtatagggagaactcaacaaataagcacagttacatagagaaagcagtggtgacgataaaaccgcaatagccgaggcgctaggacttggagctttacccggactggcgatatgcaggaggcaaaacagactggcgctagtacagggactattagaccatgtatagacgtaaaacgacaggaacaaagatcacacaggtcggctgagagcacccatgtgtgtgcccccacacgaacacgatggcgcacgtatgggngagcaccaaattcaagagcccatgagtacacagcaccagagggcagcaacagtatgagcaaccacggggaatagaggcaacaccccataggaatcgagacacaccaaagcgacggaagcccccgaatgcgaggggcaccaagggaaagcgacaacacgcagaacgtcaacagggcacacaggcaccacaaagaacttgaaaccacggggccgaaccgagtagtgatacacagcgcaaccggaggagacgtggcacagagggacacaagggaatgagccggacaggaagaagcaccgccgataacacatcaacatagcggagcacagaaaacgaggacacaccccccggagaagcgaggaacagtagagacgaaacccatgagacaaagcactcaccagacacagataaggcacaccaagggagagaaacacaagacagcagacgcgaacaaacacagacacgaaaagagagcaaacaaacacagag

SEQ ID NO: 647359 - DNA, 324 bp, Homo sapiens
ccttttttttaatcaaaaagggcccaaaaaatattatccaagaaccctagggctgcttttaccagcgatgaaagcacgtttttataaggtcaaataatggaagctgacccccctttgggcggctaaatttaaaaaaaacgttcaaaaatccctccggcccatttttgaaatttgtctttttttgaaaatttaaacaccggttatttgtttactttaatcctttaggaaaaagaattcaaaactgttgtttttttttaacccctttttgcttttcaaaaaaaaaaactgttcccccccaaaaaaaaagcccaaagttaaagttta

SEQ ID NO: 647360 - DNA, 505 bp, Homo sapiens
tctcacacatacagttatagaacgaaaatatcatacccatccccaaaatgtgatgaatcatataaaataacttagtgacctgtctcatctcacaaacagtcagaaagagaaaagaatagtactttcagctagcctatgcaagctagttgaaggctaagagggaaaacctatcaacggtgtaacataacagaagtaaatgaatatctcgcggccttcattcgaaacaggcactgacccagagtgattttcagtaaatgtccctaagccaatggtaaatgaggatcgtcaggaggtaccggcggtcgcgatcatcccaaggacacatacagtgtctaatatagataagttgggtctactctcttctatatatatgtagacatcagctccaagacgtaggaaaattttactgatgcagatgagtggaagaagtcgcggatttgatgaggctccatattagaagtacgttaggccaggcacggtggctcacactgggcgcgtaggggta

SEQ ID NO: 647361 - DNA, 225 bp, Homo sapiens
cgacgcggccgtgtgtgggtggtgactgccctgtcctctgcctcgggttcattcttcggtgatcactgcccgttgctgggtggcgctgcccgtcctctgacttgggttacttcttcggtgacactggcgttgctgggtggcgatgcccgtcctctggcttgggttacttcttggatgacgtcggcgtagctggggagaatgtgccgttcccatgactgcctcgta

SEQ ID NO: 647362 - DNA, 324 bp, Homo sapiens
  misc_feature (40)..(40): n is a, c, g, or t
  misc_feature (97)..(97): n is a, c, g, or t
atcaatgaaaactttctttaccactaagatgttgaatttnttgccataatgggaaagagaggcctttcgtgctttctcaatagggctaactaggttnattattgatgttccaaataggcactctgtctttgcccatagtccccattttacctccacagaatagaagaacaagaatggcttcaaacacatgctgggtaacctaaaggcaaaaataaacaccttatttactagtaactctctttcaacaaatttatttggtttggcagtatacattaaattgtattatgtatcttacataaagcatcccttcggattggtaaaagg

SEQ ID NO: 647363 - DNA, 233 bp, Homo sapiens
ggagatctgcaggattcagccctatcataatgtatatcaggtggagtatgatgactcatatcggcaagagcgtcgtatactagggggatatttgtaaacctacatgaatggtgctttgaaagaactaatttatttttacgagggcagtcctcaaatattgagtcttaactacttggtagtgatgttgagacatgtataacaagcagatggacttagttatgtaacgtcggaaa

SEQ ID NO: 647364 - DNA, 290 bp, Homo sapiens
  misc_feature (52)..(52): n is a, c, g, or t
  misc_feature (72)..(72): n is a, c, g, or t
cgcgcatcccctgtggctgccctgaaggccaaggtcatccagaagctggagnacgtgtccaagccacccgcntacgcctaccccgccacccccagctcccaccccaccagcccgccgcccgcctccccaccgcccaccccgggtatcacccgcaaggaggaggctcccgagaatgtggtcgagaagaaagacttggagttggagaaggaagcccccagccccttccaggccctgttctcagatatcccgcccaggtacccgttccaagccctgccaccgcactacgggag

SEQ ID NO: 647365 - DNA, 370 bp, Homo sapiens
tgagcgtgcgatagtgtgctgataatttgtgcgtgatggtactaacctaccggtgctattgatcaggctcagtttgaattcttccgcgagacaggtaatagttcatccatcatttgatcccctgtagtagccgccacagttggttttcactacctctccctacgactttgcgtgactccaatacatctcctggttgtcctgtgcggtagttggtttccagctgttggaagacgtcttgattgagagactgttgatcgcacccccatcctggccacatctctctcagtatctgataatgctctgtccacacctccacaccaccttcctcctctaccctctgtcacaaaggcacaggtccctcttccaccaa

SEQ ID NO: 647366 - DNA, 948 bp, Homo sapiens
  misc_feature (352)..(352): n is a, c, g, or t
  misc_feature (391)..(391): n is a, c, g, or t
  misc_feature (394)..(394): n is a, c, g, or t
  misc_feature (436)..(436): n is a, c, g, or t
  misc_feature (515)..(515): n is a, c, g, or t
  misc_feature (517)..(518): n is a, c, g, or t
gggcagtttgaaaacctaacacctgaacttccttttgagccaaaccaagaagttcctgtagcaccttcacagtccaggcaagatttgactgatgaattagctcagaagttatttgatgtttcagaaataacttcagcagcaatggttcattcgttgcctacagcagttccagaatctcctagaattcatcctacaagaacacccaaaacacctcgaacacctaggttacaagatcctaacaaaacaccaagattttatcctgttgttaaagaaccaaaagccattgatgtcaaagagtccaagaaagagaaaaacaaggcatagcacaaatccccctctagagtgtcatgtnggttgggtaatggattccagagaccatgggccaggaacntcntctgtcagcacttcaaatgcttcaccttcagaaggcgcacantagcaggaagttatggatgtactcctcattacattcccaaagttccagaatccttctcatgaacttttgaaggaaaatngnnttacccgaaaagttggtaccacaaggtatggacgaaagaatgccttagtgcacagaaaaggttggaacaattgggtaaagtatcgcaaaggacaattggaataccctaagatatagggatttatgggtcattgtgaacattagaaaattcagttatagatacataaaaagtgtttaaagaatataagacaaactggatttggagaaatattgagagcagaaacagtcaacggagaagcgcgataagacagtagcaggcaacacggataaaacaagaaacctgcgcctgagaaaaaaaaatttacaccggaaaaaaaaaaatcgcacaaggcaatagcccaaaaagaaacccaacaaaaaacacaccacacatggagcgacaccgcagttggcccaaaaccaggttggagacacacctcaaacaaaaccaa

SEQ ID NO: 647367 - DNA, 747 bp, Homo sapiens
  misc_feature (151)..(151): n is a, c, g, or t
  misc_feature (190)..(190): n is a, c, g, or t
  misc_feature (193)..(193): n is a, c, g, or t
  misc_feature (235)..(235): n is a, c, g, or t
  misc_feature (314)..(314): n is a, c, g, or t
  misc_feature (316)..(317): n is a, c, g, or t
ggcacgagcggtcacgagagtcagagggttttaatttacttgtgaagttcacactattgaaactaattgcaatgcttgactttattttctttagagtccaagaaagagaaaaacaaggcatagcacaaatccccctctagagtgtcatgtnggttgggtaatggattccagagaccatgggccaggaacntcntctgtcagcacttcaaatgcttcaccttcagaaggcgcacantagcaggaagttatggatgtactcctcattacattcccaaagttccagaatccttctcatgaacttttgaaggaaaatngnnttacccgaaaagttggtaccacaaggtatggacgaaagaatgccttagtgcacagaaaaggttggaacaattgggtaaagtatcgcaaaggacaattggaataccctaagatatagggatttatgggtcattgtgaacattagaaaattcagttatagatacataaaaagtgtttaaagaatataagacaaactggatttggagaaatattgagagcagaaacagtcaacggagaagcgcgataagacagtagcaggcaacacggataaaacaagaaacctgcgcctgagaaaaaaaaatttacaccggaaaaaaaaaaatcgcacaaggcaatagcccaaaaagaaacccaacaaaaaacacaccacacatggagcgacaccgcagttggcccaaaaccaggttggagacacacctcaaacaaaaccaa

SEQ ID NO: 647368 - DNA, 196 bp, Homo sapiens
tagccctgtgtgtcccgtgtagtccctgtgtagtccctgtgtgacccgtgtagtccctgtgtagcccctgtgtagtcgcgtgtgagccctgtgtagtcccctgtgtagcccctgtgtagtccctgtgtatgcccctgtgtagcccctgttgtaggtccctgtgtaagcccctgttgtatgccaatgctgtgtgact

SEQ ID NO: 647369 - DNA, 171 bp, Homo sapiens
tgaatacgcgacaactaggtgatcctagcagtagtcgtatgcttgtttcacggacttagccatgcatagctcagaataactgcattgcaggaatctgcgcatggatcattacatacagacgtaaactgccgccaaaaatcttgcggactccgcttaaataggataacttgg

SEQ ID NO: 647370 - DNA, 873 bp, Homo sapiens
  misc_feature (233)..(233): n is a, c, g, or t
  misc_feature (401)..(401): n is a, c, g, or t
tcctctctccttcctcaagcttaataaggctctggcagggcatccaagataacacagctctgattcctcagacacactcagccccctctgataacttcataaaacagctccttattgtctgggccatgaagccaggctaatgctaaagttccagttgcaaaaacgattgtaactgctacttatccgttatgtaggccagcgtctcctgaggtactggacactctactcactgngcaccatgcgattcaggctcaggtggtgtcaacagtcttcccgtgagaagcaagccagtacacccagacagggtctcagaacacgctagagtcacaaggaaagggcttggcagtccgagatgcacatgtgcagtacagtgaacacagaggacgaagaactgcatgaanctgtgtatgtttcttcgccatcacgtggttttagcagcacccgtagggaagaccctgatggtagcgtctttaatgattgctgacatggacgcactaatatgctcaacaatgcctccaacaggcaaatgtcggaaatacactttcagagctggatgggactcaagatcatctaatataatcgctctcatttgatttcctctcaaggaaaccaagggcaagaaaagtctaggcaatatcgctcacattcacacaggcagattagtaacagagctgagttcgggtctggtataggcttaatactcttgattctcccagaaatgaagcactaaagataaaataggaatatattggataaccaaatatgtaaccagaatacatggggcaaaggggttttaattatattaactattagtaaaatctgaagagaaaagttgacagtcagggttacaacagtgataatagaaagagggca

SEQ ID NO: 647371 - DNA, 363 bp, Homo sapiens
  misc_feature (180)..(180): n is a, c, g, or t
caaaaaaaacagctgtcagcccgaggaaaagcccccggcctgcagggcctcagcttttttttccagacccagatccccaaaaaggtggccctggacctggagtcaggaggcggtgtccaggaaagtcgctcatcaaccccgggttcaaaagtaaaaaaccagctggtggggtggacttcnattaaaccttaaggtgcagcccaagcgtggccccccggggagtccgcctattaggggaaaggcagttttttaggcccccatcaaagaccccccgcccccccctccccctgcctgttttgggccaggactaacccggctcctcaaattccttccctgtcaaataaacagctcccttggttggga

SEQ ID NO: 647372 - DNA, 1389 bp, Homo sapiens
  misc_feature (160)..(160): n is a, c, g, or t
  misc_feature (259)..(259): n is a, c, g, or t
  misc_feature (371)..(371): n is a, c, g, or t
  misc_feature (486)..(486): n is a, c, g, or t
  misc_feature (501)..(501): n is a, c, g, or t
  misc_feature (509)..(509): n is a, c, g, or t
  misc_feature (521)..(521): n is a, c, g, or t
  misc_feature (527)..(527): n is a, c, g, or t
  misc_feature (742)..(742): n is a, c, g, or t
ggtgcgaatcgcactcacacggtgtttcttcagacgattgcgcgtcgaagggagagcccttgggacgtgtcatccttatgagactgttgtgcagaacaacggctcccaacaaggagcagccaagagagaaattctatcgatgcgtcatgcatgcatgtgngcatcagaagagagggcagttgtgggttagtacagggatgtcctggcttgtacatcagaagtataatgcctagggcttgtacatgttgatgcaaggganttgatggactgtacatcacgtgccagtaatgtggtcagcgtggtatggacaacttgtccatgtactaatgggtgtacgaagagtctatggagaagactgaagaaccgttcantaccataatgagtgcattaccaggggtccatgagacacatctgtggcatcacacatggtgcaatatgtgacgtggtaaccgcatatgcaatagataaatggatctcaccacgatntgtgttcaatcttgncatcttgntcataggtatcntgatgnatgggttgtgaatggtacacagcaatgctgagctgattcggggacataacgggtggaaaagcaatggcgtcatggacatctagttgatgcgaagcggcgcattgcgaagcacgacttctcggggaatcccaggaatgaatgtggcaagaatcacatggacaccgcgaaggagtgcatgccagttagccatggatgccatgcttggaacacaacanatcgggagtcaaaggtatagagatcgtatgctccgtaaggataattctattaagcgcaacccaaagaactctaatttaccctatcgtcggtttaggcctcatcgtgatggaagacatcccctcttccaatcgccctaagtttggcgccgcagagaggaatgcttaagaaaattgcttgtggttggactctccgaccatggtcaggaataccccgttgtgagagcgtctcccattggtatgcttccccttgttgttccccttgcacaaatggcctaatgggggtggcacttgtggcacgtagggcgttgaacggtatgaactggagttgcttggaaagtttaggaaaccttaacattttactcggatattgaaaacccacccaagggtcgccggcggacaggccttggttagaaaaataagctcccccgcagcaagggggcgcccagaggggcaaaaggagagaaaccggggaatttgttggtgcccacaacggtggggcccccaaaagggggggacgcggacataaaaataaacgcacacgcagcagcggagggcgcggccaggtataaacacagctgccgggcgttgcgcacacgacagcagggacccggaaaacatcagcggaggagaaaacagcaacacggggc

SEQ ID NO: 647373 - DNA, 262 bp, Homo sapiens
ttggggttgctctagaggatccccgtaggcagcgcagccacatcaatttcccaagcaatatccaaattgccgttgaaacgttcattctcgatatacaaataggaacggacgagagcaagctcctgttcaagcggaacaagctgctcggaattttgaaagttgaagctggatcgcaaataatttccgaactcatcaagcagaaggcgcattctgttcagattgatgtggcctcgctgcctacggggacctctagatcacccca

SEQ ID NO: 647374 - DNA, 409 bp, Homo sapiens
  misc_feature (5)..(5): n is a, c, g, or t
  misc_feature (25)..(25): n is a, c, g, or t
  misc_feature (31)..(31): n is a, c, g, or t
ctttnacccccccctgtgggtttgnccttgncccccggaaatttgggcctaaaaaccttagaaaaaatccttacatgataacctcagtgatgccttacctcatagtttttggtgtttctcatagataagatataaatcggctgggcgcggtggctcatgcctgtaatcccagcactttgggaggccgaggcgggcagatcaactgaggtcgggaggtcgagaccagcctgaccaacatggagaaaccccgtctctactaaaaatacaaaattagctgggcgtggtggctcatgcctgtaatcccagctactcgggaggctgaggcaggagaatcgcttgaacccaggaggcggaggttgtggtgagcgaagaatctgccattgcactccagcctgggcaaacaagagca

SEQ ID NO: 647375 - DNA, 147 bp, Homo sapiens
  misc_feature (40)..(40): n is a, c, g, or t
ggtatggtaaaggtggagaagaatagaataggcagtcaantaagatctgctcacaagttaacaatttaagacaatagacacttgaagtaaatatagcatgtattacgttatttgttaagccgttacacattacgaatgagcaggatg

SEQ ID NO: 647376 - DNA, 1274 bp, Homo sapiens
gaggacaatcccaaggcggtgagggcacagagcagtgaacccagcacctacccctgaagcagacgacgatggccgcagactactggattccatgcattctgagccgggaagtactccaccatgatccatgcaatgacggggcacgagaatcatggagcatggaacgcctaggtggcttcgctcgacttcagggccccacggtctttgtctgggaacatcggggacaacgcgtctacgattgtccaagtgtctacctagctggcgcgatccgcctgtctggtaatggtaggtgaagtacagtcttggcactatcgatcaccctgtggtaccctggatgcgctcaccgcgattcgctgcgagatgctgcgctgtgagcgcgaccccgtatggtggctcatcactgagttgcctgagggccactgtcacctagtgttcgctgctgaagagtgactcctacggtggccgtgctagctagccggctggcgctgcacaagcgccccgctgctacctatcagtccaaggtgattacgctgtgcctgtaccgagacctcagcggcatgttcaccactgagagccgcctgggtggggcccgtgacgagctcgggggccgcagttggcccggaggcctgagggcctgggctcagagactagccccacagtggatgacgaggagggagatgctgtatggggatgcgggactcctcttcagacccaaaaaagggaaccgagggccagacataatcaagacaagcagcctgaatgatgcggtgaccctagtaaacattaccggagcaaagagataaccaaatggatggcatgcaagatagacggcagaacatggaaccctatgaggatctaccagcttacccaacatggcaggataggtgaaccaggggacaggaaccataccacgcagcgggcacaagcgagccactgagtaggaacagagctcctctgggagagcgaccagaaacaaggagcacaggactacaatagaacgagaggccaagacaaaggagaacgcaagcacacaaggcaaaagaggacaaacgataagcgttaggaacgacaaacaaaccacaactagagcgctcaggcgaagcagaataacagagaagaccaaaacaacacacagaggacacaaccgataaaaggcgagaacacgtaaagaaacaacaaaaaaagggacataagtcagaaccaagcaacatacaaaaataagacacaagaggagcacagtccacgccagcatgagaaagatagacaaaaaatgt

SEQ ID NO: 647377 - DNA, 191 bp, Homo sapiens
attactactttgagtttatttaaacaggaaacaattttaagagagctataaagaaaacagagtacagagacttatttagagtatatatatatctagagtgttagcctatatcacctgatctaaaatgcattgcagtttttaacgcaacacgtacagacatattatctcaatataccttcagctttcataca

SEQ ID NO: 647378 - DNA, 257 bp, Homo sapiens
  misc_feature (30)..(30): n is a, c, g, or t
cagctgagccacgccaaccgccagcgcgantgaccctcaaacacctcaggagtgtccagggacggctgaaggatacgcagctccacctggatgatgccctccgggtcagggaggacctgaaggagcagctggcgattgtggagcgcagagccaacctgctgcaggccgaggtggaggagctgcgggctactctggagcagacggaaagggcccggaaactggcggaacaggagctcctggactccaacagagggtgc

SEQ ID NO: 647379 - DNA, 408 bp, Homo sapiens
gggcccatgacacgagcatggcttactgcaacctccgccggccaggttcaagcaatcgcctcagcctccctggtagctgggattacagaggcctgccagcatgcctggctaatttttatatttttagtagagatggggtttcaccatgttgcccaggctggtctagaactcctgacctcaggtgattcacccccccttggcctcccaaaggtctgggattacaggcataagccaccgttcctggcctcctaatctcttcttttagggacaccggctgtactggactagggcctcctacagtgatctcattctaccttaatcacctctcaaaggccctgtctccaaatacagtcacattctgagatattcggggttaaggcctcaatatatggattttgggacacacaa

SEQ ID NO: 647380 - DNA, 993 bp, Homo sapiens
catgtccttccttcttgttctatcgctgttcttttggcaagctgtgtttcacctacctctatttggtccatagcatgttccccctgggggcgcatgcccctactggatggtacaaagcgcgaagaggccccccgcgtcgaaaattcccggtttcgatgtcttgttccgatgtgcttgggcgatatcaaccgctttaattgtggacgccccttcgaaatgtgggcctcgctaaggcgataattttgacgcgggccgcttctctcgcttggcttggtctgggcccctggttcccatggggaattccgttctagaatggccgttagagcttgatgacttattggggaccatgcatgacaggtagttcacacatggggagcactaggtggattgagtatcgtaggacggggcttggcgcccgttcgtagccgttgtccggtccttcgcttgggcaaattttaaagccttggccacgagcgctctgaaggtattaggccccttgtcattgcttcagtgtagcacgaggggcagcgcgcggggacctcgtacacctctgcatgctgggcaacggggtctgctgagggtctgatggaactccagcagctcgtgacaactgggtatgagactgggcaatagagctcagtcacaggccatgggcttcctggcctagagtgaggtagacgcaggcggcagaggtgcatggaccacgatctccgccaagtcatctgcccagcagcgttatccgtcgtgtccccagcccacgtgctccttgggtgtcagcttcctcgtgacctactatgggagagagtcagctgccttgtgtatccgttctggggccacagcttgctgcaaagtcctggatcatgccacatcaaccctcgggagtggtgttcccacgtgctggctcccagagctttgaccagattgtgatcccagcgttggccccatatgttgtgttctggactgaggataacagcggtggactgcagtgttttt

SEQ ID NO: 647381 - DNA, 266 bp, Homo sapiens
gaacacactaccactaccaacttcgttctcaattatcacgtcggagctaagtgatgggaactcattacaacagagaagggaacaacagacactagggcctaattgaggacggaggagggaaaggggcagcaaaaataactattgcgcgttaggcttcataactggttgactgacaactacatctgtgtaacacaaactctcatgacaagacgttacctatactaagaacacccttcccatgtacctctgacaccctaacaattacg

SEQ ID NO: 647382 - DNA, 243 bp, Homo sapiens
agggttgtggggtggagggagaaagggctgggagggagtggggaggaattgctagctgtagtgtgacacattgtagtgtttgccaggaaaggagccagtcatgccggaaacattgatttttgggaagccacccgggtttcattcctcccgggggtgggaggcaacatttcctctttttacagaggggacatcctttttttttacaaatttttcaataaagacacatttttgagtgaaatccca

SEQ ID NO: 647383 - DNA, 434 bp, Homo sapiens
  misc_feature (45)..(45): n is a, c, g, or t
  misc_feature (86)..(86): n is a, c, g, or t
  misc_feature (121)..(121): n is a, c, g, or t
  misc_feature (137)..(137): n is a, c, g, or t
  misc_feature (144)..(144): n is a, c, g, or t
  misc_feature (147)..(147): n is a, c, g, or t
  misc_feature (166)..(166): n is a, c, g, or t
acacccagctcatcagaagaagaggagctgggtcagcaagctaangccggcaggaatttcagaaaccctttggcccaagtaagctntgggcaggaaagccttcggtcactgttggctacanagacccttcccctgtntcagctnagncagctcgaggcccccgacnaacacttgcaggggtccctgctattagcgccccaccgccgtggagttcgttaccgcttccttagaacttctacagaagccaagttccctggagccctttggcagctcttagctttgcagtcgtgtaattggcccaagtcattgtctcgccttcactttccaccaagtgtctagagtcatgtgagcctcgtgtcatctccggggtggccacaggctagatcccccggtggttttgtgctcaaaataaaaagcctcagtgacccatgagc

SEQ ID NO: 647384 - DNA, 118 bp, Homo sapiens
  misc_feature (16)..(16): n is a, c, g, or t
tggtggtgcacacctntggtcccaattactggggagactgaggcggaagaatcgcttgagcccaggagatggaggttgtcgtgagctaggatctgccactgcactctagcctgggtga

SEQ ID NO: 647385 - DNA, 163 bp, Homo sapiens
aaagctgcagtcgtggacatgaggcacagtcatactgagagcgcagtcgtaatggagagcgcagtcgtactgtatgacacagccgtgggagccatggagtgtcacaccatcaggtgcacctcctggaagggggattcaacagcctccggggggagtgctcttt

SEQ ID NO: 647386 - DNA, 361 bp, Homo sapiens
atggcatgtagtgaggacatgagacactgcaaagaggatcttgccatgatatagaggaacatcttaaagccggggcggagaagttcatggacaatgcctgagactggaaaccccttcaagcctctttgcctcatcatttaggtataaaacaagtgttctatacataaatgtgactttcaaatgctgtaatctggatgccaagtatgacaaccactctagtagaggaatgtgatctagcaaagattttaaaactaagcagaaaacagtagtccttggccatatggaaaggaacaaattgtaatagcaacactctggtggaagcagaggcaagggcaatcctaaaccaagaaactacagcaaa

SEQ ID NO: 647387 - DNA, 144 bp, Homo sapiens
aacaaattctcaaagatatggctgccttcaataacggcctattattttttgctttgagtaaccaactagcaaagagaatgttatgagaggtgctacaaataaccaagggactgcgaatttttcgcatgcggagtccttttgatc

SEQ ID NO: 647388 - DNA, 216 bp, Homo sapiens
cagagtatccccattcaatccgcggtgacgccactcctggtactgctgaccactcatagacgaggtcgtacactgttgctctcattcctcggtgaactccatctacgtccatgccctcgcctgtgtaccacctggacgccaaggccttccaggcggatacatggcatgtgcaactgctccgaagatccgcttagtacagctcctggcatggctcca

SEQ ID NO: 647389 - DNA, 166 bp, Homo sapiens
atttttcttccattgagttgcttttgtacctagtcaaaaatcagttgtgcatatttgtgtaggtctctattgtgacattgatctatttatctctctacaaataccacacagtcttggattactgttgctgtatgttaaatcttaaaatcaggtaaaactgagacct

SEQ ID NO: 647390 - DNA, 365 bp, Homo sapiens
tcctgaattgtgtggtgttatgaatggagaatacctagatacttttataagaaagaacgacgcgagcttcgacaccatacttctatttatgtatgctagccaaaagagtatatcgatgctcttttggtggacaaaacatgttatgtctccattaaaaagaagcccaatgcatcattttggaggtccatgatggtacgtatggcccacacatgaatagattagcactcgctgagaagattttgaggcttaattactttaagcaaggacttgagtaggattatatgtcctacgttagacgatgtcatgaatggaaaatatacgcaaatcttaaatatattccagcctcgttgttatacaacataaca

SEQ ID NO: 647391 - DNA, 277 bp, Homo sapiens
  misc_feature (86)..(86): n is a, c, g, or t
  misc_feature (151)..(151): n is a, c, g, or t
  misc_feature (183)..(183): n is a, c, g, or t
  misc_feature (190)..(190): n is a, c, g, or t
  misc_feature (245)..(245): n is a, c, g, or t
  misc_feature (253)..(254): n is a, c, g, or t
ccgagcgcgtgccctgccgccacgacgacgtcttctttccgcctagtgcctccttccgcgtgggctcggccctgcgctagccccgnggtgtccgcagcatctcggctctgggccggacgttcacgcgcgacgaggacctggctgttttccncgcccccgggcctacgcttccacggccgggcnctgacgngggccccgaggactgcgcggaccgtcgggcgcgtctcggcaaccggagccaccgngatctgcnngccctgctccacccctgggcggc

SEQ ID NO: 647392 - DNA, 543 bp, Homo sapiens
  misc_feature (5)..(5): n is a, c, g, or t
  misc_feature (385)..(385): n is a, c, g, or t
agagntgtgcagacacaactacgagctgagcgggcccatgtctctgcagcgccgagtccagcctagggtgaatggttccttcttcaagaaggggcccttgcacgcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgngggcttcgtgcttgggctcatcatctgtggagtgggcatcttcatgcacaggaggagcaagaaagttcaacgaggatctgcataaacagggttctgagctcactgaaaagactattgtgccttaggaaaagcatttgctgtgtttgggtagcatctgg

SEQ ID NO: 647393 - DNA, 492 bp, Homo sapiens
  misc_feature (137)..(137): n is a, c, g, or t
  misc_feature (141)..(141): n is a, c, g, or t
  misc_feature (144)..(144): n is a, c, g, or t
ctacgagctcaatacgaatcatgtcatagtgttactgtgttaaattagtatcgcgcaacagatctgggtttaaaggagagctgaattggtttaaataggctcccttggctagatatgtagagactcgctcatcaganccgncanggctcatgaaatgccacgggtcaggaggatcccagcagtggacctttgggaaaaacaatcggctataccaggtgtcggttggacagtgctgagagcagtgatcacctgtgaaaagtagtaccgagctcgttatggcgatctgcgatggctcctcttcacagcagtggcatttggaaggttaaggtggatgctgtggcgggaacgttgcttcatcaggcgttgcctccggtgtggagtttggggctttaggaaagcctgggttgggtggagcagaaccatcttggagaagatgacagttccctgtcctcccggagatgcctgggtgtgttagcagaggtgacacgtgtc

SEQ ID NO: 647394 - DNA, 492 bp, Homo sapiens
  misc_feature (137)..(137): n is a, c, g, or t
  misc_feature (141)..(141): n is a, c, g, or t
  misc_feature (144)..(144): n is a, c, g, or t
gacggtatcgatggatgcataaggactgtgactaccgtgcaccccaacatcagatctggatcatataatgaagagtcatgaattggtataactggtctcctttgtcacagatatgtcagagcactcgctcatcaganccgncanggctcatgaaatgccacgggtcaggaggatcccagcagtggacctttgggaaaaacaatcggctataccaggtgtcggttggacagtgctgagagcagtgatcacctgtgaaaagtagtaccgagctcgttatggcgatctgcgatggctcctcttcacagcagtggcatttggaaggttaaggtggatgctgtggcgggaacgttgcttcatcaggcgttgcctccggtgtggagtttggggctttaggaaagcctgggttgggtggagcagaaccatcttggagaagatgacagttccctgtcctcccggagatgcctgggtgtgttagcagaggtgacacgtgtc

SEQ ID NO: 647395 - DNA, 87 bp, Homo sapiens
tcttcttactacactggaagtctgaactgggtgcctgttaccgtcgagggttactggcagatcaccgtggacagcatcaccatgaac

SEQ ID NO: 647396 - DNA, 305 bp, Homo sapiens
ctttttaccctaagttagagacagagaggggaaagcatgtatttgtaaagaacgaggcagcatttcagaagtgcttaataattggacctgatttcaaatgggtcactctatatggtttatttaaacacagtgatttgtaagtttctgcacgaagtacgtagtctcaggagaatagctgtacctctgatccacacattaggcatgattagaaaacacaagggtaggaaatacagttttattctttcagcatgacagaaatagcacactatgtagatctaatatctgacatatagatacattaatat

SEQ ID NO: 647397 - DNA, 146 bp, Homo sapiens
tgagggagagagagttaaattccaaacactccagacagaggacactacatttttctcgctggtgatattcagaaaaaaaaaattcatttcaaagcctttgctaattcttcatgctgctgatggtagagactaggtataaatggctg

SEQ ID NO: 647398 - DNA, 108 bp, Homo sapiens
tcactctggggaagggatttataaatattagcctttgcatttctcagcctttgcagtcttcccattagctgttctcacgtatgcgtcagcgagcttggggctttgggg

SEQ ID NO: 647399 - DNA, 309 bp, Homo sapiens
cgtcggcgataagcagagataatgctactgctgttccatagggtctgcatttgtagtaggttttatactgacgtatgcacaacccattaactgataacagctttcaattaatagtctacaagactactacaagaattaccaggaaggagagaaccaagatggaacagatggggcagtggaatcacaaactagaacccttggattaaagacatcttctgtggccgggcacagtggctcatgcctgtaatcccaacactttgggaggcgaggcaggatggtctcgatctcctgacctcgtgatccgtcgac

SEQ ID NO: 647400 - DNA, 805 bp, Homo sapiens
  misc_feature (191)..(192): n is a, c, g, or t
  misc_feature (202)..(202): n is a, c, g, or t
  misc_feature (211)..(211): n is a, c, g, or t
  misc_feature (219)..(219): n is a, c, g, or t
  misc_feature (230)..(230): n is a, c, g, or t
  misc_feature (265)..(265): n is a, c, g, or t
  misc_feature (276)..(276): n is a, c, g, or t
  misc_feature (281)..(281): n is a, c, g, or t
  misc_feature (284)..(284): n is a, c, g, or t
  misc_feature (290)..(290): n is a, c, g, or t
  misc_feature (297)..(297): n is a, c, g, or t
  misc_feature (299)..(299): n is a, c, g, or t
  misc_feature (301)..(301): n is a, c, g, or t
  misc_feature (303)..(304): n is a, c, g, or t
  misc_feature (306)..(306): n is a, c, g, or t
  misc_feature (308)..(308): n is a, c, g, or t
  misc_feature (353)..(353): n is a, c, g, or t
  misc_feature (357)..(357): n is a, c, g, or t
  misc_feature (375)..(375): n is a, c, g, or t
  misc_feature (457)..(457): n is a, c, g, or t
  misc_feature (473)..(473): n is a, c, g, or t
  misc_feature (486)..(486): n is a, c, g, or t
  misc_feature (516)..(516): n is a, c, g, or t
  misc_feature (518)..(518): n is a, c, g, or t
  misc_feature (520)..(520): n is a, c, g, or t
  misc_feature (527)..(527): n is a, c, g, or t
  misc_feature (596)..(596): n is a, c, g, or t
  misc_feature (627)..(627): n is a, c, g, or t
  misc_feature (650)..(650): n is a, c, g, or t
  misc_feature (679)..(679): n is a, c, g, or t
  misc_feature (708)..(708): n is a, c, g, or t
  misc_feature (713)..(713): n is a, c, g, or t
  misc_feature (760)..(760): n is a, c, g, or t
ttttaaattcatgcacttttactatgcccattgcacttctcatccatggatttgccttgccttaagaattaaccatggccttgtggctgggtgacccagttgacttttatcttgcacagctaaagagggtctgatgggtggctcaacacccacccactcctataccatgtcatcagtgttcacattttccnnatgagttgangtgccttgntctgtccnctgccaccacnaccagtgctgagttttcccatgtggttttgctttngtggtgttacngcctngcngcagancggggantntntnngnangcctccagcctgggacctcactcagttcccagggtattcaaaganggcngcggctcccattccagtnccgatgcacatggacaccactccgtatgctctcttcccacggcgcttcagctcattgagcagcgtgatgtacctgttgtgcnccagtgcagctcagtnggtgctctatggncactgcaccccccagggggttcaccttctngngngggagtngtagcttctccacacagtaggcagcctggcttgcaaaggcctcattgatctcgaagatgtccacgtcantcactgtcagccctgctttttgcaaagctantggggatggcataggcaggtccnatgcccatgatgtcaggtgggaccccaancactgcataagacctcaggaccccaaggntgggnaggcccaactcttctgccttggacctccgggccaaccaggatggcanctgccccatcactcacctggctagagtttccagctgtggtagaac

SEQ ID NO: 647401 - DNA, 433 bp, Homo sapiens
  misc_feature (8)..(8): n is a, c, g, or t
  misc_feature (28)..(28): n is a, c, g, or t
  misc_feature (48)..(48): n is a, c, g, or t
  misc_feature (115)..(115): n is a, c, g, or t
  misc_feature (171)..(171): n is a, c, g, or t
  misc_feature (176)..(176): n is a, c, g, or t
  misc_feature (192)..(192): n is a, c, g, or t
  misc_feature (368)..(368): n is a, c, g, or t
  misc_feature (398)..(398): n is a, c, g, or t
  misc_feature (409)..(409): n is a, c, g, or t
aatccctncaagaaaacgggaaaaaacncccaaaacacccaaaagggnccctagttcctgtagaagacattaaagcaaaaatgcaagcaagtatagaaaaagcgcattgaacagncccgggcacctacatgtaaattaagcccaaagatggggagaaaggaaaaggagagncaaanatagtccatactgagngtcatcaacaatccagactgaagttttttattttaatctcaatccccttttttgatttgccacccatgccttttcaggctggaaacaattttttggttccctaaagcacttttttttgactgctgtgattcagtgaaccttgccctttgctttttattacttgggcatttgcctcncctgacaatgttttaaatcgcctttgtatntccttagctgntcaataaatatttgaatgcctcca

SEQ ID NO: 647402 - DNA, 864 bp, Homo sapiens
  misc_feature (1)..(1): n is a, c, g, or t
  misc_feature (103)..(103): n is a, c, g, or t
  misc_feature (117)..(117): n is a, c, g, or t
  misc_feature (123)..(123): n is a, c, g, or t
  misc_feature (125)..(125): n is a, c, g, or t
  misc_feature (144)..(144): n is a, c, g, or t
  misc_feature (147)..(150): n is a, c, g, or t
  misc_feature (152)..(154): n is a, c, g, or t
  misc_feature (159)..(159): n is a, c, g, or t
  misc_feature (777)..(777): n is a, c, g, or t
  misc_feature (838)..(839): n is a, c, g, or t
ngcggtgcagaaggcggcgcccggctcccagaggtattcccagacaggcaactatgaactagctgtggccctctcacgctgggtgttcaaggaggagggtgtnctccgtgtggggcntgtgtncnatcatcgggtgggcgaganagnnnnannnaatgnctacactgtaactgacctagtggagtatagcatcgtgatccagcagctctcaaatggcaaatgggtcccctttgatggcgatgcattcagctggagtttgtccgcattgatccttttgtgaggaccttcctgaagaagaaaggtggcaaatacagtgttcagttcaagttgcccgacgtgtatggtgtattccagtttaaagtggattacaaccgggtaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaaaaagtttttcccctttgaattgctaaaattgcattttcctatgtncaatcatcctctcatttctaaaataaggacttgccaggcacggtggtcatcctgttatccnncccttttggaagccaagcggcggtc

SEQ ID NO: 647403 - DNA, 1153 bp, Homo sapiens
accacgcgtctgcccacgcgtccggtggagaagggcgaggagctctcctgcgaatgatgctgaaacctgctctcatgtagcctataacgaactgtgtgtgtgtgctgtgccacgagtggctgcctgtgagtgtgttgcttgtccatgtatttgatgcatgaaaatgcaactgatgtgatgggctctggacgtgatgaacatgtgtggccctgaagtgttgctgtagatgttacctgtggatgaatgtgttggacgaccattgatgcgtccatgtggcttgttgttgctgaataacctgatgcattgtgtgccattgcattggaacatgccacgctccatcaacagtgataggacctggagtgaaccgccctgaggatggcgcgtgggctcctatctaccccattgacacgaacttgacatgtgtgttgaccataacataacctgggctaacctttgtgccctggacggtgatagtgaccaacgctgatgttggacctggaaacaaactggaaatggctggcatccacctttggaacctgccatgacaccctgggatacatggctgctacccccaaggtgactgcggcccaattgcgatccaatacaacggcagacagacacacggagaaggaatttgcgcaggccagcaaagcgaccaaaaagccgcgccgcgagatttcgcaggaccctttgggagagaccccatttgaggtcgaccacgttggaacaacgcgtgttgtagtaccctggataacattatgccccaaaccgttagccgggaatggacggtacctggcgcgacaaagagtagaatggcgcaccacacaggaattggtggaaacgtgtgatagcaacagttcccgttcccagtgccgcatggtgaggaacgaccaacagaagggacaagcaaccaaagaccgatgtgaatacatgtcccgggaaacgtcaggcgacagtaggcggccgcccgaaacgataggggagtcgcctgggaaaatatccgattgggcactaatccatgaagacaccgtcccatctcgtaagggccaggacatgggttgaatccagttctcccaggtaaatgctcacaagaatagcgacaacgacgggcagcgagacacagaccgctattcctaggagtctaaattgtggc

SEQ ID NO: 647404 - DNA, 819 bp, Homo sapiens
  misc_feature (732)..(732): n is a, c, g, or t
  misc_feature (793)..(794): n is a, c, g, or t
aaactaggctagtcgaggctgggtgtgaatcggccgaggctccgctgtggacgtcgtgtcgtcctttgtctggtgtccgagatagcccctaaccaattgcctgacgcgtgtcgactgatcgctatgtggagttgtacgctgtacttgtatcctttcttccctctactgtggcaaatgggtcccctttgatggcgatgcattcagctggagtttgtccgcattgatccttttgtgaggaccttcctgaagaagaaaggtggcaaatacagtgttcagttcaagttgcccgacgtgtatggtgtattccagtttaaagtggattacaaccgggtaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaaaaagtttttcccctttgaattgctaaaattgcattttcctatgtncaatcatcctctcatttctaaaataaggacttgccaggcacggtggtcatcctgttatccnncccttttggaagccaagcggcggtc

SEQ ID NO: 647405 - DNA, 762 bp, Homo sapiens
  misc_feature (270)..(270): n is a, c, g, or t
  misc_feature (395)..(395): n is a, c, g, or t
  misc_feature (762)..(762): n is a, c, g, or t
ggtgggtgggggacgggccgaggcgatggcggagaagtttgaccacctagaggagcacctggagaagttcgtggataacattcggcagctcggcatcatcgtcagtgacttccagcccagcaggcaggccgggctcaaccaagaagctgaatttgtattgttactggcttacaggatattgacaagtgcatgacaggatgcttcatgatattactgtaccgttacgcaaggtttttcgaatatatacgcatcaacggtcaacatccccanctctacaccaaagagtgcctggcagagggctctagctaaaaatgagcagttataaggcaagatcgacagccataagaaatttagaaagcctgttgattcaagaactttctgaaagatatttccgngaagtacagtgggctaagctatcgagaggcatccggggggcaggatcgacccgccttcttaagccagctcaccctccctgtgtgaagatcccctgggactgcgatgcggcgttgaggctgggactgcgagtgcttgacgccaccttcctgctgaggtgggactgggccctggacacatccctcagcccctctgtcctcattgtttggcctcatgggaccgaggggctggaggagaggcggagctgtgccccagctgttccagcagcttgtctggcgtcaactggctttcagagtgctgacccctcatcactgtggggatcattctctctgagggcagatgacggcgcaggaaaatagtcttggaaan

SEQ ID NO: 647406 - DNA, 225 bp, Homo sapiens
gaatgtagtgttctattgaaggtatacgttcccttatttatctatattgcttgtcatcctatgctagtaaatacgcaagcgtctagtgacacattgcctcttctgatatcataggagtagctttcatagtgaaaaatgtagaactgtatatgtgtacgtgtcagaaatattctagtagggtcaggtgctttggcttagttacagtatgggggcagagatagtagt

SEQ ID NO: 647407 - DNA, 145 bp, Homo sapiens
gaaaaaaagatttttacaaagtaataaaatttaaactgagctgtttaatgtagctgttttgacctgtctgttcttgtccaaagtggaacattcccaggagaagaggaaggttccactcggttctttaagtcgccaaaagaccaag

SEQ ID NO: 647408 - DNA, 700 bp, Homo sapiens
  misc_feature (24)..(24): n is a, c, g, or t
  misc_feature (62)..(62): n is a, c, g, or t
  misc_feature (64)..(64): n is a, c, g, or t
  misc_feature (124)..(124): n is a, c, g, or t
  misc_feature (139)..(139): n is a, c, g, or t
  misc_feature (150)..(150): n is a, c, g, or t
  misc_feature (175)..(175): n is a, c, g, or t
  misc_feature (199)..(199): n is a, c, g, or t
  misc_feature (238)..(238): n is a, c, g, or t
  misc_feature (270)..(270): n is a, c, g, or t
  misc_feature (274)..(274): n is a, c, g, or t
  misc_feature (292)..(292): n is a, c, g, or t
  misc_feature (299)..(299): n is a, c, g, or t
  misc_feature (321)..(322): n is a, c, g, or t
  misc_feature (327)..(327): n is a, c, g, or t
  misc_feature (331)..(331): n is a, c, g, or t
  misc_feature (333)..(333): n is a, c, g, or t
  misc_feature (478)..(478): n is a, c, g, or t
  misc_feature (568)..(568): n is a, c, g, or t
  misc_feature (571)..(571): n is a, c, g, or t
  misc_feature (606)..(606): n is a, c, g, or t
  misc_feature (663)..(663): n is a, c, g, or t
tctttcacaaatggttcccctttnggcttaatgacccatatacttcatttctgggtgaattngnggaaatattacagaacacgctttgtacaatacagccccactactgggaagggctcggggntttgtgatccagggntctggcttaangcaaaaatacacggcatagattgcnacagccaagaagtgtccaattaanactggggggttggggggcaatacgggaggcggcccaacngggcccgcaacacattcgccacccggtttggnatanagaaaacaggcttttctnagttgangcgggggatcatctgtggcggnnaattnttcntnaggggcctgggccggggtattcacgacaaaggaatgagatgtttttcttgcccagtaaaatgattttttggcctcgaaaatagctgcatcatcataaaggtcagggataccctttagcagttttctccatagttttatatctttnaaagcaacagtcattcctccaccagtaagtggatgcctcatattatatgcgtctcccaaaagaagaacacctcgtttcttcactgatganggnggaaggaagcttgctggcatggacctcagatgagnattgtcagtggcttctaagaatggttctttcaggtgatcaggtatttgtggggtaantttttcaaccatgtattctcttaaattccttggcatt

SEQ ID NO: 647409 - DNA, 601 bp, Homo sapiens
aaaaaaaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacccgggggggggcccgggacccaaattgcccaaaaggggggccgaataaaaatcaaggggcgggggttaaaaaaggtggaaacgggaaaaaccggggggaacccaaataaaaggccttggaaaaaaacccccttttggcaagggggggaaaaaggaaaaaggcccaaacgaagggcctttcaaaaaaggggccaacccgaaagggaaaagggaaaatggaaagcgtaaaaattgggaaaaaatcggggtaaaattttggaaaaaaaagctaattttaaaccaaaagggccaaaaggggaaaaaccctttaaaaataaaaaaaataccccgaaaaggggtgaagggtggcccaagttggtataggggaaagggcccaaaagggaaacaataacccaaaaaaggtttttgggggaaaagggcccgaaaagcataaaagggaaacccaaaggggaacccccaattaactttgcggggcccggcagt

SEQ ID NO: 647410 - DNA, 419 bp, Homo sapiens
ccctgtcgcagacaacagcagtttcttggagaaacactaagcagcagttccagcatgcagcaactgctgtatatactcaggtggttttgccggctcagcgctccctaggccctgggcggctgtgtgctgtgcgcttcagcctcaggcttcaactctggcccctttctgaccttaagggaggcctaggagtgctgaaagatggaaccgaggaggctcatgctctgtcccacagcacagagctgggctggggcaggggcagaagggattctgctgggagcttgggctcaggaacagttcacctgcagggagtgggacgcgcatggcccagtgccctctcccatcagcccgtgtgatttccgttggaccagtgtcctctcccatcagcccatgttagttccactggaccacgtcctggctgt

SEQ ID NO: 647411 - DNA, 172 bp, Homo sapiens
ttgtggctaccctgccaagcgcaagagaaagtctaactggtacgtgccaaggcttagagcatgaaataccaccggaactgttcgaatgaggcacctaacatttgtataccgcagattcaggcattgattccgtgaaggaactacacctatacccgagagggccgctgttgca

SEQ ID NO: 647412 - DNA, 175 bp, Homo sapiens
  misc_feature (4)..(4): n is a, c, g, or t
  misc_feature (6)..(6): n is a, c, g, or t
atgngnagtgccgcctgctcacacacgtgcccatgtggagtgcccgcctgctcacgtgcccatgtggagtgcccgcctgctcacacgtgccgatgcggggtgcccgcctgctcacacgtgcccatgcggagggcccgcctgatcacacgtgcccatgcggagtgccctcctgctc

SEQ ID NO: 647413 - DNA, 1609 bp, Homo sapiens
ccttggctgagtgtgcccgggcatgacctgcatcgtctcgtcctggtagctcctagcgattagtcctgtgcctgcgttgcttcgtgcgactttgtggacagcctgccgtgtccttgcctgtgtgcgcacctgtctcggtccctgcgctcgcttgtctcgttgcttgcgtcctgggtcctccgtcctctgtggtctatctactctagtcgctccgtggtgcctgcgtgcctgttgtccgtgtggtcctgcgtccgtgctggcgttcgttccgctattcctttgtcgtccgtgtgtgtgcttgcgtttccctgattttgttgtgcttctccgttcggctgtcgtcttgtgttccctgtcttttctctctgcttttgtgtctcctgtccatcttgcgctctctctcgctgattgttgtctccttatcttgtttttgtttcgtcgtttggtctgttgcttcggcgcctgttcgctgggttgcggtgggtcccttcctcttgccctggtgtttttccgtcgcggtctcgcgtgggactgtggtgactttggattctgtgtgtgtgtgtggtgtcggtgcccgattgtggtgtgcccgtcttgccgtttgactgggtctgtctctgctgtgttgtgtttctttccggctcgttctctcctcccgtttccctttcctggtgctttccatctgcgcttggcctgtgtcgtgcgtgctctttgggtcgtgcgtgtggtggggtgttgccgcttgtcgctttccctcttcggttctttgcttcggttgggccttgtccatttctgttctatggtccttgctacgatgcgctcttgttgtcgctcgcttcccttcttggttctattgctattcctggtttgtgttttcctatgggtagcgtttcgttctgttgtatatgtcgcatgtcgttgtgcttatgtggtgtctcgcctctcttgtgaggtgtcgccctccttggtgttggtctttgggtcttattctcgctggctccccctctggctgtgcctcttccccgttggtgccatctggtgttgtcccctgtgtgtatcgttttcgatctgtcgctgtgtcgtggtccattctgtcgcatcggggctgtgtgtggtgtgccgtcctagtacctcccttcgcggtcgttctgcccctatgatcgtcttgtgccagcgcgtaggcgcgtctctctggtatctgtagatcccttgaccactcccaccgggtgatcctctgtgtggtctgccagggcgcgttggttctgtggtcctcatgtcgtctgtctggtctcatggtgggtcctgtctaggtaggtgtaggagcctcctgcaagcctgcattgtaggatgtcagctgtgctactagctgtccgtctgtgaactatgaaggtacttgccctcagctggaccccctgcctgctcgtacatcctggctgaggcccagtctccgcacacatgagggcctggggcttgcatggagatccgggactgtctgattgaggacagtgacgacgaggcgggcctagagctgagcgtgatgatcgtgcttgccgggacatgcatggcagtggccacctgtacaccacataacgatgccggaatggcaagg

SEQ ID NO: 647414 - DNA, 90 bp, Homo sapiens
ctagaagattcagcaaagtacttttgtgctcttggggaattatacaagacttactgggggatacggaccttgtacaccgataaactcact

SEQ ID NO: 647415 - DNA, 392 bp, Homo sapiens
agcggggaatcacttgaggtcagggtctctctctgttgcccaggctggagtgcagtgacaccatcttatctcactgaaacctctacctcctgggttttagtgattcttctgcttcacctcgcaagtagctgggattacaggcacacctgtaaattatgccaacatgcctggctaatttctgtaattttagtagagatggggtttggccatgttggccaggctggtctcgagctcctgacctcaagtgatccacccaccttggcctcccaaagtgctgggattacaggcgtgagccactgcgcccggcctgcacatatatttctaattctattgggtatatacctgagagtagaattgctgagtcatatggtcacttaatgtttaatcttttg

SEQ ID NO: 647416 - DNA, 549 bp, Homo sapiens
  misc_feature (506)..(506): n is a, c, g, or t
  misc_feature (548)..(548): n is a, c, g, or t
tcagagtctggcccaaagaggcagtctggccacagtctgccacagttgctatgctgctgttgggaattcctcctaggtcctaactatccagtctccccagcactggcaggggtcaaacagcagactggagcctcagtgatggtggctgcccctccctcaggaagctcagttgtcttaggcagcagacagccacagtgattatggccacccctgcccctggaaacttggtagtcttaggcagtctccagccaagtggctgcttgggaagtctgcacagctccctgcttggtacccaaggccctggtggcattgggctcacaagggataaagggccaagatggcttgacttagaaacagcttgcaagtttggaaggcttcccaccttgaaaggaaaattggtaagtgaatccttgcaccagcaacttgaaagcatccaggttctcttcacttgggacttgactaaggtggtccccacaacccatggagaacaaaggaaaagcacagtngtgtgaccgcctaccttgggagccacattgggggaaagaggng

SEQ ID NO: 647417 - DNA, 798 bp, Homo sapiens
  misc_feature (12)..(12): n is a, c, g, or t
  misc_feature (46)..(46): n is a, c, g, or t
  misc_feature (84)..(84): n is a, c, g, or t
  misc_feature (105)..(105): n is a, c, g, or t
  misc_feature (110)..(110): n is a, c, g, or t
  misc_feature (122)..(122): n is a, c, g, or t
  misc_feature (137)..(137): n is a, c, g, or t
  misc_feature (149)..(149): n is a, c, g, or t
  misc_feature (153)..(153): n is a, c, g, or t
  misc_feature (162)..(163): n is a, c, g, or t
  misc_feature (174)..(174): n is a, c, g, or t
  misc_feature (182)..(182): n is a, c, g, or t
  misc_feature (186)..(186): n is a, c, g, or t
  misc_feature (191)..(191): n is a, c, g, or t
  misc_feature (234)..(234): n is a, c, g, or t
  misc_feature (242)..(242): n is a, c, g, or t
  misc_feature (254)..(254): n is a, c, g, or t
  misc_feature (263)..(263): n is a, c, g, or t
  misc_feature (290)..(290): n is a, c, g, or t
  misc_feature (305)..(305): n is a, c, g, or t
  misc_feature (364)..(364): n is a, c, g, or t
  misc_feature (366)..(366): n is a, c, g, or t
  misc_feature (368)..(368): n is a, c, g, or t
  misc_feature (382)..(382): n is a, c, g, or t
  misc_feature (392)..(392): n is a, c, g, or t
  misc_feature (396)..(397): n is a, c, g, or t
  misc_feature (427)..(427): n is a, c, g, or t
  misc_feature (480)..(480): n is a, c, g, or t
  misc_feature (613)..(613): n is a, c, g, or t
  misc_feature (662)..(662): n is a, c, g, or t
  misc_feature (684)..(684): n is a, c, g, or t
  misc_feature (772)..(772): n is a, c, g, or t
aacgggcgagtncccaggctcctccagctccttccgtcctcttccncctcctcctccacctccggcttttgggggatcactgtnctctctcggcagcagaatganccggnaggtggtccgcnccagcaagtcccgcnacgtgtctgganagcnggccaaggnngaccgagtgcnatgaagangtgngcgtntcgacagatccacctggagacgagtggcttctgtgcggtcaancctaagtntgtggccctganctgtgaggncagcgggggaggggcctgcctggtgcngcccctgggcaagantggagcgtgtggacaagaatgcgcccacggtctgtggccacacagcccccgtgcaaganancncctggggcccgcanaatgacaaantcanngccagtggctccgaggactgcacagtcatngagtgggagaacccagacagggggactgaagctgcccctgacgggagcacgtngtcaccctggagggccacaccaagcgtgtgggacattgtggcctggcacaccacagcccagaacgtgctgctcagtgcaggttgtgacaacgtgatcatggtgtgggacgtgggcactggggcggccatgctnacactgggcccagaggtgcacccagacacgatctacagtgtggactggngccgagagggaggcctcaattntacctcctgccgttacaagcgcgtgcgcctcatcgagccccgcaaaggcactgtcgtagctgagaaggaccgtccccacgaggggacncggcccgtgcgtacagtgttcgtgtc

SEQ ID NO: 647418 - DNA, 214 bp, Homo sapiens
catgcgccacctctgttgccccagttctctcctgattgaccctctgcgactgtgcctgtcttaggttgttccttccctgaggaatcttacccgtctctggctatacagcatccaccgggtgcaaacagggtgacgtgcagtgtgtgagtgagggagaggaagcgcccccgagggggtcaggatactctgtctccttggtaagacttattaccac

SEQ ID NO: 647419 - DNA, 758 bp, Homo sapiens
ctccagtcgaggacctctcctagtaccactgacgagcggtggacaccatgcctgctgtatctcccccaaaccgagtccttgccctgctgcctcctcatacccacacggctggcagagaccttcaccatagcgtatctgctcaactccagaaccttcctgacctccgctagttcctgcgggccttatgccctgcttcccaggtgcaccctctcccgtggatggacagcctcagacccccgacagcactgcggcagtgctcggtgcctgctggggtgctgttccatgaatcacaccgatacaaacattctagaccacatataccaacacacatcaaatacacagtaccaagttactccggaggagtatgaagggattagcatattacatgcaacaagtacatgtacacggattacagcagctcacaccgtcatgatcaaagaccatcaattatggagaatcgtcgaacaccaagacacaaaaacaagcaggcaggcagacacaagcaagtcgagcgatattgcaagatcgaagacaccacgcgatagcagcttgctgcgaagcagcgtggaatatgtacattccaaattgactaaatctttgatttataacacgagcatataatgcgtcgagatatggaggaagatcccgaccagaagacgaccatggggcccaatgtagaagagcaagaacaaagagagtgatagacacattacgaggaatagagagtacaacgagcgacgtgaagaaaggcaagtcag

SEQ ID NO: 647420 - DNA, 215 bp, Homo sapiens
  misc_feature (1)..(1): n is a, c, g, or t
natctagaggatcccagtgctactccacaacaggcagcgtaactacacaacaccaagcattatttgaggtgcatgagaataggtgaacacagcctaacaccatttaggtttttgggtttttttcagggttgcctctaatttaattttattagatgagagagtctcttagacttcttctttgtaaggaaaggttattgggaagtgtgaaaaaagat

SEQ ID NO: 647421 - DNA, 1101 bp, Homo sapiens
  misc_feature (363)..(363): n is a, c, g, or t
  misc_feature (572)..(573): n is a, c, g, or t
  misc_feature (586)..(586): n is a, c, g, or t
  misc_feature (671)..(671): n is a, c, g, or t
  misc_feature (742)..(742): n is a, c, g, or t
  misc_feature (773)..(773): n is a, c, g, or t
  misc_feature (874)..(874): n is a, c, g, or t
  misc_feature (878)..(878): n is a, c, g, or t
  misc_feature (930)..(930): n is a, c, g, or t
  misc_feature (973)..(973): n is a, c, g, or t
  misc_feature (1010)..(1010): n is a, c, g, or t
ggaggagaatcccggaggcatttcgggtctttgccaaggatgcaatggttatatcagggcggcggaattacgtcacgtcatggcaactttaggagaaaaactaccggatggggaattagatgaaatgatcagagaagcagatatggatggagacggacaagtcaactatgaagaattcgtacagatgatgactgcaaaatgaagacctactttcaattcgtttttcccccctctagaagaacccccccccccctttttttttttttttttattaaaaagaaaaaagaaaaaagttcatttattcattctgtttgtggatggggaaaaaaaaaaacaaaagtaccttctgtccacacacacaanatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgnnaaaacaaattcanaacctattcaaatgggttctagttcaatgttgtctagtataaattgtctatagctggtttactgaaaacaaacacatttaaaatnggtttatccttcacccatttttctgcacgtcatcctgaggtaaaccaattttaaatgtgtttgttttcagnatgacgtgcagaaaaatgggtgaaggataanccgttgagacgtggccccactggtaggatggtcctcttgtacttcgtgtgctccgacccatggtgacgatgacacaccctggtggcatgcccgtgtatgtnggtntagcgttgtctgcattgttctagagtgaaacaggtgtcaggctgtcactgtncacacaaatttttaataagaaacatttaccaagggagcatctntggactctctgttttaaaaccttctgaaccatgactnggagccggcagagtaggctgtggctgtggacttcagcacaaaccatcaacattgctgtcaaagaaattacagttacgtccattccagttgt

SEQ ID NO: 647422 - DNA, 1038 bp, Homo sapiens
  misc_feature (363)..(363): n is a, c, g, or t
  misc_feature (572)..(573): n is a, c, g, or t
  misc_feature (586)..(586): n is a, c, g, or t
  misc_feature (671)..(671): n is a, c, g, or t
  misc_feature (679)..(679): n is a, c, g, or t
  misc_feature (710)..(710): n is a, c, g, or t
  misc_feature (811)..(811): n is a, c, g, or t
  misc_feature (815)..(815): n is a, c, g, or t
  misc_feature (867)..(867): n is a, c, g, or t
  misc_feature (910)..(910): n is a, c, g, or t
  misc_feature (947)..(947): n is a, c, g, or t
ggaggagaatcccggaggcatttcgggtctttgccaaggatgcaatggttatatcagggcggcggaattacgtcacgtcatggcaactttaggagaaaaactaccggatggggaattagatgaaatgatcagagaagcagatatggatggagacggacaagtcaactatgaagaattcgtacagatgatgactgcaaaatgaagacctactttcaattcgtttttcccccctctagaagaacccccccccccctttttttttttttttttattaaaaagaaaaaagaaaaaagttcatttattcattctgtttgtggatggggaaaaaaaaaaacaaaagtaccttctgtccacacacacaanatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgnnaaaacaaattcanaacctattcaaatgggttctagttcaatgttgtctagtataaattgtctatagctggtttactgaaaacaaacacatttaaaatnggttcagnatgacgtgcagaaaaatgggtgaaggataanccgttgagacgtggccccactggtaggatggtcctcttgtacttcgtgtgctccgacccatggtgacgatgacacaccctggtggcatgcccgtgtatgtnggtntagcgttgtctgcattgttctagagtgaaacaggtgtcaggctgtcactgtncacacaaatttttaataagaaacatttaccaagggagcatctntggactctctgttttaaaaccttctgaaccatgactnggagccggcagagtaggctgtggctgtggacttcagcacaaaccatcaacattgctgtcaaagaaattacagttacgtccattccagttgt

SEQ ID NO: 647423 - DNA, 268 bp, Homo sapiens
cgcaagattaaccccctaataaaattaattaaccactcattcatcgatcctccccgccccatgccaacatctccgcatgatgaaactacggctcgctccttgagcgcctgcctgaatcctccaaatcaccacaggactatctcctagccatgcagtactgcaccagactgcctcaaccgctcttttcatctaatctgctccacactcacgtctgtaggactgtaataagttatggctgaatcaatccgctaccgttcagcgccgaatt

SEQ ID NO: 647424 - DNA, 330 bp, Homo sapiens
gtgtgtgttgtacctgtgtgtgttggatgtgatttctgtttagtaggagattgagatgactgtaaatagtttatgctgattccttcggtctgcaaacatacatttgtgttggtgctgatggttctcgactaatccggttccaattacaaataggttatgtttttcaaataaaacttctggcacttatattcaggtctcataagtcacatgcatctcacacatacacacacacacacacacacacaccagaacacacacattaaagcctatccctactacactatttaatactccatactgagatgtcacactttctagacacattctctc

SEQ ID NO: 647425 - DNA, 613 bp, Homo sapiens
  misc_feature (22)..(22): n is a, c, g, or t
  misc_feature (133)..(133): n is a, c, g, or t
  misc_feature (162)..(162): n is a, c, g, or t
  misc_feature (240)..(240): n is a, c, g, or t
  misc_feature (301)..(301): n is a, c, g, or t
  misc_feature (372)..(372): n is a, c, g, or t
  misc_feature (378)..(378): n is a, c, g, or t
  misc_feature (385)..(385): n is a, c, g, or t
  misc_feature (390)..(390): n is a, c, g, or t
  misc_feature (434)..(434): n is a, c, g, or t
  misc_feature (496)..(496): n is a, c, g, or t
  misc_feature (498)..(498): n is a, c, g, or t
  misc_feature (503)..(503): n is a, c, g, or t
  misc_feature (507)..(507): n is a, c, g, or t
  misc_feature (512)..(512): n is a, c, g, or t
  misc_feature (515)..(515): n is a, c, g, or t
  misc_feature (540)..(540): n is a, c, g, or t
  misc_feature (548)..(548): n is a, c, g, or t
  misc_feature (589)..(589): n is a, c, g, or t
caggagacacgtgaggcatgantcggcgggggtcattaattatcccggcgaccaccagcctctgtccgggtgggcccgaggggtggggcagcgggcttccctgaccaccagcgtcaggggtgacccagccgcngcagagccagggaagggggcggtgccgancctccttgaggacctccactttgagggccctgtcagggacaggcctcaagtgaaaccgcatccaaagaaggccaagcnagaaggagccccggggttctcctggcggaggtcccggtataaagaactccgctctgctggnagagggtgggtgaggccgagagttgccctgacttggtctccaaagtcggggaggacacaccgaggggtganaaaatngggagtngaganggatggggactaccaggcgggtggccaggatgggaggggctgtnaggtcctggaggggcagggacgtctcttggggcaggctcggagcctccagaagccggcagcnanaaganaatngtctncanggcggggccgggcttccggtgaaangaggacanaaccccggagaagggcccggggccggactccgccggctgcnaaacttaaagtagtgcggccgcgc

SEQ ID NO: 647426 - DNA, 1283 bp, Homo sapiens
  misc_feature (447)..(447): n is a, c, g, or t
  misc_feature (565)..(565): n is a, c, g, or t
  misc_feature (625)..(625): n is a, c, g, or t
  misc_feature (866)..(866): n is a, c, g, or t
ggagacatgagttggtggtaatatgtgccacgttcttctaagaagggggagtcctgaatcttgtcatgatagcccttgatccgtagatgccttgaactacgtttctataatagtctgatgaaggtcgagtggatccttattcgctgtcgttttagtagcgtgacttcatttcctgtgcttcctagcaatcatgagtgcttttgcttgatgtgatacgccggatctctcgtatctctcgtttctgttcaactttacttctgcagtttgggcgctttgtgaatacgcgctgtaaaccgagtaaaggttgtagataattcgatacgtttccatctcaagggagatgacccaagtattcaatactagcacaaatgcagactagatgaagcctagagagagcagctggcactttatgtaattgtttagagtcgctatcataattgaaaacgngccttactctctaaagataaagcgggacaggtctactccgtttactttttacaatcatactctaacgttccatcgatatagcgaattataacaaaatggggtccaacgtcgcccattntttagggcttttgaaccccctggggcgtcgaattcacctaggagaggtggcgtccttccnaaaagtgctttcgtgggaccccctagggagcttttgtagaaacgagacattgcttgctgagtagagaacgcagtaatagatgaaacaggctcaactcagtttccctgctcttgtcatcttggagacttacgtgtgcaaacacacgtacacggccagaaagagttaagatagttactctccctagtaagaagctgacgacttgtaatactttttatatctaatttgacttcatctcgtgtgnaggagtatcgagactatgcgtaacccaaagaaatccccattggatatttcattccccaagcgaaaaatggggaagtcgtttcaccattgaatgtacttgaggatatacatcgtccttaaaaggactgcaagtggtgtacaaagacactaagttgctaaccacgcgacagggaagatattgggacaaaatatctagttgcgtttgcccgtgttggctgatacatgcacaaggttcagttcaggtgtaatgtcctttggagaatggggagcgggatagattctcttctgacattaacaggaaagacttgaattgacgcaaagaatgaggttctatgatcttgcccagagaaggaaatttttatcattatttagaaccacagaatggaagtatattaaggaggatagtcatgtgtaaacc

SEQ ID NO: 647427 - DNA, 557 bp, Homo sapiens
  misc_feature (39)..(39): n is a, c, g, or t
  misc_feature (52)..(52): n is a, c, g, or t
  misc_feature (91)..(91): n is a, c, g, or t
  misc_feature (168)..(168): n is a, c, g, or t
  misc_feature (172)..(172): n is a, c, g, or t
  misc_feature (220)..(220): n is a, c, g, or t
  misc_feature (224)..(224): n is a, c, g, or t
cgttgccacaggcaactcagggagagtccttctgactcncacatgtgtgttnccctggcttcacagactccacttctccactagaaagaanctggtgtcaatatggaagctatggagcagagagagaacaagatattccaaactctaagtgattcttctttgacatcnatanaatatttgagtctggcttgggagaagaatgagaggcttacaactgatnacgngaagcatgtgatgtgagagagcaatcaaggagtgtggctacagtaaggctagatgtaagagggaaagtcggactgtagtctctcagtgtgtttgaagagaggggttggctggcttcttctcctggagaagcagaaatctggtccttgtttactgaacttctgtggatcagctactaccttcagctcagtgacagggcctgaggctaagatctaggtcactggctgggatccagaaggctagaacctaagggggaaatacgaattgcctaatacacaaataaagatggccacaggaacctcagacagacacagttgcttcttgtccaaggtgac

SEQ ID NO: 647428 - DNA, 1047 bp, Homo sapiens
ggcgtactaacggcttccgtaaggggactacgtcggtcgagtgggaactgataattccggtcggtgcaccatggcggataccactggtggaccctcggcacttcgatagtaatatgggcgcctatgcctcatcattcctagggatctggaccgccaagtcccgacttatgggatcttgaggccctcaagtctcatatagtggtcagtgaaggttgtatcaatatacatattgaggaatgatctagctatgagaccagaattgtggcttgataaggatgatggttgggagtaagggactggtgagactggggaactgatgatctggatgtgtagggaacctgtatcattgatggttggatgtgctgttcggactaattgagattgggcaaggtggatgtatgtgtgtgtgaaagtcatataggagattgaaattgcagatgggatgtgggacgatgattgtgcaaggtcttgcgcgacctggtggacgaaaacagcgtgacctagtgtgcttgtcaggtcggaagcatatacagccaatctacgaatatagccgagtgcgcggatagagcaaggcggctctgcgttttgcggcttgtgacatcgaccttggacagagatcagcggattagccgtgccgttgttttgcatactcaagggcaccaccgcaacccgcttgagttatagaacctgtttcaaaaacagtgctggggcatgccaaacagggggtacacaacacgtttgtgcatccggagcacgcatcgaggtgacaagtggtgtggagatggccgggctctgagtagcagatctggaggccggagagaccgttgcactttgacgcttatcgaacgtgtcaaggccatgttgggcggcatgttgggtggcagaactctggattggaggcttcatgtggggccaatggtttccgtcgccgacacggtgcgagcaaatggggagagcgcgactggtggccatgccagggaacccgaaacaaacaagaagtggcaaccttggagacgacctaccttggcaggatggaggaacgacaag

SEQ ID NO: 647429 - DNA, 434 bp, Homo sapiens
tttaaaacgcgccgtggttttcgctcatgaatgacgcagttcctgttctcttgttaactaagagaggcataatatgcagcatgagtagtagacttctgtagaataattagagaccttgagggctttagtgcttactccaagaagcggagcatgtattcaaccatggctattccttcagaagacttcagcttttttgaatcatcttattaaaggggtggataaagtttgcttgtcctagatctattgagcatgggacttggacgcggggatcttcagccagtcctagttactgtgttttgcaaagcactttaactatgtaaaaggaatcttgctttatgtaatcaaccttaggaagaaccacacctttctgcactcaagcacagcgagaagtacgtaatgcgtgaaaacaaaacaactttgcattaaaatccatc

SEQ ID NO: 647430 - DNA, 340 bp, Homo sapiens
cgagcggggaaccggctgattgtgtgcaggtgcagtggaacaaaccactccatggcatgttgataaacagccacatggtgaaggaatagggggccttctccagcatgttcttctataggttaccccacagaaattcacaccataggctgggcgccatggcgcatgcctgtaatcccagcactttgggaggctacagctggaaagattgtttgagcccaggagttgaagaccagcctaagcaacgtggtgagagaccccctctctacaaacattttttttttttaattagccggccatggtggcacttgcctgtagtcctagctacgggggaggctaaggc

SEQ ID NO: 647431 - DNA, 463 bp, Homo sapiens
  misc_feature (413)..(413): n is a, c, g, or t
  misc_feature (426)..(426): n is a, c, g, or t
  misc_feature (429)..(429): n is a, c, g, or t
  misc_feature (431)..(433): n is a, c, g, or t
  misc_feature (437)..(437): n is a, c, g, or t
  misc_feature (440)..(441): n is a, c, g, or t
  misc_feature (445)..(445): n is a, c, g, or t
tatgttggccaggctggtttcaaactcctcacctcaagtgatctgcctgccttggcttcccaaagtgctgggattacaggtgtgagccactgcacccagccaatatggcagttcttatgttttagtttatgaattagatttagaaaatctcaacattttagtgatttccttgaccaagaactgtcttgctcaaaaagacatctctgaactgacttgtatccaagttgctattaccggaagcttaacatgcctagcccctgagctttccttttaaaggtggttcatcctcttctaatgtttcctgcttcagtgaattgtcagcattcccctttcagttatacaagttagaaatacagaagtcttccttgacatttttccttttcctcctccataactacctgttcccagttggnttttttccctccngancnnnctgntannctgnttttcactgctgccaccc

SEQ ID NO: 647432 - DNA, 439 bp, Homo sapiens
  misc_feature (389)..(389): n is a, c, g, or t
  misc_feature (402)..(402): n is a, c, g, or t
  misc_feature (405)..(405): n is a, c, g, or t
  misc_feature (407)..(409): n is a, c, g, or t
  misc_feature (413)..(413): n is a, c, g, or t
  misc_feature (416)..(417): n is a, c, g, or t
  misc_feature (421)..(421): n is a, c, g, or t
atgggttgcttggtttggtgtggcagcagtgaaaagcagaatagcagacagatcaggagggaaaaaaacccaactgggaacaggcagttcttatgttttagtttatgaattagatttagaaaatctcaacattttagtgatttccttgaccaagaactgtcttgctcaaaaagacatctctgaactgacttgtatccaagttgctattaccggaagcttaacatgcctagcccctgagctttccttttaaaggtggttcatcctcttctaatgtttcctgcttcagtgaattgtcagcattcccctttcagttatacaagttagaaatacagaagtcttccttgacatttttccttttcctcctccataactacctgttcccagttggnttttttccctccngancnnnctgntannctgnttttcactgctgccaccc

SEQ ID NO: 647433 - DNA, 750 bp, Homo sapiens
tatgtcgacccacggccgtcgccagatgcacccagtcgtggctgcatctgggccctccctggaagttgcccattctctgtcctcgtgtgtctccgccctcagcaaacaccacaggactctcccagacagcaacccacgtgcagcagccatgaccggcacttcccagcactgccgggccactgcctggagtacacacctggccccaaggggctgttccgtggcaaggagcacgccctgggaggcgccagccgttgggaaatcagacagagtctgctccacctgggaaagccacacggagctcagctggactcaggctctgggggaggaagctcaggcgcctgatcgctggggcaaagcagctggagtgccggagagaagggcaggccctgacagcaggcaagggttggcctgcacccaccaggctggtctcctcaccggactgagggcctctcttccccaggcacccaccatgctggtctcacaggactgaggccctctcttccccaggcacccaccaggctggtctcaccagactgagtgccctctcttccccaggtccctggccggcctccatgtcctggtcccgggccggcctccatgttctccacactcagcctcagtggatcactggacagactgcagggagtctttgccagccttggggtttttcctccccaggttccagttctcccacaaatgccctctgtcacctctgagaagtacaggaagagccgtgctcagaggtccaat

SEQ ID NO: 647434 - DNA, 348 bp, Homo sapiens
atgggaatttcgatcaagttttcaaccccccccaaattaggggcctggatgccagcagctgaatcaactgggttttcatccctaatgattaagagaatatgagtgacatagaacttcattttcttaccatatatggtggcttgtgaggttatttttccccctaatattctagaagaatagaagaatattctagaaaaagagttaagcattctaaaattacaaatctctttttttaatgattttgaaaagctgatgaaatcatatatattattgcctctgtttcatattaaatgaatatttttattttaaaggcataaataaaaaaatgattgtgtactaaaaacaaaa

SEQ ID NO: 647435 - DNA, 523 bp, Homo sapiens
  misc_feature (31)..(31): n is a, c, g, or t
  misc_feature (34)..(34): n is a, c, g, or t
  misc_feature (60)..(60): n is a, c, g, or t
  misc_feature (76)..(76): n is a, c, g, or t
  misc_feature (110)..(110): n is a, c, g, or t
  misc_feature (117)..(117): n is a, c, g, or t
  misc_feature (221)..(221): n is a, c, g, or t
  misc_feature (223)..(223): n is a, c, g, or t
  misc_feature (497)..(497): n is a, c, g, or t
taacagatttgggtggcaattcttcaaccanttnttttggctgtagattccctgtcaccnattttttcttcaaagntcagcttagatgtgttagaatgaatgaaataggntgggcgntatggctcacgcctgtaatcccagcactttgggaggccgaggcaggtggatcacctgaggtcgggagttccagaccagcctgaccaacatggagaaatcccgtntntactaaaaatgcaaaattaggctgggcgcggtggctcacgcctgtaatcccagcactttgggaggccgaggtgggcggaacacgatgtcaggagatcgagaccatcctggctaacacggtgtaaccccgtttttactaaaaatacaaaaaattagtcaggcgtggtggcgggcacctatagttccagctactcgggaggctgaggcaggagaatggcatgaacccgggaggcggagcttgcagtgagccgagattgcgccactgcactccagcntgggtgacagagcaagactctgtctc

SEQ ID NO: 647436 - DNA, 955 bp, Homo sapiens
gaagacggtcggctgggcaacctggctgaagatgccgggaaaatcgtagtgagctggtttggaatcagacacgaatgaaaaaggggagaactggaaagcaaacgaggagaaagagaaacaaagagaagccaaaatctgatacgactgaagagatagcagaagaggcagacactgttttccccaaagctaaacaagttacaaagaaagcagagccttctgaagttgacatgacttctcctaaatccaaaaaggcaaacacgaacgaggagccatctcacaatgacatttctcctaaaaccaaacgtttgagacagaacaaggagcccattgacaccgccagtggttcttctaaaaccaaaaaagtgacaaaacaatgaggagccttctgaggaagacatagatgctcctaagcccaagaagatgaagaaccgacacaggacactgactggagacacctagagacgaaacagccccaaactgagaatggatttctcctctgaacggactgtaaccccagtgaagctgcccctgaagaacgtaaccagtgagatagagcaggaacatacctgtggaacaccgagaagggctttctctaatttccatattgaagaaactaattaaattctcacaggcgaggagtgaccttcctatttcctataaagcaagacattccatatgttaaggggaaggtaattgacaggacgacacgacctggagacatctctttgcctccttttgctgaacctatgggactgagaaaggacaaagcgtgcctcagagttggacaacgagagttgaatagaatattcttttcaacgtgacgtgtatggacccatggcatgagcaaatagtagtcgtggcacgagacaccataatggacataaataggagagacagaatgattagagataaggctaaaaactgtacaaaaatcacaacggagtttattatcctc

SEQ ID NO: 647437 - DNA, 1521 bp, Homo sapiens
  misc_feature (521)..(521): n is a, c, g, or t
agcggacttgccgctgctctcggcagcccgatcggtcggcctggcgccgccttctgtcctgctagcgcggcgcgacgcgatagagcgtggcggcgcgcaggggagcccagcgcagagggccgcgacgcggcgagcgagcgcgtcagcggaacggccacgaaggaagtgaccgcgtcacgcatggcacggggccgtccggcagctcatgagtagggagaaaaggtgcgtcgcgggatacctccgctggtgcgccgtccgtggactcccgggaagctccggccggtattggccggcaggttcgatcgcgggaatcaggatcggacagtcctgtccggagctatgacggactgagccgccaaacggccccgagcgtccattgcagaatggctcggagtgaagcaattgaagcatttgccggccattctttcgtggcccacagactcaatgcaacgaagagaaaccagggacctctatggtttggcccccaaattccacccaacaagcctttggacccctcaagngacgcataaatcatgaacgggtatttgcccacctttttccccattggcacccgaaggtcttctccggaagttgcgtggaaacccagagacaaagaggcgcctattttgtgggaacaccaacgtcttaggagccaaccatgggagagctcggttagcagttggggcgcaacaatcctttttccaggggcccccgaatacaaggctaagctgggacattcgctgttggccatcaccaatattttagcaccagtgttccgacaccgtgtccagaaagtccgatggtcaaagttggcgcacacttatggcggagagatgtttgtctcggcgccaacgtaattatcgcaaagagactttatggcctggtgtggagcggtaatagagtcgatctcatatccccggcatttggtgtagcactacaccgagatgtggatacaacgcctttttccataaccgggttggaaaacccgtttctttaagcaccccgtggaagctatactagtccctttcggactatcaaagaccctatgtgcccaatttcccgtccagaaccccttgggtttcccaaaggatagcccgttacaacatgattggacacgagggtcacatagccacactcgcaggatgatgatacattatttgacacgcgtaacacaggcttaaccaaggggtgtcattcaaattcctcgggacttgtgcaagggtaagtccctctcacttccaggttgggggcccccccaattttcgaaagtaagtttaccaaacatatatcacagggccgtttgaaaaaattccccagttacgagagtatccccccagattcggagcattccttgagacgagaaagctcggacgagccaccccttttgtcttcaacacgggtacagaacgttacactgccgatagcgccgggggagaaatttccacgcgaagttaattctttatcgcgagaatagtgccaaggcgcaacacgtataattgaggcgggaccaaaggaatgtcg

SEQ ID NO: 647438 - DNA, 241 bp, Homo sapiens
tgggccagaaatcgacactacggtgagattaggttcaatgaaagtgagcagtagtagaagctactggatggctttaagacattctatgatgaaatgactagcgatagtaggtaagtacagtagttctaagttacttaattgaagccctcagaagttgctaagaatttatctgataaatctgcctttgcacaaatgtgatactgatgcatggacggctcaccggaatgacctttttggggtg

SEQ ID NO: 647439 - DNA, 146 bp, Homo sapiens
tagaaaacatttgagagttaaaacatttagttttaacacagaagtatatatacataggttgtattaaaactaaatgttttaatacaacctatgtatattacttctgtgttaaattttgctttgtcattaataacaatttaacaaat

SEQ ID NO: 647440 - DNA, 282 bp, Homo sapiens
caacgcacaaacacaggggattggccggcttttcggagccggcggagcaggttactcgcacgcggatttggctggcgtcccgctaactggtatgaaccctctgtctccttatataaatgtggatcacgagaatacactgcgagtaggatacacattgtgtacttgtacgcataccgtaactattacacaccgggtcatatttcacctgaccttctgcacgatggactgatttagtgtgacaatgcctgcgttagattgcatagttgctgttctgcttaggga

SEQ ID NO: 647441 - DNA, 127 bp, Homo sapiens
tatgcctctccccaatggctgaccatttatatgtgacctttctggggtcaactgtgtgcccactgaccagcctggtgctagccccaaattcagtgctgtttggccctggatctagactctggtgact

SEQ ID NO: 647442 - DNA, 178 bp, Homo sapiens
cgcgcttggggaggaaaaagagaaagaaactccttggccacaatgatggaaggatgaatcacgtgcaaataaaaaggccaatcaatggtgtggcagcccccatcatcctttccatcctgcccctacgagccactcatgagagccccgcaacgagccacgccaggagccccaccatgcg

SEQ ID NO: 647443 - DNA, 590 bp, Homo sapiens
ctgatctgctcgtcccggaatacacgcgggagagaaggaagaagaaaatccatctgaagcggtgcgtcttccttctgtgacttgatgttggtaactgggtgccattgaatagagctgaagccaaagtgggatgttttaaaggtgctataattttgtttgtttccttttaaaatagggtcagaccgaagtcagaattgctgaagcagggtgcctgaattaaccctatatgtcctgctgttaattttacctaattacgttttctaaataaggaaagataaagaactcatgagcaggtttctggaaccaggatccatgaataattttggttgagttttggatttggaatttttctgccttatttgcacagacagtttgtacactgtttctcagacctaaaaaataggtagttatgtaaaattccttgacattgtagtttagaacaaaattctaattttgatgtatgtagctcaagcgaagctttaggaagaaattgttatatatactcttaggtgtgagcataacagcccaacccatttttttttttgggatggagtatctgggctcccagtcgcttttcatgcaatcccatt

SEQ ID NO: 647444 - DNA, 249 bp, Homo sapiens
cggttgactctaaggatccccttccccggtcatctcattagattaggtgagaaattacacaggtcactacatgtaaagcatctttagcagggccgggtaactaacaacacttcaccggtgttacgaactactctaagtaaggggccaagtcatgagctgcacaaaggcccccaagacccagaggggtttaatgttaagcaaaaggccgccgggtctcaggtagacactcagccacggctagccccagtc

SEQ ID NO: 647445 - DNA, 202 bp, Homo sapiens
  misc_feature (8)..(8): n is a, c, g, or t
  misc_feature (142)..(142): n is a, c, g, or t
ctaattgnttcttcgatgacgttcatttaatcagtcatttgatcatgcatttgtttattaattaagcacatactttctcataaagtatatgatgtgtagaatcataaaaaaataaaaagaaaatccctggattcatggaggntagattaactctttctcataaatatgtgccatgggacagcgtcatcgaagaaccaattag

SEQ ID NO: 647446 - DNA, 102 bp, Homo sapiens
gcccggattggcgcgctgcgcaatggaggcagtgtcgtgcgttgtgctacccgatgtccgagccgacgtgctgggccgaggaccacatcgcgattactggca

SEQ ID NO: 647447 - DNA, 621 bp, Homo sapiens
ggagggtatgtgaaaaacaaaaaagaaagaagaaagaaaaaacaaaaacaaaaaaaaaaagaacaaaaaaaaaaaacaaaaaaaaaagaaaaaaaaaaaaaaaccttgtctgccgattagcccacattacttttaacctcgacaaatcttatgcttggggccgaatttaaggctcattgggcaaatggcccctatggggggtccttttacaattcatggcccgcagtttaacaactccggaattggaaaaccctggggataccccaattaaagcgcttggaatcaaatccccttttgtcaacttgtctataatgcaaaagggcctgaccggaacgcttttccaaacagtggccaaccttgaaggccaattgaacatggtagcgctgaaattttcggaaaaactggggataaatttttgtaaagtcatctaatttttgaaccatggggcgaaaaccggataatccctttataaatcaagggatttgcccgaaatgggtgtgagtgtttgtccatttgtgaacagtccacttttagagaactagcctccaagcgctaaggggagtcgttctttgaggccaagggccaattgcgggaaccatcccctttaagcccccttatctt

SEQ ID NO: 647448 - DNA, 249 bp, Homo sapiens
ggttcgccgaccgttgactattctctacaaaccacaaagacattcgcacactatatctatttatttcgggcgcatgagctgggagtcctagggcacagctctaaggctcctttatttcgagccgagctggggccagccaggcaaccttctaggttaacgaccacatctacaacgttatcgtcacagacccatgcatttgtaataatcttctgcatagtgaatacccatcataatcggggggctttggca

SEQ ID NO: 647449 - DNA, 244 bp, Homo sapiens
cgctgaccgggtgggagtacggaatactggaccacgtatagtggtgtgtctgactcacagactgtgctccacttgtcccagcacacttcacttaaaaaacacaggttcaaaggccagattgttaagaatttcaagatggcgacagcagcgcggtggtcacacccttgaagctgattctgcctgtgccatagcaggacgcatgcttcccttgtgcgtgattacggatttcttacggggatcctca

SEQ ID NO: 647450 - DNA, 927 bp, Homo sapiens
  misc_feature (124)..(124): n is a, c, g, or t
  misc_feature (305)..(305): n is a, c, g, or t
ccatgagtgagaacatgcttgcaccgccgcttctaaatgttttaaaaacaaagacaccaatgcccttcattggggaaatgaaagacttttaagtaaaacgattttgagtgaaataatatttgtngttttaaaaagttaatattaaccactctccatcatatgttgaaattatcttaagatgtgaaagttaaaattagaaaccttgtaaaggaaaaataggaaatagtttcatgaacttgacacaggaaaatatttcttagactagatactgtagcactcaccacaataagaaatcaagcgaattncacttcatttttaaaaagcttctccttattatgttgttgtttaacaacttaaacgctatctctagaccaggaataattatttgctatataatacagcaaaaaatatgtatgtataaatggactcattcaaaatatataaagaactcctattacaaagaaattgacaaacagcccagtatatcaatgaatataaaaatttgagaagatattttccataagaagatatctaaatgaacattaggcatgagaaaaccaaattttaggatatcactacacacctggtgtagtttaaaagactgaaaatattaagtgtgtgggaatgtagagcaactgaaaatggcctacatctttcatagaaatgtaaaacaatacaaatactttgcaaaactctgtccaacattttctacccattcaccaagcaactccatccctagctatagatacccaggaaaataagtatgtatcttcacagaaataattgtatgagaatattcatagttacttatgcacagtagttaccaagtaaacctgtctcccatcagaaaaatggatatcaaattgtgtgataatcatacaatcaataggatattacttggccaaaaacaagaaacaagggcggccg

SEQ ID NO: 647451 - DNA, 711 bp, Homo sapiens
cttacggcgcatgccagtaatcagtatgattggccaggctctagcagtcacatgaaccaacaacaggatccgaggcgatgacacaatgactgatatagtctcgtagcctcttaacagaacacacatatagctccctatagcggatgtcgccggcgctaccggtggaacaatagcccttgccggagtactctgacaaccaggcgagtctggtatacgaggcatcacactacatctgactctaatggcaatgctcagacccgtcagagtagttgacgtactgatatgaggcatagtaatgacacgcgacatgctgactactgcaaacagacctgaacatgatcattgcgtacttttggatcacacacatagacatcgtcggatcagtgcttcgcatacataccatctgaaccttcacagtagcagtcattcacatgttctgcagacgcactgacttactcatgactagacacgctagcacactcatgctacaaacggactcacagtgggatcataattagctagtaaggacctcagactgtacttacgctaataggactgtgacgacgtcctagtagtagtcgctaatcatcgccgtacgcccgactatcagcctaattgcagcaccgtgagctatgagccacgctcgtctgaccagtactcgactacttaccgtactcacgatactactacaggcctatgatgcctctacgt

SEQ ID NO: 647452 - DNA, 310 bp, Homo sapiens
cactataacagaagttggtatacactcaatacaaacaatacaaactgggattataaatgccggctgggcgcggtggctcacacctgtaatctcagcaccctgggaggccgaggcaggcggatcacctaatgtcaggagtttgagaacagcctggcccaaatagtgaaacctcgtctctactaaaaataccaaaaaattagccgagcatggcggcacatgcctgcaattccagccactggggagcctgaggcagcaaaatcacctgaactgggaagggggaggttacagtaagccgagattgcggtgtttg

SEQ ID NO: 647453 - DNA, 1009 bp, Homo sapiens
tgagggggtcctatcgtttactgcgttgctctccgctctagcaatccatatgaacggtgtctcttagtgcttcctccttaacgtgtgattcccacctgttcgtgtgaccgcgggccgaaccattctaaagttccgttaatccgttggtatacttttggaacccccgttcctgtttcagtgacccctctgtccaggccgcagggtgcaatttcgtccgaccgaaatggtaagtgctgtaatatccgcgctatgttttctttgttgtgttcttatagtttgggtatcctcgttggaggaactccagatggtgtgagcggtccccacttcttttccgtgccggcagtttggtgcgtcttcttcccggtgccttcatggacattcaacttgtaatgtgatggatcgacccctgggggtcaggtcgtcttacatcgtgatggggacaacagaacggcttccataggaagtcctgtcccttgtcgttctctcggtaccttgtgcgctatcatgccgcggccactacacgctcatgcattaccctgcctttcgctaggtgccaaaaggcaggggaccaacttcgatggaaagtacgtttcaccctccaggactgatgccacattgtgctggcctgcgtgtggctccatggagcggagtctattgcaacgcaaagagtgtccatgatcttttgcctccttttgcccatcagccaatttgcctatcacgccaaacaactcagcttcggggccggatgaaggggaggggcctcccccagcacaggaatgacggagcagtctgggggtaggcatgctctgtgccagtggcccccacactcccccttcccttggagggagagggtggcaggaatacttcacctgttcctctccctacaggggcaggtggtgagaggggcgcccagggttgtctttgtgtatgggggaaggcgctgggtgcctgcagcgcctcaccttgtctcagatggtgtgtaacagcactgcgattgttgtaaatgctt

SEQ ID NO: 647454 - DNA, 108 bp, Homo sapiens
  misc_feature (73)..(73): n is a, c, g, or t
tgctcgagtatgtgtgtgacagtatcttatgtggttaatacatttcagtaccacacagtgtctagcttcatantgtgttactgccacttagagatgaccagtgtgtgc

SEQ ID NO: 647455 - DNA, 188 bp, Homo sapiens
gagctcggcccgactttctaaaaggatgataaataggtgcaagtggagcactcaagtgtgatgacgtgccctcacagtggaactggagtgagaagctttctgacctcataaactgaaggctatcttcagctcattgttttatatattttaccgtgcattaataccacatataacccccaacgaggtaa

SEQ ID NO: 647456 - DNA, 661 bp, Homo sapiens
  misc_feature (138)..(138): n is a, c, g, or t
aggaaccaagaaaacttctttgtcaactttacagatatctgtaaactattacatcgtcagcccaaacatctccttgcatttttgttggctgaattgggtacaagtgggttctatagatgggtaataaaaccaacttgntaatccaaaggaagaatcccaacagaaacagatagaaaatgtctgagaagatatatcaggaatatgtcactgtcacacatgccgatcaccggacacatcctgcgaaggacccgactctattctacaggcgaactgtcatctagatgtcgttgccagtatcaaaccggttccaggctgtcacgggcaagcgagcacagctccgtgccaaagctaactaattgctaatcactgatttgcaaagctgtgtggagatgtggctggacaggttgccatcagagtggatataccgtgtattaaaaacaagataaaaaagctgccaagatttggcgagtggtggtctgaagtccttgcagacgctgatgctcaagctgtgacatactcatgctactttaacaccgtcgagaaacgtgatatggggtaaggaggtgcttttttaaaatcgttcatagacttctgtaaaatgcaagataaattaaagttattataacagtgaacaaaacacaccacaccaccaacaaaaagg

SEQ ID NO: 647457 - DNA, 541 bp, Homo sapiens
  misc_feature (6)..(6): n is a, c, g, or t
tcctcncctgtttcaacagagctgtcaaaaaatggggaaggtgcttttaggtatttgggaatgggagatagtcatatccccccccagtgccaagtgaattcaatgatgtttcccagaacacacatttgagacaggcccataattattgtagcccccccaagaaaaatccatgtgaagttcagccagactttttgccaaataatgcctgcgttaaaacattaaacttggaaagtccgatgaagactgatattttcgatgagtttttttcctccccagcattaaatgctttagcaaatgacccattagacccccctcatttcgatgaatatttgtttgagaattattgaattaaagcctgttaacttttttcaaaaaaaatttattattattaaaaaaacttccaatgtgttcaggtagtgtttataccctgggcttgtgtaattacttgtgtaataaccatgaacaaaatgcaaggtttaacctttggttttgcccataaagcatgtaattttttttacccattaaaatccctgaatgttta

SEQ ID NO: 647458 - DNA, 900 bp, Homo sapiens
  misc_feature (65)..(65): n is a, c, g, or t
  misc_feature (76)..(76): n is a, c, g, or t
  misc_feature (81)..(81): n is a, c, g, or t
  misc_feature (93)..(93): n is a, c, g, or t
  misc_feature (130)..(130): n is a, c, g, or t
  misc_feature (163)..(163): n is a, c, g, or t
  misc_feature (758)..(758): n is a, c, g, or t
gtagacggtagagggggaagagttagagaaggggggaaggaagggggggggcctcgttggtgacngggcgcgaggncctcnggggggaggacnactgcagtcctccatgatgttgcccttgggcattttncactaggggggtggggggagtcaaagcattctncaaagcatggcaagacatagccatgtaaaacactcaccagattttcatgataaatatgggaatgctgtgctagccaggggaactggtttctgtgtggctacatgggggggtacagccactcatttttttatagggggggggctatcccctgggggccagttacccaaaaagagtggagacatcagtaaccagcacaggtgctggaatgacagaattgggtaaaaaaccaacttggggtgtggagcgctctactggttgattaaatatagcacatttgaaaaaataagaaggggggtgaagtctttaaagagaaagagggagggtgcggggaggggcgggggggagaggggagagaggagggggggccggggggcgctaagggtgggggctgtgggcgccggttccttttgagggggggggagtctacggaacctcgggaccgggagtcggggggggagggagtacgaggtgggggggcggggtttccccgcgcgagggggggagagcggggtggcgcagagaggaggggaggccgggggggaagacaatggcgacaaaggggcagaaaggggccgagaggccgaaaggggcgggnggggggccgtggtttctaagaggggggccgcgggaggaggtggggagaggtgagtcgggggggagaggggaagacccaggtggggatgtgggtacacgggtgtactcggggaagtcccttgtagcttgtgagggtcgccggg

SEQ ID NO: 647459 - DNA, 216 bp, Homo sapiens
cctcaactgcgcccggacgcccgggcccgcgtggttatccagtcagttcgctgctattcccatgggtcacaggagactgatgatggagtttgatgctcgctgggtaatatatttcaacaagccagatatagatgcctgggaattgcgtaaagggatcatcacacttgtgatcctatgtgatggttccagagcccaagaatcattgatgctgctttg

SEQ ID NO: 647460 - DNA, 410 bp, Homo sapiens
ggaggtggaggttgcagtgagctgagattgcaccactgcattccagcctggatgacagagcaaaaccctgtctcaaaaaaatgcagactggccaggcacagtggctcacacctgtaatccgactgtaagctcatcaccttgggaggccactgtaggaggatcaattgagcctagaagttcaagaccagcctgggcaaagtagggagaccccttctctacaaatagtaataaaatgaaccgggcatggtagcatgtgcctgcggtcccagctgctctgataagaggaggctcacttgagcccaggaggttgaggctgcagtgagcagagcgtgccgctacactccagcctgatgacagaccgagacactgtctcaaaaaaaataaaaaaattcagattgctgagaaaaaaa

SEQ ID NO: 647461 - DNA, 394 bp, Homo sapiens
  misc_feature (11)..(11): n is a, c, g, or t
  misc_feature (35)..(35): n is a, c, g, or t
  misc_feature (317)..(318): n is a, c, g, or t
  misc_feature (336)..(336): n is a, c, g, or t
  misc_feature (339)..(339): n is a, c, g, or t
  misc_feature (341)..(341): n is a, c, g, or t
  misc_feature (369)..(369): n is a, c, g, or t
  misc_feature (373)..(373): n is a, c, g, or t
ctgaaaagaanagaaaatacgtggagtaataagcnactctgagctcccttgtgaagaccctttatcttgtagagcccttagggcagctgacaccacagagtacaaaatggcagcggcttgttaagaaccaagacagacttggaaaatgatgtccaagggctaattcagctaagagtgagaggaaatccttcctctgcactgcaagttacccagagcagagaatgatgaaaactacaacggagcaggaaagagaaaggaagagaccaactcaggccaatttacctaaatctcccttcgcagattcttaaattctgatnnttccccgctccatatttntcntncctcataccacccctgtcgagagaaacntgcntacaggggtcctaggggccac

SEQ ID NO: 647462 - DNA, 369 bp, Homo sapiens
  misc_feature (71)..(71): n is a, c, g, or t
  misc_feature (92)..(92): n is a, c, g, or t
  misc_feature (120)..(120): n is a, c, g, or t
  misc_feature (309)..(309): n is a, c, g, or t
  misc_feature (322)..(322): n is a, c, g, or t
gaaaaggaccattagatcaggggttggcaaactatggcccacgaatcaaacctggcctgccacctgttttnatacaacctgtgagctaagantggtttatatgttttcaaatgattgggnagaaaatcaaaagaagaacaatatttcatgacacctgaaaattctatgaaattcagatttcagtgtccataaacaaaatgttattagagcatagccacacccattcatttatggtattgtctgggactgctttcttggcagagttgaatagttgggacagggacagtatagcctgcaaagcctaaaagntttactacttgtntccttaaggaaaaagtttgccagtcctgatctaggccaggggggggt

SEQ ID NO: 647463 - DNA, 231 bp, Homo sapiens
caagttccatagtggataattgtctgttgtagagtgaggctgtgtattgttagggagatttttgcattatggaacttatctgtgggttatagggcatgtcctggtgtgagtatgagcaatacagggcaagtcagtttcttgtaggttcactgtaggcattgtgaggaatatgtgtagtactctggtacatgactggctcttcaggcaactttaggtgttacggtaatattg

SEQ ID NO: 647464 - DNA, 181 bp, Homo sapiens
tgcagtgatctacaggatccgcagagggcgacccgagagggaactacaacagaggtggaatgcccaacagagggaactatcaaccagaacttcggaggacgaggaaacaatcgtggctactaaaatcattctgagggctacaaccagtggcagcagggtcaattctggggtcagaagccat

SEQ ID NO: 647465 - DNA, 128 bp, Homo sapiens
  misc_feature (7)..(7): n is a, c, g, or t
  misc_feature (21)..(21): n is a, c, g, or t
  misc_feature (32)..(32): n is a, c, g, or t
caaacanccccttcaggcccntccaccggttnttgccggtttcttttttttttcgctcaagaatgtgtctttattgaagaaggcggcttcccagaagccggtgtttccggcatgactggcttccgtga

SEQ ID NO: 647466 - DNA, 160 bp, Homo sapiens
aggcgaggagagcccccaggagcaggctggccattaagggcttgtgagccaagctgattagcccaaagtcaagctgcagtggcagcagggcacctgatatgactgccagttcataaccaacctgcccgggcggctcgctcgagccccttatagtggagta

SEQ ID NO: 647467 - DNA, 637 bp, Homo sapiens
cgtaatgtatacatacgttcaatacatcatgttgtacaccctcttgtacatgatttctagtcaattcaatagattcaacaactccaaaaaacaagacattctctttacaaagaataattattaaaaataaaattcagaattccattttatttattcgtttatttttgaaacagagtgtcgctctgtcacccaggctggctgaagtgcagtggtgtgatctcagctgactgcaacctcgctttccccgcttcaaacgattctcctgcctcagcttcccaagtagctgggattacaggtgcgtgccatcactcctggctaatttctgtatttttagtagagacagtttcgccatgttggccagcctggtctcgaactcctgaccccaggtgatccgccagcctcgacctgccaaagtgctgggattacaggtgcccaccaccacacccagctaatttttgtattcttagtaaagatgggtttcaccacattggccaggatgatctcaaactcctgacctaaggtgatccgcctgcctcggcctcccaaggtgctgagaacacaggtgtcagccaccacgctgggctgggcatagcattgtatcacagacaaagcacaaaatacttgggcaatcaagctt

SEQ ID NO: 647468 - DNA, 245 bp, Homo sapiens
  misc_feature (135)..(135): n is a, c, g, or t
gtggtgttaccgttggctgtggatataggtttgatcctcagcctggtgcagctgggtttaaaaggatcctgtcttaccacagctgtggagtagatcacagccgtggtttgccatggtcccacggcacttctatantgtctagtgggtaacaacacaaacaaacaaacaaacaaaacaaaacaaaacaaaaaaacagaaaacaacaaaaaaacctgcagtggctcagttggctgtggaggtatagg

SEQ ID NO: 647469 - DNA, 138 bp, Homo sapiens
gtgctgggcaagagcagaggtatgcagattcaggagcggtgagagaataccaagcaaggcagagggaagcacagctcactaggcctctggaatctcaagagggactgccaggagctggtttcctgggtctccatcctg

SEQ ID NO: 647470 - DNA, 254 bp, Homo sapiens
  misc_feature (23)..(23): n is a, c, g, or t
  misc_feature (81)..(81): n is a, c, g, or t
  misc_feature (105)..(105): n is a, c, g, or t
  misc_feature (164)..(164): n is a, c, g, or t
  misc_feature (176)..(176): n is a, c, g, or t
aacccttaaagataacttggatncttgtacacataaattaactatcaattgctaactgataagatgtatgttaaagtgtancctgaaagagcaataagcctgtancccgtaagttaggaaattgaacattgaacctgactgattaaattggggaaggagtcatntgggggagggcntatatatattatatttgtaaatttatatatgtttatatgtgtatatcttttctcaatatatacataaagtgtatatgt

SEQ ID NO: 647471 - DNA, 737 bp, Homo sapiens
tacatgaagggaatttattaacagaaaatatttggaggaatctgggttcacagacggggaccacgggcgaccccccttcctgtcgagggtctgtcagaaggggatgggggtgacatcctcaatccgcccgatcttcatacccgagcgggcaagggctctgagtggccgacggggccccaggtccaggggtctgggtcctatttcctccgtggttggcccggagttggatgtgtagggcggggatacccagctccttgacacctctgggccacatcctggggcagccaacatagcagcactatgggggggatctcatctcgggtcgggctttaccttcatcccaccagtcacagcggcagagtggtttccttggccagaaagatcagctgactgtggtacaacaagtgtcattgaaggatgcaacagatttgggagacaccaaataaattctctccttcagccacctgaggtccgaggctgatgaccggggctaccttcattttaccttcccctttcgaggtgggcattctggcgacgtgcgtctccagaatccacccccagaacctcctaaggtggtcaacgataagcccccacaaattccaagatcacttctctcaagaagcccaagtgctgtgatgtctgtgcccggttgatgtgtctccacaacaagtggggttcggtgtgagactgtggaccactcctgaactgcgggcctgtgggatgggaatgttggaaac

SEQ ID NO: 647472 - DNA, 350 bp, Homo sapiens
ctccacccgacggggtggggggttggaggggaagacagcaatcactgtcctctgcaaaccaaagttctttttttttttgggggaggttttttaactctgccgcccagcctggggtgcagtgccacaatttaagttaactacaacctcttcaaccaaagttcgaacttttttcctgcctaagcctccttagaaacgggaaccacaggcgggcaccaccaggcggggttaattttggtattttaactagagacacggtttcaccatgtgggccaggctggttttgaactcttgacttaaggggatccacccgcttgggcctcccaaagggctgggattacaggcatgagcca

SEQ ID NO: 647473 - DNA, 214 bp, Homo sapiens
cttacgttagaagaatgggatattggtcaatggtcagtctgtttctgcattagtaagactcaggatgtcaataatgggaatgatggattaagtagagttaaaaaggtcatagatgaagcacacagcctgcacactgaggtttggattgcatcatttatgtggcagtcaaagacttagagaatcgtgcggtgcagtgaatgcacagggacatcgg

SEQ ID NO: 647474 - DNA, 173 bp, Homo sapiens
ttgtgaggtagcacacatccgcagcccagcccagccgggagaccacgtggtcgtatgcggacccctgacctatggcaagtgaacctgccagccttccaggacaggcggccggaagagctgccccgtgaaggacagtcctctcgtctatgcagacgtggtgcaccttctcattc

SEQ ID NO: 647475 - DNA, 925 bp, Homo sapiens
gctcggccactcggtgcatcgcgggggctttctagccgctgtcccaagggttggtctcgcgctttcgtgctgcgagctctctgtggtgctggcagcggaatgtggcgcctcccgggatcctgggcctgagctcttccccgtacactgggacctagcctctggagggtgactcctaagtaccaccagcccagatgtggcctcagactactcctccactttgcttggttcctgtgcctaactcgacaggtcatggtccccatggcccaggcactgagctgtggtggtccaaggtcccatggatggaaggatgcttccaatggatgtcttcccgtgtctccccgaacaccctatgggatgcatatcttggggcactctggcctgtgctggcctgaagctggcaaggagataccaattccaggcatcctctgcagcatggacctcagagggtagaacacttgatacctggacagtccccctggaacggatcttctcatctcccttgtggcagccatgctacctcacttgtgacaaacatccttacctcagccctgatggacagctaccagggacactggcctcatggaaccccaggcttggcaggagaagcctacagctcagcccggaactttaaacacaacacatgagaaggcgctcgacctcaggacccctctgaggaaggcccggggaaataggcgtactgatggcagtagtagcacacgagcaccgaggcaaaacaagccagcatcaggccaactggtgaaagggccagaaaccaaaatctaccatgacggagtcggatcaacaggagaaacaggaaagtacacacataactcgagaccgacaagatgggccaacggagacaacacgaacgccggaaacaaagaaaacgcgctaagaagagccagaaagcgctaaggccggaatg

SEQ ID NO: 647476 - DNA, 245 bp, Homo sapiens
agactctctgcacacacgtgtaaagatctccacgatacagtgacgtgaataaagcaaagcatagaacattgtttattccacactctctatttcagattttcgtttaatatatggtggggatattaagtatctgctgttctggctctcgtttatctctagaaaccactgaaccagatacattactgttcagggtctaagttgggtcaggtagtgacggggtggcgggacgcatacactgtgatact

SEQ ID NO: 647477 - DNA, 340 bp, Homo sapiens
gagcctgtacgctaaaccttgggcgatttcgtacttaactattgttccaacgcatgtacgatgccatgggacaagcagtttgttgcttgcacgagccatatgacattcctccttgatggtatgactgatgaggtatgattagtatggacgatctaacaaagagatatggttgggaattacaggaggaattttacattaaaacagattgcaaataagatacgctttgccgacgcgcaaatcggtcgctgcggcactaggatttgacaaagatccgctgcgtgcactgctttgtcgctggcgcctcgtatgcaactgtatggcaaaacggaacgaacttgcc

SEQ ID NO: 647478 - DNA, 129 bp, Homo sapiens
ccaactaccatgagggtaaaagcaaagtcaacaaacccctattatcccttcccccaaattttttatcattgtcttttttaggaaacagacaaactcattcatttgatttaataaagttttatttttcca

SEQ ID NO: 647479 - DNA, 620 bp, Homo sapiens
  misc_feature (40)..(40): n is a, c, g, or t
  misc_feature (229)..(229): n is a, c, g, or t
  misc_feature (498)..(498): n is a, c, g, or t
agctgcagcagctggaccagttcaagaaggccacaggganaacagctttcggctcaggcacccgggcccctgagcaaagccctggagaaaacggaaggccaacatcaggtgggtgaaggagaacaaggaggtggtgctccagtggttcccagaaaacagcaataagtccccagcccttgaagtcacccggcccccaagcaaggtgcccacatgtgtccatcccaacggntggtgcagggcctccattccttgagccccaggcaccagtgtcctcccctcaaggacaaagtttccagcccacggtctctctgcctgtaagacagtctagttcctgatgacccaggctgcctgagcacctcccagcccctgcccctcatgccaaccccgccctaggcctggcatggcacctgtcgcccagtgccctggggctgatttcagggaagcccagctccagggccaaattagcaaaagctctcgatggacaatgaacggccttgntgggggccgccctggaccctctttcacccttccctaaaaaccctaaatttgaggaatccacagggcagcagatctgtatatttttttttaaaagaaaatgtaaataaaggatttttagatga

SEQ ID NO: 647480 - DNA, 577 bp, Homo sapiens
gccattcagggctctggctccaatcaggggtgggatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctccgtctcagaggtgggatgcaaatcttcgtgaagacgcgtctactggctaagaccatcgcccttgacgtggagcccagtgagcacgcatctgagaactgtcaaggcaaagatccaggacaaggaaggcattcctcctgagcagcagaggttgatctgtgtgccgggaaacagctggaagatggacgcaccctgtctgactacaacatccagaaagagtccaccctgcacctggtgctccgtctcagaggtgggatgcagatcttcgcgagagaccctgactggtagctcactttcaatggcatcgataacacgggatccttagagtgacct

SEQ ID NO: 647481 - DNA, 414 bp, Homo sapiens
  misc_feature (8)..(8): n is a, c, g, or t
ttctgtcnctaaagtaatttctgatgttaaaactttaagccaggaataaacaatacagatatttccactttgctaatagatggaaataccttctatgtatttgtacaatgcttatcatgccacaaatgtttagcaattattaagtatgggagaaaaaataaaacaccataaataggaattatggccttcttttaaatgcagaaattggttctaaaaatttcagtgcctagattaagctactgttgagttcttaaaagggaaaagaataactcaatctttattaaaatatttattttgggccgggtgtggtgtcacgcctgtagtcccagcactttgggaggccgaggcgggcagatcacgaggtcaggagattgagaccatcctggctaacatggtgaaaccccatctgtactt

SEQ ID NO: 647482 - DNA, 258 bp, Homo sapiens
cacaacaggatagttttagatgagactggtctcttgactaagaattaaaccatctacaggtttacaggaaaggtatcagtaagtggtgttaaaataccaaattcagagcagcagatacgcttttaagggacaggatctcaccatgttgcccaggctggagcacagcagtgcaatcatagttcactgcagcctcaatttcctgggctcaagctatcctctcacctcagccaccagagtatctgggactataggcataca

SEQ ID NO: 647483 - DNA, 840 bp, Homo sapiens
  misc_feature (23)..(24): n is a, c, g, or t
  misc_feature (253)..(253): n is a, c, g, or t
  misc_feature (622)..(622): n is a, c, g, or t
  misc_feature (632)..(632): n is a, c, g, or t
  misc_feature (694)..(694): n is a, c, g, or t
  misc_feature (705)..(705): n is a, c, g, or t
  misc_feature (719)..(720): n is a, c, g, or t
  misc_feature (729)..(729): n is a, c, g, or t
  misc_feature (741)..(741): n is a, c, g, or t
  misc_feature (745)..(745): n is a, c, g, or t
  misc_feature (747)..(747): n is a, c, g, or t
  misc_feature (754)..(754): n is a, c, g, or t
  misc_feature (764)..(764): n is a, c, g, or t
  misc_feature (767)..(767): n is a, c, g, or t
aaagttaggctaggtacgaggcnnggtggtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgnactctttctgactacaacatccagaaggagtcgaccctgcacctggtcctgcgtctgagaggtggtatgcagatcttcgtgaagaccctgaccggcaagaccatcacctgcctggaaggtggagcccagtgacaccatcgaaaatgtgaaggccaagatccaggattaacagaaggcatccctcccgaccagcagaggctcatctttgcaggcaagcagctggaagatggccgcactctttctgactacaacatccagaaagagtcgaccctgcacctggtcctgcgtctgagaggtggtatgcagatcttacgtgaagagcctgaccggtgagaccatcagtctggagggtggagcccagtgacaccngtcgaaaatngtgaaggccaagatccaagatacaagaaggaatccgcccccgaccagcagaggctcatctgngccggcaggcngtggaagatggccnntctttctgnctacaacatccngaangngtgaccngacctggtcngcnctgaggggtggctgtaattctggaagcaggcattcgaagtgccagggatggttggtctgctataggcatttgc

SEQ ID NO: 647484 - DNA, 440 bp, Homo sapiens
tatccgtgtcggggttgcaaagaagacggtcgtccacatattgaatatgactgggagacaggtttaaggaagctagaggtttcgggctagagcttgtccaaagaaatgagggctatccctgaagccctgagggaggacagtccatgtgagttgttgtgactggagggtgtcagggtcagtccaggtgaaagcaaataggttttgggaatcagggtgtagggaaatggtaaagaaggcatccttcaggtcaattgcagtgtagagggtggtgttggtagcgacgagagagagaagtggataggggttatggactatgggatgaatagggaggacagcttgactgatggcttggaggttgtgaacgagtcggtatgagccatcagactttttaacagggaggataggggtgttatatggagagtgtgtaggtctaagaagat

SEQ ID NO: 647485 - DNA, 825 bp, Homo sapiens
  misc_feature (413)..(413): n is a, c, g, or t
  misc_feature (429)..(429): n is a, c, g, or t
  misc_feature (446)..(447): n is a, c, g, or t
  misc_feature (642)..(642): n is a, c, g, or t
atcctcacctgtgtgctccagccccatctgtgtgctcatctccacctgtgtgctcatcctcacctgtgtgctccatccccacctgtgtgctcatccccacctgtgtgctcatccccacctgtgtgctcatccccacctgtgtgctcatccccacctgtgtgctccgtctcagaggtgggatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctccgtctcagaggtgggatgctnatcttcgtgaagaccntgactggtaagaccatnncctctcgaggtggagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcanatcttcgtgaagaccctgactggtaagaccatcacccttgaggtggtgaagcccattgaccctttggagaacgtcaaatgtaaggatccacgaaatggaaggctttcttttgaccagcagaggttgatctttgccggaaagcaacttgggaaaagggcccaccctggttgattacaaacatcc

SEQ ID NO: 647486 - DNA, 524 bp, Homo sapiens
acttgaaccgattctggatggctgtcctgatgttcctcattttcactttgggctgtgggatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctcccttcgcctcagaggtggcatgcagatctttgtgaagaccctgacaggcaagaccatcaccctggacgtcgagcccagtgttaccaccaagaaggtcaaacaggaagacagacgtaccttcctcaccacagtatctaaaaagagccctccttgtgcttgttcttgggtgtgatgggggaggtgtcttagttttccctatcttttaagctgttaacaagtttcattgcactttgaataaagttcttgcattcc

SEQ ID NO: 647487 - DNA, 1104 bp, Homo sapiens
  misc_feature (8)..(8): n is a, c, g, or t
  misc_feature (45)..(45): n is a, c, g, or t
  misc_feature (114)..(114): n is a, c, g, or t
  misc_feature (128)..(128): n is a, c, g, or t
  misc_feature (138)..(138): n is a, c, g, or t
  misc_feature (143)..(143): n is a, c, g, or t
  misc_feature (299)..(299): n is a, c, g, or t
  misc_feature (526)..(527): n is a, c, g, or t
  misc_feature (531)..(531): n is a, c, g, or t
  misc_feature (534)..(534): n is a, c, g, or t
  misc_feature (538)..(538): n is a, c, g, or t
  misc_feature (540)..(540): n is a, c, g, or t
  misc_feature (542)..(542): n is a, c, g, or t
cccaggcncatgaaatgtaagccaagtccagataagaggcatccntccggaccacaaggctatcgagcaacagctgaaagcccgactctttctgactcaccatccagaagagtntccgtgacctggtntgcgtttaanagtgnatcaagcgtaaagccctgaccggcaagaccatcacccttgaggtggagcccagtgacaccatcgaaaatgtgaaggccaagatccaggataaggaaggcattccccccgaccagcagaggctcatctttgcaggcaagcagctggaagatggccgnactctttctgactacaacatccagaaggagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctctgttcaaaatgttaataaaggtttcgttgcatggtaagcataaaanncagnaanaaanananaaaaaaaaaaaaaaatgggggggggcgtcaaaaggccccaggggggccgcaataggaccgccgttgtttgttgacaatgggtgcggaccacaacaagcggaggggtgagataaaagggcaatgggcagggcgacggtgtaaaccccaccatcgagggccggcgggggaacaatcggcgactggcgaaagctgggcgaacgagcgaccgatgactgcgggggggcggcaaactatggggaataagccctccatcctaaaagatgaaggctttagcgaaaatactagcaaaagtcttctgcgcgcgtgaatacagggcgtggtgccaccaaacgccggcctataagacatggggctgcagaaacatgcggacaaccacggccaggtcatccgaggacatttgccccccgcgcgagatagaaaatccctgtcccaaaagaaaggccaccctgatggagatcacgtgaacggaggactgtggccgaggaagcttggactggcccgccgagaggccttgaagcagcagtactgtgaacaacgtgtcgcgcgcgatgacatgaccgac

SEQ ID NO: 647488 - DNA, 248 bp, Homo sapiens
  misc_feature (199)..(199): n is a, c, g, or t
cacaaaacaccggggatctatgcctgtggccacccggagatgacacgatggctcacatgtactctatgacacttaggtggaaagtgcggcgaagaaaaacaagtgacttgtggccaattacacgacctgcaaaggctagacgctgccaacatgggctccagtggagcttgagcttcgtgtagacagttctaacggaagncggtacgcaactcacacgagcggtgcgggaggagtaccgagctcggaat

SEQ ID NO: 647489 - DNA, 647 bp, Homo sapiens
ttttgttaaaggtacattttcaccatacccttttttatatctcggtattattagtatccccctgttaccctataggttggtctcttccccacccccctttgagcttttgctcttaaatacattcacggttccacagcctgaccatccttgtttaatctatcatactcttccaggtttttttctttttggtctaaggctggaacttttttcttttttttcagctgaagtcttatgacttttcatgagtccaaattgttcggatttcagcaagtcaaatcttgcaaaggcctgcatattgttgttttaacagattataatgaagtactgtgctaaagagctcttataaacaaaatgccatcatgcacttagcctcgcaataccatgcaatgtatgttaacttagtctctcttctcagacactgttggtagcttaatttctgtgttttcctttttttaaaaaaaaatatggacttattgtggttatctgagaggttctaacattcacatgcaatttggtgtggccatttagctattaatgagttaatggcgcagaacttgttgatatatgaagtgttctctccccttttgcccatgacgtaaatacataggtgtgttgccaggactttgtatccaggttttttcccccct

SEQ ID NO: 647490 - DNA, 581 bp, Homo sapiens
  misc_feature (369)..(369): n is a, c, g, or t
tcgccctctgaccgcaggtgatcttgctgtaaacgtgacagctcccgtctgattacaacattcataatgagtccctgtcctctggtccgtcttacatgtggcatgcttatttcgtgtataccctgtactggtcacatactcactctcgtaattggtccgagatgcactccatagtcaatgtcaaggcatagatcctatgacactgaacgctactccctcctgagccagcagaggttgatctttgccggaaagcagctggaagatgggcgcaccctgtctgactacaacatccagaaagagtctaccctgcacctggtgctccgtctcagaggtgggatgcaaatcttcgtgaagaccctgactggtaanaccatcactctctgaagtggagccgagatgacacccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggttaggatgcttcggtaccgagctcgagtctatca

SEQ ID NO: 647491 - DNA, 478 bp, Homo sapiens
ggttgtataattccagttatgtgaaatatacagaatagtaaatctgtaaaaacagaaagtctattgctagttgccaggaactgtggggaggagggaatgggaagttaactgcttaatggacatgaggttttattctggagtgacaaaaatgttttgaaagtaataaaggtggcagttttataacattgtaaatgtactaaatgctaccaatttgttcactttaaaatggttcattttatgtcatatgaattttacctcaatctttaaaaatatgcatttgcacccatttatagttataagaactttgataagttgctcccctcaggtctcagtgtcttcattcaaaagtgagcccttttgcttggacagtgaaaatggagaagtaagaatctttaaaatttcctccacgaaagcaacaagaacactggcaaaaatggtcagaatcaagttttccagaattctgggaattaaaaaaaaa

SEQ ID NO: 647492 - DNA, 1329 bp, Homo sapiens
  misc_feature (35)..(35): n is a, c, g, or t
  misc_feature (64)..(64): n is a, c, g, or t
  misc_feature (84)..(84): n is a, c, g, or t
  misc_feature (87)..(87): n is a, c, g, or t
  misc_feature (96)..(97): n is a, c, g, or t
  misc_feature (106)..(106): n is a, c, g, or t
  misc_feature (112)..(112): n is a, c, g, or t
  misc_feature (136)..(136): n is a, c, g, or t
  misc_feature (143)..(143): n is a, c, g, or t
  misc_feature (150)..(150): n is a, c, g, or t
  misc_feature (152)..(152): n is a, c, g, or t
  misc_feature (154)..(154): n is a, c, g, or t
  misc_feature (176)..(176): n is a, c, g, or t
  misc_feature (232)..(232): n is a, c, g, or t
  misc_feature (494)..(497): n is a, c, g, or t
  misc_feature (501)..(502): n is a, c, g, or t
  misc_feature (504)..(504): n is a, c, g, or t
  misc_feature (508)..(508): n is a, c, g, or t
  misc_feature (510)..(510): n is a, c, g, or t
  misc_feature (764)..(764): n is a, c, g, or t
gaaggggagccgagggacaccagggagaaggggangcaaatagccaatttatatgttatgtagntccgccggaccatcagaggnggngtggggtgnntaatttttngttatngggtttttcctgggttggatgacnactgctngaaagtngncncccggcgccgggggcgctcggngcagaggggggaggcagagtggcgggaagacccggacggggaagaccagcacccgntctcgaggtggagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacttggtcctgcgcttgagggggggtgtctaagtttccccttttaaggtttcaacaaatttcattgcactttcctttcaataaagttgttgcattccccannnnaaannanaaananccaagaataaaggaaaggcaattccgtccgtgatcagcagagtgtttgctcttgggcgcgcaaacagctggcaagactggtcgtaccctgtactgagctacgcaccatccagaaagagtccatttttgcacctggtactccgctctcatgatggtggcgatgcaaaatcttgcgatagaagacgcgtcaactgggcaattgactcagtcagcccctctgacgtgtcggaagccgcgaggttgagcacacaatcngcggacactgtcaaaacggctaaaagagtcccttttgacagatcggacaggggcatttacccttccacttgaacccctttcaaggaagggttttgaactcctgtgtggtctgagaaaaaataccaggccgtggtaaaggactggggcccgcatactcccgttgattccttggagcgtaccataacggtccctatgtacacatgtcagttcctaacacccctttgtctatcctcttggcgctggcgtcccggctcctttccatacaaaacaggtcggggggacaacttgcccaagaaatttttattcagggttgtaagtagaaacccgccttggaaccttgtggggtttcgaaatggaaaccccaatgtttcatgaacgattccgtgccggaacacgagtattgggtgaaagccccacagatagtgttggaatcctatcgtccaaattttttgcacaggaaaaactttggttcccacaacgcggcgcgacacaaaagagaacttcctcccaaggacactcacaactggggcaaacagcgggcgcaatcttctccccattatacccg

SEQ ID NO: 647493 - DNA, 241 bp, Homo sapiens
atcctcacctgtgtgctccagccccatctgtgtgctcatctccacctgtgtgctcatcctcacctgtgtgctccatccccacctgtgtgctcatccccacctgtgtgctcatccccacctgtgtgctcatccccacctgtgtgctcatccccacctgtgtgctccgtctcagaggtgggcacacacagcacacagatgagcacacagcacacacacaaacgcacagcacacacacgcacac

SEQ ID NO: 647494 - DNA, 1886 bp, Homo sapiens
  misc_feature (1051)..(1054): n is a, c, g, or t
  misc_feature (1058)..(1059): n is a, c, g, or t
  misc_feature (1061)..(1061): n is a, c, g, or t
  misc_feature (1065)..(1065): n is a, c, g, or t
  misc_feature (1067)..(1067): n is a, c, g, or t
  misc_feature (1321)..(1321): n is a, c, g, or t
gatatggagtcgcagttcttgtttgtggattgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctccgcctcagaggtgggagtgcaaatcttcgtgaagacgcgtcactggtaagtaccatcgcccttgacgtggagcccagtgagcacgcatctgagaatgtcaaaggcaaagatccaggacaaggaaggcatccctcctgaccagcagaggttgatctttgccggagaaacagctggaaggatggacgcaccctgtctgactacaacatccagaaaagagtccaccctgcacctggtgctccgtctcagaggtgggatgcagatcttcgtgaagaccctgactggtaagaccatcaccctcgaggtggaagcccagtgacaccattgagaatgtcaaggcaaagatccaagacaaggaaggcattcctcctggaccagcagaggttgatctttggccgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccccannnnaaannanaaananccaagaataaaggaaaggcaattccgtccgtgatcagcagagtgtttgctcttgggcgcgcaaacagctggcaagactggtcgtaccctgtactgagctacgcaccatccagaaagagtccatttttgcacctggtactccgctctcatgatggtggcgatgcaaaatcttgcgatagaagacgcgtcaactgggcaattgactcagtcagcccctctgacgtgtcggaagccgcgaggttgagcacacaatcngcggacactgtcaaaacggctaaaagagtcccttttgacagatcggacaggggcatttacccttccacttgaacccctttcaaggaagggttttgaactcctgtgtggtctgagaaaaaataccaggccgtggtaaaggactggggcccgcatactcccgttgattccttggagcgtaccataacggtccctatgtacacatgtcagttcctaacacccctttgtctatcctcttggcgctggcgtcccggctcctttccatacaaaacaggtcggggggacaacttgcccaagaaatttttattcagggttgtaagtagaaacccgccttggaaccttgtggggtttcgaaatggaaaccccaatgtttcatgaacgattccgtgccggaacacgagtattgggtgaaagccccacagatagtgttggaatcctatcgtccaaattttttgcacaggaaaaactttggttcccacaacgcggcgcgacacaaaagagaacttcctcccaaggacactcacaactggggcaaacagcgggcgcaatcttctccccattatacccg

SEQ ID NO: 647495 - DNA, 1721 bp, Homo sapiens
  misc_feature (1143)..(1144): n is a, c, g, or t
  misc_feature (1148)..(1148): n is a, c, g, or t
  misc_feature (1151)..(1151): n is a, c, g, or t
  misc_feature (1155)..(1155): n is a, c, g, or t
  misc_feature (1157)..(1157): n is a, c, g, or t
  misc_feature (1159)..(1159): n is a, c, g, or t
gatatggagtcgcagttcttgtttgtggattgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctccgcctcagaggtgggagtgcaaatcttcgtgaagacgcgtcactggtaagtaccatcgcccttgacgtggagcccagtgagcacgcatctgagaatgtcaaaggcaaagatccaggacaaggaaggcatccctcctgaccagcagaggttgatctttgccggagaaacagctggaaggatggacgcaccctgtctgactacaacatccagaaaagagtccaccctgcacctggtgctccgtctcagaggtgggatgcagatcttcgtgaagaccctgactggtaagaccatcaccctcgaggtggaagcccagtgacaccattgagaatgtcaaggcaaagatccaagacaaggaaggcattcctcctggaccagcagaggttgatctttggccgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtgaaggccaagatccaggataaagaaggcatcccccccgaccagcagaggctcatctttgcaggcaagcagctggaagatggccgcactctttctgactacaacatccagaaagagtcgaccctgcacctggtcctgcgtctgagcctgaggggtggctgttaattcttcagtcatggcattcgcagtgcccagtgatggcattactctgcactatagccatttgccccaacttaagtttagaaattacaagtttcagtaatagctgaacctctgttcaaaatgttaataaaggtttcgttgcatggtaagcataaaanncagnaanaaanananaaaaaaaaaaaaaaatgggggggggcgtcaaaaggccccaggggggccgcaataggaccgccgttgtttgttgacaatgggtgcggaccacaacaagcggaggggtgagataaaagggcaatgggcagggcgacggtgtaaaccccaccatcgagggccggcgggggaacaatcggcgactggcgaaagctgggcgaacgagcgaccgatgactgcgggggggcggcaaactatggggaataagccctccatcctaaaagatgaaggctttagcgaaaatactagcaaaagtcttctgcgcgcgtgaatacagggcgtggtgccaccaaacgccggcctataagacatggggctgcagaaacatgcggacaaccacggccaggtcatccgaggacatttgccccccgcgcgagatagaaaatccctgtcccaaaagaaaggccaccctgatggagatcacgtgaacggaggactgtggccgaggaagcttggactggcccgccgagaggccttgaagcagcagtactgtgaacaacgtgtcgcgcgcgatgacatgaccgac

SEQ ID NO: 647496 - DNA, 449 bp, Homo sapiens
caaacaaatgtggcgactgtgggtcacgtaaaaagttggatgacattcaatatagtcccactggggaatttttaacagtatgtataatacctacttccttttcattgcattaccaaatagttaaaataacttaatcaaccagctgtatggtttccctctggtaaaattaccatcagggtggggaaaatgtttgtggaaggggagagtgagttggtatgactaagggataatcggtacatggggaagggggcaacagtggataggatgactttaaagaaaatgactaccttgggaaaaaagaatttaattttggtccacatatcctaccttttcccatggtgcatatcccaggtgtcatatttaaacctagggttccttaaaacagaatccgggaatatcagggctcgggggctgggaatttcagagggataggactaataaaggggact

SEQ ID NO: 647497 - DNA, 573 bp, Homo sapiens
  misc_feature (205)..(206): n is a, c, g, or t
ttttcccaggggcccccctctttcctccatacgtgttattggcccccgggccttatccccggcactccccttgtgggcttcctcctttggcggggcattccgggttatgttccccttttcccccgggggtacgggttttgccggccacccatgggggggggaacgggtgtttcttcccggggttttccagtttcccccccccttnnggccatggggggttttttttggcccccaaaaaccggggcttttccaaaattttttaacaccccccccccctttccccaaaagggggggggggggggcggggggggggtttttttaaccaagccccttttttttacccccccattccccggggggcccccccccccttttttttccccccttaaaaaacccgggggcggttcccccccccggttttttttttgggcgggggggggggtaaattttttccccggggacccctttttccccttgggccctttttggggcccctttaaacccgttttttcccaaaaaccggggggggccggggcgggttttcccggggtttttttcccccccgggccccca

SEQ ID NO: 647498 - DNA, 348 bp, Homo sapiens
acgctctctctgtggggtatgatatcaccatgcccagctaattttttggtattttttagtagatacagggtttcactggtgttagccaggatcgtctccatctccggacctcgtgatcctcccacctgggcctcccaaagtgctgggattacagacgtgagccaccgcgccgggcctactgacttatttaaatgcttattctgaaaggatcagggttcctcagatgcccggcccagaggtccctaggctccccgcttcagcggattatcggtttggggatctttaccgtgctacagctaaggactactctgccttttcttttccccccacagagagagcgtcgggtac

SEQ ID NO: 647499 - DNA, 322 bp, Homo sapiens
ggccgcgtcgacgaaataaagtgccccgccctctggttgctcgaatcatgtcagcgacccggaaatcttcccagactacaacaggctggccatcatagccttcaaaagaaacattctcaccaccaattttaaagtaaggtagcttagtttccggcgctagtgaacgagcgagcgccttagcaaggagatcctttccggtaccgccagggccgcaaatgtagaagttaattacttgttctggagcgggtaagtgcgaaagatagtctccgcgcagcttctcgaagtgtcgacccggccgcgaatttagtagtagtagtcgacc

SEQ ID NO: 647500 - DNA, 111 bp, Homo sapiens
ctgatcactcatacagacagagcaatctatagtaactaaagctagccagacctggctcatctatatcctgacaacgtgcatctcctggccctgtggctcacctattgtagc

SEQ ID NO: 647501 - DNA, 171 bp, Homo sapiens
ttgttagagatctggaaaaaaaatcttctagacaaatcaagttgatcttggccaagtgcagtggctcatgctgtaatcccagcactttgggaggccaaggtgggcggatcacttgaggccaggagttcaagaccagcatggccaacatgacaaaaccccatctctattaat

SEQ ID NO: 647502 - DNA, 319 bp, Homo sapiens
caaaacttatatatgtgttagccacaattattctacaaagagacatttctcctccaattcatttaccactggtagaggttacataagcaaagcacagagttataccttggacacaccttaaaggactctttgtgtccatcattcatttgaaattcttagacacttatataatggaatggcttgagattatagcacttgccaaaggtgcttggttccaacctttttcactttgagtgttcattttacacactgtgcttcctaattcggtgaaggcgcctttccagacttttttggaaactcttctttttcatactcatat

SEQ ID NO: 647503 - DNA, 87 bp, Homo sapiens
  misc_feature (6)..(6): n is a, c, g, or t
  misc_feature (10)..(10): n is a, c, g, or t
  misc_feature (66)..(66): n is a, c, g, or t
  misc_feature (68)..(68): n is a, c, g, or t
  misc_feature (72)..(72): n is a, c, g, or t
  misc_feature (74)..(74): n is a, c, g, or t
  misc_feature (79)..(79): n is a, c, g, or t
gtatcntatntctgtcaggaatgatatttccaaatgaaaatgtaaagaacattgggaaataataancnaccnancaaanaaacacaa

SEQ ID NO: 647504 - DNA, 659 bp, Homo sapiens
  misc_feature (498)..(498): n is a, c, g, or t
agcggagggggctggttcgatctgtggccgggcccctcccccgtcccgggagcttggcggttccgataccgcgagttagtactctgcacttctggatgaagatgcagacaacaggagatcctgaggatactgtgactgctgaactaggtgacttgggacagttgttgccgcagatctctcggtcacaacctcgactgtggcggggcacggcgatctgtgattgggtctggccctcagctacttacccactactatgatgatgcccggaccatgtaccaggtgttccgccgtgggcttagtcatctcagggaatgggccctgtcttggtttcaggaagcctaagcaggcttaccagtggctgtcctaccaggaggtgggcgagcagggctgaatttctgggggtccggactatctgcagcacaatggtaaagcatgcactgatcagtttattggtgttattgggagaaaatcggccagagtggatcattgtggagctgngctggtatcacatattccatggtgcgtggtcccgctctatgacaccctgggaccctggggctaatcctgtacatcgatcaatacagcggacatcagcaccgtgattgtggacaaagctcagaaggctgtgcttctgctagagcatgtggaagaggacggag

SEQ ID NO: 647505 - DNA, 356 bp, Homo sapiens
catttagtatctacttggagttgtaatgatttcgtgtgtagacggacaacatgattatgtgagagagagaagaggctgcgccaggcaagacagttatttaggtcgccatgacatctctaatgtcgcagagatggtaccttttgtggctgaagcacagggtctgtgagagtgtaacacagatgacattggagaagaggtagaggtgagcctagggacactgggtgccacggtatagccgagaatgggacagagtcaggaagggtaagggcaactaatatatacaaagagcatcttatctttagaaagaccattccagcaacagtaagagaataaatgatagagccagaggctgctaa

SEQ ID NO: 647506 - DNA, 929 bp, Homo sapiens
gagcagcgcaggacagcagatgacttagacccagcgtgttcgttgaaaccgtgctgttggccacgggctgtgcttatcccatctatcagaagttcactctggtccgcacgcaggggctttacacttgtaatccactagctattttggaaggctcgaggctggtgtggatcacatgtagagtcaggagtttgagcaccagtgcggacaacatggcgaatgcctgttctccatgtaaacatatcacaaaacattagcccgggatgtgtgctaggcccggccatgctgataatcttgcagactgagctcacgtggaggccttgagtggcaggagggatcgctggaaccccaggatgcggctgttcgcagttgagccgatgcattgagaaatctgcgagctccagcctgctgtcaacatgacgcataggatctccgttctcgcaatcatatgatcatatcatgtaatagtcaaaatacctgagaagaaagctttgatcattttgggggagaggagtgcgcacatgtaaactttgcccccaccggaataattgtctatacccacgggccgtgcgtataagggtgctctagtttgggtgtgaccacactacggggcgaacccgtgaaatgtgaaataaacatgtacaaactccgtggtgtactggttactgtggctaaatacatagccggaagactactaggtctttagggtgaacttcacgcgggagggcatctagccatgaccaagcgacgaggtgccttttttagaaggacataataccgaccctgtggcttttgtttgccctgaattaatcgcttgtccgacccggtaacggggttttcccaccatgaaaagcgtggaaaagtggtttagacttttaattggccgctctaatgagcattccggtctaccaaaacaagggttccacaccagg

SEQ ID NO: 647507 - DNA, 826 bp, Homo sapiens
aaaagaaggaaaaaaagaagaaacaaaaaaaaacgacacacttagcatcagtacgatgctggtggttacttatatccatctgtgactgcacgaactgtaccggcaagtcctactgggataccagccccggggtaacccaggatagaatatgtaacggtgacgtccagagggattccggtaccggggccagatcttcccaaccgatgaatggacatgtattagatggttataaggatcactaccaggatcctgtaccaggcatcacccctagcagcagcagcaggacccggacaccatgccatctatcaattgctaacaccagcacaacatcaaccttgcagatctgacacgggctgtagaatgccactgcctcagaacatgacttcacagatgttcagtgccattgctgcggtgacaggccaatggacagaaccctaatgccaccccagacccagtgggcctccagaccagtacggctatggcggacagatggaggcggcagacagtgcttaccaacgtattccacaacgccagcccagacagccagtggccacaccacataatgaccccatacgacataatccctacacgacccaaagccaagcccatcaccacacccatcagaaacaccaagctccaggccagcaccaacccacagtcggccaggcccagccccagccatctaccagctcccggcacggcacagcagcaaagcccacagacatgcgctcgctgggacaagggggagagagtgagaaaggagagaaggggcaagacaggggaaaccggcaccagccagaagagcccagcaggacaaaccaaggaa

SEQ ID NO: 647508 - DNA, 267 bp, Homo sapiens
acaattcgccccgggcaatatggtgaaaccctgtctgtactaaaaatacaaaaattagccgggcatagtggtggtcacctgtaggcctagctactcaggaggctgaggcaggagaatcgcgtgaacccaggaggcggaggctgcagtgagctgagatggtaccactgcactccagcctgggtgacagagtgagactccatctccacacaaaaaaaagaaatataaatgttttaaagttatttgataaatactgccattttccatgag

SEQ ID NO: 647509 - DNA, 1357 bp, Homo sapiens
  misc_feature (344)..(344): n is a, c, g, or t
cctcgctgcatacgtgacatcgtctttaaaccctgcgtggcaatccctgagcgcaccgccgtgatgcccaggaaagacagggcgacctggaagtccaacttacttccttaagatcatccaactattgcatgattatccgaacatgtttcagttgtgggacgcagacaatgtgggctccaagcaagactgtcccgcagactccagcatgctccctttcgactgtggaaagtgctgtagagctgtcgtgattgagtgcaatgaacgaccattgactgccgcaagggtcctagtcctgaaggcgtcgaccttgaggaagacacctagacgccaaggcgtacttgagnagtaaaaacttgcctttgactcgtccaagtattcactggcgaggcaatagttgttgcgtggctattagttgattgcatcgcaaacgagatgtgacccgtgcaccattggaaggagtcgacgtgggaacaagtgggtatcgcttcgtggcacgacactaagacgggttgtcccaggacctagtcgtggcacctcggttggtctgggggtggtgccagtttagacacccaccaattgggttgcaaacgctcaggcctgcttgggcccgaggtcccccaagaaaaacacacttgggagtccttcgggggttccccctgcaggaaaagcaactccttctcctgttatttgtccccagggggctcttttgaagggctaattccaaccccaaacttaaaaagaatttcttccgaggggggtcaaacccaatattgcacaattaccccttgagcggattgtttccccggcaatatggctctcgcgcccagagtgattatcttggtctcttgtcgagaaatttgtgtacttgagcccccaataacttggcttgggccattgctagattaaaccccccaatttggcttatgccattcgaaactcgaggggtcaccataagagccagaaaggttcccgtagggggcccttttgtgatcaatctggcttgtcgcatgcacccgggggaattttcacgcagcccttttacccgccatcgttgttggtgctttgggaacaacacacactgtggttcccgaaaagcggccgccgtttcccttttggcgcgctcttggaattcccccattgcctttggccccttctttcggatacggcggcttggccattggcaccccctctctggcttgtgggctttggacttggccccgagcccggaaccaaggtcttgggccttccccatttagccttcggcactttgggctttggtgcagaggaccccccctaagggcgcttcaacaccgcgggtactttggaaaggccgtcccaacagtgggcaacacaggca

SEQ ID NO: 647510 - DNA, 256 bp, Homo sapiens
cacaaattcgctgtcatcctaaaggcctgacactgcagtgcaagaggcgatgctacagtctacgcacacggtcctggcacgcaggaaggagacagagcctctcccagtgcacacatccccttctctgatttctggaagaagactaagaaaggagtgggaaaacgcagggaggtccaggcccaggactaataggtggatggatctcctgggttcagttccttctctgagatggctcccaatcctctatctgggatgg

SEQ ID NO: 647511 - DNA, 116 bp, Homo sapiens
cgggcgccacagcttgtcacgtttaaacttacatcgaatcgctttctggaggacgcgagcgggacgccgctgcgcgattgacacggcatacttgcctatcaggcgtactctccctc

SEQ ID NO: 647512 - DNA, 273 bp, Homo sapiens
acacacaatgaaaaatgttgaggtgctaactcagagctgaaacactgcagtactagactctgatagagtgaggtagattgtggccagcgtgcaggtaaccgtctgcagttgcaataacagaattagaaggtgggggtgtcatggaatcttaggagccctgattccaattgcccaggctttgttgaaacacaggcaccctagtctcacctgagggcaccaccaatggggatcattccttcagcattcactctcagtattcgtgtacccttgtga

SEQ ID NO: 647513 - DNA, 845 bp, Homo sapiens
gcctgcgtagtgaactgtgcgagtcccatccgggagtgtgccggcgtcctggcatcccagtcctgacttaatgagctctagcttactctcggtaggcgctagaccccatgatcggtgctccctcgtacgagcgtgcctggatcggctgaaagctcaggtgtagtgagcgtcatacatcaacaccaggcacgtggtggtccgtgccttggatggcttggtggcatgctgaccttctggggttaatgattgtctcccattctcgagtggcagcacttgtgagaggtactccagtcttgcagtgtcttcaagttggaatgtttggcagatacgactagagcagggcccctatacgggaatgcagttccatgagcaaatgattaagttctattccaaaagacttaaaattgtttcctatttcaaatatttacctttcaaaataatggaaagtacattcgaatgtagttacacaaaacttaatgaaagacagagaagatcttgtttcagcacgacagactcccagtccggatatccgcacaaacgctgagaccgcaaccaccccgagtccgcctggatagcaggcgaaggtgtctccagacttttaaatggttactgacaagcaaaaagtccgctggggagttaaagttgctctatgtggactagtacttcacgtgaagaagttgtggtcagtggtacccagaataatgaaaccattggcaggagttgaacctccgggacctcataaggattcattggccgcccacctccgagggacggcgtgtgctccccatacacccctgtacagtgacaccgccaagctgagcactggcctccctttccccgcggac

SEQ ID NO: 647514 - DNA, 146 bp, Homo sapiens
cgaatagtcatgtgcctacgtctgcctcgcaattgagggagcatgtaccccaggtacatccatgaactgcggcagaagtttgacttatggctgtttcagcttataaggttgttgtgtattggttattgattatgtggcttgttaat

SEQ ID NO: 647515 - DNA, 116 bp, Homo sapiens
tcaaaaatcatcatacatagccatttctgctatatagccaggacttgatacctaaagatatttatttctacagagggcactttgtttcatagcaaggcatttatgacactagaact

SEQ ID NO: 647516 - DNA, 1500 bp, Homo sapiens
gatttaatgaggtagcatggaatgggctgagagtggtgttagcttctcgtccaccagaagggcacactttcatctaatttaggggtcatcactgacgctgatagcactaacacgcagaagggggatgaaatacctatccagaccaccatgtgctaatagggaagtgtagcacgatgcaatcggacattctctggtggggctcggcctcctgtgcatcgcggctaatatctttggctcttgactttacccaatcggggaacacaaatgtcagtggcctgccgagacaagcatcgtcagccggttccgtggtggtctcttgtgctgagcatcgtactgagcgtggcccgtgtctgaatgcctacctggctcactcatgtggcttcttctccatgtgggggctggtgaacagtgcatgctactgactgtggatgtgactgatgcgcccatagaaatactgatgagataatacgtatctgcgcatgcgttgtcctatcgtgctagtaggcctagacttcttcgatttgggaacttcgtcagggactctgtggctactgggtgttccttcgggcaggccaaggccacctcgtgactctaagctagcacaggacccaactcactgttcctaggaaagattactcctaccgggccacaaggcaggagaagacttatacagccccttagtgcgccaagcgcgagcccggaagggggcctacgggtaacccctttccttggagaattatgcattcccaacaaatggggtcgcagaatggtggaagcttggaaaagcaccataaaggcaccgacttttggttggcacacctggggagaaatcgctgaattccttccgtgggaatcaggtaccataatatcccttacattagaggcatccgctggggtgcgaaactctggaagcatctccagtcttcggggggctcctaaacatttcccgggatatatcaaacctggcgacactcgtctttgggcaagcaccaactaactagtcgcggacatataataggacacgagctatgctatacacccaagcgaagccaacaccactcaggaccatgaggctaaaaaagcgaaccaggaactcaacgagaactacgcacccccaaaactgacacagtcgcgcacgcaacagcagcacatcgacaaaagagcaaccaatagatatgcgcacacccggccccatcccacgccgcagacaccacgacgctctggacagtcaggccgcggaacccagagacagccaccaacagaggccacagcgactaagacgacccgggccggcgactagcaaaacgcgaggcacacaccaccagggcacgtacacagcgcctacacacccgccagaaccaggcacgctcccctggccgcgactgcacccaaccaccggctcccgctcatacgataactggagagaagagcacacgaacaccaaacgacaccaccagacagccacacagaaagaacagcaagacgaaattcacccacaag

SEQ ID NO: 647517 - DNA, 453 bp, Homo sapiens
ggctccttaattcctagccactatgcgtgagtgcatctccatccacgttggcaggctggtgttcagattggaatgcctgctgggagctctactgctggaacacggcatccagcccgatggcagatgcaagtgacagacagtgaggagatgatcttcaaacttcttcagtgaagggctggacacgtgcccgtgtgtgtattgtgacccgcttgatgaagtcgcactggctacgcagtcttcaccctgagcagtcatcacaggcaaggaacgatgctgttccaataactatgcccgaggcactacaccattggcagagggaggcaccttcattgaccttgtgtttgtgagcccgcattctgccaagcttggctgatccagtgcagccgcgtcttccagggcgttctctggttgttcccaccacgctgttggtcggcgggaacatggtgtctcggg

SEQ ID NO: 647518 - DNA, 433 bp, Homo sapiens
ggtcccggtagggctagcaccgttcaccctgtacatttcgctgcctcagtgacccccgcctcacggcttgggccctaaggacgtgcattcccagcctgagggccccgatctgccccctcccccggtctgcctgtgtggcgcctctctcacgccctatcttccggtcaacttctcctgccttccccgggggcacgtgtgaagggaagtcggaggccgggcaggagcctctgtttccgaagcttctcgaaagcccagaaaacccctcccaagagcccagcctaacctgggtggaagagcccccaggtcaccccaaatatttgcgctggggcgcgtgtgagggtgggaaataggtccctctctcttctacagttcacagctctgggaactacatcccttcaaaaaacattaataaagaactaaagtcatgtgcaaa

SEQ ID NO: 647519 - DNA, 213 bp, Homo sapiens
gcgtcgactaaaaattacatccaacttctcagaaatcatgcaagcaagaagagaatagtgaaatatttagtgttgagagaaagaagcccaccacctagaattttatatcctgccatgttgtgttacccttccaaagtaaaggaagaataaagacttactcaaagtgaaaattgagggaatttcttacaaatcggatttgcaacaaattccgtc

SEQ ID NO: 647520 - DNA, 369 bp, Homo sapiens
  misc_feature (71)..(71): n is a, c, g, or t
  misc_feature (315)..(315): n is a, c, g, or t
ccccgtgggctgcagggtcaacaaagttgggtttcctcttttggctcagaaatttaaaagaaaggaagggnccctggtgtagtggctcatgcctgtaatctcagcatttggggaggtttaggcgggcagatcgcctgaacctaggagttcgagacccgcctgggcaacgtggtgaaacctcatctctacaaaaattagctgagcatggttgtgtgcacgtgtggtcccagctgctcgggaggctgaagtgggaggatggtgtgagcccaggagtggaaggttgcagtgagccatgattgtgtcattggactccancctggatgacagaatgagatcctgtcataaataaataaataaatataccaaaaa

SEQ ID NO: 647521 - DNA, 108 bp, Homo sapiens
ttaggtctgcgtcccatcagtctcatagtgttaaaaatatatgcacttaacacgagacccctataatatatcaagcaaaaacatacagaactgatgggagaagatgcg

SEQ ID NO: 647522 - DNA, 750 bp, Homo sapiens
  misc_feature (596)..(596): n is a, c, g, or t
ggtcactgaagagggaaaaggagtgagaagacaaagccgtccgaaagccccagacagcttcgtattgctccagcccggtgcataccccgggagactcccgaggcgctccctccatcttcggaacacggccaggaattgattgagtaatcaggaagctatgagggaccctgtgacgtagtcgcagattaccatgtgtcctttcttttctggaggatgccgcatcccacgtaggactggatcgggtcggacgtctggaaggcctgggctctgtcgagatacaggccacctagcaaggtcgaagacagcagcgttggcaaaatgatcgggcaagcagctgcagcgagaccagggatgaaagaagacctgaaggtgatggcctccgttgaggtacagtgcctgtcaacttctggagagctccgcatgggccaggctagtccagttcgcttcgaatctggaacttgctctgataggacaagacttcatctactcccaatcacactggccctcattggtacttgcccgtcttcaagtcccctttcctgttccatctccatttacccatttataatcttgttactctccctgagggttttggntgggtgctgagtgaatctgccaagagttgagtgcctatgtatttaggatctaatcgtgtctactccatttcgtctcaaaaggccctcagggtcgcaaaggtaaatgggtcaaggcaatggaatactggctcaaagggattctcctttgccccca

SEQ ID NO: 647523 - DNA, 480 bp, Homo sapiens
  misc_feature (54)..(54): n is a, c, g, or t
  misc_feature (102)..(102): n is a, c, g, or t
  misc_feature (250)..(250): n is a, c, g, or t
  misc_feature (254)..(254): n is a, c, g, or t
  misc_feature (271)..(271): n is a, c, g, or t
aaaaaaaaaacccccagttgtgtgaagggtggccaacacttccagaactgggancccgccacatcctgatgtgtaaaatccccacgaatagggcaaaagcangcccactcccacactaatgccgcccctctcactaaattaaacccttggaaaaataagatgtggccttggcctttaaaactcagtgaactatcctttatggtacagttggtttcccatagcctgtaaacacaaaagatcctatggtttnctgncctaccccaggatagtncttgtcctcctagacaatgtattgatgatgcaaatgttctggaactaaatagtggtgatggtggcacaacactgtgaatgtactaaatgtcactgatttgtacgtatttaatatgaattaaatgttaaaatggtgaattatatttatgtatattttaccataataaaaatatgcattggaagatgcattttttgtgaccaaaaaaaaaa

SEQ ID NO: 647524 - DNA, 559 bp, Homo sapiens
aggggcttacagacagaactctgatctccctggggagcccctggtgggaggggcagctgtggtctctgcccatcagcagacttagtatttcctgcctgctggctctgaggagtctgggcagtccagacgaggaggattccccccagcacagtgcacccactccaccaaggggcagccagactgttgctttaagcaggttcctgattccgtgcctcctgactgggtgacaccttccaacaggagtcaccagacactgtatacagaaatgtttcagctggcatcaggtcagtgtgcctctgggacggagctcccagaggaaggagcagcccatctttgctgttctgcagtctccagtggtgatgcctacaggtgccgggttggggggtgacccaggcgaatagggtctcaggtggaccccaagcaaaccacagcagccactatggaagaagggcctgactgttaaaagaaaaacaaatagcatcaacgccaacatcaacaaaaaacttcatccatagatcaacagcctcaaaaattgaaggtagataaacccacacataac

SEQ ID NO: 647525 - DNA, 611 bp, Homo sapiens
gtggctaatgcctgcaatcccagcactttcggaggccaaggcgggaagatcaccagaggtcgggagttcgagaccagcctgaccaacatggtgaaaccctgtctctactaaaaatacaaaaaattagccaggcgtgtggtgcatgcctgaaatcctagttactcgggtggctgaggcaggagaatcacttgaaactgggaggcggaggttgaagtaagcgaagatcgcaccactgcactccagcctggtgacagagcaagatccatctcaaaaaaaaaaaaggaaaggaaaagaaaaaagaaaagaaaattgcaagtttttagccaggggtggtgtcagggtaccttatatttcccagatattcaggaactctgagggcaggaaaacgggtttgaaacctgggaggtggaggcggcagtaagctgagatcacgccagtgacttcaagccggggtcacagagtaaggacttctattcccaaaagagaggaccatttgtgagcccaagagagctaggtgtggaaagtgccacccaaatttccagcctggggcaaccaagagatccgtgtcttgacgaacacacacaaccatagcacccgcatacacaacacca

SEQ ID NO: 647526 - DNA, 228 bp, Homo sapiens
gggttagaacttcagttgttgaatgtgagtggctgcatttgttcaagttcaagactgttagtaattgtttagttagtactgtgttgacaaatcattttaaacagaattgtgaaatgatttgtactgagttgtcaagtagtttgaacttctttggcaagtggttaaaattgcgttgtgaatttgttggactgttgtcaatttattttaaccgcataacaccacacaatt

SEQ ID NO: 647527 - DNA, 265 bp, Homo sapiens
  misc_feature (102)..(102): n is a, c, g, or t
  misc_feature (128)..(128): n is a, c, g, or t
  misc_feature (186)..(186): n is a, c, g, or t
  misc_feature (196)..(196): n is a, c, g, or t
aggtcacacgagatatccccagttctgagtcgtcaacgaaatcgtaagatgtgcataaggtttccattttgcacttgttaaaaatgtgcttgcggccaggtncggtggctcatgcttgtaatcccagnactttgagaggccgaggccggtggatcacttgaggtcaggaatttgagaccagcctgnccaacatggnaaaaccccgtctctactaaaaatacaaaaattagctggacattgtggtgggtgcctgtaatcccagcta

SEQ ID NO: 647528 - DNA, 463 bp, Homo sapiens
gctctcggctcgcttggacctctgtctcctgggttcaagtgattctcatgcctcagctcccaagtggctgggattacagtgcatgtcaactttgcctggtatttttgtatatttggtggagatacggttttgccgtgttggccaggctggtctcgaactgtcttcgggtggtccaccaacctcggcctctcaaagtgctgggataacagtcgtgagccaccgagactggctatgtgcagatcttgaggcacgctgatcctacacaagcaggtagccctttcagcactccagctcttctctgacattaggttacactcaagttctctggaacctctcctgtgcagccacttgaatgtatagaggtactcctttcttatcctcactttgaacagcaaccaaaagctcatctctggtcataacatttgaaacatttttgctgcatctcatctctccatacacatcc

SEQ ID NO: 647529 - DNA, 429 bp, Homo sapiens
agcacacctgtcatcgtaggaccaactgaagagatccgcgcccctcatgcagccattgggaaatccccttgctggctggggagtacatcatccggtgctaagaaatcacaaactcccacgcattctcactcctcatgtggggggctctggtttaatctcacggcccaggattacgtcatccagtttgctcagggtgacgtccgcctctgcttgtcggcttccgggccttggacatacgtcgcctccagtacctgtgtggatcctcggcgacgttttcttgggggagtatgtgacctcttcgaccgcggggacatgaagagcggcgcacgagtgggactggcgcgcgctcgccctccggagcggacctgggaagccggagacacgcaggcgcagtaacccgggtgccgcccaaggtgatgcatgcgcacc

SEQ ID NO: 647530 - DNA, 688 bp, Homo sapiens
  misc_feature (394)..(394): n is a, c, g, or t
  misc_feature (688)..(688): n is a, c, g, or t
gaggaagctaaggctgcgttggggtgaggcctctattcatccggctgactatcaaccggtcggcagcgccagcccgtacactcgcccgggcgactgggctctgtctccgacgctcgcttgcatctactcgagtccatcattctgcacgacgatgaggtgagcagctcacggagcgataagatcgagagtgccactacattaaaggcgagccagggtgtacaagtgttgaggccttttaggcactggcgtatgtttgcagaaggccctgtgccaacggtcaacatggggacgcctcatcgtgcagatgtaaggggccgcgtggagcgctgctccgagacagactgggtgctgctagcacagacacgcgacggttccatgcctcgcgccctctcancggtgcgtggcttggcgtccacgccttgaggcgatgacagacaaccgtgcggagagcaaagaggagagacgaacgagagtctccgagggacgtcgtggaagtgacatgaacctgtggggccttattgagtcttgtttttgagctaagacgcctctttgtaataacgagtgttacaactaaaagagctgaagctttagaaccatgaggataggagaaaggctaaaaagaaaaaagaggcgttgggcaaggagggagtcgaaaggcctgggagggcaaatggaggaagctgtgagn

SEQ ID NO: 647531 - DNA, 205 bp, Homo sapiens
cggaagactcggcgtcgggtcttcggcgtgtgcatgcacacgccgagggttcatactgagcaaagcgaactcgccgatcttcacgtgcacacgccgaataaccatactgcacacgccgaagatccacacacttcttgaggtcaacgcgtaatcgccgatctagatcggcgatatcgggttcgcggcggtctggtggctcggcgtg

SEQ ID NO: 647532 - DNA, 494 bp, Homo sapiens
tacgacttctagactgtccacagtctggagcatagtcatagcactagctgggatgctactagtatgctgaacattatatttgagaaatgtacttggtcccatgtgttagggaccccctcttattcccttgtctccttgtgtcctaagtgctgatagcttcatcattgttctactactgctgtgatcactgatgacatgttcccattttgtacatatactctgctttattcactccttttatagtgtagtcgtcctgatacatgtggttgcccagtgccatgaggcaggataggagagccacttgaggtcatatgttaaggtatgtaacacacactgttctgatcacttacatctgtggctctccagttttccttctaaggacttatttcttcacaagcctggtaatttgaggctgtgcttctaacgtatgctttctcttctatatctcatagcctaggcttgtaccttaataggggaggtacgaagagggacag

SEQ ID NO: 647533 - DNA, 762 bp, Homo sapiens
tcgcgcccgggagtcgcctgctgcgccaggatggagtgtcgtgaaatgccttgggaccccgagagagttctacaacctggtgcgctgccggatcgggggcagcggaaggtgagtgcccaagatggaccaggagctcgcgtcagcagcagactgggaaacttgcctacaagtatctcaatcagaccagtcgcagattgcgcaagtcttgtgatccaggcgctggatggggaaatgcgcaacgcaagacgtgcgatattgtatatcggggattctccgagtctctggacacaccgtggaatgatgacatgaacgctatcagctgtggaaaagaaggtcgccgcatgttaacaccaactttcagcctcgtttccattataccaatccaatggactggacggttacattggaagagcaaggagaaggagttcgacaggtgctggaggatattccccaatgatctccctggagtttagaaatctggtgtgagaaataccataagagggattgccgaggatttgcaccggagaatgggcattgggatggcagagtatcggataatgcatgtgactcttgaacaggagtgggacaagtactgtcactatgttgctgggttggtcggaattggctttctactgtgtgttctcagcctcagagtttgaagaccacttagttggtgaggatacagaacgtgccattctatggggctgtttctggagaaaagaaaattatcggtgatattggaaggacaagaaggaggagaga

SEQ ID NO: 647534 - DNA, 646 bp, Homo sapiens
ggaggcacccatggtgcatgtgcgctgtttccaccgcccatcctccagtccctctccagcactgaggcacgctctgcactccgtaactcaacatggcagcctttctcgccgtaaactatttagtgagattttagggactatttttcagtatctctgtacctgttaaagggggtgcttttcgatctaaaactgaattgttatatttattgacttatttttctagactaaaattgtatatgctgtttggtaattaggaactcgttgagaatattggcttctgattgttgccatcacgttcctacaaaattgttttgtctaggggatgttctggcagctgtggtcatggaaatggctgctgggttcatgcagtcagtccataagagactttataccagcataggcattagaatcccgtgccagttaccattaactgtaacctatttagcttttggttagggatctttcatgatggtcttttatgacgcaatcttagttctaagtcatggttcccatcccttttttgtgtgtttcagaaaatatgtgtatttgattcccctgcttccactaaatccagttgtgactaaatctacgtgacattagatgtaaggttataccaatggaacttatgagatccccgcgaacagga

SEQ ID NO: 647535 - DNA, 1406 bp, Homo sapiens
agaactacctggaggaggccgccgagcggctgaattcctgtggagcctggtcaggttcaccatctccagccgcacggacgcctggggtccacgccctgagcaacgcggcgcacctggacgtccagacgccgctcaggccggacgaccttcccgacccgcaggtcctaggcctgaggacccatacaaacacaacagcctgactggcaccctggccaatcacgggtcctagcgggcacttcacgagtgcccagaagactatccacgcaacgtcacgcagccactgtcccggacctacctgtaccgactggcccattggctgtcacctggcgtgatgagctgcacggtgtatgaactgcaacctatgctggactctcccggcagagaagccgcccaggacctcctcggaacacaagaattcagcgccattccagtacggttggcagacacggtgcctgaagacccacggtgccgacaccggctagcagaccgcggtcctccggataacccccaaggacacaagccacgacccattgggtcaacacgcggacggagtacgccagagaagacctagcaggttctttggacacctgggacgctccggagacgcccagctactatcacccgtgatactaaggacccagggaaccgagcgacgcgcatgcaccgcgcatcggccctggggtcgcgcaggagcgcgcgatagagagcgagatatagagcacaacatgccaccagagcgacaacgcaccgaaacccgtgagcaacgccacacagcacacaccagagacaacgccacaccaactacagatgtaggcacacaacagcacccacaggcaactaacatcccaccaccgctcgagatgcataggaaccggaaaacagccaacacgcaagcccagcccagcacccccctgcacagaccaacaacagataacgaggaatcccacgagatagacccgcgcacaacacccaacgcaacagcagaagacgaaccacagagacagcaaacaccgaacgaaccgcaccacgcaggcggaagaccaagaggcgagagcgcacacacacgaacagcggcccggcgcaaacagaaacaacaccaaaacagaggtcacaaaaacgccacggccaacacgccaccagcggcgcgcgaggaggacacgagagacacgagcaccaacccagcagaccacacacaaaaagaacaaaacagcaacaaaaagcagcaacaacagaccaaagcagaacagaccacgaaaggcgcagagaccgcccagagacgaccgcacggcgagaggaagccagaaacgcgagcgcaaagacgagcgccaggcagcaccaacgacccacgacgggcgccagcacacaacgaacaccgccaccgccccccgggtcacggacgacccaac

SEQ ID NO: 647536 - DNA, 112 bp, Homo sapiens
gtgaacagggagcggggcttttgtctgttggtctccctcgactacgagaggagattagaagcccaagactaagattctcaaaatggtttattacccagacctcttgtctggt

SEQ ID NO: 647537 - DNA, 559 bp, Homo sapiens
acgtactatggcatagctgttcctagagtatactggtactccggaaggcccgtctcaatggtcgctgtctcttcggactgttgggtacacctgcagactaacaacagacaaaacaggcacacagggattaatatgagatttataatcgtagtacttccaatggtcttaacccaagtgacagggttaagatttgcgaggccatcagcaactcctgcaattgcctcagttcctggcaccaaatttaaatgggcttttgatgcttcgaaaatttgttcttttaatttggaaatgtctaaagtgagattatcttctcttccctgtagatggcgtctaaccatgtcccagtgatgctcagactcattataaatttggggtgtaatacaaaaatctgacgtattccagtcacattgtaactggaaacgatgttctaagctcatgagtctgtctcccatccaaatgacagtttgtctaagatcattaatttgatttgccaatttttgatcaatactagattgtgaattccacaatcttgtagaattcttttgccaatcattaacaa

SEQ ID NO: 647538 - DNA, 610 bp, Homo sapiens
cattttctgtacataaaaaaaaaaaaagaaccactaaacgcagccgggttacgaccgggggcgcctcagtcgcctcatttgatgttctcggggtttggttcgggggaggctggggagcggggatggggggctgggggggggtcccccttttcccctttgggccctgaagagactgggtgggttgagcacctcgtccacaccacaccttggggcccaggtgaccggatccggggtcccaaggagagaagccccaggtccccgcaccttccgggctcttcctggcccggcctgtggaagccaggcccatctctcggggggtccgtctggtcgcgttggcggagaaggctgggtgtggatggtgacccagagcaccggggtgggggtgagtgtccgaggagtacccaggtccagaggcccctcttgcggggaaggtgacccacagccccgtggcagcgggcacggcagcttggcacaggataaggccagatggggcagcagggagaaccggctggcgcgagttgtcagcagaatccagggctgggccctggggcaccactgggctgcaaggcatttcccgaggtcccagggcggcgtagcatcacatggtgga

SEQ ID NO: 647539 - DNA, 385 bp, Homo sapiens
  misc_feature (11)..(12): n is a, c, g, or t
  misc_feature (29)..(29): n is a, c, g, or t
  misc_feature (51)..(51): n is a, c, g, or t
  misc_feature (59)..(59): n is a, c, g, or t
  misc_feature (76)..(76): n is a, c, g, or t
  misc_feature (114)..(114): n is a, c, g, or t
  misc_feature (172)..(172): n is a, c, g, or t
  misc_feature (191)..(191): n is a, c, g, or t
  misc_feature (209)..(209): n is a, c, g, or t
  misc_feature (211)..(211): n is a, c, g, or t
  misc_feature (221)..(221): n is a, c, g, or t
  misc_feature (229)..(229): n is a, c, g, or t
  misc_feature (267)..(267): n is a, c, g, or t
  misc_feature (318)..(318): n is a, c, g, or t
  misc_feature (338)..(338): n is a, c, g, or t
  misc_feature (341)..(341): n is a, c, g, or t
gcacagcaccnngggcctcgccagtcagngggaccagctggaccagctggngcatgcgnatgcagcacaacctggngcagcagatccaggccaggaacacaacaggtgtgactnaggtaggccctcaaagaattcagcatgatgtttaaacactttgacaaggacaagtctngcaggctgaaccatcaggngttcaaatcttgcctgcncntccctgggcntatgaccngcccatgggtggaggaaggggaacctgaccctgagttngaggcaatcctggacacggtggatccgaacagagatggccatgtctccttncaagaatacatggctttcangancagccgggaaactgagaacgtcaagtccagcgaggagatttaga

SEQ ID NO: 647540 - DNA, 317 bp, Homo sapiens
ggttcctgtcaaagaaaactactagtacaaataacgctggcactgtgaaaaatccaccgtcaacgctcaccagaaacacattgtgtagcgctatgcagagttttatcatgtccccgtcacagtgatcctctagaatagactgattgaggatactgaagactggcgtccatcgactaacaacagactcagttctcgctcatttccgcaatccttgcccagatcactgggactgaacatttgaaagaatctgaagccgataatacaaagaaggcaaaggaaaagataccccttcacgtctttagtcccaaatacacaaa

SEQ ID NO: 647541 - DNA, 355 bp, Homo sapiens
aagcgctgtccggtcgattcgggattgccggcggtcttcgccgggcgtcggcggtcagccgggcggcgctggtgtgaggtggattcccggccagtctgaccatcttcctccagtttttccacttcgttcggaacttctcataactatgtccaccctctacgtctccctcacccagatgccttccccagctccgagccctcatagccgtcgctatggggaggctggggagggtccggatggggaggagccaccgattgttcaggccgaaaggagcaagtggtgggccgaagggcggccggctccagtgtggggccaggtggtgacaggtggtgggccagcagacggggaggccaaa

SEQ ID NO: 647542 - DNA, 240 bp, Homo sapiens
cccctcacgtagtacagtaatgcccagtgacagaggtattgaccccgtgtaagatgctatgatacaaatgtatacatgtagtactctttacttgtatactacttttctattattcttttatgagacactgtcgcactgttgccctgggatagggtgccagtggtacaaatcttggctcacttggaacctcctgcctccgtgggttccaatgctgattctccttacctcagcctccttgag

SEQ ID NO: 647543 - DNA, 1106 bp, Homo sapiens
agacgttcttcgccgagagtcgtcggggtttcctgcttcaacagtgcttggacggaacccggcgctcgttccccaccccggccggccggccatagccagaccctccgtcaccgtcttcaccgcacccgtcgtgactgcccaagggcccccggcgcacgctccagacgccgcgtcagacaccggacggcgacgcacgccatcatccttaagtcgcacgccaatgaacgaaccggagtcacaacctccgcagggttgcgccagaaactaccaccaaggactcagaaggccgccatcaacgcgcagactccaacctgggagctctaccgccatccctacgtttaccatgtcccatgtcttactacttatgaccggagatagatgtggctttgaagaactttgcaaatactttcttcacaattctcatgaggagagggaacatgctgagaaactgatgaagcgtgaagaaccaagaggtgggccgaatcttccttcaggatatcacagaacaccagaatgtgatggactggcaagagacgggttgaatgccaattggagttgtgcataacatgtggaacaaaaatggtgaatcaggtacattattggaattggaaaaactgggccatgaaaaatattgagcccattgtgttgattcattgagacaattacatgaatgagcaggtgaagcatcaagattgggtgacagtgaaccaactggcgccagcatggggaagcgcacgaacctggagtgcgcggaacacgaccttgggcaaggcaaccctgggaagacacagcaaaggaaagcaacagaccggactaataaccaagaccgcgggggagacaggaggcaacaaggcagacgaaacaggcacacgaacaatacaaaaatgcgcacaacaacagagacgaccaggagagaacaacctccaaacgacagggacccgaacagaaaagagaaaaaagtacgccccgcacacagacaaaccacgcagcgcaaaagagaagccaggaaaaagaaactaaagaacgaaaaggcgaggaccaaacaagagagaggaaacgcacaacccacaccctgcaccgagaacgagaagacaccccaacggcta

SEQ ID NO: 647544 - DNA, 684 bp, Homo sapiens
  misc_feature (78)..(78): n is a, c, g, or t
  misc_feature (162)..(162): n is a, c, g, or t
  misc_feature (212)..(212): n is a, c, g, or t
  misc_feature (218)..(218): n is a, c, g, or t
  misc_feature (239)..(239): n is a, c, g, or t
  misc_feature (245)..(245): n is a, c, g, or t
  misc_feature (263)..(263): n is a, c, g, or t
  misc_feature (277)..(277): n is a, c, g, or t
  misc_feature (297)..(297): n is a, c, g, or t
  misc_feature (309)..(309): n is a, c, g, or t
  misc_feature (375)..(375): n is a, c, g, or t
  misc_feature (415)..(415): n is a, c, g, or t
  misc_feature (419)..(419): n is a, c, g, or t
  misc_feature (436)..(436): n is a, c, g, or t
  misc_feature (462)..(462): n is a, c, g, or t
gagctgagcagtcaagatgtgtgacttcaccgaagaccaaaaccgacagagttcaaggaggcctatccagctagtttnaccgaacaggtagatagcaaagatcctgtacagaccaaataataggggatatgatgaaggccctgggccagaaccctaccaacnccgaagtgctcaaagtcctggggaaccccaagagtgatgagatgaatgtnaaagtnctggactttgagcactttctncccatnctgcagacagtagccaanaacaaagaccaaancacctatgaggattatgtcnaaggacttcggntatttaacaaagaaggaaataacaccaatcataagtgctgaaatccggcatattcttgtcacactnggtgagaaaatgacagaggaagaagtaaagatgctggtancagnacatgaggacagcaatngttgtatcaactatgaagcgtttgtnaggcatatcctgtcggggtgacgggcccatggggcagactcgtccgcatggtgctgaatgactgaggaccttcccaatctccccaaagtccgtgcctttccctagtgtaaattttgtatctagcctaaagtttccctaggctttcttgtctcagcaactttcccatcttgtctctcttggatgatgtttgccgtcagcattcaccaaataaacttgctctct

SEQ ID NO: 647545 - DNA, 273 bp, Homo sapiens
  misc_feature (190)..(190): n is a, c, g, or t
  misc_feature (243)..(243): n is a, c, g, or t
aaactgttgtttatccaaactcctccaagctaaaggagcatgttttaacccaatgcaaggaagctaagaaccttgaaaaaaggttagaggaattgctaactagaataaccagtttagagacgaacataaatgacctgatggagccgaaaaacacagcatgagaacttcatgaagcatacataagtatcantagcgaatcgatcaagcagaagaaaggatatcagagactggagatcaatttantgaaataaagcatgaaaacaagattagact

SEQ ID NO: 647546 - DNA, 260 bp, Homo sapiens
cgtcgactgcgcgcacacatacatgcactggcacatacacacagttcactgtaagctgtgcctcacagggtcagtgatatttaggtaataatgtaacattatgaaacttactaggaggattttttgtgcaaatttagagtagttaggaaatacagccttactataaaggctaaagatagcaaacggctgggaaaggcagtcaccagtgttatctgtactctaataaattccagaaggtgggaagtgacaaaggtcgacgc

SEQ ID NO: 647547 - DNA, 81 bp, Homo sapiens
tgcattccgcagcccccacccccaaggttctccaacatcacagcccagcccacccactgggtaataaaagtggtttgtgga

SEQ ID NO: 647548 - DNA, 126 bp, Homo sapiens
cctaatacaggtcggggagacgtatcacgctaagatttctacaggcggttaggaaatccttcacacatcgtcgtcatcggatgtatcacggctactggtctctgtgtcatcacgacattgtgattg

SEQ ID NO: 647549 - DNA, 170 bp, Homo sapiens
cctctcacgttacctcaaatagacacatttcttttaagtttacattttttccatttcaatttctcatatactatattgtttatttgtcatcctatatttcacctctggtaatcactaaactttgtctcattttttttctcttccatcaaatatcaattttggattcagat

SEQ ID NO: 647550 - DNA, 173 bp, Homo sapiens
tcacagcacaaagcagtcatcagatatcagtagatcaaggggaaatgggctggcacgtcagtcagcgttggtcaggttcatctgtccagtggcatcagagaccttatacagagctgcgggctgggattggccttgtcagcggtgaggtcttcctcagggttgccctccttcag

SEQ ID NO: 647551 - DNA, 293 bp, Homo sapiens
cggtgcagtgcgccagcccgtacgagggcaccgacggcaaccagttctacgaccaggtcgacatgttcaacggcgcgcttgaccgctacaactggaagctggtgggcaagaaggaattttacctgccgtacaactccgacaagatcgccggcaacaccgtcaagtacaaggacatcatccgtccgaagcacctgaaccaggacctgccgcgctacgagctgcatcgttactgggtggtcgaggccgatctcaagcccggcaccaaccacaccttcaagacgcgccgcttaaac

SEQ ID NO: 647552 - DNA, 717 bp, Homo sapiens
gaaggcctagttctccatccacagaaggctgctcatggaaggggtggcccagaacctgcaagagaggctctgtgagatggagaatagggctactaaagtcaaggaaaaataaagtaacagtcatcaaccagagccatacatatacgtagcataagcagcattagcgaggagggcggataacagagaggactcaagcaccggaacgtccgggaaccaaacactcataaaaaaaaagggggaacaagagggccatgaacgcccaaggaacaatcacttctaactgaacttaataaacgacataaacaaaactacatccgcacatcacaggatagcacaagcatacacgagactaaacaacagacacacgagactagccagaattagtcacacaagacaatctcaaccatacacgatactacacaagcgaaggagagaatgatacaacgaaagagcgagataaaacaacatccagatagcggacgggcaagaacccagactgacacacccaaacgcgtatactaactaaaaccctacgaacacaatccacacaccacacttcacagcctagaccaacagaacaagcagatgaatcagcatgaaagcaacaccaaaagatgacagaagagaagtaaacaacgtcgacggagacaccacaacacacacacatcataatccacactatgcacaactcacccagaagtaaaacacacaacacac

SEQ ID NO: 647553 - DNA, 443 bp, Homo sapiens
ccacgagaaagcctcttcccatgtaaataaaataaatccgtagaatttattaaatattgtcatattataagtcgggaaaggccttctgaatgcacgtatattgaccaaatagagttagattcaaattatttattacattttttcaacatcgaagttaagtagaatggataaacatacagcagctattccaacattaactatcaaagtagtcttactcggagaatctgctgtcgggaagtcctcaatagccctcaggtttgtatctgacgattttaaagagagcaaagaacctactattggtgccgcatttttaacaaagagaattacaagggatggcaaggtcattaaatttgaaatatgggatacggcaggccaggagagatttgctcctttagcgcctatgtactacagaaatgctcaagctgctttggtagtttttgatg

SEQ ID NO: 647554 - DNA, 117 bp, Homo sapiens
actgttgctagatttcactttgatccccctaaaagaagtcaataaaaatgtattcacccgtgaaatgtgaataacacatcccataatgctgttttagacttgtcctgatatgtgcta

SEQ ID NO: 647555 - DNA, 410 bp, Homo sapiens
  misc_feature (40)..(40): n is a, c, g, or t
  misc_feature (109)..(109): n is a, c, g, or t
  misc_feature (405)..(405): n is a, c, g, or t
ctttggatcatacttccccccagaaggactccctctcctnaccctcaaattctgatccccaacaatgagtttaggcttttgaaaagtaaaagacagggccgggtgcggncaagtaacgccctgtaatccccagcactttgggaggcccaaggtgagtggatcatttgaggtcaggagttcgagaccagccctggcccaacatggtgaaaccccgtctctactaaaaatacaaaaattagctgggcgtggtggcggacacctgtaatcccaactacttgggaagctgcagcaggagaattgcttgaacctggggggcggagattgcagtgagccaatatcgtgccacttcactccgtcctgggcaatagagcgagactcagtctcaaaaaaaacaaaactaaaaanaaaca

SEQ ID NO: 647556 - DNA, 899 bp, Homo sapiens
tccatttttataagggtgggccctttatttccaaggggtctcaagtcagggtccgggtaaccccgggttgcccccccccacccccgagggaaaccaaaacccttcatactcctcagagtgtggggggacacaaaaagaggggggaaagggggggcacgaagaggctcatctatctcaaaataaacacaacaataaaaaagttattaagagggcaaaaatattaaaaaatattgtgtgctttcactatattttcaccacgaaacagcatgtgtctcatccactctctcccctgtgtgtgtgtgagaccttgtgcgaaaagaagagacgtgtggcgcccaatctctctccttataagaagaacgaacgtgtggggggtgcgcttctaaagagatgtgagcaagagagaagactctctcctgtgtgtaaaccaaaccccgctatctcttctatatatatgtgagagacatgtagacactatatcttctaaacacagaaaccacaccaagagtgttgtgtgccctctctacagagtctctcgctgcgcgcgccccacctgtgtgtgttgaaccactcttgtggaggggaggaagtgtctctcgcctctccaaaacacgccgaacgcgttgggtgtcgtcccctctttctccagccgcgtgtctcaccaagtgtattctcttcaagacctctcgccgtggagtactcaacggccccacagaataaacaaaaatagaagcaaaccacccccacaaaacaaccaaatagcaacaacagaaaaaacaacacaaatataaataaaccaccgagtgtgccaaaaaaactcactaactctgggttgaggttactctgtgggcccccacacaattttaaagagcagttttgtgtgccccaacacaaaaggg

SEQ ID NO: 647557 - DNA, 104 bp, Homo sapiens
ggactcatcacatggaggatgaggcaggtagatcacataggtcaggagtataagaccggcctggccaacgtggttaaaccccgtctctacattaaaatacaaaa

SEQ ID NO: 647558 - DNA, 291 bp, Homo sapiens
aaaacacccgtttgggaaggccccaaggtcagtttattaaggaccccccttgcccccccccccaaccatggaaaaacaactggagggtggatggggaggccaaagggaacaattaagggtggtcccaactttgctatttactcggtatgcctttaggacatttttttaccgctcatgggccccagtttcctaaagtgtgaaaagtcaggcccttccctctaactggcatgcaacagccccccctgcctgaaagccctgaggtggcaataaaacatttatgctcaaggggga

SEQ ID NO: 647559 - DNA, 322 bp, Homo sapiens
acttgagctcctggcctcaagctatcctcccagtgcttgggagcctgaggcaggagtatcactcgaagctaggagttcaagaccagtcttggcaacatagcaaaaccccgtctctacaaaaaatatatttttttaattagctgggcatggtggtgcacacctgtcattccagctactcaggaggctgaggtgggaggattgcctgagcccagaagttcaaggctacagtgagctatgatcacaccactgcaactgcactctagcctgggcaacagagcaagaccctgtctctaaaaacgaaacaaaaaaaaaaagtcgacgc

SEQ ID NO: 647560 - DNA, 101 bp, Homo sapiens
aattcaagcttctaacgatgtacggggacatggaacaaatgggatcaatttgtgagttttttcctttaatgataactaaaatccctctaatttcacaaaaa

SEQ ID NO: 647561 - DNA, 1924 bp, Homo sapiens
  misc_feature (387)..(387): n is a, c, g, or t
ttcagtgggtgtagtcgtggaggagagatcgaataagtagggtggtgtgtcatctgtccactagagtacacaccctctcgtgtggtgggtgagttctgttgtcattagtttagtctctctgtgtgtttgttcgtgagcattagtatagtatgtctgtgtttggagcggacacacactagctggggttagatactccagagaggcgccttttttattaaaagaagtgtgtgggacaatatattttatttagagtcaggcggcgctctttctttactcaactgtggtccggcagaaaatagttgccgtaccggattgttggtttgttgcccacacaatatccatcgcttgtggaatagatgggttctttttctccgcgcctctctatgngaataggtttgtctctccacaacatgataaattccccggtgatacacatatcgtacacaccgaccaaacccacgaatattggcgccgccgctgtgttgttcctgttcgtgaggcccaccacgcagtaaatgtaaggcgcccccccacaccgcttggtctgttggggagaaaagcttccacaagtgagtggataccggaggaaggacgcacatgcttgtggggccccgcagaggaaatccttttgtgagaccttgggggcgcccaccgcccgcaagagaagaggcatcgtctttgtgaagccaccagatccacctgaggtgaatacgccgtctgtggggtgaacaacgcaccacgaagattggttttttttgttgcctctccaagagggtatttagtagagaattgtatgtgttgtctggtaacactgttctctattctagggggggaggtgtgcaccaacacaaaagaggcgcctccaaatagagcgcgttcaccaaacaaaagaagggtggttctacacaccacaacggtattgttgtttgggggcgccacaacccactccaacaggatatagactttgtttctctctcctccgcgctcaggatgcccccccccctcgggaggggctcctctggtgcgccccaaaagaggtgtgtggccccacctgggttttattatttgtggagccgccaccaatatagaggcatccatactatacttgcggtttcttcggtggttgtgcaacccctggtactgtcctattgtgtggagcacaacacgcgcgtctctgttgggctctacgaaaaaaaaggagcggtttaccccacgagtcctcactccgcccaactcttgtgagagatatctctcacacacagagaagatattttataaaaaaagaatatgtggcgcccacaacgggagctgaatccctcttatttcacaacagggattctcgcgcaacacagtctcttgatttcaacacagagaccacaattatggcgctctctctctctcgcgagactctatatggagcgctctatatctctggacacacacagagagctactatcacacacccttctctctgggtgtggctcttttggtggtcccacactcattaggtgtgagaagtggagaccacacagggagacttttgtgtacacatgtctcgagaaaggcgtctgttgtgtgtgtgtgtggagacaccacacagaaagccgggtggcgtgtcaccacctctctcccacacatgtcctctggcttggtggcacagagcgaaacgcgcgcggcttctcggagaaaagatttgagcctctaaagttcacttgagcacccaccctgccacaagtgttggcaccatggccgcctttccacgagaccactcggagaggagagaaagaaaagcacactttcactggggcccactgtaagaaaagaacccgaattgcaaagagaagaaagagacgcttaaagcccgaggcaccagattttgccaggttggtggggtttccaatataaagattattttccccctgga

SEQ ID NO: 647562 - DNA, 1002 bp, Homo sapiens
cggacgcgctgggtcgacccacgtcgtcgcgagacgcgtgggtccaggacgcttgggtctgacccacgcgatcacgggtgatgtacagataagcatattatgcgtccggagacaacccagggatatctgagatgtctatgctccgtcgtgactagcacacgagatatgtcacttagtaatgagtggcgaaagtgccgcggctattagacgggggattctgaatggtctatgcgctacgtgtatgcgcctgcgagagctgcgccaagagactattgtgcagattgagaggtgtttggggccacttgggaaccaaaagttatacttgacttgacaagggccactaattttggtgacgtggtgcaccttggcgttgcatttggacacctcagcaaggtggcttgtcctacagacaatgtgctatggggtccattggcgcacgagatggaatcctttaacttgcaacatgggcctcaattatgttgggaactggctagcagctcgtgttgcaactgcaaaattactcagcactaagctttgggaacaaacgtccaattatgggaatttgcgttgccgatgccccacgtggttaagacgctgtataccgaccctcgttggctcataattgatgagcgcgactttgcgaatgcggtccacctttctcggcctccaagaaaagggctaaccccaaacattgggacttaaatctatcacagatagcggattcataacttgggggagattaggcctccgcattagaagccgggcagcaggacattttgttagggcactttgcggaagggcgagcgttatggctactttaagttcaccaccgtcaagccagattcaaaatagcgaagacacgagaagaatagcctcttagcggtgtcaatttagacatactcgctggccataagccataacaggaagagttatcgaaactggcctgcgcaacaggaattagccatttacggcggaaggagaccaaccgaagttgcattatcg

SEQ ID NO: 647563 - DNA, 373 bp, Homo sapiens
tagaggatccccgctcttaggggtagggtcttagtttgtagcgtttgccaaactgtttccagcattcatgagttcaggaagctttgcggggcgtgacaaaactgttgcctgagactcaggggagctttttctttggactctaggcctgtgattaatttctggctaatcaagttaattgacacagatctgtcacagtttctcattgcagggtcaagagttctagaattcatctattctacagttaagccttctccaaagatttgtgcctgcacatcatcatcaagttaaaagaagaaagatcatctttgtgatgtttgggaattgcttacgttaactgccggaagcacatgcgcacgcacacacacgcgaacac

SEQ ID NO: 647564 - DNA, 1074 bp, Homo sapiens
gatccatctgcatgccaagttattggttttaatagcttaagttaggaacaacacggcagtgatatctggtggactcttccccctgaacaacgttcttccaagaagaagtcttatctgatgttggtggccctgatgccttggaatatgtgccaggtcaggagtattttggacatctgcgctttgatagcggagactatcatggtcttatgttcttccaagtcctgaccaaagagcagatatgtacttggaaggcaaaagaccagctcgggggttggctttcatgtcatccttattagcaagtgtggcagctcaggaagagtagcacccttatacagacagtgataggtgtcatggatgttacccttgcgcgcattgcggggatgagacagatgtccaagtctcttgggaactgtcgtttcatcctgatgtagtcgtcttctggaggactaagatcaatagcgagagagcctccgtatggtgctagatgtcctttcggctgcctggagtaagctagattccgaatgatattcacgcgatagtttagccacttggtcccattccgatgctcaaatgtctgcacagcacggactgcatacttacgcgaaggcctataggcaattagacacttcgccatgtacttctcggcgaaacatgctgggcctggactcgtcagaccgcagcaagacccggagtttcccgcatactccgctatggtagagaccgaatttcattggtaacttgttccattcatgcacagtcaaggttacctgattggtcttacacaaccttgtcatcttggccaagtcggacttttcggggcgcgactatgcctcgaatgctaattttacacgcctgctactctcttcaaaattgcctagtcactctcaacgtttatatcggatctttcttctggggcacaccacacggttatgggataccccggagcagcttggatggtaacccaggggatctcggtcttatcaaattctactccgtctagtacgaccaaatcgaccttccatcccattatgtgtgcgtgattctaggattcttgatgccacgatataatacacc

SEQ ID NO: 647565 - DNA, 329 bp, Homo sapiens
ccctactaaaactctacagacaacactcccatccatggctaggggaagagggacacaccattgctgaagtagctctttatcaggtactcatgttgtggctaatctctaatatttaagtggttataaacacatatagaaagcagatgacataaaaatcacatcaccagtgcatttaaatgaaaaccagcatggaagagagaagggaccccttataaaaggcaaaaacgaattggtttccccaagggaagccaccattgaattggcagggaaggagaaggaaaattggttggccaaaaaacctggaggttattcttttcggtgattatttg

SEQ ID NO: 647566 - DNA, 353 bp, Homo sapiens
  misc_feature (44)..(44): n is a, c, g, or t
  misc_feature (176)..(176): n is a, c, g, or t
  misc_feature (321)..(321): n is a, c, g, or t
  misc_feature (337)..(337): n is a, c, g, or t
atcttttccttcctactgctccctgggccagccctaagattctnagcaagagagtattctggccctgtgcggtggctcatgcctgtaatcccagcactttgggagacaaaggcagaaggattgcttgagcccaggagttcaaaatcagccagggcaatatagtgacaccccatctntacaaaaaaatttaaaaatgagctggatgtgtgggcgagcacctgtagtctcagttacttgggaggctgggtgggaggattgcttgagcctgggagattgaagctgcagtgagctcttgatcacaaccactgcacttccagcctngggaaacaaagccagnttcttgtcttaaattt

SEQ ID NO: 647567 - DNA, 1165 bp, Homo sapiens
taaagaaaagttattaccaggtatttggggaggcaggtttacaacactacaagttctggagtttaagaaaggaaagaggaaaaagagaaaaaacaccaatacccagaatttaaaaaaaaaaaaaggcactcatgagttcttgagggagtccattttaacccattgaggaaactttctacagtttattttcgatgtgtgttagcggtggtaccacagtctcgaggtgagattataagtataaaaattacacaagtgtgtggtatatagggcgcttatatgtggagtataaagtgtggcgtgggtatatatgtgaacccatataataatacagaggtgtgtaattttatgtgtgtattatacccacgcgcgggggggggtcttaataaaaccgggtgaacatatgtgggtttaaacagacacacaaaatctctgggaattctccaaaaaagagacacaagtgaaagttttgggagcaattctcccacaccccgtggcccccatattggtgtggataacaccggtgagagggcgccttcttgggggaccctctttaataaaaaacacacaacatcttataaaaccctcaaaccacaaacgcgtggagaaaaagggggagaaacggggcaaccgggggtataaaaacgggggggccaagcgtgtccggaggaataacacaggcagaaatagaggccattcacatttttcgacacgcgaacgagccattggggcagaaaacaaacgggagacaaaaaaaaaaactcctgcgaaaaagtgccacagggggataacggcgagtaacaaccacatcagtaggacacacacaaaggaactttggggaaaaaaatacggtggagaaaacacctgtgggaccccaaaggtggggccactaaccaaacaagtgggacagctgctcaccccatcggagccaaaccaaaaaaagtggggcaaactaaaaaccccccggggcaaaaaacgggcggacccaaaaaaacacccgtcggtgaaaaccacccacaaaaaagcgccgcaacaaaataaaacggtggccaaaactacacccggggtcacaacacccacaccacaagaaacacaaaaaccaacacaaacaacaacaaacaaacaaaacaaacaacaaaaaaaaaacaaacagacacgaacacaacac

SEQ ID NO: 647568 - DNA, 275 bp, Homo sapiens
aggcaggttcactgttgccaggctgtagtgagtggtgcaatgatagctcactgaagtctcaaattcctgggctgaagccatcctcctacatagctgggactacaggtgcgcagcaccacacccagctaattttatttattcgtttttttgacagagtctcgctctgtcacccaggctggagtgcaatggcgcaatctctgctcgctgcaacctccatctcccaggttcaagcaattctcctgtgaaggagtaaataatgtagacaaagggaaaca

SEQ ID NO: 647569 - DNA, 410 bp, Homo sapiens
gtctatcagatttataaaagcacctagtcagaatgcccaagatcctgtcctgaagataccttccatatgcacagttcttctttatagcattaactgtaacagcaaaagactagaaatcatctacacatgcatcagtccaaactggttacccaaattatggcatatttgtacaataaatcagcatgtatcttttaaattaaattatctcctcaaaaaatatgacagctctttgggaactgatatgaaagataactgagtcatattttacttaaaaaaaggtgcaaaaataatgtgtacaggatacacgtatgtatagaaaggttacacaagaatgtagttgggtggctagaaggaatgagaaactttttttttgctggttactcccttttgcactttttgagtcttgctct

SEQ ID NO: 647570 - DNA, 289 bp, Homo sapiens
acttactatccaactgatcaataatgccttttatctgattcatcgaggcgcttcctgtccacccgcgtaatctgccaatattttcccacccataaggtcattgctgtgactgccaggacaaccactaatttgttgattttcatatagcctcctttctatttgatggtgattacattcacacaactttaataaagtagcggcctttctccatatagtcaattgaatcttattcatttccaaaaggtataaaatgaatttcactcacttaatgtaagcgctaacaaatgtt

SEQ ID NO: 647571 - DNA, 364 bp, Homo sapiens
aggcttttttcaagggcgcatggtccaacgttctcagaggcatgggtggcgcctttgtgcttgtcttgtatgatgagatcaagaaatacacataattatgtcctaggtgttctccccgagaacaggcatgttgtataatataccatatcttgaacattctggacagattctctgggcttgtctgttttatcagtggcaactatttaccagttgaaaagtgggaagcaataatattcatctgaccagttttctcttaaagccatttccataatgacaataatgatgggactcaattatattttttatttcagtcactcctgataataaaaaattgaagaaataaaaatacccaaaaccaaaaaaa

SEQ ID NO: 647572 - DNA, 751 bp, Homo sapiens
  misc_feature (369)..(369): n is a, c, g, or t
cggtttactggaattgctctggtgatcgagggatcctattacaccgtaatcattgtctattactgtccgtataactggaggggccgtgcatggccactgaatggtgtgaacgaatgtttgtgttggaccattcgttgacatacaggtcgcttcgtggatccaggcccagatggtgagtcgacggattttctcgaggaagatactatttcctcagtgtgctgaccgcgtctgtgacatcagggtctcgagtccgcgtgcctcagtcccaactggatcgtgccatatccaggttgccctatgacagccatacaacgattcgcgcgtctgaaaccgttgtacttgaggttgagacgggaatggtccggcaanggaatgccaatacccttttaatattcgctttccattgagggccgatggtgggttgggcaccataattccgtttccttttgggttaagttggaaggaaaccatcgggagttcttttgaggccccgtataaagccttataaccaaccgtggtaggccgccatggttccgatgtggttacgggcgcgattagaggacctcgcggagattaagccctatttcaacacggcgcgccttttaccaacttttgtttgcccttccctacgttaaaggcaataccctttcgaagtttcggtggcttgggctcaccccaaattggcgttgggaactcgtcggaagtgggacacgttttttgttgggggttccaggttggggtcaatcccctg

SEQ ID NO: 647573 - DNA, 430 bp, Homo sapiens
ctggcatgcagcaacacttctggccatcttgtgacgggtcacagtagtaaatgaaatgatgggacagagtcaccagtgccagccatctgcattgtggctgctgttccagtcacagctgtgacactgccagggtagatcctctgagctggcaattctaaaacggtagatgtatggcacgtaaccctaaattgaaatgactctgaacacaattaaaaagggcatacagacgagctgcaagcactggaacaaagatcattcaacccccgacaagagtcataaccacagctgactcttagcttcacaagcagccctcagaaggtggtagctatgtattaagcagcaggcatgcagacaccatgaaaccaaaggacagggccagtcagggctggagtctgaccagaaagttccatgccctctgctttctgcatgg

SEQ ID NO: 647574 - DNA, 177 bp, Homo sapiens
ggcattttccagagattaatggagatgcttgtgaatctatgtatcattgaatgattgttagctaactagcacctatggcaaagataacctttaactagagaaaatgcataaggaaatgaaaagcatttgccaaatggaattagtgtaatattttgttgaagaaagttttaaatgaat

SEQ ID NO: 647575 - DNA, 638 bp, Homo sapiens
gagactggcagccgactctggaacccagattgttgcttcccggtctagtgatccttcctccataatctgatactcccacacgggtatgtactgaaacaactacgtcagttacatgtgaattgggaggtatccgagtgcccttgtcggtggagcgacgcaggactttctggtagttggcgcgactaaaaatcgccagtagaacggacatctcaagcacctacctcaacaagtgacctgaaccaacaaagcgtacagaactttccccatctacttacatagacaaagacactccagagcctcaagagagaatggcgggactctaggcgctcgcacgctcattgcacactgcggctgccactcttccttcgctgaaccgaccatctacgagcaatccaagaggaacccaatggcctccgcgcgcgacacgcaatacgacgagcaataatccacatctacccggcaaagcgaactgctgagagttccaccaaacagtagccgaataaaagtccctcaaacgcccaacgtacacactcgccgacgaccagctttcacaccaaccgtgaccgccccacgctatcccgtcagcacggaggcacaatcgcacgaacaccagttgcaattagcgcgggcaacaacac

SEQ ID NO: 647576 - DNA, 312 bp, Homo sapiens
ggtggacggagtgacagagaacttggttaaatagtgcaaccacttcactgaactcaagggtggtttctcagtattcaaggtctgctttctccaaggagtgtaaatgcagtgatgaaagtgatggacccagccacagccaccagtgtagatcttagagatataaaaatagtaaagaagctgggggggacaatggatgacggtgagtggggggaggggcgggttctcacccaaaaggtgtcaagttcgggcataaccagagtggagaaggccaggatggggcttatccagtttggcttatcgggggtaccgagc

SEQ ID NO: 647577 - DNA, 612 bp, Homo sapiens
  misc_feature (13)..(13): n is a, c, g, or t
  misc_feature (67)..(67): n is a, c, g, or t
  misc_feature (81)..(81): n is a, c, g, or t
  misc_feature (95)..(95): n is a, c, g, or t
  misc_feature (98)..(98): n is a, c, g, or t
  misc_feature (183)..(183): n is a, c, g, or t
  misc_feature (243)..(243): n is a, c, g, or t
  misc_feature (264)..(264): n is a, c, g, or t
  misc_feature (302)..(302): n is a, c, g, or t
  misc_feature (327)..(327): n is a, c, g, or t
  misc_feature (450)..(450): n is a, c, g, or t
  misc_feature (491)..(491): n is a, c, g, or t
  misc_feature (573)..(573): n is a, c, g, or t
tccgctgccaggntatcgtcccgggaagccccccaccccctcgctttcctcctccgctttccctaanccgtctcgcggggncatctacgcctcgnccncgccctcctcctcctcgccctccccttgttcgtcggccgtggcgtcctggtactgctggtactcggccaccaggtcgttcatgtngctctcggcctcggtggcctccatctcgtccatgccctcgcccgtgtaccagtgccgggnggccttgcgccgggacatggncgtggactgctcgggggtgcgcttggccagctcctggntggccgtgctgttgccggtgacggnggccggcatcttcgggccgcggggcggggtgtcgcacacggccgtcttcacgttgttggggatccactccacggagtagctgctgttcttgttctgcgcgttgagcatctactcgtccacctncttcatggacatgcggccccgggagatgggagccgccgtcngtgtgcggggtggcgcgggtcgcaggcggccatcatgttcttggagtcgaacatctgctgggtgagctcgggcacgtgagcncccggtactgctggctgccccggctggtcaggggcgcga

SEQ ID NO: 647578 - DNA, 532 bp, Homo sapiens
gcaggtcaccctgtcaaatgcccagctgaaagcattcaaatgatgacggagaaggcgagagaagccctcagacagcagaagaggaaagcaaaggcctcaggagagcgttgccatgtggagccccacccagaagctatctctgcggggcctacccctacgtcctaccctgtccatggccagccatggtgaccacaccatgggcttcgtaggactggtcccaggtatccgctagcgcgagctccaggactggcagcaacagctggtcaacatctcgtgccatgaggaacaataacggatgcacctgtggaccatctggggactgatgcactgctatgactccagtgcccccccaaaggtacgcaggtaccaggtgctgctgtcactgatgctctcacagccaattctcaaacgaccatggtgactgagcgggcagctcatgcatgcgactgatgggcatgcggggcctgacaggtggacaagcatcctgcagacaggatgatgccactgcgtgggcaagcctcatcctaccccc

SEQ ID NO: 647579 - DNA, 469 bp, Homo sapiens
tccttgatgtatagaatctccttgtaaaataaataattgcattgtatatcagtcttcccatcaatattaattattaaatattttagaatttttaaataccaactatactattctggtgtgaggtattttcttttacattacactctatcccaaaagattaaatccagcttaaaaatgatatgtaagccaggtgtagtggctcacacctgtaatcccagcgctttgggaggacaaggcaggcggatcacctgaggtcaggactttgagaccagcctgaccgacagggagaaaccccatctctactaaaaatacaaaattagctaggcgtggtgacacatgcctgtaatcccagctactcgggaggctgaggcaggagaatcacttgaacccaagaggcggaggttgcagtgagctgagatcgcgccactgcactccagcctgggcaacaagagcaaaactccgtctcaaa

SEQ ID NO: 647580 - DNA, 446 bp, Homo sapiens
attgcaggcaagttcagtgcaattcaagctcaaatcctataaaagactatacccaagagtaccagaaaaacagaacatttccaataaagtggagatggtgcatgaataacagggggtgacgttctgcagttctggaggctggaattcctagaccagagtgtcagcacagtcaacttctgcataggagctgaatttcctacattcgaactaccactctttacttgatcttagccaaaaggcttagagatgatctctccaaaccgctcttgtcagaatctgcctgggtgagcctttttgaaatatatctcctcggctccttctctcctctagacaccaaccgtttattcttaaggcctgggcccaaagctctcatctgttctgtattctgttatttaatatccacaaggcttcattgctaaatattctacttgttccctaccatcaaa

SEQ ID NO: 647581 - DNA, 452 bp, Homo sapiens
aaactttaatttttaaacctaagtgatgatacagctcttcccttagattatcgcccagggtggagtgcagtggcatgatttcagctcactgcaagctccccctcctgggttcatgccattttcctgcctcagcctccccccgagtaactgggaaaacaggcgcccccccccatgcctggctaattttttgtatttttagtaaaaatagggtttcatcatgttagccaggatggtttcatttttattctttaatgagatcagaggggaattccccaagaaagacctttgctgttcccttgtgtcatccaaaaactgctcaaagctcaaaattataaaagggttttgagcccctaaagatttttaatttgcttttaatccctgaggggggaacatcatgagggaaaatttgattttcaaagttagttaaataaattgtatgggcttttccacca

SEQ ID NO: 647582 - DNA, 323 bp, Homo sapiens
ccctacaacttcctgtacttaattccttgttatctgatccaaattttatattctcctcccccaattttctccctttgtctctctctcctttattgattcttactactacactacatgatgtactcataggaaagaatgatgctcaaataaataaaatgttctttacatatcagaaatattattaaccagctacttccacatgccctaatctagtgttcaattcactaaaagtttcactttacagattttcaactgatttccacatcttagtatctctcttatctctatttcgagatcaaggtcattaaaatgatctaggtact

SEQ ID NO: 647583 - DNA, 166 bp, Homo sapiens
  misc_feature (20)..(20): n is a, c, g, or t
  misc_feature (134)..(134): n is a, c, g, or t
  misc_feature (146)..(146): n is a, c, g, or t
gaaactaatcaacagagacntgagtgtgggtctcccgatcagcattggtaacttttttagctgttcatagattaaggaaagacttccttgtcagtgaaaatcccaactattgtcaattctgcaataaaacgcanatcagttcttancttggtgatgttggtgtttt

SEQ ID NO: 647584 - DNA, 333 bp, Homo sapiens
tttgcccccatcctttttttccagggggggggccttttggggggggggcccccccaggtttttttttcccccgggggggggtttttttccctttggcccctccccccgggcccggaagaaccccttttggccccttaccccccccccccggggggggggacaaagtttggccccttccccttcaaaaaataccccccaaggggaaaaaagggttttcccttcccccggggtttttttttttggttttggggggggggggccccttttgttaggggaggggccccttcccccaaccctttttttgggggataaaaatttggggttgggggggga

SEQ ID NO: 647585 - DNA, 929 bp, Homo sapiens
  misc_feature (373)..(373): n is a, c, g, or t
gggcggcggcgccgcggggcaaatctgaatgcggtgcggagacatggacgtctgcttgagattcaagacattttgaatactgcttagatatggaacctctgtctatttgtgtacggctttgtgaacaaggcaattaccccagaagcttcatacatcggttataaaaggagcttcgcaaggcttcctgcacagccactgaaggcctgctgcaccaattaatgacaagctgacctttctggagaactctctgatgccgcattctgtcacgctctgcaaccaggctcccgacagactggcatttgctcggttgaacgaactgtaccacgtagaaaattcactggcattgccacgccagctgtacccaccaaacttntctaccttttttaaacacacggaattaattaaaacactcataggcttttataaacactcaggtggcaaacgttgcgcttaacaggagaaggaaccctatcagcattgtggttcccatccaccatctttattcacttttttttaaacaggctctaattgcctttggcgcattggcctactggtccatatttaattgtatcccctctatttaataaggctctgaatagacttttaatttttctaaaggcagtcgtgttcttatacaggaatgtggcaccatctgcttgttcccaatggttgcaagtataggttggaaaccccatccagtagtacttgtgtaacgtacggttattgcacttgttgaccatttcaccattaacaaacctttactttcggcacttgctattgccttactaacttgtggactaacaattggtagtggcggtgacaagttgaccagggatcgccaccacttgggcatttttattcaggatcattatggtttccgacctggctttgcaacaaaagcggaaccatttctgtgtccactcttgaca

SEQ ID NO: 647586 - DNA, 288 bp, Homo sapiens
tccctgttggaggagggcttttggggggccataaaaaacaagcaggaaggaatttagtaggggccaaagggggttttgtttggcctgtgagccccgttcctacctgggcctgaccctccggttcaggtaccacaccgaggaaaggggccggtcccaaccatggccccccttggggccacccctcaccctgacaccgaggtgttggccccccctccccctgacaccgaggggtcctggaaaaaaattaggttttatattcctaaaaaagtaaagggggagagacctgga

SEQ ID NO: 647587 - DNA, 762 bp, Homo sapiens
gagcggagggacaggcgctggtgcccatcctcgccgggcgctgtccgcccgcactgcctgttccgacggagagacccgcagcgctgaccgttgcttcccgttcatccacgcttcgccaccactcgtgtccggtgcaggtccatcaaacgatctgtggctgcatggggaacgagggggacacaattccaaccaggtacaaacctggtcagacggggcataatccgcatgtttaccctgggcgaagaagcccgtgcactgaggtcgtctcggggaaacgcagagcctgacgtgtgacggctggaagcgacggatcagtcacgtggtgcacgtccgtccgtggtgctgtgcaccgtgagaatgatcaggactgagtccacggtcttgtggagatgttcgacgtctctgagatgggatccaacggtacgtgattcccgaatcgtgggagaactatcaatggtgagacatgtggattaggctcagacgttcgtctacaaaactgagtcacatttggcgtggacgagcgtgcacaatccaattggttgtatcctaaaataccaacgatctaacatagacccaaggagtttccccaggttccacatgttgatcacgctagcaagggcactgaatttacttagtgtcgcacgaggcacttaggcaaaggaagcccatgacaaacttccgatggctaccatcaataaactcaagtgagccgtaacgtagcaccggttaaccgagaaatcaccaaacttgacgacaatgcct

SEQ ID NO: 647588 - DNA, 163 bp, Homo sapiens
gggtcatagtggatttgagcaggaagatgaaaatacggcagttacaatagttaccgggacagagaaatgcacactatgtatcaaatagcaagggaaatgaagcaagattataacacagtgtggcaacgcacgagcaagtaaccatgagagtaacatgactttg

SEQ ID NO: 647589 - DNA, 205 bp, Homo sapiens
  misc_feature (14)..(14): n is a, c, g, or t
  misc_feature (159)..(159): n is a, c, g, or t
  misc_feature (195)..(196): n is a, c, g, or t
tactgctacttgcnttgtggtcatcgataatttccataatgccttccgtggagggggctccctgcctgagagcctgcggggggtccaggagctgacaggccgctctgtggagtttgcggagatggacattttggaccagggagccctacacgcgtctcnttcaaacaagtacacgctttactggcggtcatccannctttgcggg

SEQ ID NO: 647590 - DNA, 686 bp, Homo sapiens
aggctgtctagaggatcccacagcagctatccaagtctttgctattgtgaatagtgctgcagtaaacataacgtgtgcatgtgtctttatagcagcatgatttataatcctttgggtatatacccagtaatgggatcgctgggtcaaatggtatttctagttctagatccttgaggaatcaccacactgtcttccacaatggttgaactagtttacactcccactaacagcataaaagcgttcctatttctccacatcctttccagcatatgtaggtaagttcttaaatagcaattttattttgagatggagtctcgctctgtcccccaggctggagtgcagtggctccgctcactacaagctctgcctctcaggttcacgccattctcctgcctcagcctcctgagtagctgggactacaggcgcccgccacgcccggctaattttttgtatttttagtagagatggggttcaccgtgttagccaggatggtcttgatctcctgacctcgtgacccgcccacctcggcctcccaaagtgctgggattacgggtgtgagccaccgtacccggccatagagcagcctcttccttttcctgttgggtctctgctcaaatgtcatgtcagagaggcagacctctggggcggtctatctgagggaatgcacccaatctccttcctctgac

SEQ ID NO: 647591 - DNA, 277 bp, Homo sapiens
cgattaaaatacccggggtttttaaaaaaaaaatttaagggggggccttggggaaaaaattatttttttctgaaaaagggtttccaacccaatttttttttttccccagttaaagggaaaaaggggtttttattttgggggttttaattgggtaaacccccccctcccctgggggaaaaaaggtgtcccgggcccccttcccgggacttttttttttttttaaaaggaaaaggatggggttcaaaaaagggttcccccctaaagttgggggttttta

SEQ ID NO: 647592 - DNA, 466 bp, Homo sapiens
  misc_feature (9)..(9): n is a, c, g, or t
  misc_feature (416)..(416): n is a, c, g, or t
ggcacgagncatttctcctcatccttcattggctcccacggacccccagaacatcttgacctctaccgtgcaattcacgggagctgcccgggcacgaaaagcaatatcagcttggagaaacacttctcaagcctgccgacccggttgcacgttcattcttgcattgattggttcgtaccctgtgtactgagcgcttagccctgtactccggctccttttgaggccctgtacttaagctcaatagtcccacaacagctgagagtgtgcggtctagtggggaaggaaaatgcagaaccaaccaactaggtgtgatactatgtggtttagtgaccatgcagaagaccgtcccccagaacagcataaaaagaaccttttggttagggctgggggtcagcttcacagaaggtaacaacggncggtgaacagctcaagcaaaggtcccccagcatgatcccagcctttgtca

SEQ ID NO: 647593 - DNA, 829 bp, Homo sapiens
  misc_feature (337)..(337): n is a, c, g, or t
  misc_feature (759)..(759): n is a, c, g, or t
gctgtccggtgaacgtccttcatcctgtcctgtggtgccatcttgtgttggcctctcatacactcatcagggagcacggctataacagaacttctatcatctctagtccggttaccaggtctgtccgtaactaagacacatgtgtgcatgcatgtgacttggaggttggaaggaaaggcggtcgatgttggagacgaatctgtctgtcggtttgatgaccaatgagatatggtgaacgagaggatggaggattgttgtcccaagatcgtcatattcgagctggggcaagcagtagcacgaggatagctagtgctctcatattgaatgctcacattangaccgtgactgaatttggaggggactattgtactcgtataaagttactcacattacaagtccgtgtccggctcgcttctacaactacttaattcattcctggttgtcgccttcgagtgtgtacccttgatatcctaagggatgtgaagcagggtgtttttgggcccattgcaatgatgtgaagtatacagacaactttggttgtcccatactcactatgccattgggatcgagagatgctagatgcaatacactttgtattgtgcatgtatactcttaacttgtctatcttagatggagaagagaatagtaaactggagaataaggtgtaatatacaagactgacctgtacatagagggcataggtacacaggtttaagaaatggggcagaaaggatcaagctcattttcctttaaaaaggncgttgttatgcttgtagtcttgaaatgataatatacatagagactcaattgagtggaagtgatgcggaaa

SEQ ID NO: 647594 - DNA, 113 bp, Homo sapiens
tgtgtagtaagggtggaaggtgatttatcggaatgggaggtgattcctagggctgtacaaaggagggggacccaacccctagtccagacaaaggtccctaaggcaggtgtaca

SEQ ID NO: 647595 - DNA, 364 bp, Homo sapiens
  misc_feature (364)..(364): n is a, c, g, or t
gtacgatgtcatgaacagacagaatccgtagagtcagatgaaggcctactcctctgtattatagaaacaccatcggaacgatgtatgctctcagtataatgctgatgcatgtgcatgacgcagattataaagcccaggcgtgattcaagggagagcaggccgttgatcgacgacacaatgctgtggagacagcgtggagcgatgacctgcacatttcgcatgctacctgtagcgacaaaggcaccttaacgagatacagatgcgcttagatgatttcatacccagactatagcagatcctagcagataagatgaatgcatccatacgagctaggtatcacgaacgaagtggtccggacgcattn

SEQ ID NO: 647596 - DNA, 417 bp, Homo sapiens
agtagaggtgatagagcaaccgactgagggggaaaacaatacgatcacatgcgtgaagacatcgatgactaagcatggtaagtgcagaaaatgggtcggtccttacagccaggtagatgagggtatctgacctgtgccccacacagatcagcttggcaatcagaagagcatgtgactgaagtcaccttctgaattctatggcccctcatctgtcaagtgtaccatatagttgtaatgagtcaagatctattactacttagtaaggtgagctcgggtgcagtggacaaatttgaaagtctttgactgtaataggcaatgcttagctaggatattgttatataatattccctaacactcagtataaaagcaaatctgaatgcaattaagctcttcaaatcaaatgcctggatttatttc

SEQ ID NO: 647597 - DNA, 275 bp, Homo sapiens
tacggaaagtcgagtgggcaaagctgtggcatgggaatcttctcaggtgaaccaggtcaaaagatccaggggtgccgctctcggtgggtgatcacaccaattcttcctaggttagcacctccagtcaccgtacacaggttaccagtgtcgaacttgatgaaatcagtaatctggcgagtctccaaatcaatctgaagggtatcattcacctttgatgaggggatcggggtagcggagggggcgggcatcatgagtcaccagatgagggattcctt

SEQ ID NO: 647598 - DNA, 669 bp, Homo sapiens
ggcggactcggtggctagccgatgaggaggccgggggggaacccggcccccgggccctgagagcgactgagcggagcgatctgcgcaggggccggggagtcatggtctccatcacccaactccatgcttcagagtcctgctctctgttcagagctcccctgctcggctgtctggcctggctgtctgatccctccagtacaggcctgcgtgctttggggcccagcaaatggggggatcggcctgttggaggaggccccagtgcgggtcctgtgcaaggactggagtggcttctggacaccgaggcgaatgagccctggggagctgctgcggctggctgtggccatgaagccccgaggcaaggtgcgcgcccagccatgtactcggtgtgcgttcttcgtcgtctgggccaggctcttggggtgtctcgggcacggacgccctcctgtggcattgctgtgtcgacgagctgcagggagcttgagtcgatgctccgatctatccgaagactgcgctctcctttgagcattcacggccatccacgtgtgtctggaccttgcaggcttacttggctttccatctgatggtcccctggtgtgtgccctggaacaggagcgaaggctccgtctccctccgaaggcactccccctttgcagcccttctccgaggtgg

SEQ ID NO: 647599 - DNA, 158 bp, Homo sapiens
ccctgactggtcacacgctgagctctggtcataagctgagccctgatcctggtcacacgctgagctctggtcacacgctgagccctgaccctggtcacatgctgagccctaatcctggtcacgcactgagccccaaccctggtcacacacgggtaccg

SEQ ID NO: 647600 - DNA, 298 bp, Homo sapiens
aagatctcactctgtatctcaggctggagtgcactggtgccgtcatggctctgcagcctcgacctcccgggctcaagcgatcctcccaccttagcctcccaaagtgttagggttacagacatgagccactgcacttggccgagagttatttttttacaaaaatgggatcaagcccagtgtgtgttgcgcctgtagttccagctacttgggaggttgaggtgggaggattgcttgaggctaggagtttgagaccagtctgggcaacacagcatgactctgaccagtctgggcaacacag

SEQ ID NO: 647601 - DNA, 222 bp, Homo sapiens
atccactgtttcttttaatatgaatttttagtaagatgggcgtttcaccatattggccaggctggtctcaaactgctgacctcagggtgatccactcacctcggcctcccaaagtgctggtgattacaggtgtgagccaccgcactgggcccccactgttttttttaaattgcatttttagtagagatggggtttcaccatattggccaggctggtctcgaa

SEQ ID NO: 647602 - DNA, 1021 bp, Homo sapiens
ggcgtcttctgcgcgccggggccgctctccttccgccggtgccgcggcgcctcatggaagccccggagggcggcggagtggggggctgtagctgcggggcccggatgggcagtcggcgcccgaagtcagcgctgcacttccgaggtggcgaggttcatcatggaggctggtgtctcgctcgggctgcggtccattccccaggtcgtcgcagcatgcgttgcagccatttaccactcaacagcttctctttgccgacgcatcaccctgttcgcctagtgatccttacctgattgccactgtcttcaattgtacttggccgctgcgaggtgggagagcacgcacctgcggactcgtgacatccatcaatgtgtgcgactcaggtactttaaccccaagtcggtgagccccctggaatttggactcccgccttctgggaactccgggaacagcatcgtgcagtgtgcgcttctcatgctgagagttctgcgcttccaggtctccttccagcatccacacaagtacctgctccactacctgggtctccctccaggaactggctgaaaccgccacagttggcagcggacccctgttgccgtccccgcctgggccctgctgcgggacagctaccatggggcgctgtgcctccgcttccaggcccagcgcgatcgccgtgccggtgctctacctggccctgccggtctcggagttgaggtgccgcgcaggtccacgctgcacgcgtggttggcaggtgttcactgcgccttccaagcccatcattgctactctggcgctgcctcatacggtttccctgggcggagtccctaggtctggccagctgcctaggagccaggtgcgtccgggcctgccccgtgccgggtggccccacgtgagctgtgtgcgcgcggcgcacacgtcgtcgctcccccaaacggcagtgtacgcccggcacattgtgcccgcacgtcttgcccgccgcccacctgcatgttcttttctttctttttcctcgctctcccccccc

SEQ ID NO: 647603 - DNA, 185 bp, Homo sapiens
gggaaacttagataaaattaactaacaccttgcattacagaattctcagtcatgctttcatggctcagacctgaccagagactgtttctgccaagttgagatctcccgcgagaaaacatccaaaagttttgtcattatctacctattgctcggaaatggtttattctgcctgctaaccactcaca

SEQ ID NO: 647604 - DNA, 107 bp, Homo sapiens
catcaggtgtggctatcctcctgatcctccatcccttctactctccctgcttcctccttcacttgtcatgccagcagccctttttttccagaccaagggctgtgaac

SEQ ID NO: 647605 - DNA, 1690 bp, Homo sapiens
gctctgcacccatggcggctgcctgtcaggcatggtctgctccgcatcggtcgggtctgcccgcactatgtagaggtgccattccgttggtgccatttctgcctagctgtaggcctcgaggccttgcatgtgatgatgcgaagaatctgcacgcgtttgatcaagatattactttgttgttctcgggttgccacgtacaagggacagacaagttcattccatggctactctatgctctccttcgactgcgcactgccagccttgctggtacaatcctctatgctattgtcaagcctcttactcttcttaaacgagaggttaacaagtcacggttcctgcttcgagaactgggcactggaacgctctccattgaagcaccccttaaacgtcactttagaatctgaaccttatctacaagtgggagtacaaacttactttccgagtagacttgattttcctttacgtaaatacctttaggcgtaattgtacaatcacctatcggcatggattggtacgcattaatcattggaataccacctctagcgtacagggcagtcttttcaacacgtctttggaacacgaacacaatgcgcccctcaattcccctggaaaacttatttcccaaggcaggcacgtagggtaggaacacacgttggccttgcaaacagcatttgtgttactaggcaaaggaataccattacgaacgcgtggcggaagtttcctcccacaacatctattttacgttcacccaatatcattttggccccgtaggcgcagttcagagcatttagcaaacccgcataaaaagggaacacaatggacaatctggcacgatcgaagcttatcatggccgtgccaccataatcactgtttgacataccccaatttccagcgctaacagtacacgtcgtggcatacagatggaagcacttataaggccgtaatacgcaccgacgcaacttaatatctccacgagagcgataaccattaacagagagcaatgggtagagcatattaggtctcacaagtaaacatcgggcttcccatgggaattcgcatctggacccatccttacgacggccactgggagatccttacactttacgcacatataagattttggtaacccccgcacaaagctgtaggcacggtttaccagctacataagagcccacaattatctatggaaggcaccggattccaaagcgcgaatattactatccaccccaagtgtagtagcgtcgccaagaaacatcaccggtctggcggtacaagtaatcaacacccactctacacggccaatgaggaggtggcataacagcgccgcgattacacaagacgatcatgtgaatagcacacaccacaccttttagcaagagacagacaccgggcacacaatccagcaaacagggcgacctaccccgagagattcccgccaaaagacaacaaaacgaccacgtcacacgacacgattgacccaggaacgcgcacaccgcacagaaacggggacaaacgcgtcgaaaaatgcgccactagtaatacacgagagcagccttctcaacccgtgcaagagcccaaccacacaccccggaaaccccgagcaccataaacccatccaaagagacaccacgtgcaacacagcaggcagtcaaaacaacggcatggcaaccaacaacacaacacaacaagg

SEQ ID NO: 647606 - DNA, 144 bp, Homo sapiens
gtcgattacctgcaggcccagcatcctcccccggtaagggcattcgcctgactcccgtgtactgtggtggcagcagcagtggctatgcagcagtggaggaagtgggacatggagcctgcggttgggaccccacaagaaggaaga

SEQ ID NO: 647607 - DNA, 921 bp, Homo sapiens
ctgacggtttctgagcgttggcctttggcacagcgctacccccttttgctttggttctgccatgccgatgtaccaggtaagagccctatcacgggggcggcgcgcctctccgtgtggagccttcccacctgcatgtaccggctccccaacgtgcacggaggagctacggcccagtcgccgtggccgcggtggccaacgtgcaggattacggggcgctgaagagacatcgtgatcaagcgcaaaacccggggccttccctcatcccactactccctgctaggtgctgcacaggcgtgctctgtgagcatcttcaggctcctgtccacggtgtcacacgctagctcctcggtcaaagagctgtgcctgaaaaccttctcaagttgcttgcaggaccagaatatgatacagccccgcgcgaagactatcaagttggggatccacgtttacgttccggaggatgtgtgccggataggtacgcgggcattaagatgcatgcatccagacgatgttgccccatcgaaggcgacggggaaccatggcgcgtacttggtccttctctgttgggccagaagcataagttgctgtcacggcaagccttataagatgggtgggttagattggcgactttacaggttcaacagagggaagccgtgaaagaagacagccgctgattttcggctccatgaactctgctcttggggaaagaacccttgtgctcgcttggggaatgaactcaccgttaagcagaacgtggtgctgtgggctggtacttaccggagatcggagggtgccggtgacaagtgcccccattgtgccaggtgggtgagtcctttggacccggtcctcttaaaggcgcaaagacttatgatggccgaccacatagggagataacagggggcggccacgcatagaggggggttg

SEQ ID NO: 647608 - DNA, 377 bp, Homo sapiens
gagtcacgcgctggagcatcaggaaaggcaccctaacgataaacacatgttgggggttgcacaggaaataaggtcctgtccaaacataccccagcaacattgattcctggactgtccttcctaccaaggcctgtggctcccacggtgacagacactggaaggcagacatcctgcagtgtctctgcagcaaccgaggctggagatggggcagttaatcccactgtttgccctcaatctcggcctgcaaagtgggtctctatccctaccccacggaccctaagacctaagatcagcccaagatggggggcctccttaaccaaccctgggaatgctaccctacccaggatgtgaagagacaaagagcttgggacacgaga

SEQ ID NO: 647609 - DNA, 352 bp, Homo sapiens
cgtcgactcaaggatcctattggtgcgggggctttgtatgattctgggcatcgatctagtactagttactggttgacacattgttgtgcttgagtgtatatctcgtaattgacattgctcgtggggaataggttatgtgatcaagattacggttagaaccactggaaacaacaaagagacgaactcaagttcaattatcgccttcatgggttgaggcgatgatggaggtggagatttggtgctgtgagattgttttaggtaatagcttttctagtcaggttaggtctaggaggagtaggggcaggttttggctcgtaagaaggcctagataggggattgtgcggtgtgtgat

SEQ ID NO: 647610 - DNA, 231 bp, Homo sapiens
gggaccacgggtgaaggtacagctctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccg

SEQ ID NO: 647611 - DNA, 113 bp, Homo sapiens
ccgtaaaattttcaggaccccccaattgttttggattttttttctttcctcttcacaaaccagggttattaaaagtgtgctttctttttaccttatattacagttccaaggta

SEQ ID NO: 647612 - DNA, 124 bp, Homo sapiens
gacgaacaaagaagtcaaccagtaactactactgaatcaagcgcccataatcatacaaagcccgcgcaccaataggatcctcccgaatcaacccgtggacccctaatcatacaaagcccccgct

SEQ ID NO: 647613 - DNA, 110 bp, Homo sapiens
  misc_feature (35)..(35): n is a, c, g, or t
  misc_feature (96)..(96): n is a, c, g, or t
  misc_feature (108)..(108): n is a, c, g, or t
catctcagtattgcctgtgggggccacccctccanccccagccccaagtgccttcgctctgtttttataccctgaattggaggtttattttttccnctatattatctnag

SEQ ID NO: 647614 - DNA, 282 bp, Homo sapiens
tgtggacaagaggctctggatctgcaggtgcccaactcaaagtcatcagcaccatgtctagtggagcatcgaccactatgagattggctgaaatcaagaagcgtgggatccgagtaggctacaccccagatagtcctgaccgatagcaccgccgaactcgcagtctccctgctaattaccacctgcctgacggttgccggaggccatacgaggcagtgaagaatggtggctggccctcgtggcagcccctctggctgtgtggctatggactacacgacagag

SEQ ID NO: 647615 - DNA, 999 bp, Homo sapiens
  misc_feature (749)..(749): n is a, c, g, or t
ggccgccgcgccgccatcatggacaccagccgtgtgcagcctatcaagctggccaggggtcaccaaggtcctgggcaggaccgggttctcagggcacgagtgcagcgcaggtggcgcgtggaattcatggacgacagcgagccgatccatcatctcgcaatgtaagaatggctcccggtgcgcgagggcagatcagatgcattcacccattttggagatcagagcgaagaatgcccggacggtttgcgcatgacgtcttggcatgtctcggcgtgggtcgttgcgagtgtcaggggttcagacgcatcgttgtggcctgatgggaaatcggtcatgtgcgagcaattgcttgctcctcttttgtattggttgcgctgccgactaccgtacatctcgagcatgcgtccttgtagaatagagaggcggtctgctgtttcgaagtcaaggaaatcagtagaaaggggccacaaaatttcctagagagggcgatgaaaagaatgccgagaggtgagcgagaggacaaaaaagggggtagttggacgacgtggggccccccgtgtgtctcctttgaggcgtgtgttcgcctttggcccccatgtgttctcgttgtgtcccacattggggtgggtgcagaatcttagcgcggggttttccctatatatagggagagggtcgggaaatttaaaggtttggcgagaaataaaaggcccaagggggttttaagcccgtttggcgaattttaagtgganttgtggtgggaggagaaaaaaaaggggaaaatagtatggggcttcaccaaaaaccaagcgctcgtgggatgttcccgccgtgtgacaggccccacaaggagaatttcaccgtctgtgcatccaccaaagcggtggggggagaaacaaagctactagccgcatggagcgtttacccccacacaatataagagcgaaagagtccagaactgttgcaaaagtttataggcgatataagagccaccgggggtaa

SEQ ID NO: 647616 - DNA, 173 bp, Homo sapiens
tctagagcagcaatattcaatacaaatatgatataagccacatatgtaatttaaaattttcaggtggtcacattaaaaaagaaaggtgaaattggccgagtgcagtggctcatgtcttgaatcccagtactttgggaggctgaggtaggaggatcatttgaggccaggagtta

SEQ ID NO: 647617 - DNA, 221 bp, Homo sapiens
  misc_feature (58)..(58): n is a, c, g, or t
  misc_feature (70)..(70): n is a, c, g, or t
  misc_feature (96)..(96): n is a, c, g, or t
aactttgaggtggtaacttatggtcctgagctccctacaggattaagtcaaggctggnacttttcctgancttgctgttgcctgacaactactgantccctgtcttgcttacctcatttccttaccaatttctcttgggagcactttcttaataaattacttgcatatgaaccttcatttcagggtctgtttcagaggagcctaagacaatccttattgcc

SEQ ID NO: 647618 - DNA, 184 bp, Homo sapiens
catggatttgctggtgcagtacaactaggcttaatagggacatggtggtgggcgcctgtaatcccagctactcgggagactgaggcaggagaatcgcttgaacttgggaggtagagattgcagtgagccaagattgcgtgttgcactccagcctgggcaacaagggcaaaaatccgtctcaaaa

SEQ ID NO: 647619 - DNA, 649 bp, Homo sapiens
gaggaactccttctctttttaacccacccttttaaaaaaaaaaatggcaccaaagaaagacgtgaagaaacctgtggctgcggctgcgtgtgccccagccctgtgcacccggcacctggcaacctgcccctgccccaagccaaaacccacaagaagaaaccaaatttgacctctcgtgccattaagatccgagttctctaaggaacagcaggatgaatctcaacggaggcatttctcctgtttgaccagaccaggtgattccaagatcaccttaagccaaggtcggtgatgtccttcgagcttcctgggccacaaaatcccaccaattgcaagaggtccggacacgtcctgggaaaccccagcatctgaagagctgaattgcaagaaaatgtgagtttgaaccaatttcggcctatgatgcaaagccatttccaaccaaccaaggtaccagggcccacctatgaacaactttggtggaaggggtcaggaggtgtctttcgcacacagggcacggcacagggccacagtacatggggtgcctggaaactccgcccaggttcatagccaccccgtgggttgtaacacgatggaaacgaggaaaacagtcgggcaaacccctgcttgcccaggtccaacaagactcaaaggc

SEQ ID NO: 647620 - DNA, 275 bp, Homo sapiens
gatactagacttcctctgataaaggcatagtggatgactactcctatagaggagagttcaacgcgtgtgggaatagaataatctcgtacgcagagtcagaggagaagagacatgtaccttgagcatcgtccttcctctcaagcaagccagaagggtgagagccataaggacgcgtgacggtaagcagatggagtactggtcacgaggataccagacaccactcccaaagctcagacgagccaggttccctttctcttcttccccaggtccttcct

SEQ ID NO: 647621 - DNA, 132 bp, Homo sapiens
gcacgacaacacataatgacccaccaatcacatgcctatcatatagggaaacccagcccatgacccggacagggcccctctcagccctccgatgactccgcctagcatgtgagtgataccactccatgacgg

SEQ ID NO: 647622 - DNA, 128 bp, Homo sapiens
ggagcacaccctctcgcctcagcctgccaagcagatgggactacaggcaatgccgccaagctctgctaattctggtcttacttttggaaaagacgggttttatgtggcccatgctagtcttgacctct

SEQ ID NO: 647623 - DNA, 244 bp, Homo sapiens
gccggcttatctagaggatcccagcgctcagcagtatacagaacgcagtgggcctctgtacaggcactgggaggtgatggtgttcttagagagaagatcactggaagaaacttctgctttattgggctttacaaagctggcaatattacaatctcttgacctcatgtgcaagcagtcatcttcagcattttcccatgcccttatagccaccccaaggggtggattttgccttcctcgagtggct

SEQ ID NO: 647624 - DNA, 130 bp, Homo sapiens
  misc_feature (48)..(48): n is a, c, g, or t
aggtctagcccccgcttatactgcgagaaggagcctccctccaggtantcctctctgtgagagctgaatggttgagctcatgggacaatctgtctccagagaggagctacccactccttctcgcatctct

SEQ ID NO: 647625 - DNA, 550 bp, Homo sapiens
  misc_feature (52)..(52): n is a, c, g, or t
  misc_feature (162)..(162): n is a, c, g, or t
  misc_feature (164)..(164): n is a, c, g, or t
  misc_feature (166)..(167): n is a, c, g, or t
  misc_feature (179)..(179): n is a, c, g, or t
  misc_feature (205)..(206): n is a, c, g, or t
  misc_feature (214)..(214): n is a, c, g, or t
  misc_feature (218)..(218): n is a, c, g, or t
  misc_feature (227)..(227): n is a, c, g, or t
  misc_feature (262)..(262): n is a, c, g, or t
  misc_feature (274)..(274): n is a, c, g, or t
  misc_feature (280)..(280): n is a, c, g, or t
  misc_feature (283)..(283): n is a, c, g, or t
  misc_feature (291)..(291): n is a, c, g, or t
  misc_feature (295)..(295): n is a, c, g, or t
  misc_feature (311)..(311): n is a, c, g, or t
  misc_feature (323)..(323): n is a, c, g, or t
  misc_feature (329)..(329): n is a, c, g, or t
  misc_feature (341)..(341): n is a, c, g, or t
  misc_feature (347)..(347): n is a, c, g, or t
  misc_feature (352)..(353): n is a, c, g, or t
  misc_feature (357)..(357): n is a, c, g, or t
  misc_feature (408)..(408): n is a, c, g, or t
  misc_feature (413)..(413): n is a, c, g, or t
  misc_feature (415)..(415): n is a, c, g, or t
  misc_feature (419)..(419): n is a, c, g, or t
  misc_feature (457)..(457): n is a, c, g, or t
  misc_feature (474)..(474): n is a, c, g, or t
  misc_feature (502)..(502): n is a, c, g, or t
  misc_feature (514)..(515): n is a, c, g, or t
  misc_feature (517)..(517): n is a, c, g, or t
  misc_feature (525)..(525): n is a, c, g, or t
  misc_feature (527)..(527): n is a, c, g, or t
  misc_feature (547)..(547): n is a, c, g, or t
tgctttatacaatatttcaacataaagtccccataacagaaatgtaacaaantgggaatgatagtggaaggattaaagtggcacaaattcaccaaacaaatattaaactacaaatttttcagaggtagattacttttgaagttgagaacaaaaaacagtatnantnnaacctagccggnttccaccaactcagtcattaatttanngggaggcntaanatgtagggntaaatgatattaatatacttagggggaggccaatntgttgtttttcntctctnttngagatgcnagtntaaaacctggtatgcnaattcatttatncttacncgtagacgtacntctgtncaggnntggnatgcgcctgtgcactggtatattgctacatagctctctgataatataatanttatnanttantgccaggttagagtctgagaggttggcgtccatttggntgttcaggcgcaacagnagagtaggcttgggggagggtccatatnggatctggtttnntntccgttgngntggcaatctacttgtgattnagg

SEQ ID NO: 647626 - DNA, 159 bp, Homo sapiens
tacgtcccagtaggcgccaccgcttctgcgacagcacctgacggcgttagtgattgtcgtagctgctgtaggcgcagattgatgaacatggttttgtgttccatgttctgctggaattccgggctggccagataatcggccttttgctgcgcctcggga

SEQ ID NO: 647627 - DNA, 330 bp, Homo sapiens
gagacagtatggtaacagatgggagcaggaatgtgtccagtgccacgcttgcagtgctcttcagtaagccagagagatgtacaatgtctaccaaaccgatttctccaaggcttttgcaagaaatgggatttggtcttgcaagatgaatgagggaagaggtcctcgatggcttctaagagagtcaagcccaatggtcttccaatactcacttgcataaagtcccatctgggtcccccaaatccaggaaggtccctggtggcaggtccccctcttgctctcagggacctggggctcttgaaggtgctggtccctgggaaggaggatcgagga

SEQ ID NO: 647628 - DNA, 3758 bp, Homo sapiens
caaacgttcccaaatcttcccagtcggcttgcagagactccttgctcccaggagataaccagaagctgcatcttattgacagatggtcatcacattggtgagctggagtcatcagattgtggggcccggagtgaggctgaagggagtggatcagagcactgcctgagagtcacctctactttcctgctaccgctgcctgtgagctgaaggggctgaaccatacactcctttttctacaaccagcttgcattttttctgcccacaatgagcggggaatcaatgaatttcagcgatgttttcgactccagtgaagattattttgtgtcagtcaatacttcatattactcagttgattctgagatgttactgtgctccttgcaggaggtcaggcagttctccaggctatttgtaccgattgcctactccttgatctgtgtctttggcctcctggggaatattctggtggtgatcacctttgctttttataagaaggccaggtctatgacagacgtctatctcttgaacatggccattgcagacatcctctttgttcttactctcccattctgggcagtgagtcatgccactggtgcgtgggttttcagcaatgccacgtgcaagttgctaaaaggcatctatgccatcaactttaactgcgggatgctgctcctgacttgcattagcatggaccggtacatcgccattgtacaggcgactaagtcattccggctccgatccagaacactaccgcgcacgaaaatcatctgccttgttgtgtgggggctgtcagtcatcatctccagctcaacttttgtcttcaaccaaaaatacaacacccaaggcagcgatgtctgtgaacccaagtaccagactgtctcggagcccatcaggtggaagctgctgatgttggggcttgagctactctttggtttctttatccctttgatgttcatgatattttgttacacgttcattgtcaaaaccttggtgcaagctcagaattctaaaaggcacaaagccatccgtgtaatcatagctgtggtgcttgtgtttctggcttgtcagattcctcataacatggtcctgcttgtgacggctgcaaatttgggtaaaatgaaccgatcctgccagagcgaaaagctaattggctatacgaaaactgtcacagaagtcctggctttcctgcactgctgcctgaaccctgtgctctacgcttttattgggcagaagttcagaaactactttctgaagatcttgaaggacctgtggtgtgtgagaaggaagtacaagtcctcaggcttctcctgtgccgggaggtactcagaaaacatttctcggcagaccagtgagaccgcagataacgacaatgcgtcgtccttcactatgtgatagaaagctgagtctccctaaggcatgtgtgaaacatactcatagatgttatgcaaaaaaaagtctatggccaggtatgcatggaaaatgtgggaattaagcaaaatcaagcaagcctctctcctgcgggacttaacgtgctcatgggctgtgtgatctcttcagggtggggtggtctctgataggtagcattttccagcactttgcaaggaatgttttgtagctctagggtatatatccgcctggcatttcacaaaacagcctttgggaaatgctgaattaaagtgaattgttgacaaatgtaaacattttcagaaatattcatgaagcggtcacagatcacagtgtcttttggttacagcacaaaatgatggcagtggtttgaaaaactaaaacagaaaaaaaaatggaagccaacacatcactcattttaggcaaatgtttaaacatttttatctatcagaatgtttattgttgctggttataagcagcaggattggccggctagtgtttcctctcatttccctttgatacagtcaacaagcctgaccctgtaaaatggaggtggaaagacaagctcaagtgttcacaacctggaagtgcttcgggaagaaggggacaatggcagaacaggtgttggtgacaattgtcaccaattggataaagcagctcaggttgtagtgggccattaggaaactgtcggtttgctttgatttccctgggagctgttctctgtcgtgagtgtctcttgtctaaacgtccattaagctgagagtgctatgaagacaggatctagaataatcttgctcacagctgtgctctgagtgcctagcggagttccagcaaacaaaatggactcaagagagatttgattaatgaatcgtaatgaagttggggtttattgtacagtttaaaatgttagatgtttttaattttttaaataaatggaatactttttttttttttaaagaaagcaactttactgagacaatgtagaaagaagttttgttccgtttctttaatgtggttgaagagcaatgtgtggctgaagacttttgttatgaggagctgcagattagctaggggacagctggaattatgctggcttctgataattattttaaaggggtctgaaatttgtgatggaatcagattttaacagctctcttcaatgacatagaaagttcatggaactcatgtttttaaagggctatgtaaatatatgaacattagaaaaatagcaacttgtgttacaaaaatacaaacacatgttaggaaggtactgtcatgggctaggcatggtggctcacacctgtaatcccagcattttgggaagctaagatgggtggatcacttgaggtcaggagtttgagaccagcctggccaacatggcgaaacccctctctactaaaaatacaaaaatttgccaggcgtggtggcgggtgcctgtaatcccagctacttgggaggctgaggcaagagaatcgcttgaacccaggaggcagaggttgcagtgagccgagatcgtgccattgcactccagcctgggtgacagagcgagactccatctcaaaaaaaaaaaaaaaaaagactccatctcaaaaaaaaaaaaaaaaaaaaaaggaaagaactgtcatgtaaacataccgacatgtttaaacctgacaatggtgttatttgaaactttatattgttcttgtaagctttaactatatctctctttaaaatgcaaaataatgtcttaagattcaaagtctgtatttttaaagcatggctttggctttgcaaaataaaaaatgtgttttgtacatgaagtaggaatcgtatttcagcttcaaggttcagattgaggggcccactgtttggagaggatggtattcaggctttctcatgtccttcaaatctgttagcgtttgactctagaaatcaaagcaaaggagtggttacccagacacttcttttggtgtgatcaatgcgctgatgtgatctatgaagatgattcatgcttgaaaactagcacagaaacatcttgcttatttgccaaagctgggagatgagcttctctgcataatttaaatgttcagataaatgaagctgacttatttaagcaataaccttttaaacattttagctaagatgtataaaaatgtttccaaaatataccacatactttatttcttcttaaatgtagtacattaggttacatcatttttcttgctgtcttgggcatcaaaacaggtgccatggtaacctgacactctcaggagacattaagatagaaggggctgttcttcagtggttcccattgattctccccatatctttttgctctcaggctctggccgtctcttcctgagccttaactgtgt

SEQ ID NO: 647629 - DNA, 783 bp, Homo sapiens
ctcgcgcttttggaggtccccatgtgtcgcctagttcatgaaaaggtccttacagtgtctatccgatatggtcaccagagcagtacagtctcgtataggcgactttacacaggaaatataaccagttgtcaatctagaacaagtatcctaacatagcctgtagatcttgccacgtggcctagagttatgtgacaagtcccaaatagtacaaatgttttctcttagaaatgtagtacaagttgtccgtgtcgtagcgttcaatctcgcggtatagtgaacgttctagaactggagaaagcgcgtgttaaaacgcatctgttaggtgttcagttagaaagtctgagagactattagtacataaattctcaatcttggcatgctgtacacgtgccagagttttaggtactgtagtgaccgttgagaagacccttgtttatttacacttgtgaagcactgtttgtgcaaagcaacctttgcattagtataagtgcctgtattccgattcatttacttcatgtccaggggtggcatatttacgctagaaccattgtctactaacgattaacagttaacatgacaaagtgtgtggattttgctttttcaaggaggttcaattaaggcaataagatgtttgatggagaaacctattgtttactgaaagcactcaatgaagtcgaaattactgaagcttttgcatacatcttggtcttttatgtaaagtatgttaaatataacatgtaaggaaaataaacaatattataattatgtgtttgccatgtttac

SEQ ID NO: 647630 - DNA, 113 bp, Homo sapiens
tgctatcatccgtacatcatagcaacatcaccctccttaacctctacttctacctacgcctattttacaccaaccccggtgccgatgaatagcgaggtgccgatcaatagcga

SEQ ID NO: 647631 - DNA, 165 bp, Homo sapiens
cagcaagaatggcatatcagtggaatcatacctttcgggttgctttttaacttatcatagttccacggttggctccatgtgtcagtcagttctgagttctttagctgaatgcagtgtaagggagaacggggttgtgaatggctggcaaattggagcaccaacatt

SEQ ID NO: 647632 - DNA, 489 bp, Homo sapiens
  misc_feature (410)..(410): n is a, c, g, or t
  misc_feature (476)..(476): n is a, c, g, or t
tggcaagtggctcctgactggggccaggcgcgtatcgagtcgatggttgctaaccgtcctgactggtgtatctcccgtcagcgcacctggggtgtaccgatgtcactgttcgtgcacaaagacacggaagagctgcatccgcgtacccttgaactgatggaagaagtggcaaaacgcgttggagtcgatggcatccaggcgtggtgggatctcgatgcgaaagagatcctcggcgacgaagctgatcagtacgtgaaagtgccggacacattggatgtatggtttgactccggatctacccactcttctgttgttgacgtgcgcccggaatttgccggtcacgcagcggacatgtatctggaaggttctgaccaacaccgcggctggttcatgtcttccctaatgatctncaccgcgatgaagggtaaagcgccgtatcgtcaggtactgacccacggctttaccgtggatggcangaaccacttgcaa

SEQ ID NO: 647633 - DNA, 222 bp, Homo sapiens
gctggcgtctgaggctcccgtccattctccaggctctcggtcgggcttgttatccacacatgccatctcatctcggtctgcctttctaccacgtcgcctcttttttttttttttttttttttgttttttttttttttttttttttttttttttttttttttttttgccccccccccgggggggccgggggggagggggggggggcccccccccccctccccc

SEQ ID NO: 647634 - DNA, 692 bp, Homo sapiens
gagactccactgatgtcgtggcgctttaggggaagaagtggtgtttcgctgggccctggtactgaagacgcggtccgggtcgcccctagctgtttcctactcacccaaagccccgacccgccttttctctcatctcctctgcaggatgaggcgtgcaggcctggttgaaggagtacctcctcgcaatctatgggaacgtatggctatgctaatagtgcgtatagtgcctgtgaaggaacgaacaatgagaggctcactgaaagttctgagaagcaagagtaaggtgctataaaatcgtctttccatttgaaataggccatgaagttaaaagccagaataaattattagctgaaatggattcacaattgtgattccacaagtggatttctaggtaaaactatgggcaaactgaagattttatccagagggagtcaaaaaagctgtgtgctatatgatgctgtttactttatttgtcttttatcattatgggattattaaacctgagggtgatgcatgtaatttgtgaatttggaattgtgttccaaattaatgggcttggagtacccacttgtgattaaaaatcaggcatcaaaacattcctagtgtgcaaaatactgtggcatttttccatgggaaaatttggtgaatttggttaatttataaatcagcattagtaataacagggtctttga

SEQ ID NO: 647635 - DNA, 484 bp, Homo sapiens
  misc_feature (29)..(29): n is a, c, g, or t
gcctggcaaggtcccatgcatttgagggntgatgataggattctgatgtgtttggagagcaacgcacattgccttactattgtgagcaatagaggagctgcggggcaagtactccatgaggcagcagcccaggtggtgcagtgggtgagctttgctgattccgatatagtgcccccaggcagtacctgggtgttccccaccttgggcatcatgcaccacaacaaacaggccactgagaatgcaaaggaggaagtgaggcgaattctggggctgctggatgcttacttgaagacgaggacttttctggtgggcgaacgagtgacattggctgacatcacagttgtctgcaccctgttgtggctctataagcaggttctagagccttctttccgcacaggactttcccaattacaagcgctgtttcctcaactgcatttaaccaagccccagttccgggctggtctgggggaagtgaaactgtgtg

SEQ ID NO: 647636 - DNA, 352 bp, Homo sapiens
  misc_feature (131)..(131): n is a, c, g, or t
  misc_feature (138)..(138): n is a, c, g, or t
  misc_feature (149)..(149): n is a, c, g, or t
  misc_feature (164)..(164): n is a, c, g, or t
  misc_feature (184)..(184): n is a, c, g, or t
  misc_feature (209)..(209): n is a, c, g, or t
  misc_feature (223)..(224): n is a, c, g, or t
  misc_feature (253)..(253): n is a, c, g, or t
  misc_feature (276)..(276): n is a, c, g, or t
  misc_feature (291)..(291): n is a, c, g, or t
  misc_feature (314)..(314): n is a, c, g, or t
  misc_feature (326)..(326): n is a, c, g, or t
tgctggtcccaggttcttggtgagggagggctacgctggaacctgggaacctactgggcacctctaatgcagatgagaaaaacttgagaatgtgaaagtagatcagtcccgctcccaccgaagtcagagangcggganattaaccagcngcgcgcgggggtgangtaactaagggcactctccnccccactgcccagggacggagtgcncgacccaagacctnntcccaggccccacacccaacgcaaagcgnaaggcagctacccacagcctgcnccatgacgcaacgangacacgcttaatacaaatatgtnagccgagggggnaggggagtgcctgggaattctccgca

SEQ ID NO: 647637 - DNA, 546 bp, Homo sapiens
aggcattgaggcagccagcgcaggggcttctgctgacgcgggtgcaggcggagccttgacgcgaaaccccgcagactaagttcttttctctctttgaacagatacgagattaatacaacctacttaaacaaatactagtcaatacggttacctacacgactacttcgcttacgcgttacacgctttcttacacccgtacccttctctaactacgcctttaacgactcttctacacgacgaacaccacttactcgaaacgaccctttaccgcacaccgcacggtaccgcccatttggaacgcggccacaaactggctcgcacaaccacgacacacaaacggcgccaaacttcccaacacacaccaacgggggccttcttccctcccgctcttcaacacactccagtcaaagccctcaattttggtcaacccggtgggcacaggcgggcgtctcgggcacacgggcaatttgccaacaaggcccccttatcacctttctcccacatttggcgcctgcctcttacgcacaaacatcagtgggttaattt

SEQ ID NO: 647638 - DNA, 239 bp, Homo sapiens
aataaaggctaagaccaaaacagcatggtactcatacaaaaaaagagatatagaccaaatggaacagaacagaggcctcagaaaataacaccacatatctacaaccaccatgatctattgacaaaccatagacaaaaatacagcaataggggaaagaattcccatatattaataaaatagcgtagtaagggcacaaacttggctcagcccatatagcagcaaaacttgcaaacttggca

SEQ ID NO: 647639 - DNA, 156 bp, Homo sapiens
ataaacctgatgtggggacgatgacaggctgaaaggagggcagggaggccatacgagagcacatcttatcctccaggcttttctctcttaccttccctcaattccttctgttaaatacctctttgatttctccccgattctcagaaattaaaatgg

SEQ ID NO: 647640 - DNA, 232 bp, Homo sapiens
tcgagtcctattgttacacactgaataagccatgataaaaactagcaaccagcttgctctgacagtgcttagtaatgcgtggacttatctcactgaatgcaaccctttgtttgcatcactaggttaaacacactgttgtcgtagcatctattcagcggacatttctgagtcaattgagacctacaatacagaaaacacactattacgtgcatacacattagaagacaagctc

SEQ ID NO: 647641 - DNA, 684 bp, Homo sapiens
ttcccttaacgtaacgggaagtgttttgaaattcccagaagagagctgttttgtaatcaaagtgatggattataagaaagccagactttggaaaaggataattggaataaagggaggtgcttgaagattttccaaactactttatgtcatttagcttctattttctgaagggctttctttggtgccatgtactcagatcagtcagttgacctgaaagatgatcatgttttcttcgtaaagatttaagcaattggcaactacaaagacattattttcttactgatctatatcatgtactgttgctgacattacaaaaagggtctggaagggaaaccgggtcactgttttatcttttttctttaaaatacaaaagtatcccaactaatcatttattatggtcagcttggtttacatgtcccctatcatgagaaatgctatcaaacatctgtgatttcttaagagctttaccccaaattgttactttaattcttggggccctggcggagggggtttttctttttaaaataccattttttattcccccctgggggcaactgggggggggtacctgcggataccaccggatgattcttggagctggggcttctttaaggaggctaaaactctggggttttatattaggtaaccagtttgggaagctttggggcatacttgtcaatcttt

SEQ ID NO: 647642 - DNA, 298 bp, Homo sapiens
cgccttttacactatctacagcaggttgtctggggtaggggggaggcgttttttttttttggaaacagggtctcactctgtcacccagggtggattgcattgcacaacttcacagctcactgcagcctcaaccgggtttcaagtaatcctctcacctcagcctcccaagtatgttgtgccctctaggcacacaccatctatccccggcaaatttttggtattgggtatttttggtaaaaccaggattacgccatgtgggccaggcggttctcgaacacctggtctcaactgatccgcc

SEQ ID NO: 647643 - DNA, 261 bp, Homo sapiens
atatgtataatgtatccttgcttgggggttgggggaatttattaaccattctctttttagaaactttcagtactccgctgaaattccctatctatacaaaatgttattcaccttttctactggaaccttaaacattatttataaaaaggcttttaccaatccttgtcctggtagtttccacaatatggctcactctgtggatcctgcatctattggactattttttccccttcagtcttattattttctggcttcttcctt

SEQ ID NO: 647644 - DNA, 1500 bp, Homo sapiens
  misc_feature (383)..(384): n is a, c, g, or t
  misc_feature (746)..(746): n is a, c, g, or t
  misc_feature (752)..(752): n is a, c, g, or t
  misc_feature (763)..(763): n is a, c, g, or t
  misc_feature (773)..(773): n is a, c, g, or t
  misc_feature (783)..(783): n is a, c, g, or t
  misc_feature (799)..(799): n is a, c, g, or t
  misc_feature (804)..(804): n is a, c, g, or t
  misc_feature (814)..(814): n is a, c, g, or t
  misc_feature (821)..(821): n is a, c, g, or t
  misc_feature (829)..(829): n is a, c, g, or t
  misc_feature (841)..(841): n is a, c, g, or t
  misc_feature (846)..(846): n is a, c, g, or t
  misc_feature (851)..(851): n is a, c, g, or t
  misc_feature (853)..(853): n is a, c, g, or t
  misc_feature (865)..(865): n is a, c, g, or t
  misc_feature (868)..(869): n is a, c, g, or t
  misc_feature (876)..(876): n is a, c, g, or t
  misc_feature (887)..(888): n is a, c, g, or t
  misc_feature (891)..(893): n is a, c, g, or t
  misc_feature (904)..(904): n is a, c, g, or t
  misc_feature (908)..(908): n is a, c, g, or t
  misc_feature (911)..(911): n is a, c, g, or t
  misc_feature (917)..(917): n is a, c, g, or t
  misc_feature (925)..(927): n is a, c, g, or t
  misc_feature (930)..(930): n is a, c, g, or t
  misc_feature (932)..(932): n is a, c, g, or t
  misc_feature (935)..(935): n is a, c, g, or t
  misc_feature (946)..(946): n is a, c, g, or t
  misc_feature (953)..(953): n is a, c, g, or t
  misc_feature (956)..(956): n is a, c, g, or t
  misc_feature (959)..(959): n is a, c, g, or t
  misc_feature (965)..(965): n is a, c, g, or t
  misc_feature (967)..(967): n is a, c, g, or t
  misc_feature (977)..(977): n is a, c, g, or t
  misc_feature (983)..(984): n is a, c, g, or t
  misc_feature (1003)..(1003): n is a, c, g, or t
  misc_feature (1011)..(1011): n is a, c, g, or t
  misc_feature (1038)..(1038): n is a, c, g, or t
  misc_feature (1128)..(1128): n is a, c, g, or t
  misc_feature (1161)..(1162): n is a, c, g, or t
  misc_feature (1191)..(1191): n is a, c, g, or t
  misc_feature (1205)..(1205): n is a, c, g, or t
  misc_feature (1462)..(1462): n is a, c, g, or t
gtcttttctttctcagggtcctctttggtggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagagaaaatctatgactcccaatatcttctagaataaagaattttccctcttnnaccaagggccctccttgtcattgaccttagctaaaccatggcaattcataaatagaggaaacattaatgaattaaagcattccttattttttaactgaatattgtgtacatgtttctatagtcgtctttcacaagtctttgcctcctttttgtgcctttatgtttaatttttcctttgacagatggtaacccttcctggatcattcatttcacatttgtttcttgtttttgttgcacctgctaagtcaaataacaagtgaaagtaaacctaaagttagaaaccaaggtgaaatgaatgatccaggaagggataccatctgtcaaaggaaaaaataaaaataaagaaaaaaaagacgcaaagncttggnaagacactaanaaaatgtacnaatattagtnaaaaaataaggcatgnttttnattcattaangtttccnctatttangaattgccatgntttanctaangncaatgacaaggnggnnccttgtnttaaaggtggnnagnnntttattctagngganatngggggngatggggnnnggngngcngttattccagngtctacnccngantgcggngncatgattctncctcgnnattatgctcctattaatangggcttcncttctggccttacagcaagtgtgtggnatggggcagagccttggggctcagggctgcacacctgaagttaccctttagtaggggtcccctagagtgaatgacagttttgtggctganacctacacaaagaggaagaggaatgaggcaggnngacccgtacctaaccataccctctttggnctgcagaaaactgntggcaacatctcggggagtggctgcccaccaaagaggaccctgagaaagaaaagagcataacctgggaaatgggctacatgggggcaagggacatggtgagcgggcaaagttgagatggtgttttccttgagtgaatgtctttcaaaactaacaacatactgtgtagttgtctaacatgctgatggaggaacactgctgggccctgaaatcctagctttgaatccattttttccctttagtattgtgagtagagggngataatgaccttatgttttccccacgacacaagtcacc

SEQ ID NO: 647645 - DNA, 257 bp, Homo sapiens
gtattttcccccccaaattaaattttttccttttttttaaaaaaatccccacccaagtttttaaggtaaaatatttggctttaatggtattttagcccttgattaatgaaacagggaaatattgatttccagtttgggtcccctaaggacccaattttggttggctttgggaaaagccctttttttaaccaaatccaatattgccccaccaatgggcagaaccctttttgataaaaaaaattggtttttggccttta

SEQ ID NO: 647646 - DNA, 716 bp, Homo sapiens
  misc_feature (383)..(384): n is a, c, g, or t
  misc_feature (695)..(695): n is a, c, g, or t
gtcttttctttctcagggtcctctttggtggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagagaaaatctatgactcccaatatcttctagaataaagaattttccctcttnnaccaagggccctccttgtcattgaccttagctaaaccatggcaattcataaatagaggaaacattaatgaattaaagcattctatttactaatatttgtacatttctagtctctttcagttttgctttttttttttttttttttattttttcttttgaccagatggtagtcccttactggatgattcatagtaacgcggtattctacttgagcattaactgttactgttattggagcatagcaggtgctacataaacaagtaacaaatgtcgccaccctacttcagcagtgctagacgatgtgaacagctntaagtagatacaaaaaaaatg

SEQ ID NO: 647647 - DNA, 678 bp, Homo sapiens
gccttgtttggaggcagtttaaaagcccctaaaggaattaagaggatttcctttttggtgtgtcaggtcccagcctaatgtcaggattatcccgacctttacacgacatggtatgtttagggacgtcctgtcataggggaataaactctcaaagtaatgcctttcatttgggaggagggcacaaaccggtattccccccttttggcagaccaagaccggggttcgcttgacataggagttctagaccagcctggccaactcaacgagaacttgtctctttttaaaaagaaaaaaccaatgcaattcagatctttttcttgatatatggcttagacatcacaatgtaaaaggaattcttctcttacttcaatacaatgggttttaacatacctttaagttcagtccaatatccaatattcaaacccaaaagttgactttggaatggggcctttttcaagtcataaagagtgcttgtttaaggtgatctccccaatggtagttttcacccgtctcataaacagcaagctaatcagtcagacattcttaaatgacgccaattttttcacttaaattgtgaccatgttttctgttttgacaaattttggctaaagcattgtaagagtgttttttttatagcagtaccttgtgtttccccgcctgtccattaaaccaataatt

SEQ ID NO: 647648 - DNA, 1076 bp, Homo sapiens
gctcagcgtgtcgtgtcctgtagccctaatagccaagaatgggaaaggagaaagactcatatctagattgacgtcattggacacgtagattcgggcaagtccagcagtactggaccatctgattctataattgcggatgcgcgaatcgcacggaaagaacggcattgatgaaattgagagacaggcaggctggcgtgcagcattgggagaacgggcatccattcatagatcatagcctgggcgtcttgggagtccaacgtgagcagcgtgcagcagttgaggtgtcggtatcagtcattgatcatctccgttcgtggcaaattcatgagcatccagacaagctactagtgatgactactccatctgattgcaccgcagagacagcaaatgacttataatcgaaagaaccatgagtctacggggcacatctcagtgcatgacatggtgactgctgccgtgagtccgttggcgtatacaatggccgtgggtcgaaagtttgaacgacgggttatctccgagcaatggtgcagaatgtgaaaagcatgcccttctggcttaacacactaggggtgtgaaaagcaaggtaatgcgtcgggtgtctaagctgtacaatgtgattctcgagctggagcacgaaaccctaacagactctacagcagcatatgagggacaatcagtcaaaggggacagttcgacggattgcactattgacaagacacattgcggggtatcgaaaccgcgagcttcattcacccagtatgggagcgcgaaggcattcttgagtagagatatgcgtagaccagttgagtatcccttagttaggacccacatggtggttgaagggcattcgtccgtagcgtgactcatcagaccggaggatctgcccacatgtgtcagctccggtcaaccgcggatcttggtaacataagtcgcagggcagggtaaacccatcagtcacgattaccgtgaggtgccactaggagacactggacattacataaagcaaacaaacactttccggtgccagaattgtgaacacagagcgccttttggcagacctaagcccagctgcacaa

SEQ ID NO: 647649 - DNA, 1210 bp, Homo sapiens
ggaaacccttgccaccgagcgcctggacaaaggcttcaccctggtcgagagggacctcctgctccacccccagtcaaaccacctccttcccctgtgaatatcagaacaggaccaagtggccagtctctggctcctcctcctccgccttaccgccagcctcctggggtccccaatggaccctctagccccactaatgagtcagcccctgagctgccacagagacacaattctttgcataggaagacaccaggcctgtcagaggcctagcacctcctccacccacctcggcctccccatctttactgagtaataggccacctcccccagcccgagaccctcccagtcggggagcagtcctccacgcacactgtgatccgaatggtgccagggatgctccaccgaccggcagcagcaatgagcggagggcagagaccgcgacacaccacgcagccgcacgaagcgccacacaagacccgccgcaccccgccccgcgccaaccaccccagaccaaggcaccgggcagaagagacccctggacaccgcagtggacgacacagacgacgcgaccacccgacaccgcacacaagaccgcgccccaccgccaggcagacaacgacaacaccacagaccacgacccaccacccaaccgcgccactgacgacaggcaccaaccacaaccgcacggacacccaccaccacgacacgcagcagaaacaacacacaagaagccgcaacacgaccagacgacacagaaacagccacgagccgcacaccagaggaccaacgacaaacagacaacagcagaatggaacaccaacaaggagcgcgacagcacagaccagaagcacacggacgagcaccaaccaagacacgaaccaagcacccccacgccagaccccccgcccaccaacacaccaacccaacagcaaccacaacgacgccacacacaaacaacaaccagaagaccaaaagaatacagacaacaaccaaaaacacaggcacaacacggaatcacaccaaccaaaagcacagaacacgaacgacacgccaaaacagcccccaccgacacaacgcacccacggagccacttcacctacggcaggcacgcaacgcccaacgcagacaccaacacacacaaacagacagaacgacacgaccacaaaaccaccaagacgacagccacacagaagacacacacaccacaggcgac

SEQ ID NO: 647650 - DNA, 234 bp, Homo sapiens
cacgagcgcgccaagagcaagagaaagacttgaacgtgcctcctctctttactttgcacatacaacacgcgcaaggcgcgcgcgctgacagcctgattacaatgctaccctatccttctcacataattacttgtcacctctcccctagtgcccactttgtcgctttaaatatggacgccctgtaactcctcattgtaacaagtgctgactccagaccctctcgggtcgctcgcg

SEQ ID NO: 647651 - DNA, 588 bp, Homo sapiens
  misc_feature (1)..(1): n is a, c, g, or t
ngaaggcggctttctcacaccttaattcgtgtcacccgaggtgtgtctcactattatctataagtcataaagtttgacttggacctgtagaggcctattcgtcacatctcttttcaacagtcttgttaatagcttttcaggtttcagagaccagaaaagtcccatggggtggactcccatatattcccctccaattgaaagagcttgattcgggtccacctcaccgatttcattggccatatagtgggcttgagaatatccagtgtctccgttttcttcttccagtaatgcttgaaacctctccatctaaaggtatctcaggcctgtagcttggatatgctgtgcgctcatcgccaagtgccctcacaggggtactgttcatttggatcatttttttagtgtggcacttggaatgattcttcaggattatcttcagcataccctcaacctctagcaagagatcttgcccccaaaatttcagcgtaggttctattttccttaagtgtcgctgtggtctgagatatatagagaaagagcacaaagagagacattcacagctgcgcctccgggggtgatgtcacatctcag

SEQ ID NO: 647652 - DNA, 304 bp, Homo sapiens
aaaatctttaaggaaaaaagctgaagggtacgcccatgcacatatgtgacctggaaaaagcaaatttagatcttttatgaattaaatattaattgtttcccaaagaagttccctccctttgaaattaaaatataatgtataaattttgcactgagccatggcggagctgggcagcccctaggttaaagtggaaacggaggcccaggggcaggggtcacacctcatttggtttccttcccatttcacaggttaggttgtgcttttcaacaccaagtttttaagagcaataaaaactaccccatga

SEQ ID NO: 647653 - DNA, 947 bp, Homo sapiens
ggtgacatctttcggttgctttgccccatcttatcctcgcgtcttctcagacattcttgccctcattctccaggagccaatgcgagactttggctccgagttaggcgagcggcccgagagcttggggtgcgcgaggcaggatcgagagagtggtgatggagatgcacgccttcgaggggactgatccgagtacacctgacaatgcaggaatcatgcaaggaatacttagaggggcctgagacccgtggggtattggacacgatagtatagggcacgcctgccaacgatgtctggactgtgccttgcgagaggtagctcccatccttgtgcataatgaactggagtgatgcggatgctctttctggagcaggctttgccacaggctgatgtagctctggtgcggtacacaagataggaagtcagcacggctcaggaggaaagtgcagggttgctgaacgtggtctccggatctggcgcaccgcagtctgctcgccagcggggtgctcctagtgggctcatcctcaggcccatgtgccgtcagaactccgattgccttctgggtggggggaaggctggtctgatgacacaagtcagctgggaccagacaagcgatgccgggagttccctcccttgaaagtacgccgaggagcgatgggaggtggtcttgagcttcatggttggggctccccccaagtgcacgctgtcagacagggaattgggtcaggtcctcagcagggtgggtcattgaagagtatggagcctggagagccggctggatttacttccgttgggttccagttcctgtttgtgggacacccggggtcagatctggagctcctagtgggcagcatttggaggaaagcaagaacgggagggccgggaaaaatccccttcccttcgcaggaagtttctgggaagcgaatccgggaagagagaggacatctggc

SEQ ID NO: 647654 - DNA, 217 bp, Homo sapiens
ccggggcatttggggccccccccggggggataaaaagggccccttcccccgttgggggggtttccccccaggggggggggggaccggttttctccccccggggggggttatttgtttttttttaaacccggcttttttttgggccccattttgggccggggggccccctttagttgggggttttttggggaattaggggcctttttccccctcccca

SEQ ID NO: 647655 - DNA, 1123 bp, Homo sapiens
ctgcccccaccgcccaatctaggagcctggcaccccccagcctgggggatcccggtggagcctgcctgcccatcctgggacccagcactggggcccagcaccaatgaactgagaatgtctgccaccgttgtcttgtgatgctccctggagtgtgatgtggtggtgcatggtggtgtgtgccacaccccagccatgcgagggcagtggctgcatgcatgctgtggtcacccctgctgggtgtggacccccacgccgtcagcggggcgggctggctctgcctcctagctacaccccccacccctggccctgctgggtgtgctgtgtattgtctgacgtgtggtccccaccctaggcttggcagggtggtctcacccctgtttcaaatggtggctcatgtggacccacatgtcttggacccactggatgcatgtgacctgcacctcgcacagtctgctagtccagcccttgtgggcatgcctgtgcagcacatacctgcctagtgtcagccttggagcctgcagctgacccatgcctcagtcagcctgtcggatgttggtctttgggggagcccgtccccacaggatattgctcccaccatatcctggctcctggcctctggtgatgctgcctgtgtccctgagttctctgtcgggggacccagcccatgtggcccaaggttcagtgtctccttgatcctggggagtgtgtccgggtaggcgagcctgacaccccagccagccttggtgctggtcgctggacccaggcgcattagctgcaggagctgcctcagtgctgaccctggtgacttgtccgcctgggctctgggccctgcgtcccttatggtctgtgtcctgtgtgcgtggtgagttcactggatttgacactcaaactgaggagaggggagagagagccgggacacttgtaagggggacacccttgtagacagttttccgcaaaagcccttttccgagagacaggtgcgacaaactcacgcgcagtcgagcaagggcacaaggagagcgaactcgggggttcacaccccgatcgatgaatgatcgtgacgccgacatgtcgtggacacacaaagaggagatgaactcacagactacagagaactcgataa

SEQ ID NO: 647656 - DNA, 633 bp, Homo sapiens
gctgagtcggatagctatctcatgcgaagtcagacgttccttttgactccatctcagtcactagtctttctcaatcctatccataatgatgtcagtgacgtgcagccgaggaggcagcgattacgactggacgatggacagtgagtcccctcatgagtgcaccacaggaagtctatctattctcggcttgttgaaacgtacacaggccgagtgaacatgaatttgatcatgttttaatggtggggctgtgcttgatgtgatagaaatgacgacagtgtgtgctataatcgtgttatagtaaacggagtccggatcttacgtggcgcttcgggtggggggtaggagtgagagcttggaaaattcggcttggaaagcattgaggcagattgaggttcaaacgaaggcggggccaaaattatgagtaaacaactgcgctgacttggttgatgaaatggtcttgggtaaagcaaatggtttggccatcgtggggggttccgcaagtgaaaggactaccaagtgggtctttaatggggggctcgtgttggttcatgtggccgagtgaatgttgagggtgatggagatggtaagtgacgtggtggtggaggatgcaggggtaagaagatgaggaggagg

SEQ ID NO: 647657 - DNA, 470 bp, Homo sapiens
  misc_feature (85)..(85): n is a, c, g, or t
  misc_feature (90)..(90): n is a, c, g, or t
  misc_feature (94)..(94): n is a, c, g, or t
  misc_feature (116)..(116): n is a, c, g, or t
  misc_feature (425)..(425): n is a, c, g, or t
  misc_feature (428)..(428): n is a, c, g, or t
  misc_feature (460)..(460): n is a, c, g, or t
aggctgttgctgagccgcgcgcgatcctcaaggagcgtatcatcgacacccatatggaaccccacggcctcaccgccgcgcagtncaagntgtngatcatcatggcccagttcggngtcgataccccggcggaactgtgccgcaacctatcgctggatagcggttctatgacgcgcatgctcgaccgtctggagcaaaaagacttgctcagccgcaagcgctccgagctggatcgccgccaggtgcagttggtgctgaccgccgagggccagcgcctggcggacatgctgccgcacattggcgccaaggcccttaaccagttggccggcgtgcttgagccgggcgagctggaaaccctggagcggatcctgaagaaaatgctgatcgctgcgggtgaccccatcacgatccagcgggtaggtagntcntgaacacacgcgcattcagcctggtgctgtcnggggagaaga

SEQ ID NO: 647658 - DNA, 246 bp, Homo sapiens
  misc_feature (229)..(229): n is a, c, g, or t
caggtattacgctttcagtacaggctccaaaatgtatgcctctcttgaatattcacaggattcatacaggagtggtttgggaaacctttgacagattcatttttatctactatacaggaacagactttctggaggtctgatacggatttcgtactttcaagtatactcctagtcacgcaaaggtgtcactgttgagcagttctgcgagacagatactgctttcatacgntctgcagtctgccctgt

SEQ ID NO: 647659 - DNA, 712 bp, Homo sapiens
gatgaacggccatgtttcctccatcagtttaggggctgccaagatcaggaaacctattaagtgccaccaagggagataaatgactaagtgctgttcttcctccacctgagtggtgccactcgagataggagccgcgcaagcaccgtgcatgcccccgtccgcgacagcccctcagccatcgacccgagtgaggactcacctgcgcggtcgaggacgcgcgctgacccgtgccctgtcgtccacgaggtagcgagcatgagcgaccgcccgcgacgtgtgggccgggcaaggcccttcactcatccgccgtacggcgctgttccggctgctgctgtggacgcatcctggttctgtcaaccgtcttcctgtgagcgcagtcatcgtcgctgctggcccttcatcattgctgcgccttgccgtggagtcgccagctgcggccgcaagcggcctgcttgcccggccagcttcccgcctgcggctccgctgctctcgcgaggccgacagccttgtgcgggctggaagccctcggtgtaccacgtgctgctcatcctgggcctgttcgccgtgctgctgtcctgctgcgcctcgcgcatgtacaccagcgtggagggctgggactacgtggactcgctctacttctgcttcgtcaccttcagaacacatcggcttcgggggacctggtgagcagccagcaccgccgcctaccggaacc

SEQ ID NO: 647660 - DNA, 322 bp, Homo sapiens
atcagaggagcttgtggcagtggaggagaatccaaactgttgtgctcattgcgtttgggatgctggtggacacaagtggaggtgacatgtggcagctgaggacagcgagagagaggcctgaagtggagcctggaattctccagacacatgtgccatttagggctctaggattctgtctgcaagggcagccatgagggccgggcacggagccccagacgactccccatgtagagacagggagaaacggggactcagaggaggggagtgagcaggtgcagctgtgggggcgggcagaaccacaggaactcagggtcgcctttct

SEQ ID NO: 647661 - DNA, 337 bp, Homo sapiens
tcgtcatggctgactcttgaggatccacccgcggcgtgttcatgcagccccctgcagtagggccggaagttggagatcataattgctctatgccaaatcttggctggcagcggccagaggagttctggcttgcatccatgtaggagggcctgggagatgcagattggaggcttgttctttaaaggcccagtgggggtctggcctgccctgccctctgtgctgctgctgggacgtccagccaggctgagccacatccttgagctgtcagagagtgatgatgtcctcttctctcaacctggaatgcaccttcctcaccagcagctcttccttccttccg

SEQ ID NO: 647662 - DNA, 165 bp, Homo sapiens
  misc_feature (117)..(117): n is a, c, g, or t
  misc_feature (135)..(135): n is a, c, g, or t
  misc_feature (155)..(155): n is a, c, g, or t
acatggcccctggactgaaggtgctcagttagtaagggagtgtcatgcaggtcaacacacgtcgcacatggaccacaaatgcctgccaccacaggatgcacaggacttttggggggngtggacaggtattattgngactggtgaggtgagaggtnagagggggct

SEQ ID NO: 647663 - DNA, 466 bp, Homo sapiens
tagcgatcaaacccatgccaaaaatcatcacgaagatcatcgctgccctactcccaggcgcttgcacgcaaaccccgcgctcatccccaacactccggacaccaccaccgccgactcccaatgcaggtagctcagccataccgaacacaacaacgacacggcgacgcagacgatggttggcacgtcgcgtacaacgggggtgatcagggcgataaacgtcgcggcaatcgagaattccagacccagccgatccagcccgggaatgcttttaccgagcacgatgccggcgaaggtgaagacgttccagatggtatagaacgtcaggccgacgcccagggcgtaccagcggttgaaggtctggcggtcatattggctgaccagggcgaagaattcatcggtcagcaaaaagcccaggctcatgcgccacctgggtttgagcggcgacagcgtagggcgcatgtgcatg

SEQ ID NO: 647664 - DNA, 621 bp, Homo sapiens
gccgcgcagctggaggcggcggagcgaaagccttgacttcatctcagctccagagcccgcctctcttcctgcagccgtgggaacttcagccggttgggagccccacctatggttgcaatccgaaagaagcgtggtgatcgtgcggggaatggtgccgtgtgggaagacctgcctcctcatcgtcttcagcagaggatcaagttcccgggaggtctacggtcccctacgtgtcttgggagaacctatattgcggacattgaggtggaccggcaaagcagcgtggagctgggctctgtgggacaccagcaggccaggaagactatgatcgatgcggcctctctcctaccggggacactgatgtcatcctcattgtgcttctccatcgaaagccctgacagcctggaaaaacattcctgagaagtgaccccagaggtgaagcacttctgcccaaatgtgcccatcatcctggtgggaaataagaaggacctgaggcaagacgagcacaccagggagagagctgcccaagatgaagccaggagcccgtcggtctgagaaaggccgggaacatgggaaccggatcagtgccttgggtaccttgagtgctcagcaagaccaaggcgg

SEQ ID NO: 647665 - DNA, 550 bp, Homo sapiens
  misc_feature (498)..(498): n is a, c, g, or t
cgtgccagaatcctcatatgacctgcacagtctcatcttcctgctgaaagaaactactaccgtagcgagaatctaagctatagcagggatgcagtttatgcaaatctgaactagcttctttgttcatcaagtcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcanggaagaaggtaaaaaagagaaggagaatactgggagataatgcgcaaaatga

SEQ ID NO: 647666 - DNA, 553 bp, Homo sapiens
ctgatgcagagagccagaagtatgactgtatacctgtccagctatcttttttgacaaatctgagcaaagaacaagcaatggtctaaatgtattgaatggggaaaagagttgccattcaataaataatgctggtgataaccggactagtcgcgtatgccgaagtttagtactggaccccttccttacacattatagaaaaatgtactcaagatggattaaaggcttaattaccaaacccaatactataaaaacccagcatgacaacctatgactatatcattctaggaacactggcatgggcaaagatttcagtgacagagacgccaaaagcaattgctacaaaagcttaaaattgacaaatgggatctagattaagagcttctgctcttctatatgtatctatcgaacagacttagtctgtactagttccgtatgggagaaaaattttgggaatctattgcttctacaaagggctaatgttcagcatctacgaggaactttgacaatttccatgaaggaatgccccgttgtaaactggttgaggatgagccag

SEQ ID NO: 647667 - DNA, 493 bp, Homo sapiens
  misc_feature (52)..(52): n is a, c, g, or t
  misc_feature (69)..(69): n is a, c, g, or t
  misc_feature (274)..(274): n is a, c, g, or t
  misc_feature (277)..(277): n is a, c, g, or t
  misc_feature (284)..(284): n is a, c, g, or t
  misc_feature (286)..(286): n is a, c, g, or t
  misc_feature (298)..(298): n is a, c, g, or t
aattcacggtcattagaccatttccaggacttgtgattaataaccagctggntgatcagagtgagtcanaaggccccgtgatacaagaatcagctgaaccaagccagttggaagttccagccacagaagaaataaaagagactgatggaagctctcagatcagcaagaaccagaccccacgtggtagacctcttccctcctaggcttaaagtatcagtggttgagaagagcttttcggacctgttactaccccagctgtgtatatactgatacngantaccttntnatccaacctttnttttctaccttttagaatggaaattgtttaccttttttcaagcaggttcttgttgactttaaaagtaggccataagttggacttggtgggggatcttggaaaatggccatggtgggtaaccttgggggaaaagtggaccctaaattccggggaatttttaaccccggtctttggctttggcacattgccgggggt

SEQ ID NO: 647668 - DNA, 384 bp, Homo sapiens
tcgaactcgagctgataccccccgctggccaatcgcagtggtcttggcgttggaggtggcttcagttccagcagtggcacgagcatgtgggggtggctcagtctgtaggaggcggcggttccaccatcaagtacaccaacaacctacctcctccagcaggaagagctataagccactaaagtgcgtctgctagctctcggtcccacagtcctcaggcccctctctggttggcagcgccttctcctcaggttgcctgtcctctcctggcctccagtctcccctgatgtcccaggtaagacgtgggggatgaatgctttagtgccctcactactcctctctctaccttattacaatttgagcacccattgctcaccatcagaatca

SEQ ID NO: 647669 - DNA, 974 bp, Homo sapiens
cgtcctgctggggatcctctacgggaaagcaagtacgaggcggacatgtgctgtgaggagatttcctctggaataacatcccgatggatgaaacaggaacgcacggtcgtcagtggcttcataaactgtaccaggagaaggacgcgctccaggagatatataatcagaagggcatgtttccagagtgagcagtttatgcctgcccggaggccgtgggaccctcctgcaacttcctgtcctggagccaccatatctcctgtcatccgcctcttcagattctgtcttgggcgtcatttgccagcggatcaggctctcctgatcctgacttacttgggcgttagtggagagcagcttcctttggagttcgcagactgataggagtaacttgagatatgaaaaaggctccagctacggaaaccaagagtttaagacaataaggacatcacttaatgcgcgtgtgacgtgaacacacgcggccctgacggtggtatccagtttaactcaaaaccagacgacacagagtgccggacaggacaattacgtaaactatatctcttacttagctggtgactaatattaatcaaaacttgagcccaagagctaacgaattcagaatggcctgtcaggtgaaggtcttcagactcccacagcgcagaggtccaggatatccacgcgcgcccgttgggaagggtgggatccgggccggagaagggcctccccggcggatagccgtcttctccagaatctcccgcattcccaagaggggaccctttgggatgcgatatttctctcctttaaaggtagaattaaattttgtgggttaaattcaggtacttgggagacttaacgtgggccctaaagtttattggaaccccgcgccggaatggtgtctgcagaaattcggggccccttaatgggggagcacacacggaaatatgcgagcaatgtacgaatggcgtacagatcaaataaca

SEQ ID NO: 647670 - DNA, 439 bp, Homo sapiens
gggagggagtctatgcgtgaaaaataaagtgaattgagcgtgaaaaaaaaaaaaaaaaaaaaaaaaaaaaaaaaaaaaaaaaaaaaaaaaaaaaaaaaaaaaaaaaaaaaaaaaaaaaaaaaccttgtggcccgcttggccccaggggcctttagccccggccaggtttttgcttggggccgtatttcgggctcattgggccaatgccccctttggcgagtcgcctcccaatgaatgggccgccgttttccagggccgggattggaaaaccctgggcttgcccaaccttagtggcttcgaagcaaatccccttttcgccagttgcctttttgccaaaggggcccaaaccgatggcctttccaaccattggccttcccaaaagggcgacgggaatttgtggccttgatttggtttccggtttaatttttggtcttccttt

SEQ ID NO: 647671 - DNA, 103 bp, Homo sapiens
ccagaaggggcattagctggcgtggggtagggggcagagctaattgtgaaggaagagggcctgagatcacgtagccatgtcggagaacagctgtgctcgctgc

SEQ ID NO: 647672 - DNA, 1641 bp, Homo sapiens
  misc_feature (73)..(73): n is a, c, g, or t
  misc_feature (96)..(96): n is a, c, g, or t
  misc_feature (120)..(120): n is a, c, g, or t
  misc_feature (158)..(158): n is a, c, g, or t
ggcgaagagtatgctcaacgtttcagtcctgtcggatgctgaggatgatgtcctgatggatgtcctggcgcantgtaaacaatgatcacacgtagnaatatgcgtctgagtgtagacganaagtgcttggaacgattattcgtctagtgaacgtgtgntcccagatgctcgccattggattgtactaacgtgctaggagcctaggaacgaaaggaatgagggcacgaatttcatccagtagggatctctatttgagggcgagtaacgtactagaatacaatcgtccaccgtgtgtgttaacttctctaacgaaaaggacctgccaaataaacgcgaccgaacgggcatgcattcgtggcgtgagtagcgactaacacatgaactcgtgccgcaagttctgggaaggaattcacgcatgaacagttcatctgcccatgagatactgtatacttcagtcatttggatggaggactatcacggaaagtaccggtcctgattagcggtcagctggatagtaggacgcataatcggtagacaagagagaggctaaaattatcattggagtgttaggtgatagtgaggcgggaaaagttgggcgggtaaaaattggtgagtggcatctaaagaaagcgatggagatacttggttattcgatcgcaggatgtccccaatatttggtgggtaagctaacttggcttgttttgacatggacgaaagttcttccaaattgagaaactcttatggaaatttgtgcgaagaagtaacgcctcgtaggagttgcaatcctaggagctaaggcacactactgtctcgtggttctgtggggacaggggtcgcctcggtgagtatgtgacatatgaacactgaagcggaaaccttgagcggcaattcggatcgggcgtttcgtgacactttgaagcagtgctttgcgtgtggccacaggacggtttttggagagaaatatccttaactatgggaggtataagcttctcctagaaattgcggcgagagaaatcacttgggggactttaaccacatgtgggtgttgcccctactctgtttgttgaccagacgatgttctgccacattaggacacccttggtgcggtggtttgctgtccacaccggtgtggccaacggcctgtgtgtgcggaaacccgagactggtgcgttaggtggggcgcgggtctcgcaaccacaattttgtgtggggcggagaattgcggtggttaaagaaccacgaggacacctttagtgatacaagcggcgcgctcgtaggagagcaatttaatgcagcatcgacggaacactctgttgcatcatcgtgcttctgtacacacacgatgagttttatccagcgtgtgttgagatgttgagtacggagctaataaggggggtgaataaaatatattgagtgataagataatcgagggtggaatatagtgacactaatgagaggcgcagaaacggggtatatatagaggagcggggtgattgttataatgatgaaaccaacacttaggataacagaagatgagaatacgtacaatttgtaggttgctttgattgttgtttgttgttgttttgtagatattattattgtatgcttgtatataagggagagagcgagagcgggaggtgg

SEQ ID NO: 647673 - DNA, 112 bp, Homo sapiens
gcagcaggcggatcacgaggtcagagttcagtcagctgacaataggtgaacccgtctcactaaaatacaaaatgagcaggtgtggtggcacacgcctataattccagctact

SEQ ID NO: 647674 - DNA, 625 bp, Homo sapiens
  misc_feature (44)..(44): n is a, c, g, or t
  misc_feature (133)..(133): n is a, c, g, or t
  misc_feature (235)..(235): n is a, c, g, or t
  misc_feature (568)..(568): n is a, c, g, or t
taatttttcttttttttatattttattatatcatctctctcttnaccatattcttttctcttcttattcttattttatctatttttttcccatttttcttactttttttctcctccctttccctcccaatttncaaacttttcaccccttctcctacttcccttttcattttaatcatatttatttcaatctttattctcatctcatcttcaacatctctcttttcaaaatctanaactctcttttccaactcttcttcatcaatcttcataataacctccttttctctctttttcttctcactccctccaattctaccttatctaccctttccccttcctctacctttcctttccctcttttaccccttctcctccacctcatcatcaacccttttatccttcttcctttccaccctccttctttttaaaacctccccctccctcctctctttcctcttttccttatacctatcctcatccttatctctcctccttctcaaaatctcctcttttatatttactattttcctttttccacttttactttattcttttacttttttcanttcttatattcttactctacttaatcttcctttatcctcttttattttcctctcatt

SEQ ID NO: 647675 - DNA, 838 bp, Homo sapiens
agcgctgttcctccatgaaactgaaaaacacacacacacacacacacacacacacacacacacacacacacacacgagacacacacacacgtctgagagagagagggagggagagggtcgtgtcgctcgtatgcactctagctgctcgccagatgtccactcttatcacgagtctcgtgctcctctcctgtgaaatgtgaaaagggaacacacacacacacacactctgcagagagggaggggaggagagggtcgtgctagcaaataaagagctctctctccacaatatcatctactactaccaacacaaatattatgagcagacaatcattacatgctgttgttcatagaccgcctcgttgttacagaggcctcatctcgacattagatgcgcacaacacaacgacgctccgtgggagacagacgacgaccgacacgcagcaagagtagttgcatagtagtacgccagccatcgtaagatccatacgagggagcgaacggaggtagatgcttcacgcagagcatactactaacacgatgatagatgcgtggtgcatgagcgacgaaggagcgaggggcacggaggaagaagaagtacgctcacggaggaacaagaatcgcatcactctcatccaggtaggagattctagtttgatagccccccaacgaagtgggtacgaagaaacgatcggtggaagatggtaaatataagtaggggtcggttcgatgaaagaatcattggcgagcaagggggaacataccgtgggtcgtgcacacgaaacagaggcgggagcaggaggaaaaagcacagcatgaggacgacgaagaaaaaacaacg

SEQ ID NO: 647676 - DNA, 643 bp, Homo sapiens
gtcctcgacatttgcgctggctctctgacggtcgtgcaggtcgtgcagtatgcctgagactgtgtctgaggccgctgctgaggaggttaggcaccttatgaccaagtcatcgcttcaggcgatgctgctcatatatgctgattacaaacaagcaactgtgcccgacataagtacagagcgtcccgcgctgatgtacttcacgcccaaggtcacgtgagatgcctggactgagctgaagggaactgacatggaagatgccatgaaagcttacatcactaaagtagaagagctagtggccaaatacaggatatgagagactggatttggtaactgcgctatgagtgtattctaacgtgatacagtgccttgatgctgtctaataccgagcatgtggggaattcgagaggatagccagatagaccagctgctcacggctgatcaccatacggctctaacagattagcagctcagttggtactttaatgaacgacaccattttagatcacactcaaggcgttgcccgaacgccaattgccctaacgcggtcggaatcacccttaatggcccgccgattacaacgaggcccttgagcacccctggcgtacacaccttctctcttcaccaccctcccctctttgccgcg

SEQ ID NO: 647677 - DNA, 215 bp, Homo sapiens
agtttatttacaagatacttgtgcatacggttagatatacatcctatgccattttagtagaagaaacttgaacgtccacagtttttgctattttttttggaatcctggaactaatttcccacagatacagagggagaagggtgtagagaacaaattggtggctgccagagacagggggtagaagattggcaaaatgggtgagggtggtcaaaagg

SEQ ID NO: 647678 - DNA, 856 bp, Homo sapiens
accgtgtaccagcgggcggtggtcgctgtgtcggtcggacgcactgggagtataaggggaattgtccggtgtttcacaggtttctctggtttttgtctccagagccacaggcttttttctttccgcctgcccccctcctcggggagtgaggtcccccctcgaggggttcacagggtggccccccgccccacgggggctcttggtgttctggtgtccctacaaccctgccgtcgcgccacccggcgcccctgtcgcgctgttcttgccacggcgcccgcctctctgggcttttctgccacagcacagggctttggcgccccaccctctctcgagagttgggagagtttggaaaagttataggcgcctctctccgggctgtccccctcgcccctctggtgggccctcttgtcacgccccacccccaaggcgtttggccaccgccacaccacaggtggagcccccccgatggcaccccccggcgctctgagcgccctctcttgcgcttctccccataccacggccctttctcccctcgtgctcgcctcgttggccacgccctgaacacacccccaccctcggcggttctgggcggttccaccacgtatgggcctcccacctctgctcgagagggcacttgtcacgcgtcacacctgaaagtcacccacgcttgccggaacactttttaatgccaagacactgagagaatccattattaaattcaccacggactgagcgtttcacctaatcacatggggctataaaactcccccgggagaggaaagtttccccgttcccctggcgggctttcatttgccattttaagaaccaccatttaatagaaaacccccgaatggga

SEQ ID NO: 647679 - DNA, 644 bp, Homo sapiens
catgagccactgtgcccggcagacatttgagtatttgtatataagatattttcgtagacatttgagtgtttttttttgtttgtttgtttgctgacactgattttccctcttatttcccaggctggagttcaatggcacgatctcagctcactgcaacctccacctcccaggttcaagcgattctcctgctgcagcctcccaagtagcacatgccaccatgcccagctaatttttttgtatttttagtagcaacatggtgaaaccccatgtctatcaaaaatacaaaaattagctgggcatggtgatacacacctgtaatcccagctactcgggaggctgaggcaggagaatcacttgaacctgggaggcggaggttgcagtgagcagaaattatgccactgcactccagcctgggcaacagagtggagaccctggctccccaaaccccaccaaaaaaaaacaaaaacacaaaaaatgaagaaacgcatttgtgtgggcccgccttaggccccctggaaaaaacgtttgtaagcaccaatcgtgtgggggcgcggggacccaaagtagggtacggaaccgtgggccaaaacggggtcccaaagaaaccccgggccaagaacaacggcgtggaacccacccaataa

SEQ ID NO: 647680 - DNA, 151 bp, Homo sapiens
ataagtggcgtgttgccactgttagtgaggggtaggagtcaggtagttagtattacagacgggggttgttagggggtcggaggaaaaggttggggaacagctaaataggttgttgtctgattgtggttaaataaatagtagacgggatgat

SEQ ID NO: 647681 - DNA, 675 bp, Homo sapiens
acattttctgactatggaaatgatattagacaaaaagcaacttcaagtggttttcttatttgagttcaaaatgggtcataacgcagcagagataacttgaaacatgaacagcgcattgtggcccaggaactactaacgaacatacagggcaactgtgattcaagaagtttgtgcaaagcagactagagccttgaatatgaggaacacagtggccagccatgggatgcttcacttcttgaagcatcttgacagcttttgtgcaggtgaaatgcttccacaccagcaggatgcagaaaaatgctttccaagagttggttgaatccagaagcatggatggtggggtttatgctgcaggaataacacaaaactttctaattcttttcccttccgggttttgtgggggcaaaaaaaaaaaaaaaaaagggggtttggggtttatctgggggaacactctctgcggggttcttcaaaccacaacgttctgctgggggggggggaatattttttttttctccccccccccctttttatttaaaaaaaagttttttttcaaaaataaaggagagggggagggggggggaaacacacatttttctcttttttacacaacaaaaacaaacatttttttttcactacaaaaaagacaaaatcgtagaaaaacaaaacagggagaga

SEQ ID NO: 647682 - DNA, 159 bp, Homo sapiens
agactttagaaaaacttagtgactactagagttatccttaggactctgcattaactctagtatgttcttggctacttagaaaaaaaagcatatttgtcacagaaatttagatgacatcttacaacttaacatgtatgtatatagcttagataaatgtaa

SEQ ID NO: 647683 - DNA, 137 bp, Homo sapiens
agtgatatgggtctgtcaaagcctatactaactttgatgctgagctggatgcttcgaacatagaaacagacatcaagaccaaaggtgtggatgaggtcaccatagtcaacattttagaccaacgcgcagcaatgcac

SEQ ID NO: 647684 - DNA, 611 bp, Homo sapiens
gtgctgatcagtagtgggatcgcgcctgtgaatagccaggctggtctcaaactcctaggctcaatgccattcacctgcctcggcctcctaaagtgagagattccaggtgtgaactacccacttaaatcgttttaatttaaaaaataaaatgaaaagaatgttcttcgtgttgattggttgggttgtggtaatcattgcatagtgtatacatctatcaaaacatcatggtgtatgccttgaatatatacaaatcttatttgttaataaattggtggagagaatatcctcgtggcgcggatagcttccctcttatatggtcggagatgagccccccttttcctgcattgtacttgtaacagatatcttttttcccctctgtagcttgtcttattcacctgttagttgtgtcttttgataacataaattcttaatttcaatagtagtaatgacatctaatcttctcctcctgtatgattcagtgctctcctgtgcacgttatgacataacagctcataaacgataatctctaatatacatctactacaacagccaatcgctttagcactttcacactctagatacctatacagggctaaaattactcaataacc

SEQ ID NO: 647685 - DNA, 390 bp, Homo sapiens
  misc_feature (40)..(40): n is a, c, g, or t
  misc_feature (107)..(107): n is a, c, g, or t
  misc_feature (121)..(121): n is a, c, g, or t
  misc_feature (212)..(212): n is a, c, g, or t
  misc_feature (229)..(229): n is a, c, g, or t
  misc_feature (296)..(296): n is a, c, g, or t
  misc_feature (299)..(299): n is a, c, g, or t
  misc_feature (379)..(379): n is a, c, g, or t
ggggaggcactgggctaggagttgttcctcaaactcgagnatgcccaaagacaggataaatgaaccgcatttatactcaaatatttgtgggaaaatagttctttttncaggctgggtgtgngtgtcacgcctgtaatcccagcactttgggaggccgaggcgggtggatcacctgaggtcaggagttcgagaccagcctggccaacgtggcnaaaccccgtctctactnaaaatacaaaattagccaggcgtggtggcgcatgcctgtaatcccggctgctggggaggctgaggcnggngaatcccttgaacctgagaggcggaggttgcagtgagctgagagtgcgctattgcactccagcctgggcaacaagagtgnaactccatctc

SEQ ID NO: 647686 - DNA, 1046 bp, Homo sapiens
gacccattacttccactcataattcacaaggcaccaaattcattcagccacagcaaataagcaatcagtattcagacagcaattggatcctcattttgaacccctctccagtatcttcacactcttgtcaactctccccgtgcctctctcttgccctgagttcatcagcctgtgtggtgttaactcaccttcagaagtgtacacagctaagcaaatgtacacagtatcaaccctcccagttgcttaattcatacccataggtaatcaccaaaacagctctgaagacccaaagatgcaccattactcaatgatgtgatttccaggagccaccagaagaaccttaccagcttccctcaaatcagtccttatcctctttctatcttcactcccatcatcatctattttcacactatccagctaagcaaaggattcctgtgacgtgctgacattgtctcttcagactcacagagttgcacatccagctcttctgacatcaagacccaaccagtcgtcttctcatgcagacctgtttgctaacaaaattccatattctgcccaaggatattgcaggcacacaagcaggctacttgatcggcaggcccaacactccgtgcccacattggcaagtgtatcctctacctagggtcgtttgcaacacctttcactgcaggcacgggtcaacatcaaaccctgggccaatgaaattttgtcaccacgtagcaactcacagtgcccatgggaaatacccacgcccatcatcatcactttcagtccatcttacttgtggtcagctgaccgggaacgaccaggcacagggcgcgcccctggaagagcaactcacaggaggcgctcacgcaggccaacagacgggcccctataaaacagctggacagggcccgagcacccctgacaaggcgagcgcgcagtagcagcgcgacggaaacaacacatgcacagacggacggcgagacaggaccgcaccaacacgccacaagtgagcggaagccgtacacaagcacacaacaatcaaccagacacgacgcaaa

SEQ ID NO: 647687 - DNA, 347 bp, Homo sapiens
taagtttagggaaaaaaaattgggtttgggattttttggtttccccatttgtgattgaaagactatggccctgtaataagtccaaaaacaccagttgcagggtaacagggctgttaatggaatcgggtcatttaaaaacagtcaaaacttccctgttgggcatggggttaggagccagggcccccgtcagtttttaggaaatggccagtttgagcaaaagcctttgaaatccaagacttttccccttggggtgctgttgaggggagaaaaaaaaatgggggaattttttttttttgaggattgagattttccccttagaaaaaaacaaaaatttttttttcagggga

SEQ ID NO: 647688 - DNA, 101 bp, Homo sapiens
  misc_feature (27)..(27): n is a, c, g, or t
  misc_feature (31)..(31): n is a, c, g, or t
  misc_feature (85)..(85): n is a, c, g, or t
ctggccgtgatgtcatcagccgagccncccncgcggcgccccattcccgccccccgcaggatgccgcgctgcagcctgagcgccngtccccgccccgaccc

SEQ ID NO: 647689 - DNA, 126 bp, Homo sapiens
caaggagtattacaagtatgcaactccaccattacccctcctaagagaggctggagagaaagccacaaacattaagaagtgccggtcctgaagaagggaggtggtgtttagagctctgcaaggagg

SEQ ID NO: 647690 - DNA, 431 bp, Homo sapiens
  misc_feature (4)..(4): n is a, c, g, or t
gagncagcctgggcaacaagagccaaactctgtctcaaaaaaaaaaaaaaaattaggaagtagccaggtgtggtggctcacacctgtagtcccagccctttgggaggctgaggcaggaggaacacttgagcttaggagtttgagatcatcttaggcaacatggtgagactccttctcaaaaaaaaaaaaaaaagaagtgatgaatacttaagcatcattgtttttaacattatttacttttttttttttttgagacagcctgggcaacaagagccaaactctgtctcaaaaaaaaaaaaaaaaaattaggaagtagccaggtgtggtggctcacacctgtagtcccagccctttgggaggctgaggcaggaggaacacttgagcttaggagtttgagatcatcttaggcaacatggtgagacaccttctca

SEQ ID NO: 647691 - DNA, 743 bp, Homo sapiens
tcctgtgccttgcaattaagcgttgagctgcgcggggcgcgggggacgctggctcggccgggcaggagagagggcgcccgggctgctgcttggggcgcggtccggagagggttcggctcccctgggaccgggccggggctgcgcgctggagaggccccacaggtcctgtgctactgccctccaggagctgttggcggcgtggcagcgatctggggcccggggcagtcgcctttgattatcgagggcgcttggcgttcggggaatggttggcagcaccttacgagacccacacacgtcccctggggcggccacgggccaccttctgcggagcctcgtgggcttcgccgcgcgtcgcacctccgctctgccttgcgcttactgcggccccaggaggtaaggcccccatccgggtgacggaggcctgcgagtcttgttcaccccgagtcccaccagggtcccgcttgcgaagggtgaaggcggagtgggctcgcttcagaaaaccagtacggcctgctcccagtttctctaaattggggttggagccccgtcaccctttccccagatcaccggccgcgggggagcgaagggaacttcccagtgactgcatagggcgcctcccgggacccacaggttgggctagggccggccccttttgagcatacaggctaaggcttgacttgggggaaatctcccgtggggagcgcgaaatggtcttccccggggaccagctctggccgggttac

SEQ ID NO: 647692 - DNA, 100 bp, Homo sapiens
ggggtctgtgtccggtgcgtgttggggttggggtcaccgtagtgatggtggtgatgggtgtcgctgttgggttctgtgtgccggtgcaggttgtgggact

SEQ ID NO: 647693 - DNA, 243 bp, Homo sapiens
ccaggggtttcttcccctaaaggagaagtctctcgaaaagcttctttgtgtcagatagagctcacctcccatcagggacgcacagaccaggtctttgccctctcgtgtaccgcagcgccccagtgaaagaggctactatgacccaagcagactgtgttctgctaaaaattcaccagcaacacatctgaccgagacctcaaggctgctctgccactctcagcagctcactcttcctgtgctccg

SEQ ID NO: 647694 - DNA, 1480 bp, Homo sapiens
  misc_feature (487)..(487): n is a, c, g, or t
  misc_feature (522)..(522): n is a, c, g, or t
  misc_feature (525)..(526): n is a, c, g, or t
  misc_feature (539)..(539): n is a, c, g, or t
  misc_feature (550)..(550): n is a, c, g, or t
  misc_feature (561)..(561): n is a, c, g, or t
  misc_feature (572)..(572): n is a, c, g, or t
  misc_feature (577)..(577): n is a, c, g, or t
  misc_feature (585)..(585): n is a, c, g, or t
  misc_feature (595)..(595): n is a, c, g, or t
  misc_feature (602)..(602): n is a, c, g, or t
  misc_feature (614)..(614): n is a, c, g, or t
  misc_feature (619)..(619): n is a, c, g, or t
  misc_feature (625)..(625): n is a, c, g, or t
  misc_feature (627)..(627): n is a, c, g, or t
  misc_feature (636)..(636): n is a, c, g, or t
  misc_feature (645)..(645): n is a, c, g, or t
  misc_feature (675)..(675): n is a, c, g, or t
gagacagagtctccctttgttaccaggctggagtgcagtgacaccatcttggctcactgcaacccccgcctcctgggctcaagcgattctcctgcctcagcctcccgggtagctgggattacaggcacctgccaccacacccagctaatttttatattcctagtagagacagggtttcaccatgttggccaggctggtttcgaactgctgatctggtggtccgcctgcctcggcctcccagagtgctgggattacaggcgtaagccaccacgcctggccaagaaaatcaagatttacctggtttatgtgttgaccagctatacacagagaattctagatttttttctaaaaattattatcaaacccccaatttcaccagtagaaaaagagatcttaagatttctgtgtttttttttccagcataactcagttacttatggctgggagaaaatatgtagggagataatctaatacctaattcgaaggnagaaaatatctaattctaagtcttgagttcttctnatnngaccatagcaggntttaacatttnacatttttcanaagcttctaanagacntcattcanttttttgccncagcagnggcatttaaatnactgnctttananccatgaatngctggaggnttggaaacttgagtcaatttccctagtacnacctccaaggcagaactagcagcaaaacagtggtaggaaaaactctcaaaattttacccaatctgtatgtttctctacattgtcagtatctagttcttatatagtctcacatcatgtcacttctaacaatttcctgacagtgtctggtgctataaacaccagacccagctccaagatgtcaaagcacagcactctgcacgcacattccacagtcaactaatgcgacttatggtagccaaggaagcccgcaatgttaccatggacacactgacgtgaatggtttcgaactgaagacttcgtcgtgtacttacaggcaagtaacatatctactgaactcacgcagcacagtgtcgggacccgcacaagtacttcatgtaccctccagtgggctgtccacgcacagcttagagcgtcatcttcgtactcccttctaatctcaactcttcacacgaacgctagcggactgcccatgtctccagtagaacgctttcatcaccttctggccacttggacacgactgcatccagcctcaccaacacgggccatcactcgcacgtcaggctaacccatgtatccgcctcctcgcccaaccgggactgcactctggacaactgcatctccgcaaatccaacccgttaaaattcgacaccttctgttaaaacctcttggacctcttctacctaacgtttgggacaccaaagacggttagtaccaaaatctatcatcaggacctacacccagcaagcaccggagaaccaatcagtcacccactaacacaccatagcacaccaaaccaacatatata

SEQ ID NO: 647695 - DNA, 150 bp, Homo sapiens
gcccttcatcgttcccagctaggccgcttgtggcacttccatgctttagtcacatgcctgcagaggtctgtgctgaggtgcgtatcagttcatcagtagggctcttaaatggggcattatgaggtgaaatgcggcatttggatttgaccc

SEQ ID NO: 647696 - DNA, 165 bp, Homo sapiens
gatgtacacccgtgtccagcgtcagcatcgccacttcctagccggcgcaaggaccgcaacaccggcgagtttggtcgacgacacccagtggcaccggtgtgacgttttatgaccgcctggccgagatctgccggcgagtacctgaagaaaggctgacccgtgtat

SEQ ID NO: 647697 - DNA, 277 bp, Homo sapiens
agcataaatagtgagccatatctgataaaggcagtaactacgattcaagagaacaagagtaggtggcatggtgcctcatgcctgtaatctccgcacttttggacgccgaggtgggtggatcacttgagttcagagttggagaccagcctggccaacatggtgaaacccgtctctactaaaaatacaaaaattacgtcgggcgtggtgatgcacctctgccatcccagctactcaggaggctgaggcacaacgaatttacttgactctaggaggcaga

SEQ ID NO: 647698 - DNA, 307 bp, Homo sapiens
  misc_feature (9)..(9): n is a, c, g, or t
  misc_feature (73)..(73): n is a, c, g, or t
  misc_feature (95)..(95): n is a, c, g, or t
  misc_feature (128)..(130): n is a, c, g, or t
  misc_feature (145)..(145): n is a, c, g, or t
  misc_feature (172)..(174): n is a, c, g, or t
  misc_feature (180)..(180): n is a, c, g, or t
  misc_feature (185)..(185): n is a, c, g, or t
  misc_feature (188)..(190): n is a, c, g, or t
  misc_feature (283)..(283): n is a, c, g, or t
ggaggaaanaagggggcacagcaggagtgtatcttaatcctttctcaaagaaaaagaagtagagcattctganttgctgaaaacctgtgcaaatngggcttctgaaacattgtactgtgagctctcannnaaaaggaggaaaaanatgttgataaataaggaggcaatttcnnnaagaanggganaannngggaggcttactatttttaatgccctcagccccagtacctgataatcagaggagaccatgtccaatcttgaatcaattccctgttcaaaaagnggtgctaataccccggggacaaga

SEQ ID NO: 647699 - DNA, 128 bp, Homo sapiens
tagtgaatgaatgctgggggaaagcccagggcctaggtgttgcaatgttttgtggttggcaaatgctttttgttttgttaaaaagggccacaaataaaatttatccatccctttttgcttctcaggga

SEQ ID NO: 647700 - DNA, 332 bp, Homo sapiens
ctgccacttataaagtgagagaaggaatatacgtaaaagatcagtggaatggttccatcctgccaacgcgatatgaacatctggtccagagcttcaagaagattacaaatgtattgtcatctctaggcctgctgatcacttttcagattttctaccagtgtgttcacatcaagaccatcatgacagccttagcattatgcatatgcaacatgcgtaccgtccctgatgtctcccgtcccctctctccctttacagaagcaattacttgggcgggcacagtgactcacctattaatctgtttatttcgcgacggagtctcactccatcacccg

SEQ ID NO: 647701 - DNA, 135 bp, Homo sapiens
agggcatttccccggggggctttcattttttttcctgccaccctgtgaaaaggggctttttgccatgattgtaagtttcctgaggcctccccagccaaatggaactgtgagtcaattaaacctgtttttttcata

SEQ ID NO: 647702 - DNA, 126 bp, Homo sapiens
gctcgatggtacccaccacgtgaggcatcgtgctcccccgtttggcctcgcagccatgactggaagttgctgaggcctcctcagaagcagaagccgccctggttcctgtacagcctggagcaagat

SEQ ID NO: 647703 - DNA, 112 bp, Homo sapiens
tttctttcttctttcttccttccttccttccttccttccttccttccttcctttctctctctctctctctctctctctttctttctttctttctttctttttgatggcgtct

SEQ ID NO: 647704 - DNA, 770 bp, Homo sapiens
cagacacaatttctgtattcatctgagagccagttgaccttaatttctacatctaaaatacgaacatatgtacactattatataatagcagaactaggtctgtaaagctttaactaaaattgccgacattcttaaaggctgtttacaagaatttatgtgtagtctaatatggctgtagcctggaaattagtctagaaggtcctagaacacagtctcaagggacttgtatgtagagactcttcactatatactgaggcaaaaatcatagggtgtaccagtattataacatctagtagccagtagagaaacactacactctatagaaatctctgatttgacaacatataagaaatccttgacttcagatactcacgtggtctcctagtatgaagtcagccgacaggtagcgtcatatgagaagagagaaatccccagcatgctcaagctgctgctgagattgtgtgctaggaacaggctatccctccggtattcccctcagtcaaagcttgagccagcctctggatcgatgtgatctctatagcatgtttccatggggtgtacctatcactttaagccaatccgtgctgtatgcactgcttaaggttaaatagtaagccgtagaagattagcacatgtgcagatcctgttgctatctgatagcatctcttccgccacgtgtaagctagccacctggagggcgtgatgggatattatagcagctgatcgcacatctgaacaggggacccatatttaatctccctttgatctca

SEQ ID NO: 647705 - DNA, 643 bp, Homo sapiens
  misc_feature (72)..(72): n is a, c, g, or t
ggagaataagggtcagtcattagtatctgaattacataattgctgaaatacacaattattaccaatttgttncacattggaatgtgataacactgggatgctcattaaaggtcaaatgtaagggcctcaccaacaaaaacaggactggcctaagaacctgcattttagcacaaccccaagtgattcttactcagatgaaatcttgagatattgtctcatgtaattcaggtaagccaaataaataccttcctctctcagtagatttttggagaggggaaaaagatgtttttcccttcccttgtaagattctaaatataagatttaccatataacatataaataaataagaaataaatttatttttagatatatcactagaatgataatctaatcattcacttgataataattatagggaagcaaaatgccaccggttggcatattacatgttttgcacgtaatgctatttatttttcaagacacagtttttctcttagtgcttaaaaacaattgttttagctttattattaattaaaataagataaactagccaataactgtcagtattaacatgaagtatcaatataaattttattatagactaacatcctttaacttattttttattctacaaagtgatgcc

SEQ ID NO: 647706 - DNA, 115 bp, Homo sapiens
cggactctgaagtatgggcaataaataacaatgacatcattgacaaagcatggggaccactcctcgtagggaactgggcttttcctctccagccagagcacccagggcttcagag

SEQ ID NO: 647707 - DNA, 497 bp, Homo sapiens
cggagcattacccgggcaactcataacagcttctcctgggctgcccaagctgctcatcctggttctctggtaaaggccaaggcctgggacactgggcatcccccttcacttcctaagacatggctaactaaggactctagcatgtgacaaactctaccagggcccgaaagacagcacaggggcagaggttcttcctggatcatctttcttctaagcattagcctgttaactggtgcatcagaaccggcccgtgctctccgggaaggggatgtcccttccaacatcccctctccgggggcccaggctcctaccttaagtctcggggttggtcagcagaagccaaaatcagtcaccattaatatcagctcaaataaggtttaccggtgagtgactgaaaacccaaaataacagtagccttgaatgatctatggtatttcagtggtgtcagttgtaatatctccggtttggtatctaagtgaggtgattgggattttctc

SEQ ID NO: 647708 - DNA, 145 bp, Homo sapiens
ggtggggtaacaggtgggacctggctacccgttcgggctatttgtaggtcatgtacagaacatgatcaagggtgttacactggggcttccgttacatgatgaggtctgtgtatgctcactgccccatcaacgttgctcatccagg

SEQ ID NO: 647709 - DNA, 360 bp, Homo sapiens
ctcccaaagtgctgggatacaggtgtgagccatgcgcccggtggtaagtactcttatgtgaagtgtgctttagttttatgtaaaagtgtctatgtacatattatatcaaatgataaatatattacttcctgtgtatcgcatttaaaaagtaagagaaaataatttgagagagactagtagtgtaagtccagacaagaggtgcaggggcccaaataaggacagatgagatggacataaggtacagataacacatttcagaaaataaatgtgcaggacttgtcaatagataacaggtaagggaagaacgaagattaaggtgtaaaaagtaggggaaggagtggatgacacagatagggacgt

SEQ ID NO: 647710 - DNA, 925 bp, Homo sapiens
  misc_feature (925)..(925): n is a, c, g, or t
taccaggcttaattcactattatgtttctggtataaaaaccctatgtggtagccacagtgggagcctgagtccgctgcagggagactcgggggggggtctggacgagggggctcagtgaacctccgtgactagggagactgggtgaatacagtctccttccagaaggtcgggggctcaggtagctgtagggtctataaaagagggcactcaaagggggcctgggcgaagtctgcccagggtggcagtgcagccccgggctgagggtgtagcagctcactcgaataccagccatcagtgagcagcttctaaggcacaggtgcggaaacgagtgccaggtgccccggggtgtgccgggattgaggcgataccagcacagagccgcaggcggccgtgtcacctggcaggggacacgtgtggggctgtgccgatcttgtgttcccccaagtagccctctgggcacggggtgacgatggaaagcttgggccaggattgatggccccagggattggcgggtggccacctcctttggagcatttaacacccagaccgagtgtgggccatggtatgtccccgatagcaacaaatggccttgaacctgggtgcgctggccggaacgggtcggcttctggccgtgggcataaattcttcaaaacctaatccttgaaagaggcccccaggagcgacactcagggagcctcgagaatcctatatatgaggcggggaggaacggagatgagaatctccctcacgaggggacctgggaccttgccagttgctccctatggaaacaaagggggggccaacgtgtgggggagaacggggcattccacactcccgctaaatcacggcgggacatgcctacgcggagaaactcacggaagatcgtcgggccccggaccccggccccagtgtccggagaccccn

SEQ ID NO: 647711 - DNA, 338 bp, Homo sapiens
acacaaaaccggcccgggttaatactatttgcgggggcttcgtatgattatgcgttgattagtagtagttactggttgaacattgtttgttggtgtatattacagcgatggctattgaggagtatcctgaggcatgggggtcaggggttgaggtcttggtgagtgttttcgtggcgtcagcgatggaggtacgattggtactgtggctgaaagagtataatggggtgactggttgtggtcaactctaatagcgtagcaagctcgaataatttatcgaaggacgaccggtcaggctcgattccccgagcatcctacttccccggtgcattcctatctcc

SEQ ID NO: 647712 - DNA, 1778 bp, Homo sapiens
  misc_feature (226)..(226): n is a, c, g, or t
  misc_feature (348)..(348): n is a, c, g, or t
  misc_feature (396)..(396): n is a, c, g, or t
  misc_feature (417)..(417): n is a, c, g, or t
  misc_feature (601)..(601): n is a, c, g, or t
gggtatagcatcgggtcaagccttacctcgcatctgttgtcaggtctatggaagatacgcacgaggcccctatcgctgatagggagttgccactggagacgcgcgtggaggcacgctgacgggagttctaaaggaacagagccgtgcattggtgcaggagtccatgctgaatctcagagataggcccgctgagcagcaatggccagtactactggtcctcagaatnacctgcacctgggtaccctctgatgaggtccttgcggctgtctggggacttcgcaccaggatccgcaggctagctccccgagagagattggagtgggacctgttcattgtgtgtagaggctnatggaggatcttctggaggacgtgacggcgtagaaggctgctcttatngtgcgaactccatggaacctngtagaactgggaacgcactctgcggcatatagcacgcgctgatcattggccacactacatgcgaggggaagctggctcacgcgaggcgggcacaccacaggcaaggtggctcactgcgcggcgcaaattttgcctgaaaaacggcgtgatggtcacggacaccgggatggaatctcggcgcgtncccactgagggcgttacccgactcccacacaggtagagccagagatctagactagggcagtcctggtttgcgctcgcatggaaagccggcaagatgtaccttgcggggctggctgcgtagtccagcgtcgtggcgttcacttctccacgtggcgcccccgtcgatcgtcgtttcgcgagccctgttcgcgggccaagggacttaggttgccgactgtagagcaaaggcctaggggtagggtttacctgaaacttaaagaattcggggcggcctcgcccgtccccgaagtgctaggtcccgaagcgcggctgaaaacacttggccgtgttcagtcaatgagcgggtcaccttcgacagtccccagaagtttgccgattagggcactatgtggcagtgtccctggagtgcttgaaatctcggagctagaggctaggcaaccacatttcctaggccttttctgcaggccacagcttgttacccttgtaaacacttttggtaggcctttgccacaatctatcggaaagaacgctccgtgggagagtcaccccgaacagaatccacaccatacgctaaaggaaacgttacctgtcagcagagaaagtttggccccatccttggagcgaccttagcacagcggttgcgaaaatgacggggagagacccactaagcgtgtaaccaggatgtggcgatcccgtagaaattcccgagagagagaacttaggggagccccagagagggcatatacaacccgtggagacactgggacccagccgcgcgactcgctggcatatacaggcagggacaggcagagaagtcggaacccagtagattgaagacatcatacgtggtccccagcacagaggacagggagagccacaagggcagccctaccagaaaggggcgatcaccacagaggccacagttaattgcagaagagaaccagcgcgggacaggcaccacagagtactgcagaaacggcagcgagcatacgccagacaagggtaggtacgaaaacgcagggacaacgtacgagaaaggtaggactgagcgacacacacccgccagaggctgacgcatgccgcactagtgggcagccagaacaacaggacatctcatacagagtacggtacgaaaagcagcgtagcgacgaccgcacgccacagaccagcagacacga

SEQ ID NO: 647713 - DNA, 847 bp, Homo sapiens
  misc_feature (81)..(81): n is a, c, g, or t
  misc_feature (90)..(90): n is a, c, g, or t
  misc_feature (120)..(120): n is a, c, g, or t
  misc_feature (171)..(172): n is a, c, g, or t
  misc_feature (174)..(175): n is a, c, g, or t
  misc_feature (179)..(179): n is a, c, g, or t
  misc_feature (185)..(185): n is a, c, g, or t
  misc_feature (189)..(189): n is a, c, g, or t
  misc_feature (229)..(230): n is a, c, g, or t
  misc_feature (232)..(232): n is a, c, g, or t
  misc_feature (249)..(249): n is a, c, g, or t
  misc_feature (257)..(257): n is a, c, g, or t
  misc_feature (259)..(259): n is a, c, g, or t
  misc_feature (269)..(269): n is a, c, g, or t
  misc_feature (279)..(279): n is a, c, g, or t
  misc_feature (282)..(282): n is a, c, g, or t
  misc_feature (318)..(319): n is a, c, g, or t
  misc_feature (324)..(324): n is a, c, g, or t
  misc_feature (338)..(338): n is a, c, g, or t
  misc_feature (348)..(348): n is a, c, g, or t
  misc_feature (359)..(359): n is a, c, g, or t
  misc_feature (379)..(379): n is a, c, g, or t
  misc_feature (399)..(399): n is a, c, g, or t
  misc_feature (406)..(406): n is a, c, g, or t
  misc_feature (422)..(422): n is a, c, g, or t
  misc_feature (431)..(431): n is a, c, g, or t
  misc_feature (449)..(449): n is a, c, g, or t
  misc_feature (453)..(453): n is a, c, g, or t
  misc_feature (484)..(484): n is a, c, g, or t
  misc_feature (487)..(487): n is a, c, g, or t
  misc_feature (501)..(501): n is a, c, g, or t
  misc_feature (505)..(505): n is a, c, g, or t
  misc_feature (722)..(722): n is a, c, g, or t
tgcgggcccaggtggccggcgcgcccgttgggcactgggggacgcgggcgcgtcaggtgaagactgggggccgcacgcgcnaggagaacnatgccatttttgggtcaggactggagatcncctggatggagttggattaagacagaagatggctggaagagatgtgcatcnngnngtcngaaacntganagagagaataaccgttgtaacatcagtcacagcattatcnnanatagtgaagatggaganatattccntnatgaagagcntgaatatgcntcnaaaaacaggaaaaaggacccttttagaaatgacacnnatacnccccaggcctggcnattgcccccngggagaagccnttaatcggttagacttctcnagtgccattccagatatccnaagttcnattatgtggtccaacngttgccgcnaattgccaaatccccgtnaacntccttgagtggcgtggcacagaagaattacntcnaccttttggataanctcnttccacaggttcttgatgaccaccaccctcctcgcttaatcaaagatcttctgcaagacctaagctctaccctctgcattcttattagaggagtagggaagtctgtattagtgggaaacatcaatatttggatttgccgattagaaactattctcgcctggcaacaacagctacaggatcttcagatgactaagcaagtgaacaatggcctcacccncagtgaccttcctctgcacatgctgaacaacatcctataccggttctcagacggatgggacatcatcaccttaggccaggtgacccccacgttgtatatgcttagtgaagacagacagctgtgga

SEQ ID NO: 647714 - DNA, 421 bp, Homo sapiens
  misc_feature (37)..(37): n is a, c, g, or t
  misc_feature (41)..(41): n is a, c, g, or t
  misc_feature (109)..(109): n is a, c, g, or t
ctacataaaatatctggctgtgaaacaaaccaggagnaggnccacggggcgttatccaagcagctctgcagaagctccgtggaatcggataccgatttcagacagatcnatcctgcgttcgtctctttcctctcttctctttcttcaagaaaaaaaagttgatcctaatgatttcagcccatgcattaaacagaaaacaataataactgtagaattcatatttttctaaagggaacttaaaaactgctgctacatgtatgtacaaaactggtctctgctacatgaacagaatcacaggtttggttttggtacttttgtttctctttgtactcagttgtgtagaacttccaaattcagagtgaaaagaaagctgttctgcatcaaaccatctaagcaataaatgttatatttaaaaaacgga

SEQ ID NO: 647715 - DNA, 324 bp, Homo sapiens
cccccccttttttttttttaaagggggggcccggggccccggggttttaaaaatttttcacccgggcccccgggggggaaaaaatggggccccccctgggagcccccccttgtttgggggcccccttttccccaatggggcccgggggccccccctttttgggggggggaaaaaaaccccccccgccggttttccctgggggggcccccaaatttttccttttggggtttccccggttttttttacccccggggggcccccggtttccccccctttgggggggggggccccccccttttttttccctttaaatttcctttttga

SEQ ID NO: 647716 - DNA, 731 bp, Homo sapiens
gagtgtggggaagcttttaggactagccgacaacttactggtacatcatagatttcattatggatgagaaagcctacgaatgtaaggagatgtggcaagggctttagtgtgtatggacgacttagtcgacaatcagagtattcacgactggtgagaagccctttgaatgtcacaaatgtgggaagtcctttaggctcgaaagcaggccttaaagtacatcagagtattcatactggagagaagccgacgatgacatgtacaggaatgtgtgataatggcctttcgtcagttttcccaccttgtgggtcataaacagaattcatactgcagaaaaaccctatgaatgcacacggaatgcgggaagggcttcacatgtaggtatcaacttaccatgcactcgagagaatgtattcaggggagaaacactatgaatgtaccgcaacatggggaggcccctagtagtggccatcaacttactgcacctcgatacattttgacagtgttgagaaagcttataagtgtgacgaacgtgggaaagcctttagttgcgcatggacgacttactcgacctcagggtattcatagtggcacagacacccctatggaatgtaccaacatgtgccacagtcctacagcgctcaacttcattcccttcaagatagcagtccaagactattcataccggtgtcaacaccttacaatgtcacgcgcccgtgcggcacaggcctcca

SEQ ID NO: 647717 - DNA, 122 bp, Homo sapiens
ctaccgtgtacaagagatgataaagtaaatgcacgaatacaaatggagatttccaaggaacaggagctggaaataaaatataaggacattatgagaactgaaattgtcccatgcgaagttct

SEQ ID NO: 647718 - DNA, 854 bp, Homo sapiens
aaacttaaaaagcgtaaaatctcctcccacaattaaccagtgtcccctcgtaactctttttccccgatcggtcccagttactctctgggtcccagttggggtccccacaccccccaccaagcgggctaaaccttgaagcgtagggtccggcaaaaattataacggcctgaatgttcccttctaaagacgcctcttgttatcctcccgcctatgcccccgccgtttcttgtttcaaccaatttgcgcgcttaatccctccataataatcttgtcccgccctattattagcccccctctgaatttcaaggggggctataccgctgcgccacataactaactttaaagggggcaccttccattaactcccagacgcataggattggttcaaaatcccgtgcccctcccccgggtttcttctttgttatcgggtacaaaacacacaacggggttatcttctattagctccccaagactctggggtcgagaccacattttgccgcctcccccactggtgacaaggcagcattcatcgggttcccacgtgaagatgtgcccccgtcttctgacttggggaacacccgtctcctcccgagccttttgaatcggagtgtccccccccacattgttatggcaccaaacagggcgaccctagcctatgatgaaagtggcactctgaacgaagagtctgtgtgcttgcggcttctatgggtcaaggctgtctttgttgtcaccaacaggggccggcagtgttctgctcttcaaattggagaccgacgctgcgttgttgaatataatatcagcccaaagtggggccccaaaaatatactaagagacaactttacggccacataaca

SEQ ID NO: 647719 - DNA, 805 bp, Homo sapiens
  misc_feature (16)..(17): n is a, c, g, or t
  misc_feature (71)..(71): n is a, c, g, or t
  misc_feature (770)..(770): n is a, c, g, or t
  misc_feature (776)..(776): n is a, c, g, or t
  misc_feature (781)..(781): n is a, c, g, or t
  misc_feature (793)..(793): n is a, c, g, or t
  misc_feature (795)..(795): n is a, c, g, or t
  misc_feature (797)..(797): n is a, c, g, or t
ttctctgggtttaccnncccccggggtttgggatatgtctgacccacgccgctcgcccacgctgtcggacngccatgttggggtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaacagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaacttgggcttttggtggtgctggagttggcaagactgtactgatcatggagtcaatcaacaatgtcgccaagcccatggtggttactctggngtagcnggagntggtgagaggcncngngaagggca

SEQ ID NO: 647720 - DNA, 283 bp, Homo sapiens
ccgcgacagagtgccagtcagcgtggtcgagccttcggtgagaatacgtacatacactttcgaaccctggggcggccttggcgatgttgcgcaggtcggcttcggagtcggtggagagcaggcgcacgcccttctcgtagaagtagcggatgtccttggatttcttgatggtgttgccgtagctgatacggtcagggctgacgccgcggtccatgaccttgtccagctcgtagatcgacgcgatgtcgaagctcgaacccttgtctttgagcaggtcgatgat

SEQ ID NO: 647721 - DNA, 1114 bp, Homo sapiens
  misc_feature (16)..(17): n is a, c, g, or t
  misc_feature (71)..(71): n is a, c, g, or t
  misc_feature (1114)..(1114): n is a, c, g, or t
ttctctgggtttaccnncccccggggtttgggatatgtctgacccacgccgctcgcccacgctgtcggacngccatgttggggtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccagccataacatgcatgacataattcatatgcataaactgcagatgagagaaaacaaccgaaatgtaaaaaaaaaatctaaccatccaattgtggcaatgaaagcccctgtgacagtgtatatgcaggcatgttgtatgtagcctagtacttagtgaattgataagtagaaaagcctcgagtcgatgaataattgtgagatgatcttccgagttagaagataagcaattggaccaaacaaatttataatatgattcatatatagcaaatcaaaatatgaaatgaaagagagcacatagagacagattgcaaattgagatgtcaaaaatgaaattcaacccaatcggcacgtggtagacccagaatgaaaagagcctcaaaaacagatgcaaaaaagactgttgccaaatatagctggaatagcgcaaatgacggggttaggaataaacactcccctaacaaaaataaaaaatgatattctaaaattataacccccaatagctaaatactaatccctagacacctaaaaaaaatatctacccccaaatatttcaacgaatccgaaaaaatatgcacccatacactgtacaccacttaaaatccaagttaaaaatataatttagacttcctcaactaacatcacaacttaaagaggaattactaaatataattacctagtttgagagaatattacttaagtaccgaaacaaaaatatcgaccccctaaatgaaaccccaaatataaagtaattatctcaactcataaaaaagaatcctatagacttaaagatcaaattttaaacgtacagaaatatataaaacctctcacaacaaaaagaacctatatttaccacaattgactcgn

SEQ ID NO: 647722 - DNA, 210 bp, Homo sapiens
ttagcggctggtagatgtgctaccgccggttcccattaatgtcattcaggagcttttggtgtcctagaggattacacctcatctcctctgcacggttcaaggtcttttcaagctctcggaacatcccttcagtcattctgagctccttgctattctcttcctttattccaacatcaactctagtacataggacttggcacaatgtacctg

SEQ ID NO: 647723 - DNA, 297 bp, Homo sapiens
ggggggaaaaaaacgggggggaaaaattaccccccccgggggggggggcccccttttcccctttggacccccccggaaccccttttttttggggggggctttgggggggtaaacccccccccgggggggggggggggtcacaatttttggggaaccccccccttttttttttgggaaagggggaaagggggccctttccccccctttccttttttggtggggggccccccccttttggggggccctttggtcttggggttttcccccccccaaaaaaagggaaagggggggggccca

SEQ ID NO: 647724 - DNA, 810 bp, Homo sapiens
accaaggcaatgtaacttttgattttcggtcaatttaagttctttgtcaccaaatattaataaacagttttgacttcaaaaaaaaaaaaaaaaaaaaaaaaaaaaaaaaaaaaaaaaaaaaacacaaaaaaaaaaaaaaaaaaacaacaaaaaaaacaatttgggcggccgcgccgccgcccccacagaaatgccttccaaacacaacattcggggggcgccgcgggccccaagggtgaagaacacgatggacaaccgtgtgccacaagacatcgctgggcaaaagacacgggcggcggtgaccccccacaaaaaaccccgcggcgggagccaccgacttgtgacgaccccccacaggcagggtgtcgccaagatctcgggggggtatcaacacagcgggtccccaccgacgcttcataaaaaaatacccccgcccgtcgggatgacatcactccagaacgacacacacaccacaaccacaacactacacagccaagcaatcacaccacacaccaaccaataacattctcacaccatttctaaataccactgctatccacgcaactcactctacataccacaaccagccactactcaacacaaacatcaacacatctccttcatacaacatacacaaacatataataacgataaatatactactcaacactactcatcatcaccacatatcaacaagcaaacacacacatacttcaccccacaatatttgcctcgatatatactatattacaaattcacagacatagtcatactataatcaaaaataaccactatattccacaaataacc

SEQ ID NO: 647725 - DNA, 435 bp, Homo sapiens
  misc_feature (47)..(47): n is a, c, g, or t
acagctcgaaagattttaactttactgcaaggggtccatcagggtgntgggtttcaggacattccaaaaaggtgtttgtttttaatagaagacccaagaaatgatttaaatatcttatcaacagaaaaccagttctatcaactatgggcccagtatgcagcttttaaaaatgccagttctatatacattgatatgagcccatttcaaacaggtattcaataaagtatagaatggtaacatatccccaactgtgtaaagaaaaatatataaacatatgtttgcataggcacagaatgtatcatttcatatgatacattaaaaacaaaagaacatatagtgcctgtctttgaggggaactgtgaagctatggaaaggtgttgaagaaaccctttttatagtatgtatttttgtaattgaataaaaaataaaattcca

SEQ ID NO: 647726 - DNA, 183 bp, Homo sapiens
tagaggatcccactgcttatacatttactgggtctctattacctcctacagctcagagtattcgagtctccttcacattcccgagggatctacggtcacattttttgtagccacaggtgtccacggacgttcacgtcatttatttgggtcaactttccctcactatctagcttccggtcgaac

SEQ ID NO: 647727 - DNA, 108 bp, Homo sapiens
  misc_feature (68)..(69): n is a, c, g, or t
gggagtacaagttcaaggtctcaacagaggcctccgtcctcatcgaggaaaccattttcaaaggcatnnggcaggccccagggccacaagtttacaaccttgccccat

SEQ ID NO: 647728 - DNA, 101 bp, Homo sapiens
  misc_feature (34)..(34): n is a, c, g, or t
ctgtccgattacgctctagacgggcaggatgatncatttgagcccagagtcaagggttacagtgagggtaataatgacttgtggtgatagtagatatcggg

SEQ ID NO: 647729 - DNA, 111 bp, Homo sapiens
  misc_feature (6)..(6): n is a, c, g, or t
ccccangaatagcggagacgctgcgtgacgaggtcttcaaggagtggctcagcctcaacgtgatgcggcagcggcccgggctcagcacgaccagcaatctcccgcgctggg

SEQ ID NO: 647730 - DNA, 558 bp, Homo sapiens
  misc_feature (24)..(24): n is a, c, g, or t
  misc_feature (28)..(28): n is a, c, g, or t
  misc_feature (49)..(49): n is a, c, g, or t
  misc_feature (68)..(68): n is a, c, g, or t
  misc_feature (219)..(219): n is a, c, g, or t
  misc_feature (264)..(264): n is a, c, g, or t
  misc_feature (342)..(342): n is a, c, g, or t
  misc_feature (355)..(355): n is a, c, g, or t
  misc_feature (391)..(391): n is a, c, g, or t
  misc_feature (398)..(398): n is a, c, g, or t
  misc_feature (427)..(427): n is a, c, g, or t
  misc_feature (456)..(456): n is a, c, g, or t
  misc_feature (493)..(493): n is a, c, g, or t
  misc_feature (516)..(516): n is a, c, g, or t
  misc_feature (547)..(547): n is a, c, g, or t
gtcacgcatcgtctggtagtccangttnttacgatccaccaggggacancaccttgtcgatcacgcanagaccgcatgccaattgcgccaccttgaaactcgtcagcgttttgccgctgccgtggtgtgccaaatatagccacctgccgccaccgtacccaactgctgctgatgtgtggcagtgacaatgcgttgcaaaatgcgctcagcagcacagantctgataaggcctgcatcacccaacaacttacgattggcacttanaacaccgcagtatttggtcagcacgttgatgcagcgaactgcttggctgaatatacgttttgcgctaaaactagtcanactcggtgatcgngctgactttttcgcatctgcccaccaaatggctaancgagaanactgcttggacgctcttacctccttactngcgcttgttggattgctccttccacatgnccccggcgccgcatctgttatttaccgtcacattacntggctcatacttgcccatttgcngatccgcacaaaatagctggcactataaatnccgtaactaac

SEQ ID NO: 647731 - DNA, 1574 bp, Homo sapiens
  misc_feature (1013)..(1013): n is a, c, g, or t
tctgaacagagaggaagattaagtagtaacttgtgtgtgaaaaagtaaaagtttttaataagtagataatagtgaacgagaaatattttgctccttgggggggataatcttttgtgggtggccttgtttttaccatcacaaagattcgcaccacaaatgatgcgtggggtcctctatatccatcagataaagctttgttttgtgtgcctccctacttgtgggtgtaagtgcaggatatttccttctttgtcctcgagcagccacccaccgttgtgtatttggggacgccttgtagttccttcacccctcagggggtggagagcccctctagcactctatagccgcgctgattatttcgtccccgaagaccccccacgataatgtcccccgcttttgtggggattgcgtcaatccctcccccgaggtgttccttgtttcaacaataagccgctcctccccaaggagacatcgtgtgtcctgggggccctcccatagcctgctaagacgattttcctcaaggaaaagaggcgcccccctcaatttagtccggtggtcaacgacgccttgctctccttcgccccaccgaggggacaccacacgagggggacaccacacgccctgctacaccaacgacacctgggggaggcttcctcatccttcgttaaaagacggataagactcggcgcagagatccagcaacacaacaccacaacggcccggctacctcaaccacgatcggcgggaaaggagtgtgcttctcctggtgatgaggagggaagcatccgcggcgcttctggagccacccggcgcgcttgataagcgccacgcgtgctctcgcggcgcacacgcgggtcttttgtgccccccacgtgtgtgtccgctcccgcgcttttattaacgccacccacgcgtctcttgggtgtccacgcgcctctcccgctatagagatcgctgtagcacacgcgcacacacactcgtttgttctcgccacacacccgctggggtctcccgcngggtgatagctcccacactcgggagatctcgagcgcacacttctgagagtgaggctctcacgcttataggtctcacagagatctcggagatatagtttccggctctctctctcggctgtatatctctcgctttatagctctcgctcggtgagagattttatagccacaggagaagcctcgtggagagagaccacgcggtttcggtcttttctatagcacatgagacagacacacagagagccctcacactcctcacagagatggcacacacatcgagagctcggcgcggagattgagaagagagtagctcgtttttcgtaactgggagaaagggagtttttcacgcccttcacgaattcgcttccaccctctgcacgcttctcccctttctctgtaattcctagaaactgagacacacacagctgaacactcaccacgcttaatttcctcactttttataaagtcccttcaccaaccccgtgttttaggagcatgagtgccgctgtgtgtgcgtcctcgtcggaagcccgtctcctctctctgtaataaactcatttctag

SEQ ID NO: 647732 - DNA, 107 bp, Homo sapiens
ccggctgtgcttgtaggccagcgaagattatggcgacactcttgccgccatccaggacttacctgaagaaacatgaagctttagagacagacttcaccgtccacaag

SEQ ID NO: 647733 - DNA, 604 bp, Homo sapiens
tttttgggcccccaagcgggcccccttaagagcaaaattatttatgccagctccagggcgccctccagaagaagctgccagggatccagcatttattgcaagccaattgtttcgaggggtgcaaggacccctgccccctggcaaaaaaaattgggggcagtgccgttatttccctggagggcaagcctttgttagccccttttggccccctgcctggaggatttggcagccccccccctggccttggggggtgcagggtgcccccttccttccaaaccggagggggtgggggggttcccacaaggggagggcaatccctttccccccgttgccaaacaaacccccccccccctgggttttccttttccccccctcccctggggggtttggccttccccaaatggttttggtttttttattccttttggggtgaaacagacccagttcccccccggcccccccgttgtgggggggcctgtttttttttttaccacatcccccttccccccctgggcccccccccttccctggtgcccactttttacccccataggggctttggggttgtttgttttgttttggggttaaatggaatgttgtggga

SEQ ID NO: 647734 - DNA, 266 bp, Homo sapiens
  misc_feature (79)..(79): n is a, c, g, or t
  misc_feature (185)..(185): n is a, c, g, or t
aaacaaaattattctctgagagggaaaggacatttgagggaaacatcaaatttccccataaataaatgaatggagtttncaggaaggtgaggatgagcagagatgtgtgtggacatctctgcaccatccatcgctgtatcaaatggattgattctaatccatgcggcatcaggcatcaccacganccaggtacagtcatggcagcagccctatgtcacgccccagtaactagcctgaccctcactagctctgactagggtgtattc

SEQ ID NO: 647735 - DNA, 238 bp, Homo sapiens
gcggccgcctactactactactgctcggattcaagcttctaacgatgtacggggacatggtgaaaccccatctaatctaaaaatagccaggcgtggtggcaggcacctgtagtcccagctacttgggaggctgaggcaaaagaatggtttgaatccaggaggcagaggttagagtgagccgagatcacgccactgtactccagcctgggtgacagagctaatactccatctcaaaaaa

SEQ ID NO: 647736 - DNA, 590 bp, Homo sapiens
  misc_feature (269)..(269): n is a, c, g, or t
acccctcttcggtctatgttattctcctccccgtcgcccctattctctggcgtcggcggtggtgttgtattacatacgcggctgcgccgccggccccgctcgacagtaagattcttgtgttgctctttagtatgatccgcgccgctcccctccctactttatatatgggcgcgcggccatatgtctttctctcgccccactcctgctcgcgctctatctccgcgcgccgcccgccccgcggtctgcctctgttgtgtcgggcgagaggnctacgcggcgccgcaacgatgctggttttgtgccgcagcccccgcttgcttacgcaagtgtttcctctctcgtcgtcggcggtcccgcgaagaattatgctccgccgggtattgctccccacctatccgccgccgggagcacacctgggtgttcctcaccccaggggctgccctcctttcgcccgcggcgctccccccccacgttgttttctcgcccccggggggtttgggagttttggcggccccccccccccctgtgggtaccccccccggcggccgcttgttcctcaaaacacacaaggggtggtgtgtaaaaacaca

SEQ ID NO: 647737 - DNA, 115 bp, Homo sapiens
tcatcgaaacccttacccctcctgtgtatctgagaccaggctcttcccatcaatattccttgtagtctgctgtctcacccgtatctctgtcaattgagatacggtcattatatac

SEQ ID NO: 647738 - DNA, 351 bp, Homo sapiens
aggggttttaatttttttttcccccggtgccccctggggaaaaaggggctttttgggggggggtggggttttaaagggttcggttaaaacctcacccctttttaaccgggggggggtttcttggattgcgccaaaaaaccgggttctttaaatttggggggccgggggcctgggccttttctttgttttccctggttcccgggcccccgggccccctttgccccccctggttggccggggtaaggtcccccctttcccccgggtaccaccttttttgccggttctttttgggaggggtttcccggggcccgggttttgggggcccccccttaattaaattccgcccttttt

SEQ ID NO: 647739 - DNA, 162 bp, Homo sapiens
aggtctccagtgggtgcacagctggagtctgtcgctgacctactgagacagcacagccaacctagctagcaacatttgttttagtctgaccaatatatactatataagaattcagtcaatgataccacaatcttgaaacagcttcaatggggtggactctaa

SEQ ID NO: 647740 - DNA, 196 bp, Homo sapiens
  misc_feature (153)..(153): n is a, c, g, or t
ggctgattagaggatcccccagtgcgcttgttggaggtgtcagccagaagaagatgcaccgaatgcacccagtggccactttctgcgaatgcagcttgagaacgtgtcggtggcgctcgagtacctgggacgcgagagcatcaaactggtgtncatcgacagcaagggcatcggtggacgggaaccttgaagctga

SEQ ID NO: 647741 - DNA, 261 bp, Homo sapiens
atagtaggtgtacaagatagaatcgttagttccactactaacttcgcccacagcaaccgtctagagtaccctagtagaatttaactgctagtccacacagaggaacagctcttcggaccctaggaaaaaactatgtagagagagtaaaaaatataacatccatagtaggcctaaacagcagacaccaattaagaaagcgttcaagctcaacatccaatacctaaaaaatcccaaacatataactgaactcctcaacacaag

SEQ ID NO: 647742 - DNA, 931 bp, Homo sapiens
tatccattttttctctttatacttgcatagtatgctatgtgtttctcattgtaaaaggctgccgctgggtggcagaagccaagagaccttattaactaggctatatttttcttaacttgatctgaaatccacaattagaccacaatgcacctttggttgtatccataaaggatgctagccctgccttggtacttaatggtctcaactactatcaaaaaacaaacacacatatctatcaacccatttcactactatatcccactactcaaggtatccatggaagcatgacacagaataacatttatgcagcaggaaaacaccaaaacatccctgaaaatatacacacctcatacaccacacacgcacaggggaactaacatacagaaacatcattttcctcaccatagacttgatcccaatccttacaacccatccttctaacctccgatgtgctatactacatactgccacacatttcaccaaactgttcttcggtcatttcaaacatacttcagtatcatcaatatcagtagataccagtgggctggcaccagggtcaccaccttgacaccctctgaccgcaactagccatactcacagcccttccaaccctgccaaatattgccttcagtcaccccagtgcacaccaggtgaactcttcaaatgcgtgaacgcactaccagttacagctaaacgtacccagcacagacagccttgggctaatatattagcacagctccctgacccatcagctgccatcctagcacccttccaccagaaaccatggacatccccttcacacactggactgccgcgctcatttcctggtcccccacatactggacttcctcctccacgctgctctcctcacgatccgcaccacgcatcatctggcgcaaccctcttcccacactgctcccaccacccacac

SEQ ID NO: 647743 - DNA, 682 bp, Homo sapiens
tgccgccccccgcagaagcgcggccacccttagcaccggagcctcaaccagcagcttcggcttgttctctcgtgaggttaaacagcagctacctgctatacatggcaagatggctggttatactctgggaactattctgggtgggtgaggtgggcagtggaaccatgacgggcccctatccactcactgtcctcactcggggcaggggaacagcctcgtcacaagcaaaaggccagagtcacagtggtgggtagaacaatggtccttgccccgctcttgggaactcactccataggggcagtgcttggcagttccagacctggggaaagtggtagcgtcctgtctgggggcagattcccaagcaagagtgacccatggttaagggtctctggaaacatggagagagcttgggatcctttcctcctggggcctatggtgttgattgcagactggaggggtaacctcctctgaaggtctttatgtgccaggcatggtattgggtactttctgcattgggaccaggcagccgggcctgccatttgaggcaacgagcctccatgacctgtcctccctcatttgtaatagtggggtcacagctatgtccccggccagttgttggcattaaagtggtccttttagtgcccagccaaaattctcaattaagccattcagtgagaacaaa

SEQ ID NO: 647744 - DNA, 153 bp, Homo sapiens
agtcttacctatcgagtacacgtcatgcaattggtacagctaccttttaggtacactgctttgacactctaaggataggaattacagaagcggcattataggctgtgcacggcattattgatttgttgacggatcgttcgtgacaaatattga

SEQ ID NO: 647745 - DNA, 181 bp, Homo sapiens
agccagtgaaaagactcggccaaatgtcccaccgtgcctcaataccccactcttgctaagccaccaaaagggcctacagcccatcgtaaacaagctctgctcatgcagctcttcttacgaccaacacactctccactataacaccccatatcctccctggttaaaacagtctgactggctc

SEQ ID NO: 647746 - DNA, 757 bp, Homo sapiens
cccacgcgtcgccgagcctgagcctgagagaagagacctgggaaattaatatttcttgcgagaggtacagtgtgtgggattgcaggctgcatgatgcaggggattcatggaaaggcattgctgtacctgagcccccagcatggctgggcctaaagcaggcgtggcaagccaggtgtgtgccatgaagagcatggtgagcaggaacatgggctgtacagcctgcaccgcatgtttgagatcgtgggcactcactctgacacacagagatgtgcgcgatgccttacattatccatctatgctctgagtgtcacttgcatgaccacgacgctctggcactcgatccgacaactggacagtgacatatcttagtatggcactgtgacgcgcccagggccagcatggtgatagaaacgtacactcttctgccaggatgactagcatgcttgctgcagcatcaatcactcgaccaagacacgtgctgccctacgtcaacccgtcaagaggagacgaggctgtgtgcactgatcttgatagacaagtatctggaggagaccatcaatgtcgatatgtgaccccacagaagccctcatgtgataccagacaccaaggcctcacacagcccctctaagaacaagtgcatcaccacactataacatgatgagcgtggtgggccaagtacgggcgtcctcagcactgtgttagaatgcggccagaccgagtggaaaagagaaaaatggaaagccaggcacacgccgac

SEQ ID NO: 647747 - DNA, 342 bp, Homo sapiens
acgattcagatccaaattattcatttgacctgttaggacggagaaacccttcaatattagcttaagaaattgagtaattttgggccgggtgcagtgactcacgcctgttatcccagcactttgggaggacgaggcgggcggatcacgaggtcaggagatttgagaccatcctggctaacacggtgaaaccctgtctctacaaaaatacaaaaattagctgggcgtggtggcgggtacctgtgatcccagctgctcaggaggccgaggcagagaattgggtgaacccgggaggtggaagttgcaagtgagccgagattgcgccactggccttcagccctgggc

SEQ ID NO: 647748 - DNA, 891 bp, Homo sapiens
actccattataatacagtatgtaatctactgttttgaacggtttgttcagcattggctatttaaaaaaatatttataaagagattatttctttcagttctggaggcaggaaagtccaaggttgaggggttcacatctggtgagggccttcttgctgtgtcatcccatggcagaaggtggaaagtaaaaaactggaaacaaccaaatgtccatcgatggatgaatgaataaatatctatgagatggaatactacttagcaatgaaaaagaatgaagtatggacacatgcagcaacatggatgaatctcaaaatgattaagatggattcttgctctgtcgcccaggctggagtgcagtggcgctatcttggcccactgcaacctccatctttgggggtaaagcgattctcctgcctcagcctcccgagtagctgggactacaaggcgcacactgccgtgcctggctaatttttgtgttcagtagagatggggtttcaccgtgttgcccaggttagtgttgaactcctgagctcagacaatccgtgtgcctcggctcccaaagtgtctgggattacaggcatgagcaccgcaccggcccggatctgcatttcacaagtcttctgatggtcctctgctctggggtcgagaagtcttgttctatggtctctgaagtgtttgaccattcgattcaaccatcctttggtctttgttaggtctttcttaaggcccggctaagggtgcagtccctcttctgggggtcccctttcgcggtgtcggcgcggggttcacactctggccgcttccacacgtgggtgtgcacaccaccctaatggcgcgggagcgcgcgggctcgacggcgggccctctgcgctctcgcggcggggtgtgtgttg

SEQ ID NO: 647749 - DNA, 1051 bp, Homo sapiens
gctcgaccagtcaggccagtcttggtatcctgtcgtgtggagggatctgattgttgttacattgcacctgtcgtccacgcgtgggaggactgcgagccatcgttccaagtgagaaatgatgctagaggccggttttgaggagtcgaggtgactgacttgggttagagatgcagtctatctccatgcatgctccgaggagacctgttcgaagaacccatgcttctgagtgaagcactagactctaggatacgcagatatgctccatgcgagagcaaagaagagcaggcagggtacgctgagatgagctccctaagggtttgcgtcgattaccagattgccagcttaacatgctgatatggagctctatattgaggtgatgcgacgatcccgctatgtactgctattgtgtgaacgcactgcattgttggctctagccgcatgtcctggaggcttgtgcgggtggcacttcgaatccctgcagactacagatgtgtcctccattttaatcctacactctgtacgaccctgcggcgagctgacatgtcgagttccctcaattggtgccccgtcatggagtactctcttcataggagagcctcgtaccctcgaatgaggctgcttggaatgcgcgagaaggcagccaagctttacgtcccccccggactggtttagttccaaaaaaatgcacgctgccgtacaggattgcgtcagggcagaactaaagcgccctttgtcctgtgcggctaccgcgctttcagtctacgtgtcgcatgtggaaagttaaccgtcagtatcaagtctgttcccagacttgaagcgtcatatactggctctgcaatcggttagatgctgcaggctggcacgagcagttgggtacgatgaacggcagtgaactctcttgcccgttctcccactggggggaaccgagccaaactccgttttaggtgcctggaacgaactctctgaagggccaggtatgaccgtagcattgacaaaaaggccccggggggggcccacaaagttgcagcgggtaacgagactctccctttga

SEQ ID NO: 647750 - DNA, 841 bp, Homo sapiens
gggcgagattcccccgccgccccggaagactttccccgtgcctccacctcccctatgctggggatggcgacgatgcagagaggtgcttctagggaggtgccttccacgacggcaagccttcccggcgaagccgaggtgaatcataatccaccacatgcagactacgtggtagtcgaggagcatctatccgctataacagaacagtgacgcacgcggaggacgagggacgcgggctgagaggtactcccacatgaccagcgcgcccggccgcagaggcgccagcgggagcaaggcgtgaagccagggaactgcggagaggggaagaatcagaccactgcaggccacgtccgcctgcttgcggatgagaatgaagccccaacatgacgcccattaacaagacggcacccgcgcaagaagcttcgagtacgtagcgagcagcgtgccatgtcccgcacaagccacaaggcatgggcaccaaaatcccaaacacgggcatgacagagcacagagacacaccaacgacacaccccaagcgcactattgccaagaccgccggggggatccagacaccagagcgacccacccgcagatgaaagacgctacgcgccgcggcggaccgaggcaagccgacgctagtcccacagggccattcccaccaagacggcaatgagagaccgcacccaaaaagcgcgataagcacgggagggctatcccaggggacgatacccaggaaagacaccagagcgcaggccactaaagccatgggcccagctggggaatacacagggcgcccgaccaaaagaggggacggcaccacgaagcgaccccagccacgcaccag

SEQ ID NO: 647751 - DNA, 849 bp, Homo sapiens
caccgatttcatcctgtcttcatgattcagaatgctggaatgttaactgggattcaacagtccattctactcattacctgtatgcaggagaaatcgaatggagtaatagaaaaatggaagatggtgtcgttaataaaggcatttaattagataaaaacatctcctaataaaggatttgaagctgatcctattatagttagaaagataatttcgctttcaaacgtgaggtccgaagaaaactaagttatggcatcagtctgtgaaatagtaccattattgtgttaaaatgcttcagaaaggttttcagtgtgcggtctgagatgcctggtatataggagctcttgggaaatacctatttttccagtcattcgcatgcatatggatatcaccatgaagcaagagacatgcattctataatcatgtagacactcagactcaggggaaaataccagtcatatcctgaaagccgtgttaaaactctatggtaggatcacagattcaaatggtctcagagaggttgcattccaagtaattgttctagtgctttcaagagcaagtacatcaaaatgtagaaggtacatatgtgatgcaatactagtatgacatctattccaacgtctctaaggagccaattgaaaacctagatgttcttcacagctctgtgttcgtgtacgtatgttcactgtaggaacttgcagtccttacttttggccaggcattcctaaataatagggaggcccggaaattacctcaagctttggtaccctgcaaagtggagggctcacaggctacacataaggtgaaatcaccagattcccgaaaagcggctctttttcagccacgccgggg

SEQ ID NO: 647752 - DNA, 131 bp, Homo sapiens
attgcagcctgttcagtgacacagccgtacccatgggatactgctaagtgctacaactgaactatcaaacaatagctacttgtgaatggaacattaagtgcattctcccagaacacttatctaaagtgcat

SEQ ID NO: 647753 - DNA, 1014 bp, Homo sapiens
gctgctctggtggtcttggatgagagccccatgagcgcgggccctggtgggctacagcagcaggggctccgaggatgagtccgaggacgggatgcggaccaggccgggggatgggagctcaccgtcgtggccagagcccccttcccaggcagagattttcagtagcctgacagtgtgctgaacatgttcgcgcgggtcaccggaggcaggggcctgaagactgacagccagaaaagacggggggacggggtggtgcacctttccctgctacggagcgacggcaatctggggcacccgcacgtctatgtacccactaatgaagcccatcggaggagttccctggatcgtgcttgatctgtgctggctgccgcctatgctcgcgagacagtatgtccgcccggctggtaaggcatgaaggtcgtccaccgtcagaggcgtgtcccagagctgtgggtgctgggccatccagggggtccttccacgttcgatgcaggggtgtgtaaagcccgtatgatcgtccttccaaagattcgttctttgctggcaagcaggttaaagattgtacaccaagtccatgaggaaaaccagggacttgtatgggcgttgaggtcacgttcagggcatgccctagattcctggacctggttgcagaggtggacagagtcatggaggaaatcaactcagcgactttctgccagggatccttctttgcacctcagccgtggctggtgtgttgggtggtgccgtttccgctgtgaggggcgggcggcggatctgcgggactcgggctgggtttgacaatgctgtgggctgtggcgtgacactgagctgtccgttgaggcgggagagtctttcgagcttgggtggcccgggctctctccggcctcgagccgctgatgggaccggactctggcgtttgcccggggcgccggtcacgggggcccctccggggatccgtcctaggtgtgccgctccgtaggtcgctcgagcctcggcgagtattccccctctttg

SEQ ID NO: 647754 - DNA, 982 bp, Homo sapiens
gccctgagagagcctcgaacgccatgctgcgatgggtcactgagccagagagtccccggggcggccgccgcggagagcgacgcggagactcgcgactatgcgccccccagccctcgccttcttgcgtcgcgttccccgtatcctcgggtccttctgtcctttccgcgtagtccccacctgcccgccatggccaccttgctcctgcagcaatgcttgtccagatcgtgggccacgtccgtgtccgaacaaggtcccagggccaacgatgagcggctatgttcggccaggatgggttctcacggcggcctacggcatgatgacggcggtgggcttcggcgcattgcggatcgacgctctgactttgaggcagcctgccagggccttgcaagattggtacactccttgaaagccagagtggtaaagctcctgacgtggggactgaggagcgacatgaaagcgacaccgatcgcaggggcatgatcgactccaattactcatgcagcagggcctacgcgtgatgcctccgtcatggccgcgccatccagcgactaccaaggactcacggtcgggacggttggtagggcgaattcttgtggggagccactgacaaaggcccaagaaatcacaggtagtgcggacggcaggctggcgaaccagtgatcataaagccatccagaggacaaaagtacagagcctggggccatagccccgtacgtcccagtccatgtcaaccggccgtgcttagcctcggcgggggtttggtttttcctccattcatcgcttccgcacaggcccgattgctagctggctatggctatacctcaccgcgtcagaggagtccctccactacagctggtgcactttgttacccgacgggaggcaattgcaacgtagcgggccgaagggttggataggccggccgttgctggagacttcggtacccgtgggcccttatggcacgaacgcccatgcctgcgccccc

SEQ ID NO: 647755 - DNA, 135 bp, Homo sapiens
tgaggagagcgatgacttcaatctggaagcctagcggatctcccatctttgcattgctgtcttttacatgatggtgaaaactgagtgcctgatgctggagattctatgagtggtgctctacctacaaggtgtatc

SEQ ID NO: 647756 - DNA, 178 bp, Homo sapiens
  misc_feature (59)..(59): n is a, c, g, or t
  misc_feature (95)..(95): n is a, c, g, or t
  misc_feature (103)..(103): n is a, c, g, or t
  misc_feature (114)..(114): n is a, c, g, or t
  misc_feature (116)..(116): n is a, c, g, or t
  misc_feature (119)..(119): n is a, c, g, or t
  misc_feature (131)..(133): n is a, c, g, or t
  misc_feature (148)..(148): n is a, c, g, or t
  misc_feature (158)..(158): n is a, c, g, or t
  misc_feature (170)..(170): n is a, c, g, or t
  misc_feature (177)..(177): n is a, c, g, or t
tgaaagataataaatttttggagaataagaatacagggctgggtggagtggctcatgcntgcaatcccagcactttggaaggaggaaaaggtggncgcttganccaggtgtttnanacnattttgggtaannnggtgggactcccctntttaaaaaanatagaaaaattngccaggng

SEQ ID NO: 647757 - DNA, 1563 bp, Homo sapiens
tccgcattggtagagggaatgaagaaggaggagggaacagagtaagttgttagtgcagatattactcaacaaagtcttgtgtggctggttggatactggaactgacgaaggagatggacaatattatgggacttattgattcagtgtgtttactactcttatgtgagcacctgagatagtgtgttatgtgctgacgaggtacacagggacacacgacacgtacagacaactcggacgacgtgacttggttggacttgtggcctttgacttatttacgacctttgctaacgcttcaacgactgacctagtgtaacccatcaaacctgatggacgcacggtcatgcccactgcatttcgcaccactgttgtctctctcactctatacgagaaggacgacacggacaacggtgacacgaactacaacactaccactggtgaacgttataaccttaccaacctaagggactgctagacaaccactggacgtggcttaaccgcggttgccccaggggataacagcctggggcagcactggacacgaaggaagtgacaacgtggccccaagggtaccgacgaaaaaccctacacgaacactggggtaagcacttaacgcgggacgacagctgcagacgagactaacaccaaggcaccacctggccgaactctaccacgggccttgaggcccacgacaaggggtacacacactgaagccttggcgtcctaatacagatgccacacaatgtgacacggccccttaccactactagcgtgataaggactcgaataatcctacatgcccttttccacggacgcccacgcttataccgaggttgataccggacccaagtcccccttggtcctcggctttggtctccacagacccctgaaaaaccttatcagattggaagacaacccaagaagaagacacggccgtgaactggactgggcatatttcgtttgtaactgcccacccaagttaggcaaactcgtcacgtaccgagatcgttgcagcgaccattacttacagtgctcgcacgcccaacgagcgcaggaattctttgcgccagggccttgagcggcaacgagtacctggcccagctcgtacgacgcagtctgtgactaacatttccgagccaggggccatgtcccgacaggaaacaaaccggtgcgcaaaacaaccggcggagacaaccattttgaaacgcacaagggctcgccggcgcagttcaccacgtcgacacagtggcgacgcggggagcagatcgacgaaagaagacacatgagagcaccaggacaagagctggacgccaacgcagaggggaggcgggcgcaccacaccacgacgtcggagagatgacatacagatagacgatgaagacagccacgacagggaacacggagacagcgtccgacggacacaatggagctcgcccacggttctgagacgtcaagcagcgcactcagagtgcaacacacgggacaacgtgcacgcaaaacctccatagcacgacggaaccgcggacgatcgtacgagaccgcacacaactggagaacgtcattcga

SEQ ID NO: 647758 - DNA, 903 bp, Homo sapiens
gcttgaagccacctttcccctcaaggggaactgaccctgtctttaatgctgcagttggcatccagggatcagatggtagacatgtggctttgatgcataccgccatcctgctgtttacgggaggtccgagtcgacaagaagactgtgttgactccgcctggtaggcactaagagcagccgggcatcttgggatggacttcccttatggaacgatgaactccctgtacgggctggactgctactacgatctctacaatcctaaattaactgcattttaaaagccagcagcagcgacaggtccgatgataccttgagtacagcgtgtgcgagttatgcagagccgtgccgcttgtaccaaggtcagtatggtggacttcccactaggggaaatctgggcgtgctgtatctcagggtgactcccagtctccgttactagtcagggacaacctccacttcctttctggagcgttagtctctgaaagttccctccagttggggtgtgctccgctttcaagattgtgcctgcatttccatatgtcatatggctctgactcattgagtcttgaagccgtgactgctggggcttggcatgtcggcttcaggttttgcactgtgaacatgatgtgaggtctccttttctgcacccgagcgctatgggagggcccagagcaccaatctctaggtcctccagaagcgatgcgtgagacaacgattttgtaggggtgggcactcttttttatccaaagttgactaagctacgacatcagtgtttagctgagaacagaattgacttttccatttggttgtaccttgacacttgaggaaagggtgatgggtacctactgatttcccccttctttgaaactagaaatggtgcatggcaggggaaaagcggttaactgc

SEQ ID NO: 647759 - DNA, 133 bp, Homo sapiens
ttgcaaatggcacagaaattgaaaactaaagcttccagttcagcattgaggacagcaacttacagaaaaattggagagggtcagaaccagtgtgatggcacccagcatggctttgagcttagacaggctacct

SEQ ID NO: 647760 - DNA, 382 bp, Homo sapiens
ctgccccaataacaagacaaaaactttcgagacagattacccaatggtagatattctgatccattttatacctgatgatcactgtgtgtccatgaacatggtcctccatgtagaccagtgatgggcacaatctatgccatggcttccagtggcctctcaaacacagcaatgttttggcggagacatatttaaccagcagcatggggtgggaagatgagccatgagcatctcgtctccagctggatgtgctctagcctgtcgtgatatgttacaatgagcgtccagggcctgcatacttgaaccatgagtcactttaacaagcagtacctgaattcagcgagacgtggtgatctcattccgctacccggcctcttaagaggag

SEQ ID NO: 647761 - DNA, 118 bp, Homo sapiens
  misc_feature (56)..(56): n is a, c, g, or t
aggtcacagaaggtgcctctggtggttcccaaaaagccagaagccccacctgctanagtgctgagttcaaaagaagtagtccagaacagaaagttgatttgtccccggctggggatct

SEQ ID NO: 647762 - DNA, 211 bp, Homo sapiens
aaaaagactctagtttttcttattcaataagaatataagtagaaaatttaggagtcacatttacagtttggctgatacattcttttttttgttttttaaaacttgtagggtctggcctattggcttactaagggcaaaaggcataaaaatatcaagggggctagtatgtaatggacagaccagggcgatgtaaaattgagctagacttggg

SEQ ID NO: 647763 - DNA, 99 bp, Homo sapiens
ggaaatggcagagttaaagtacatttctggatttgggaatgagtgtgcttcagaggatcctcgctgtccaggttccctgcccaaaggacagaataatcc

SEQ ID NO: 647764 - DNA, 1289 bp, Homo sapiens
gctgccactcctctagttgaaagctgttgtgtttacatctgacattaacattatttttccagcatacaacgatttaaatttgggaacggggcgggatgtcctcaattagcacactttccgactcacgcctggcctggctaccgtctagctactatgcagccggctcctcaagcttggcacgaacaatgtgcctttcacttcacttaccctcctcttggcagcacttcctctgcctggcacctgacacatcgtgtgctcacgggcacctactttgcgacacctggcactgttcttctcgcacacttactctttcactccctctcccacgcacctcttcctgacactcttcctctgacggcgccgtctttaacatcttcctcctgagtctgacttgctctctgccatcgctgctgctctctgtttctcacgacgctgctggccacgcttactcccacgaccactggtgcccaacttccagccggttacgccaccttctgggctcttcgaggcttcgtggcctaactctccttgcctgcatggctcccgcccactctttactccgtatgctgccttcaccctgggcacggcagcgggccactgggcttcaccctccgtccgtcttagcgtcgggcttccttccttacaccttaacctagatcgcgcttcctaagcgaacaggggcgtgattaggcacgtttcgggcgcgcaaccgcaccgcggttggaccgccttggaacttcccccaggcctcttttatcctttcccccttcttgctggccccttcggaacgcggcctttcgtctggcttacccatctggcggcgcaggcgtgcgcgcgcccacggcgcgcgcgacacgcgcggcacgccttacctacgccttctacccttcacatagcccctaagcttcgtccagctgtccaggcgtgcgcatctctaccctggggctgtacgactagacacttccacgccacgccttactatgcgtatcgcggcgcttaagttccgtttgctcccccactaggcgccccttaccgcgcacgcgctgcccatctcactctggcgtgcactgcccatcctttgcccgccttccagcttaccttatctcttcctcggggcacacgcaactgctgctctacgcttgggctgcctcctgcgctggtcccgcctgtgcactcctccgcttctccgctgccgcgcactactccccccacgctcggtgctgcgattctgcgccccctggtgcgcctctacgctcctgactgcgcgcctatatcccctctcccctggg

SEQ ID NO: 647765 - DNA, 111 bp, Homo sapiens
ttttgcacttctagcaaagacaggcttcaccatgccggtcaggctggtctcgaactcctgaccccagatgatccatggggtgagttctttttaagttaatgaagaaggata

SEQ ID NO: 647766 - DNA, 454 bp, Homo sapiens
gtggacaactggagtgcaaactacggtcgctggcaggtccgtgggacactcagtgaccacttcatcagattcatcagaatgctaagacacatcagactggtgagaatcatcactgacatcgacatcatcagagtcgttcgagtcaatggagtcctggctgtccacatggtcatcatcctcttcatcatccatatcatccatgtggtcatagcttttgccggctttaaatggaagggtctcttgtttaaagtcattggtttcttcagaggacacagcattctgtggggctaggagattctgcttctgggaatggtcagggtttagccatgtggccacagcatctgggtatttgttgtaaagctgcttttcctcagaacctccagaatcagcctgtataactggtatggcacaggtgatgcctaggaggcaaaaagcaaatcactgcaattctcat

SEQ ID NO: 647767 - DNA, 614 bp, Homo sapiens
cttggggccccagccgatggatgactaagtccattggaccagaagaggagaccctggaagtccattccagcccaagagaaaggtgagccagcccaccaggcccagcaaccggccgggaaccacccgagtccaccaaatcttatatccatccaggcccaagatccgggaactgggactgaaggacccctggtccgagcaccaggtccatccgccgtccagaccccagccccgatatggattctagggctctggacctgattgctccccggatcctcctgcccagccccagctggcctggccccccagcgttcacctctgggagcccccgctgctcttaagccccggatctctttcccccaggaccccgccctctgcctctgcgagaatggacatatttgatagatttttcttataccagttagcaaattccagctcccttctgtcctggagctagccaagacttgtgtgatgcctccgcaaggggctttgaatttctggggtgggaattttgctctctgtcacggtgtgataaaatgttgaaccctcccccccccccctttttttttttaaacccgggatgtctgttgaaataaaaccttccgtctgaccaacca

SEQ ID NO: 647768 - DNA, 1338 bp, Homo sapiens
tccgggggtcctcgccgggggtaatggccgctggttcttctgtggtctattgtggtgtgctctgtttttactcttgttgtgttctctctcctggtgattactctcccctttgtttctactctggtgtggggacatgtgatcttccacgtgggggcccttccctcccctgttctcccggggggcccacgctaagggtggctcctgtctagtgcccctctttcggggttggtgcaccgggcgcccgtttttaatcgttgtctgattatgtctgggtgttattgattgggtgccacgcgtatatttgggggcctattgtctgggagttacttatctcccctccccccacagggggcccttctaagaggtctggttactgaggtccccccgcgggctttttgttggtgggacccaaatgctctcctttgagagatatgcgcccgtggtgctacttttcggctggaacttgtctcggttttaaagggtctcactatggatatgcccaccccccccgttgccatattttccgcgcgctctaaggcgttttcccccctcggcgtgtctccccccctcgaggggccctttattatacctcacgaggttgtcccttattggggacgcaccggaacttgagcacgtgtctgtttgtctgtcgccactataagtggatgctctctgtggacgcacatttgtgagagagctctggggcactctcccacagacactgcgggggattgaaatttttgggagagccaaacagcgcccacatatactgtttgtctgtataggagatgtgtgtccctctctctctctcactccacccatatcccgccattgcctctcacaacatccctctgtttgttagaggtgtgatagccctctgtttctgtgccactggcacgcactttcgccctctgtgtgtccacagggcctctcctcccactctgtttagaggtgcgctctagaaagagtgtggtctgtgtgtcgtctgtgtgtgtagtgtctgtctgtctgttctgtcgttgtgtctttcttctgttgtctgtctgtctgcctctctccctctctgtctgtctgttctcctcctttcttcttcttcttctccctctcttcttctccctcttgtgccacagaagtaaaggatataaatttctctttctaactataaagcacctcggtgttctccaactcttttggttctccacagagccccacactctcttaagaaattgaggaagttctccaagagctttgcttatattttgttctctttgagatacttaccctaactagagaatttaagcgaaaaccatttttataaatataatacccctgccacca

SEQ ID NO: 647769 - DNA, 186 bp, Homo sapiens
  misc_feature (76)..(76): n is a, c, g, or t
catatgaaacaaatatgtttaaaaagcaaagaataagaatatatacaaaagggactggaatctgtaagctgatccnataaacgaaataagtagacaatccatggtgaaacctgaacatactacctctgctttggagaattgctatcatacaacattcagtcagctgaagatggattggtagaggtg

SEQ ID NO: 647770 - DNA, 107 bp, Homo sapiens
  misc_feature (28)..(28): n is a, c, g, or t
  misc_feature (38)..(38): n is a, c, g, or t
aatcaaggaagctccatgctcaggctcntcagctctcngggccagtgctcctctcttgtcccgggtagggaatactgggagactcctgccttttaccctccccttgg

SEQ ID NO: 647771 - DNA, 986 bp, Homo sapiens
ggcgttggtggtgtgatcttgatccgctcaggaatcgagatggcggttctctggaggcatgagtgccgtaatgcggtgcccttaaggaggacgagactcgtgtttgcttcgaagtcacagtggtcagatccttgctcatattgttcagtcgagttgtactctcagcgtagccgaccggtatcctcagaagtgggtgtggatgtagcaggccaggtatacacattgtcgaccggagccaccgatgtctggtggcttccaagggctgtcactctctcggcattggacatagccgagagtgtgtcgtcagtagttccggtcctggagtcctgctgccggctgctgtatgtattgaaatccttgctcgtgtgatggactattccctggcatgattcaccttcactcattgcatggtcacatggggccttgagaacaaggtgagtaaacgtgactgatgttcatggggatgccattgcaggaaagcttgtcaggggagggctttttgggggactttcgagttgttagagctgtgctgggaattatggatttcaattatcacgatagtgtgcatctgcaaaggtgttgccattgatgtggaaggctttgatcatttagatacatagtggtgaagaagttgatgtatgcgtcttgtgcctctggtttgtcgtggcattattgtcacattatggaagaatacaggatagtccatgatgacaggctgttcttgcaatgacagattatgggcagaatgatcttggggaaaagggggagggataatcttggggtgagactgaatgcaaaatgtgggggaggggtggcaccaatgtttgtaagattccagagtattacatgatatgggtggtgtaagttaatttttaggaacagtttgaggggtttgaactctttgctgttaaaaggagaggattggtaagaggaaaagaggtgtgaactcaacaacgtgtgaaaaaggggaaataagggtttgggaa

SEQ ID NO: 647772 - DNA, 225 bp, Homo sapiens
gggagcgtctccgttgggtccggccgctctgcgactctaaggaaaagctcgcaccaggtggacgcggatctgtcaacatggtaacggagacccaacaagccgcgggcaaaatgtcctcgtacgccttcttcgtcgacctccgggaagggcccaagaggaccccagtctctccgtcaattcgcggaattctccaaaagtgtcgagaatagagaccatatctccaaa

SEQ ID NO: 647773 - DNA, 877 bp, Homo sapiens
  misc_feature (740)..(740): n is a, c, g, or t
  misc_feature (877)..(877): n is a, c, g, or t
gtatacccctctgtacaatgcggtctgcctatcttctcaaatgacaaaaacgtaacccccatgtcaatcatgtaataaatctttccctcgctatcacgtaaaccttcgtccgtcactctctcgggtcttaatccagtcatagccaggcagttggcggctgagacttgataacgcaagatccacgtctcaggccatcacatcattcactcatatctccctcatactataccctacctgtaggcaattggagactaaataggcagatgtactagcggttatcacatcccttgacacccattaatcacctgtttcctctcatctgtataacctagtgtgatattaaatttccctaaaacttgaacgtgagctctggtagtttcacctcatccataacttgccacatgtttgattaagctacgctagggcatcgctatcgagagcactcattatccttatctcactcccttcgtcgatcgcttgtaaaaaataaatgatttataacattggaactttaggtcatcctctataatagtgtaccatgccaaaccctgcacttacttcacacttagagtagggcacctgacacactacgtatctgaaactgggagcattttcctgggccccacaattgcgtgcaacattctactgtgaaagatgtgaacttatcatatgtggaaaccaattaggaacctctatgaatagctcctacgattacaataagtgcatcctgttatcctgtnaactataatttctcgtagtatatatctctaagtgctttaatctaactgccatttcgtcaattaatgaagttatttccccacatatactcataggcaaggatatataaactacaaagtgtgatagtattgaatctttn

SEQ ID NO: 647774 - DNA, 348 bp, Homo sapiens
ctaatttgttttgttttgttttgttttgggaaagataggatcctgctatgggacccaggctggttttcaactcctggggtcaagcaatcctcctgcattggcctcccaaaggggtggaattacaggcatgaggcagcacgcccagccctaattacttttattacgccaaattccttgtgtggaattcctgggctttgcacccaaattgccagggtggccccaaaggggaaaaaagtgggtccccttttccccttttttatgcctacgggggtggcaaatttcccgaatcccccaggagccggcgctgatttttgtcctctattcgctgaaataaagttccccctggga

SEQ ID NO: 647775 - DNA, 931 bp, Homo sapiens
cgcggtggctcacgcctgtaattccagcactttgggaggccgaggcaggtggatcacgaggtcaggagatcgagaccatcctggaccaacagggtgaaaccccgtctctactaaaaatacaattataaattagccgggatgtggtggacagggcgcctgacagtcccagacacacatcgagtaaggactgagagcaggacgaacggagatgaacccgagagagagcaggagacatcgcagatgagccaaagatagagcacactgatactccagcactgaggaagacagagcgagactccgatcatcaaaaacaaacaaagaaaaacaaaaaacacacaagcagaaagacagacaaacacaaaaagacacaaggaacagaacacacagacacaaccaccagaccacaaaacaaaaaagcgaacaacaacagaagaaacagagaaaagacacaaacaggaccacgaagtacaaaagaacaataaaaaatacacgagaactcagagacgaaagagaaacaagacaaagaaaaagcacgaacagcgcacagaaagcaaaacgaaaaagagaaatgaccgacacacgagaagcacacacaagcaagcagacaaaagcaaaaggcaacagcgcaaacagagacgcacaggagagaagagacggacgcgcacgcgacaacaacagaaagaaaacgagacaagacaaatgacaacgagacaaaaacacagcaagaaacaaaaaaagaaaggaaacaccacaagacacaatacacacaacaacacaaacacaacacgaaaaagaaacagaaacgaaggcaacaacaaaagaacaaacggaagacaaaagagcacagaggagaaaaaaagacagaaagaagagaacaacacagaagagaacaagagacaaaaaaaaaaagacaccaccagacagacgagaa

SEQ ID NO: 647776 - DNA, 226 bp, Homo sapiens
atcatcaataacggattaactaatgtggatatttatactcagtggatgtagtgttcagccttaaagaaagaatgaattcctgatcatttgctacaacatagatggaactggaggacattatgttatgtgaaatatgccaggtacaaaaagacaaactttgcatgttctcactcatttgtgagagctataaattaaaacaattgaactcatgggacacgaatgttca

SEQ ID NO: 647777 - DNA, 809 bp, Homo sapiens
  misc_feature (433)..(433): n is a, c, g, or t
actacttaccgtgttgggctgcctgtccttcacagatcaatatgcagatcgtctctctgcgccaggagcgttgtcatctctatagaaatcagacgctactgagtcctaaattaggggtctccatgtgtcttcttagaggtcatgtgccctcagagatactcttgtcgtgacgccgtaggtggctggctctgtgagagcttgaggccattctggtaagtcaccacgtctgtaaaagtctacattaactctcgctcagaccaatgacacttctgtgctcgagagacagacttctcacagagcctgcttgccgcgcattgtctgccattcgatcctgagagtgatcactccgtgactgtagcccgattagactgagcaaggattgatccaagcattactattccagtccatacagtgaggtgtacagtgttaaacngtcgaaaacgtcgagaggcacgtcctgccctcttccctataaaatcacccagcgtgatctcacaaggtccctggggctaccttgctcacgtgcatcctctgcccctaccttatgacgatatgcactgcagcagttgctgttgcttattctgaaaggaatgtagaacttgacagcagccttctgagtctgggtcaggaagatgtcctttggaccaaagcagacttctttatacgcagctcagtttcccgggagtcgccacagatgtacccactagcccaggttgctgtgagtcagcggaagctcccgttatgccctttgctcctggtgggagagggaggagtgagctccctgggttccagtatttacttggtatacg

SEQ ID NO: 647778 - DNA, 999 bp, Homo sapiens
tgcgtttccgtgaaatatacagaggtaccctggcctcagaagattcctttcttgcgtgcccgcattacggcatatcgaaccctatattcgcttatcgtcttgtcaagcgcccatctgtgtcttacctctctaatggccgcttattgggaaaatatattctccccaaatgttccacgaagtcaggaacataatacccgttcgacgccgaagaattttgcccccctgtgtatgagccatttgggtataccatacacctacgccgtagtttcttacttgtgtctcacggggcaaaatattaccggaaccttcataggataactctcagaaggagcccaatggacccctgagtagtagacaatgttgtaacatgccaataaagccttgacgaagttgctctcctaagtcacaaagatgtagaagtcaattccttacacacgctagtatggagatactagttcgtattcatataatggggaatcaagaattgtcagtatattcctcatgtttgcggctttgtccttgcttatgttatatggcttagacttacagactgtggagcaatgcccaaactctgtaatactgctgtcctacacagggtaatattatctgctacactggaaggccgctaaggaagcccttgcttctctcaacagttcagctgttcatctagggacaaaatcatgtttctgatgtacactagcaattgtgttcccaatgttacgtacacgacatacagcgtttaatcaccgtgtaagtgctcgcagtccttcagcagatggcgtacattgtacgtaccctgttgtgctttcagtttgtttttcacctatagatgagagttgtaaacaacaaagcatacttgtggggtctgatagcaaacatagaaatgatgtatattgttatattgtctatatatttattttcatcaaatacagtagaatttgatgtacttgcaaaaatagataataattaatataacaggttttctgtttatagatgtta

SEQ ID NO: 647779 - DNA, 485 bp, Homo sapiens
  misc_feature (260)..(260): n is a, c, g, or t
cattacaaactggtgaaaacggaggattttagcttgaacaggtttttcctctatttgaaatcaatcatttcccttttacaattttggagtgaagtttcaaaatcagtacgcacccactcccaggtttatccttatgtaaagtgccccctctgcacatgcaacatttaataaaccttgaaaatatgatgctaagtgaaagaagccagtcacaaaagaccacatgttgtgtaattccatttaaataaaatatccaaaatagnccaatacatagaaacagaaagtagattagtggtggcccggggttaggggagttggggggaactggagggatatggggtttacttcaaggtaatgaaaatgatctaaaacttactgtggtgctgtttgcacaactgtgcaaatatactgaaaaccgttgaattttacactttcaatgggtggcttctgtgatatgttattaatatttctcaataaaacttcaaaaa

SEQ ID NO: 647780 - DNA, 431 bp, Homo sapiens
  misc_feature (431)..(431): n is a, c, g, or t
cagtttacaaaagaaagttgtctcacccacaacatacgggaaatcaagctgagatttgggtagggacacagccaaaccatatcattctgcccctggagcttcccaaatctcatgtcctaatatttcaaaacaaatcatgcctttccaacagtcccccaaagtcttaactcatttcagcattaactcaaaagtccacagtcccaagtctaatccgagataaagcaattcccttctgcctatgagcctgtaaaatcgaaagctagttactttctagatacaatggaggtataggcattgggtaaatagagccattccaaatgggagaaattggccaaaacaaaggggctacaggcctcatgcaagtccaaaatctagcagggtagtcatcttgctcctgatctcctttgactccgtgtctcacattcaggtcn

SEQ ID NO: 647781 - DNA, 252 bp, Homo sapiens
agacaccctacctcgcattgtgggtggtgctcagtgtcaagagagttactcccatgggaggggctggccactgagttcaatttggggaatttatgtttatatttattctatttattttcgagatggagtctcactcttgtcgcccaggcttgtagtgcatatggctatgatctaaggctcactgccaacctcggcactcctggtgttcaccgcgatattctctgcctcaggccttccaagatagctagggat

SEQ ID NO: 647782 - DNA, 200 bp, Homo sapiens
cattggtccgagagaaattaggaatgaataaaaaagtttggctgcagaaccacagaaaggactagatattcatacatgcgagagcacactgagtactgcatgtttatttggcataactgctagaaaaaagtccgcaaagaactgccagaaccaggcctgtgacccatgtttacagtcttctcatttctctcggaccactg

SEQ ID NO: 647783 - DNA, 220 bp, Homo sapiens
gggcagcgtgctatgatgcgagtgctgtgttgataagatactggggtctcatcagggctgtatctgattagcaatgactgccattggagggggcttttcatattttacaggaaaacattgtgattttacatgaaactgtaatgtctcccacatagcggttgcagtttttctttttctgaagcaaaagcaatagcccaagaaaactcccaatgattataag

SEQ ID NO: 647784 - DNA, 125 bp, Homo sapiens
aggtgggcagacagcacctatcaagatcttacaacaggagggaaagctaataaggaatcctccaaagggctattctactcctctctaccccctgatgggacagcacctgagtctactacaagccc

SEQ ID NO: 647785 - DNA, 183 bp, Homo sapiens
  misc_feature (85)..(85): n is a, c, g, or t
  misc_feature (99)..(99): n is a, c, g, or t
  misc_feature (111)..(111): n is a, c, g, or t
  misc_feature (124)..(124): n is a, c, g, or t
  misc_feature (165)..(165): n is a, c, g, or t
atagcgtatgagggtgacaggcccgagggaggcccggcactgctccgagttggggggagggggtgtggcaacgtgccccccgcanaggccacgcatgtntgaccaaagccntcattgtggtccngaccggatcatacgcccttttccctcactgcgccctcatcngacgcatcttcgctcatt

SEQ ID NO: 647786 - DNA, 735 bp, Homo sapiens
gggggagcgcgctgcgcgtcgaggagtaacctacttggtctcctgctttcgcgaatggccttcaatttggggctccctcggcacctccggtaccggtgcagccaccgtggccccggctgggtgggttggggaggattgtgggacaacatctatcaatgcaggttctgcattcagcttttctgccccaaactaacacaggcactactgactcttgtggtggtactcagaacaaaggtttgtggattgtggtacgttgtttgcacaaacaagcgggaactggtacctggttaaggtactggttggggaactggactgggattggaggatttaatacacagcagcagcagcaaactaatcatatctgaagatattagtgagctacaaaagaatcaaactactatctgtagccaaaatgtgcacaatacaagaggaaattcatggatctttcccatagaattttacaagtgtcctaatcaaacaggaacttcaagggaagagtggttatgccattcaggctgaatgaagaagcagttgcgagttcagcgtggataacgatacaggggtggaactaaaatggcgcctaacttcagttcaaggggcgactaaatgaatgtgagtgtctcaaaatcaggggtgcagcaatcattgtggggcagtcagattctggaggaaaggttttacataggatgccgattctgttgcgagaaatcacggcgggttttggaccacaacgga

SEQ ID NO: 647787 - DNA, 120 bp, Homo sapiens
agtctgagaggcgaggacacggccttatattactgtgtgagatatggttttgacagtactgatggttacttcatggcttatgatctatggggccaggggacactggtcaccgtctcctca

SEQ ID NO: 647788 - DNA, 410 bp, Homo sapiens
tgaggctgggtctggctcttgttgcccaggctggagtgcagtggcatgatctcagctcactgtaacttccacctcctgggcttaagccatcctcctacctcaacctctccagtagctggcactacaagtgtgccaccatgcccggctaatttttgtattttttgtagagacagggttttgctatgtcgcccaggctggtcttgaactcctgagctcaagtgatccgctggcctcagccacccaaatgctgggattatggggatgagccgctgtaacgggccccttttttcactataacgtttctctctatgtgtatatatatatatttttggagatggagtcttgctcttgtcgcccaggctgctcttgtcgcccaggctggagtacaatagcatgatctcggttcactg

SEQ ID NO: 647789 - DNA, 117 bp, Homo sapiens
caggaatattacagccgtcccgcttttaatttcgtcacggggcctgggcttagatggtaggtgacatgggcactgtctgacaatctctcacagtttacgcggaagattcagagcccg

SEQ ID NO: 647790 - DNA, 277 bp, Homo sapiens
ctgaatctctcagatctcgatcttttagccttactgccaagtagcttttattctgactgacagactgtactttccgtactatacctttcttgagtcatttcctttttcacagtctgcatttttcttttgcaaattaactactttcacctttcctggcgatttcttgatgttagactgtgaagctgtggttaacttccccaaaatagtgtctggaaggagttttcttttcttctgttcgatgaacagctcctcgcgtcgcttcctcttctccttcagg

SEQ ID NO: 647791 - DNA, 505 bp, Homo sapiens
  misc_feature (24)..(24): n is a, c, g, or t
  misc_feature (288)..(288): n is a, c, g, or t
  misc_feature (344)..(344): n is a, c, g, or t
agcggaagtcgcgaccagagccantggagggcgcggggactgcaaccctaatcagagcccaaatggcgcagtgggaaatgctgcaaggacatctgtggaacgaggcgccgcccgattttcaaggggatcgacggcgtgggcaacgcaaagggcgagtgtataaaccgagtgccggggccaaccaaagggcgcgttccaccgtggccacgtgagtggagaaccaagtttcgggaaccgaaaaggggggtttaaaccccgttttgggcatgtctggcattgcaagacccnaggaaaaaccttgggcaggcaagctgcactgtgggcagtgatgattcccaaggggngcgttttaaaccgcgaatgcttattcttccgacttcttggactcacgctgacacctaacttggaaacggtttggggcgttttggggggggccaccccgggggtctttggggcccaaaggggagcccccccaaagggggggggaaaaaagcaccccccaaag

SEQ ID NO: 647792 - DNA, 503 bp, Homo sapiens
ctaggatacttaaccagaatcctccgtgtcctgtcccagccatattatacccctggagttttctgccactgaggtaccatccacgaagtcaaaatgaaactgcctgtgtgtggcggttgggtagcgggatatgcgggtagtgtgcacgaggggagagagaatttctctggcttttgtattttaccttaggcaggtgaacgacatataattgtacacgagaacaggatggtgtagtacgggcatggtgacctgtctatttactctgatgcaaccatttgcaaaattgtgccattcccttcagcacttaccccaattccttagcccgcatactgtgacttacccagcggcggatcatgattcgagagcaggcagacgttgaaaaattccatagtccaggagcgtgtctcccactcttgtgaacatatcccagctttcatacgctctactgcccccaaaacatatcgtaggtcatccgacatcctatacgaaccgagggctccccc

SEQ ID NO: 647793 - DNA, 482 bp, Homo sapiens
gcctcgctgttctgtgctctctcctggtatctggtgcgtctccagtcgagctcttgtaagtgtgcttcctcgaccatctccttacttgtgacagcacccagggtggtggctatgcttttgtacaggatgttcttctcctgtgggtgcctcatcgtactatggcatctgcctgcacagctccaggctcagctgtgagattcacgcgttgtcataaatgatggccagggtgtctcgcaggaacatcaacagcttctcctcccactcctcctgtggcagggtctcttctgtgtgctcatccaggtaccccagcagcagcgggacagtcgtttcccaatgctgacccagcaaagggtgaatgtttgggtgcagaacactgaggaggcgcagcgccgctgccccacgtccgtcccctaggtaggggctggaagacacaaccaacagtcttccggttacagcatagggagacgggaggctcgcatggg

SEQ ID NO: 647794 - DNA, 554 bp, Homo sapiens
gagaggagtgccgcgtataagagataactcttgcaaccccaatagcggatactgggatattgagaacactgctcttattagaccttgtcgacgctagagttctggcgaaatattccacaccgggaccttgcgtaggcgaccgttcattcttgatgaagcacttggacataaactttctaagattaagatttatcctatcccggtttaagtaaccgttgtggaacactcactcactacactgggagtgttccaagacatgcgctatttgtccttgtatgagaagtgttcaatctgatggaatctgcacgatcaggctgctgatgttcagaagagaagttaatcttctcatgaccggcactacttgtgttgagtataaagaaactctaaccaaggccactatacttgatcgaacggtgacctttcagaatttgcccgtcacatttcggaaacagttggttaactgaccctgggacttgacattattatggctccgttttttctatcgctgatctcatgaaagggtgcccatgggtaggtgagtgggcttttttctt

SEQ ID NO: 647795 - DNA, 113 bp, Homo sapiens
cttgactcggggcaattctggactcggggcaattctggactcggggcaattctggactcggggcaatactggactcggggcaatctggagtcggggaaattctaggactcggg

SEQ ID NO: 647796 - DNA, 258 bp, Homo sapiens
  misc_feature (5)..(5): n is a, c, g, or t
  misc_feature (8)..(8): n is a, c, g, or t
  misc_feature (19)..(19): n is a, c, g, or t
  misc_feature (32)..(32): n is a, c, g, or t
  misc_feature (110)..(110): n is a, c, g, or t
  misc_feature (125)..(125): n is a, c, g, or t
  misc_feature (137)..(137): n is a, c, g, or t
  misc_feature (177)..(177): n is a, c, g, or t
  misc_feature (179)..(179): n is a, c, g, or t
  misc_feature (188)..(188): n is a, c, g, or t
  misc_feature (190)..(190): n is a, c, g, or t
  misc_feature (194)..(194): n is a, c, g, or t
  misc_feature (231)..(231): n is a, c, g, or t
tcccnaancccaaagattnatttggcaagggncaaaaaaaaaaaaaaaaaaaaaaaaaaaaaaaaaaaaaaaaaaaaaaaaagagaaaaaaaaaaccaaaaaaaaaatcnaaaaggaaaaaaaanaaaacccaaacnaaaaaaaacccccaaaaggccaaaaaccccccagaattancnaaaaccccngncccnaaaaccccccccccatttttaaaccaaaaaaaaatgnaaagaaccaaaaaaaaggggggcaaga

SEQ ID NO: 647797 - DNA, 241 bp, Homo sapiens
attgcagagatcctatccatcaacgttgcttcagtacaacctataaactagaggcactagtacatacagaatcgtacaactacaggaaatgaaaagttcaaaaagtagatcctacaaaatgtaacgcatcactttcctaaagcatcaatgatacagctcagaacaattcaataacaagatttggcctactataaggcatcccgataagacaggctaaaccctatgagtccacattctactg

SEQ ID NO: 647798 - DNA, 301 bp, Homo sapiens
ccattgggttggatgtccccactacttccgttaacccttcccattgtcaagatgtgccacgggtgcctctgggggcacactgaactcgtaggaagtgtgattttgaggtaggtgcacatggtctttgactttgacagagatcaccctcccctcccctgacctgacaccggtagtagtaagtcactcctcatgagggtggttcggtattaggggtgttgaccctctcataattgggcccataccggacggatgcgtagggtgagttgtcaattgtgtaacatgtggccttcttgcgaggtta

SEQ ID NO: 647799 - DNA, 356 bp, Homo sapiens
cccttttcccctccctttaaaaggtttgggggatttggggcccggaataaaatttttcaaaggccccggtgttgggaatggttttaggtccccccctgccccccttcctcaagttaaagggggttgccgcaactttttttcccccagtcctgggcaaaagcccccgggttgggttccttccccccttttgggatttttccccccctgccattttgtggggataatccccccggtttgctttttgggtccccaaggggttgtggcccattttctttccctcccatggttgcctttttttttcccctttttcctttttttttttttattaaaattttggtttccccccctggctccca

SEQ ID NO: 647800 - DNA, 328 bp, Homo sapiens
  misc_feature (242)..(242): n is a, c, g, or t
attttaaggcgctccgacgttttcacgcaacttggcgaggatcttactgttcaggctaccggaagcttcttcgccgacgggttgcaggctcaggctgatcttgccgtcgggcggatctccttgataaagcccttttcctctttgccggcccgcagaacttgaacacttcgttcttgtgaatcagcccccaatgcttgttgttgatgatcgccttgaagcccatgtcggtggcttcggccagncaggtcgacttcctggccgggcgtgtactggcggagtcttgtccaggtagcgatccaggcggcgcgtggcggtgatacggtcgacg

SEQ ID NO: 647801 - DNA, 280 bp, Homo sapiens
cacgaggaacgagagctatcgctatgtgcgcaccgacgtgccgtgggcgaagtcggaggacgagctgcgcgacatctggcgcaagcgggtcaagaacgactggctgcgcctgaaactggccggcaaggacgacgcggcgatccgcgaaacgctgggcaagcgctacgacctggcgctgaccaatctgaaccgggcaaagagcgacgacgtgttccagctcttcatgaacgcctacgccgagtcgatcgaaccgcataccagctacctcggaccgcgcgcg

SEQ ID NO: 647802 - DNA, 342 bp, Homo sapiens
catatatgtatactcttaacagaacagtgtgggaggaactacccataggcctgatcaggaaagagacaagagacgataagataggatcttatcatcattatgaagtttaatatcaagtagtagagataaggcatattcgactatgtaagaacacacagtcagcaaagtgcattaaggatgacataaagaggtgcagcagcatgagcagtggggggggtccagcagatgcctgtcactttcagccaggcacaattagggcaatatgtttatcgcaggccagaggtcatttgagttgcagtcttacaaagcaacagggtacatgctggtggcgctcgtcaggag

SEQ ID NO: 647803 - DNA, 355 bp, Homo sapiens
  misc_feature (79)..(79): n is a, c, g, or t
gttcttcctgctccctctgttccgctgctgttgctcccgttgccgtcgagctgccttctgctcttttttccttgtagcntgccgggcctccatttcttgagtcaatggccctggcacctggaagatttcacaaagatattataaaactacaaggaagcagaaagaacctatgaggatctctgatgccctccgctctgtagctccttttccagctcacccgagccttgttgtaatcataggcatcaagattcttctccatgaactccggaattcattacgcgttgatttgtcagctgctacagtataaggtgccgagccctagagtccctaaggataaaaacccaaaaccaagtta

SEQ ID NO: 647804 - DNA, 842 bp, Homo sapiens
agcggggcaggcagggttacccctgcaggagggggtgggggagaaagggtaggggtgggcaccctatacatctacccagaggggtagatcaagcagccatcatctgtcgtaactagatggtcccaggaaggtggcgtcagcaatctgcagccgcgtcgacgttgtcggatcctccgcggaggacccactgagagccggactaggacctacggaccctgggccatccaccagactccgctccatggcataagcttgtgcaggccgtcatacgagagccctctaagggctcgtcgagccaggtcctgtgagtccagtgagagtgtcctagagtgctccgatgaccaagactttcgtcaagcttccggtcagaagtgtgaggctgacgtgggctggaacctgacctatagcagggctggggatgtctgctcttgcgcgtgctaggctgtgagagatggatcggaggctgtacaacgatccatgtccagctgagactatatcatgacctgggtcctgctcttcagtagactcaaggcctcatggggagaccacatggaggacagtgacgagcctttcgtgagcatgtgtggggacagagacatatagctcaggctgatggccggatggacgtgctgtgatgtggcaggcgcacgcaccactactacgactagaccgtgacaccgacatatgagtaccagtcagagacatgggacagaacacgtcatttcagacttttgaccatcgaccgcttgacagtcaacgcgtgacgtgggctattactcctggacgtgtcccaagtccctggagaaccgggatgtcttccagccgtccagacctgggtccca

SEQ ID NO: 647805 - DNA, 384 bp, Homo sapiens
aaaaaaaaacccaagaatcacctgtattgatttcatcaaattatgaaaggaattcaagtgattaaagtttttttagatatacaagacaagaacgttaacttgttcagaatttcaaaatattaagaaagaatgcattcatatataaatgtgatagcatttaatccaaatctgttccccagagcaaaaagctgccactagcttaacctctctatgctttgcttctttcatcctaaaagtataggtccactgcagggattgtaagagatgaaatatgaaaattgttttacaaatgactatctcatacacagcccataataccactgctattattaccttgaagtagtgttaaaaagtctgcaatttcagttctcactagcaaacaaa

SEQ ID NO: 647806 - DNA, 290 bp, Homo sapiens
gctcgacaaaaatctttcctctgcctcgtatcacttattaatgataagaaaacatggctgggcatggtggctcacacctgtaatactcgcactttgggagacccaggtgggtagatctcttgaggactggaattcaagaccagtctggccaacatggcaaaggcctgtttctactaaaaataaaaaaaattagccaggtggtgcacacctgtagtcccagctgcccgggagctgaggcggaagaactgtttgaacctgggaggcagaggttgcagtgggctgtgatcacg

SEQ ID NO: 647807 - DNA, 260 bp, Homo sapiens
tatgcgctctgcatacatgtgtccatagtggtccactgcaaggctctgtatggctgccctgggtgccccatctcacctccgaacacttgcttattgaaacttctaaaacataggcttggcctcccaggggtgttgggattacaggcgtgagctacccatgcccggccagaatggtcgacctcttggagttgttgggagaattaaatgaacaacacatatggagttgctttgctgctgctattgaaacttctaaaactagg

SEQ ID NO: 647808 - DNA, 449 bp, Homo sapiens
  misc_feature (130)..(130): n is a, c, g, or t
ggctttgctcacgaacacaaagcacgctcctgactatccgggacaggctcttctcggcttccatattggtggcagtggtgcacactgggcagagtggagacatattccatgtgaggtacaccttaacggncctgggacgccggaggacagggcattgtcctcagtcagatacaacagcatttggggccatggtacctgcacacctaaaacactaggccacgcatctgatctgtagtcacatgactaagccaagaggaaggagcgagactcaagacatgattgatggatgttaaagtctagcctgatgagaggggaattggtgggggagacatagccccaccatgaggacatacaactgggaaatactgaaacttgctgcctattgggtatgctgaggccccacagacttacagaagaagtgggcctccatagacacgtgtagcatcaaa

SEQ ID NO: 647809 - DNA, 406 bp, Homo sapiens
taccatcatgagatcatagcactgtgattagcttttgacactgtgtctcttgttacgtgttgtctgttgtcatgctgagagcacatttacattaaagattcattttgttccttttatttcccttgtattcttggtcaagtgattcatttgcataaacattactgatctctgcatactgatttggggttaactctttccttctaactctaaagaaaaaatatttgctgcagaattatcctcagaagaggcttccctggccttcatctacctatgcagtctgaccaagtatggtacattttagccgtattcaaggacacatctctctacccaggtcattgctgtcactagcagctttcaagtcaaacctgcagcactaaatatttgtatatcctggttactctacata

SEQ ID NO: 647810 - DNA, 362 bp, Homo sapiens
  misc_feature (72)..(72): n is a, c, g, or t
  misc_feature (76)..(76): n is a, c, g, or t
  misc_feature (101)..(101): n is a, c, g, or t
  misc_feature (111)..(111): n is a, c, g, or t
  misc_feature (113)..(113): n is a, c, g, or t
  misc_feature (124)..(124): n is a, c, g, or t
  misc_feature (152)..(152): n is a, c, g, or t
  misc_feature (155)..(156): n is a, c, g, or t
  misc_feature (169)..(169): n is a, c, g, or t
  misc_feature (230)..(231): n is a, c, g, or t
  misc_feature (233)..(233): n is a, c, g, or t
  misc_feature (249)..(249): n is a, c, g, or t
  misc_feature (264)..(264): n is a, c, g, or t
  misc_feature (271)..(271): n is a, c, g, or t
  misc_feature (338)..(338): n is a, c, g, or t
gggacggagtctcactctgtcgccaggctggcgcgattttggctcactgcaacctttgcctcacgggttcangcgnttttcctgcttcagcctcctgagtngctgggactncnggcacacgccnccatgcccagctcatttttgtatttttngtnnagatggggtttcnccatgttggccaggatggcctccatttcttgaccttgtgatccgcccgactcggcctcccnnantgctgggattacaggngtgagccatcaagtntggcganagagattgtttttaaatgagggtgggggcgggtgtccttagcccaaagcttgtgccagtttctatcngaaataaatgcccccaaaacctca

SEQ ID NO: 647811 - DNA, 145 bp, Homo sapiens
atgtctcattgtgtagtgtctgacttaatctaaaaccaaacccatgttgaaactcagtactttcccctttaaaaacaaaccaaaaaaaacaaacaaaaaagaaacttgatccatatatcaaaattaattccagtcagattttact

SEQ ID NO: 647812 - DNA, 271 bp, Homo sapiens
gggcccaagaaaaaaaacagctttcaaggccctttttgcggtttttcaggggggcaaaaaaaatttggaaaaggaaaaagctttagtttttaacaaccgcccctcctacaagatttaaaaaaaagtttccaccaaaatttagtttacaaaaaaattttggggaaaaaaactttttaaaaggtattttgaaacccattaaaacggcttttttttttccagcaagaacccacccaactggttttggctccaataaattttgggaaacccccca

SEQ ID NO: 647813 - DNA, 154 bp, Homo sapiens
cgggtctgtgtcagtgcgacacagcagagtctacgtattcccgccatatatacacgcatatacactggacccatggcagacactgcggacacacagcctgtcacggcccacatctagacgagcacactatcatggaccacatggtagcacacac

SEQ ID NO: 647814 - DNA, 99 bp, Homo sapiens
  misc_feature (63)..(63): n is a, c, g, or t
tctctctctctctggaactggtgggcagcggttaccgcatgtcgctggtgaagaggaggtttnccacagggatgtacctggtgagctgctgaacccgca

SEQ ID NO: 647815 - DNA, 468 bp, Homo sapiens
gtggacctcctggggtggacacaagaactgctggatcttatgcagcgggaacgtggcaagctggatggacaggacagataagactatggcttcttcacctggggaagtcacacagcagatcatcctatgtccagcaagacttcatgcctgaagacagctccaacacgtttacaaacatgaaccagaccacaacatgtggcctggacagtggtcctccgaggctgcctttggaaaggctgaccagggatgtctacccttggggcccctccatgtgtgcgccctgtccacctcatcactgctgaaggtgtagtgcaggtgctgctttctgcagcggccttaagttatcacgagggcagcacagcacgcccgtcgccaggcaggcgatgcactagggcaatctagcatgttgatcggtaaagtggcatctttaactacaacatcatttcttgcatgaaataaacttagtat

SEQ ID NO: 647816 - DNA, 803 bp, Homo sapiens
  misc_feature (54)..(55): n is a, c, g, or t
  misc_feature (135)..(135): n is a, c, g, or t
  misc_feature (139)..(139): n is a, c, g, or t
  misc_feature (143)..(143): n is a, c, g, or t
  misc_feature (199)..(199): n is a, c, g, or t
  misc_feature (248)..(248): n is a, c, g, or t
  misc_feature (261)..(261): n is a, c, g, or t
  misc_feature (269)..(269): n is a, c, g, or t
  misc_feature (293)..(293): n is a, c, g, or t
  misc_feature (330)..(332): n is a, c, g, or t
  misc_feature (336)..(339): n is a, c, g, or t
  misc_feature (341)..(341): n is a, c, g, or t
  misc_feature (352)..(352): n is a, c, g, or t
  misc_feature (364)..(364): n is a, c, g, or t
  misc_feature (368)..(368): n is a, c, g, or t
  misc_feature (373)..(373): n is a, c, g, or t
  misc_feature (390)..(390): n is a, c, g, or t
  misc_feature (394)..(394): n is a, c, g, or t
  misc_feature (417)..(417): n is a, c, g, or t
  misc_feature (430)..(430): n is a, c, g, or t
  misc_feature (436)..(436): n is a, c, g, or t
  misc_feature (440)..(440): n is a, c, g, or t
  misc_feature (454)..(454): n is a, c, g, or t
  misc_feature (465)..(466): n is a, c, g, or t
  misc_feature (479)..(479): n is a, c, g, or t
  misc_feature (484)..(484): n is a, c, g, or t
  misc_feature (490)..(490): n is a, c, g, or t
  misc_feature (501)..(501): n is a, c, g, or t
  misc_feature (513)..(513): n is a, c, g, or t
  misc_feature (521)..(521): n is a, c, g, or t
  misc_feature (594)..(594): n is a, c, g, or t
  misc_feature (726)..(726): n is a, c, g, or t
  misc_feature (801)..(801): n is a, c, g, or t
aggtcccggcccggcggcggcagccatggccggggggccgggcccgggggagcnngcacccccggcgcccacacttcttgtacgaggtgccgccctgggtcatgtgccgcttctacaaagtgatggacgccctgnagcncgcngactggtgccagttcgccgccctgatcgtgcgcgaccagaccgagctgcggctgtncgagcgctccgggcagcgcacggccagcgtcctgtggccctggatcaancgcaacgcccgtntggccganctcgtgcacatcctcacgcacctncagctgctccgtgcgcgggaaatcatcaaagcctggnnncctnnnncnccgcttctgtncccaggcaccantgcnccgangcccagcagcatccctncacncgctgaggccgaggcctggagcncccggaagttgcnatcctnagcntccaccttcctctncccaacttttnnaggctcccaaaancattnagggcntgaactcggcntggtctcaagcnctgcttcnctgtggcctccaccgctatcttcagcttctttttctactaagctaggctcagagagctcagtgtttatactgnagggagcccgcccctttccgttttgctggcccctctgtgagatttcccggggcaccacaacttctcggaggagctcaagatcggggagggtggctttgggtgcgtgttaccgggcggtgatgaggaacacgntgtatgctgtgaagaggctgaaggagaacgctgacctggagtggactgcagtgaagcagagctttctgaccgagntg

SEQ ID NO: 647817 - DNA, 315 bp, Homo sapiens
atcgttagaataaagagtggaaaaagaaatatgtcagcctgtgtgaaatgggtgctgactatcatcccagtttaatgattacatgcagaatgttcacggtaaggagattgaacaaaagaaaaccactgtgaaagtcccaggaaagaggccaccccgagccacgtcagcctgcgcacccatctccagccctaaaaccaatggcctatccaaggacatgagcagtttacacatctcacccaattcagacacagggctgggtgactccgtatgctctagccccagtatctccagcaccaccagccccaagctcgaccc

SEQ ID NO: 647818 - DNA, 154 bp, Homo sapiens
ttacctgttgggggaaacaacattggacgtaaaagtgtgcactcgtaccgcagcggcaggccaggacccttgtctttggtgcgtctatgattgataagcgacccggccctccaggggattccctgaagcggactcttcttggcggccaaactct

SEQ ID NO: 647819 - DNA, 153 bp, Homo sapiens
tatgagcggctcacagacacaggcggagtatacagctgcatctgtgttacctgggtgtgtggatctaagtgtgcatgcgtgtgctgcacatgtacatgggggcatatacctaacgtgagcaggtgggtgcaagtgtgtgcatgtgtgagcacc

SEQ ID NO: 647820 - DNA, 904 bp, Homo sapiens
gggaagaaattccagacacaccatgtttaagagctgtaaaggggggccaggcgcagtggctcactcctgtaatcccagcactttgggaggccgaggcaggtggatcacgaggtcaggagatggagaccatcctggctaacacggtgaaaccccgtctctactaaaaatacaaaaaattagccaggcgtggtggcgggtgcctgtagtcccggctacttgggaggctgaggcaggagaataacttgaacctgggaggcggagcttgcagtgagtggcatcgcgccactgcactccagccctggcgcgaacagggccgacgacctgtctcaaaaaacaacaaacaaaacaaaaacaaacaacaaacccctcgagggcctctctatattcccgcggggcgcgggagaaacaagcgcgcgtacatcgcagaacgcgggccaatggggcgccataagcgcctgtgttaccgcgtgaccccacaattcttctcgtgtgctccccaacgagggcgcaacaacttcgcgcgcgcggctccccccctctaatatagagggagagcgcgcgacatatacaatctccgcgatattaaagcccgggtctcaccctgggcctttagaaccccccgcaaaaaaacccatcccctcccaccccccaccaccaccccccccccccccctccacccaccctccccccacccaccccaccctcccacccacacaccctccccccccccccctcccctacatactactaatgtatcacctacacatccaccacaagactcaacacactcactatacacctactcttttcacattcctcctctatactcatagacctacaaccagcacgccccacacaacctcactccgacacagcaaacgtatacccaccccacacacccacc

SEQ ID NO: 647821 - DNA, 325 bp, Homo sapiens
  misc_feature (48)..(48): n is a, c, g, or t
gagatggagtttcactcttgtcgcccaggctggagtgcaatggcacgntctcaggtcactgtaacctccgcctcccaggttcaagcgattctcctgcctcagcctcccgagtagcggggattataagcatgcaccatcatgctgagctacttttttgtatttttagtagagacagggtttcaccatgttggccaggctggtctcgaacttctgacctcaagtgatacacccaccttggcctcccaaagtgctgggattacaggtgtgagccgcggtgcccagcccgatttactaactttctgaccctaatggtgagtggggttga

SEQ ID NO: 647822 - DNA, 335 bp, Homo sapiens
  misc_feature (304)..(304): n is a, c, g, or t
  misc_feature (326)..(326): n is a, c, g, or t
ccatgtggtaatctccctccatccctttattttgagctctattgtgtgttctgcacatgaaatgggtctcctgaatatagcacactggtgggtcttgactctttatccaatttgccagtctgtgtcttttagttggatcatttagcctatttacatttaaggttaatattgttatgtgtgaatttgatcctgtcattatgatgttagctggttattttgtttgttagttgatgcagtttcttcctagcatcgctggtctttacaatttggcatgtttttgcagtggctgataccggttgttccntttcaggggaaattcctctagnaagttcgaa

SEQ ID NO: 647823 - DNA, 1069 bp, Homo sapiens
  misc_feature (865)..(865): n is a, c, g, or t
gccccgcttggctctacgtaagtgtatcttcctccaactcccatcactgcacgtgtaacagaggtagcccatatggtagagggacctgtctagtaggccatcgggtaactgtgtgctgagaaaggggatactgacgtgactcggcatactctagtgacttgacaacgtaatctgcattaccatgtcacaacgacagcatactcataaacagcacctcactcgatgggccctcagtgttcccactaccttagatacgggcgcacgatggtgcgtaatcagagggtgccggagtcaatcacactcaacttgagattaagtatgagctacgtgccccaaggaggcatggagtgagtcctcatagcatgattatacaaattgcgcgtaacaatgccgtagaattaccttaaatggcatacatggccggtgtagcctagctacaaggagtcttcaataatggccccacttaggtggtgctggctatgatcgcggaagacgcgggaaagaaggtgaccgagctcttacttgcgaatcgaagggctagcgagtccagacatgttgattttctcctaaaggctccctaaggaacgtaagagtagcaggtctaacgcaggtaattcatgtcgccagtctctggtggcaggcagaacttagtcaccacgaagcactaccctgttagtctccgacagcctgggtgacttgggtaccacgctaagagttatccttggtgcacttcgggctacggacatgagttgggaatgtaacttgggtgcgatcacgacgctgttactattattttcgaaaaaaagcgccccggtaccaaataagaatacacgaggcaacacattgaaggttgcagacttccgcntagaatgcgaatgggccttgtgaaagaatacactatttgtacattacataacactggagttcacacttactctgggtttcgtattggaccgtggtcaagaacaggcacttactctcgcttaaatagaagaacgacactgtaactccataatgatgaagacctggtttcagggcagaaggtaggctgtgggggaaccatctaaca

SEQ ID NO: 647824 - DNA, 732 bp, Homo sapiens
gcctcgtgccgtgcttatgcccgcgcgccaggacgcctcctcccgctgctggcccggccggcggccctgactgcgctgctgctgctgctgctgggccatggcggcggctgggctgctgggtgcgcccgggcccatgtgaggcggggtggcggcggggacgggccccccgggagacggcgaggacggacaggacccgcacagcaagcacctgtacacggccgacatgttcacgcacgggatcagagcgccgacgcacttcgtcatgttcttcgcgccctggtgtggacactgccagcggctgcagccgacttggaatgacctgggagacaaatacaacagcatggaagatgccaaagtctatgtggctaaagtggactgcacgagccactccgacgtgtgctccgcccagggggtgcgaggataccccatcttacagcttttcaagccaggccaagaagctgtgaagtaccagtgatcctcgggacttccagcacactggaaaactggatgctgcagacaactgaacgagggagccagtagaacaccacgagccggaagttggcacctgtccagttgccccgatgctcaagcaagggggtgtatgagcttctcagaaagcaaacttttgagctgcagcgttgcacaaggaggaccactttatcaagttcttcgctcgtggtgtggtcactgcagagcctggttcaacttggaagcaggtggctctgggcttac

SEQ ID NO: 647825 - DNA, 749 bp, Homo sapiens
gaagaactatgtagaagaagctttgccgcttttgtgcctctcacaggcgcctgtcattgccatgggagggacgatttggggctctcctccttcttctcttttcctcctttttcttcctcccccttctgccttccttcttttcttctttctcctcctcttttctttcgcttctttttcttctctttcttgtctcttctcttcctttctttcctcccttctctcttttctccttctcttctctcctcttctccttccccctccttcccttttctcttttcttccttttctcttttctccctcttctgttcctttctctttcctcttctctttctcctctctcttcctctctcctgctcccttttcccttcctccctcttcttctttcctccctttttctgcttctttctcctttttctccccttctcttgctcgcgctcttttctcccttttccttccctctctcctccctcttttccctctttcctctcctctctctcgtctctttcccctcctcccccctcgtcttcttctcctccccttttccctccctctttcccttctctctgctttctctctccctctcttttcccttcctattttcttcctccttcttctttttctcccctctgttcctcctctcgttctctctttcctctctttttcttctctctctcttctcctctccctctatccttctctcttgcctcctctcctttctctcctctcctttttctcctccctctcttccc

SEQ ID NO: 647826 - DNA, 1359 bp, Homo sapiens
aatcatcggactaatttacagctcagaacagccctaggctccctaattatattcatactacgtcactgctctagcgtgccctagaggaagcgtatcaaatagccatccgtgagcgcaatcaatacgttagatatgacgtagacattacacaaatagcatttgatagataaatgataccttcgtttacaggactcacacattatgacgtcccatatggccctatgtctgaatcgccgcatcaggttcgggtcaatagctacttgaccgagaagtatgtcttgaatggacataggtcagtggctagtgtggtgataatgagcgacctctacgaacttcacttactgcaaattcgcctcgtgcacatgaatcgagccaattagacactaaccgccattgcacttgatactaagtcgcactatggaggcataattaatacatatacgcttcgctagtcttgacctataacggacctagagacagaacgcctaatagatctcggcttcattttagcgatatactttcttctccaatgtctagagctcgaacaataaggcctctgtcaggtaaggatagaagctaaggcgccaagttctgtccatgtcccagatatggcccccgacatggagaagcttatcaggcaagggcgcaagggattcgatgtatgccgtgcagtaaagtgcgtccacccagctgaggaaccttttatgcatttgcacgttcgaatgtaactctatttatccgtaggtcgcataagggccaaacaacgttcgaaaaagcattaacggtaaatcagccagcatccatgctaggtttccgaccaatttcaatataagttcccgttcttccttcaggctgggaaacttttcagaaagtcttcttaatattcgcccaacgttaaaattaaggcatctcctttggtgaactggagcggttcccttaaggcccacatggcgcctttgcgggcgttaaaaaccattctggctcgtttaatcggctcaccccacaatgtaaatttaaaacagcccgtaacctggggggacaggacacattcgtccttggtgggcctaaaagttaaaacacccaccggagtcggccccttgggtatgtcacaatattaatgccacgtttcctgtccctttaactgtttaaccagggggaactattccaaaggtgttaaacttaaagggtcgagcaatggggtgctggtaattaactttcccgctgtactaaacagttgtatttttataacgcgacaagtagcagcgaaattgggggggtttcccactttccaacccaaccacgtcattttttatcccaacatcagtgtaagagacccccttcattttcgaaccggaagaa

SEQ ID NO: 647827 - DNA, 166 bp, Homo sapiens
tgggaaggggtaccccctcaaccccgaggtagtggaccaggaggagagaggctacctgagagggaaggaagcataaaagggacccgctgcagactcagcgcaaagggaatgccctcggtgctgggacctgtgagcactacaggaagaaacagcgaacgtagtgaga

SEQ ID NO: 647828 - DNA, 135 bp, Homo sapiens
tccagaagactgtgctcctgttgaactgaccccagctggggacatcaggcacaggagggcagtcctgtggtataggcatggaactgaacggctctagataaacagtgggagcctgctatggcagcctggccccta

SEQ ID NO: 647829 - DNA, 253 bp, Homo sapiens
gctgggccaggaatatgagatggcgccgaggttgataccggacagtgacaatcaatactgaacaaaaagtatctgacttctacgacattccaggacgagattagagatctggcgaaatttggacagtgtctttcgacttgtagaacagaaaactcgtaaaagtctgggcaggtgacgttcttcaagggcatattcagcatacagagaaagagaatatccggcaggagattagcatcatgaactgcctccacca

SEQ ID NO: 647830 - DNA, 387 bp, Homo sapiens
attcgcggccgcgtcgacggcatgcacctgtagtcctagctactcgggaggcacaagaattgcttgaacccgggaagcagaggctgcagtgagctgaaatcgtgccactgcactccagcctgggtgacaaagtaagactgcatttcaaaaaaaaaaaaaactagccaggggtggtggcacacacctgtaatcccagctacttgggaggctgaggcaggagaatagcttgaacccgggacgcagaggttgcagtgagccgagatcgcaccactgcactccagcctgggcaacagagcatgactctgtcttcccgccaaaaaaaaagaattattgctggaataacataaaaaaaaaaaagtcgacgcggtcgcgaatttagtagtagta

SEQ ID NO: 647831 - DNA, 1187 bp, Homo sapiens
  misc_feature (1074)..(1074): n is a, c, g, or t
  misc_feature (1116)..(1116): n is a, c, g, or t
  misc_feature (1141)..(1141): n is a, c, g, or t
  misc_feature (1149)..(1149): n is a, c, g, or t
  misc_feature (1172)..(1172): n is a, c, g, or t
  misc_feature (1175)..(1175): n is a, c, g, or t
  misc_feature (1183)..(1183): n is a, c, g, or t
tagcactaaatgcccacaagagaaagcagaaaagatctaaaattgacaccctaacatcacaattaaaataacgagagaagcaaagcaaacaaattcaaaagctagcagaagacaagaagtaactaagatcagagcagaactaaaggagatagagacgcaaaaaacccttcaaaaaatcaatgaatccagggctggttttttgaaaagatcaacaagaaaaccctgtttggctagttcacctggctcatctgatggcaagttcctatcttgagaggactatgaaattaaaaccaatacaagtgccacaaataacatacaacattgtaaatcagcacaatttgtagctgggtgaatggaagaaatagttctattcatcacttcctcattttccctaaatctacaatctccagatgtcactactgaattaacagccaacaattccacaacattacctgggagacactggccctttttcttcctcttcctcatcatcactttcattttctgtaaataaattcagagaagcaggtcacattaagcaattcatacttcacatatgaacaaatcactgtccagtcatagcacaaggacataactattctcagtgcaagaataaggattctgacaggaatattctagggtgtcctagattaactttggtgagaattagatgaccctgctttccagacccacaggccaaaatctccctctacgtgtagaccataatgccatattccctgcctgagtcaaagttaaacaaaatttttttccccaaaaaaatctccaaaaattggtcaaacaattttctaagagtgttgctgcgatacggacttatatcaccaggtaacatggacattaaatgtttagaggcatctatacatgaaacacgactgatagataaatttgaacaactcttgctttaaaaagaatctgtgatttgggaggccaagacaggtaaatcatttgaggtcatgagttcaggactaccctggccaatatggggaaaccctgtctctactaaaaatacaaaaattagccagatgtgatgttgtgcacctgtggtcctagtaactnaggagactgaggcaggagaatcacttgaatcttgggaggcanaggttgcaccaagccaaagatgggngccactgnactccagcctggggtgacagaancangacttccntcgc

SEQ ID NO: 647832 - DNA, 161 bp, Homo sapiens
tgacgggcgggctgggaggatagcttgaactcaggagtttgagaccaaactggttgggccacatagcaagacttcatttctataaataattttaaaattagccagtcatggtggtgtacacctgtggtcccagctactccagagactgagatgggggggaa

SEQ ID NO: 647833 - DNA, 170 bp, Homo sapiens
caatgtgactgactgtgaatggcaacgcttattcgaataggcgtatatatactgctgtgctgaagtagccctggcatgtgacatcgatgttgcacttgaactgtccgccatataacaacataaggaatgttctccagtagctaatgctctgccctacagaggtggtatag

SEQ ID NO: 647834 - DNA, 294 bp, Homo sapiens
ctctgcgcggccaggagatgtcctattttaaaatgttatccttggccccatacatttcacatggatagatcttttatcatgatttgtatctgggctagacatttgggtagattgagtgggtatcataaaaggatgtggaattccttcctcagcctatccttgacacctgaaatcccactcattccttttgcttaagtcattgttttgcatgcattacatacccagtgtagtactgtcaactacctaagtaattagcatccacctctaagttattctagcttattttccaacaca

SEQ ID NO: 647835 - DNA, 232 bp, Homo sapiens
tcgagccggtaccagacgtccattctgcatatggagcagtggttggtagttctccttggagaggtccttcacatcccttgtaagtggattcctaggtactttattctcttggaagcaatgtgaatgggagttcactcatgattaatgataaaggggatatcaccaccaatcccacagaaatacgaactaccatcagagaatactacaaacacctctatgcaaatggacgtct

SEQ ID NO: 647836 - DNA, 218 bp, Homo sapiens
acggacacagaggctgatggatactttgtgaaataacactgtgagagtttgtgcacatttctttggttgttttcgtcatctgaatccatggctgactggctcccactctgctattttaaaaataaaatgtcctttcttctatcgtttctgtggttttgtcgccaacccatatttgctggaataaggtagtaaaaaacatacactaaagtctgaagtcc

SEQ ID NO: 647837 - DNA, 245 bp, Homo sapiens
acaggaccctatgatacacccaccaagttgttcttaaaaagttccatccctgaatgctcaggagactgatttgagtaacagtaaaactctggcctcccacacagtcggctctgtgtgaattcctctttccctatcgcaattcccccatcatgataaatcggctctgtctaggcagcgggcaaggtgaacccattggacggttgccttattacctgagcctagcccaggggtatagggtggtatag

SEQ ID NO: 647838 - DNA, 284 bp, Homo sapiens
gagcctgatcattacaaaggttgtatgtatcagaagcagagaccacatgccctgtggtaacagtaagggtatatccaagagaatctctcctgctgaaaaatacgctttctgccacctacacattgctatttaggaagtaaaatttgcttcatgtgtcatgaccccattagtcagtgttacagctgtgtagctgataggaagtatatctggcatattgacatttatacacgtttgcataaagcagattttaaaatatagtaacatccatttttttcccttgaaag

SEQ ID NO: 647839 - DNA, 191 bp, Homo sapiens
ggccgagtgcatggctaccatgacttttaaagaattagtttgaaaagccctttctggatccatgtgaacgctatttcatctttctgtcattctactaatccacattgttatttctctagatgctcttctcccagcttgatgactattattgggtctaggaacttattacccccatatgagtggattcttgt

SEQ ID NO: 647840 - DNA, 337 bp, Homo sapiens
  misc_feature (16)..(16): n is a, c, g, or t
  misc_feature (40)..(40): n is a, c, g, or t
  misc_feature (45)..(45): n is a, c, g, or t
tttattagtttaatantattatgtagtttttaaatgttgntttanattttttttttgaaattgtaatatttgtaatttttatttttaaattaaattgaatattattttatattgtattggatttttatatttgaataattttatataagggaagataggttagtatttttatggattttttttattattattggatttattttaagtatttttatattagatagtgttatgtaatgtagatatgatttttttgtgtaaattatttatttgttgtgtatattgttttataatattttagattttttaatttatttatttgtattaaatataattttta

SEQ ID NO: 647841 - DNA, 517 bp, Homo sapiens
ttgggaaagggctcgccctcccgttggggggagaatctctttttgcccacgctggggaccactttcatgtttgggaagaaattttggggcgctgtggggtctgcccgctttcaggaacccattatttcattatggaataagtccgccagtgcccaagcacccccagccggaatcggggacacatttgggggggggtttaccctccctcccacccccattatggaatacaaaactccccccgccagcatcaaaatgccaggcaggttggccccccaaaggctcctttttcaaaccctttggaacccgcggttgaatgtcccatgcccctccccctttttggagggccccatcattaaagcgggggtcatcggagtttcttgttttgttggcgggcccccgggaaaacccttttttcctggccaaaaggaattggaagaccttttttttttttaaaaccaggctgcccccccccagctccccccccagttgagttcccttaataaatggggttaaccta

SEQ ID NO: 647842 - DNA, 207 bp, Homo sapiens
cagtatgatgctgcgacactatcatcatcaacacagactcatagataagtgtaagctgccgaagttgacccagttccatggggtcgtgtcttggaatcaacaaatactgagggatgggttaagagacagctccatgggcatggggaaggcactgacacagaggactataaaacatccttctcttattcaaacaaaaaaaacaaaaaa

SEQ ID NO: 647843 - DNA, 697 bp, Homo sapiens
ggcctattgttggctgtcatcaatggcatccggcctgggcaggaggacttgaggttgccatttcagtgccgatacatcaatagcaacaagaagacagaaaaacagtattaggtacccctgaagcttttgctgggtgccttaccatgagcaggatggcacagtaatggctgccctaaatggtgggtgtgcctgtgctttggacatgatagctaggactggtagaatgcattcgtgcagacaggggcacaaatggaaaatgggatctggtttgacgcaactggtggaatccccgtgggaccagtgactaaaaactccagatggaactggacaatagaatactagaagatgtgcaattacttttgccagaagcgactacgctgataagaagatctctccaaagagagacaatgggattgtgtggagaaaattgactagctggtatgccatgtaacttattccatttgtcaggcaagaggtttaccacattagtggacgaaaatagtggaaagcagattaaatgggcttgatcctgctacctctgaagatagttgatgtggtatagactggaattgagctagggagtgatgccggtgatctctagtgaatctccagaagatctggagagttgtactgatcatatagaatcaagggttgatgggaactctacttggtcaggtcctttgtgagaagagtaact

SEQ ID NO: 647844 - DNA, 980 bp, Homo sapiens
ggtcaatggctgcagtagcgtttcttcatgggagtgctccatgtggtgccatcatgaccgacagtggcatgcccattgtgcctggagacccctccacctcaggacaggtgctgccccagtgacgcgacttgtcctcgggaactgaatctcccgctggtgctttgtgacttgagggtcccttgtgtgccttcttgctctcctccaccattgcatatgtaggtgtacgcgcatgtgttcgctcgacctgagtgcttatgagcttgtagtttgtatcgatgttgtgcatgaatgcattccccggccagatggcagagcgcgaggcaagacaaggcctcgagagtcgaggggtagtcagggactggtgccataatctcactgtctccaggtgttcacccgagtgcccgtggacactcaaggaccatgaacgcaaggacccccatccgaagggacttcggggaatgccctatgttgacaccaatggggccacaatggtggggtcaattcaacaagcaacggggacaaggcgtttgggccacattgtgcgccaatcgatggccaatgtgaggtgttccaagatggttcttggggaggcgccccttttgacattaggatgggggcgaccttgcgtggcccctgtccaaagggcccccccaatgacgagtgtattacaccttgtgcccgtcccacatttgagccgtccgtatcccgcttctcccagagaacaggacccatgtcccccgggtcgatggcgataatcgcgttccaggcaccccggtgggccaacggttgcgcccgctttccagtggtcccgcggcgttccgccatattgagttgttgccgcaaggaggctttccgttgggccccgttgaggctctttttccacccgttcttttgggtgaagagccgcgccccgttccccttgtgtcggtaactgggttaggccgtacgcggctatggttctttggggggggacaggccaa

SEQ ID NO: 647845 - DNA, 163 bp, Homo sapiens
ttttaaaaaaaggggataaaagaggcctgaatgaaaagaatgccttttcaaaaaaagggttcaatgaaaaacaaaagttaaaaaaggtaaccctttttaggtaacccgctgcccttctttttgagtgggaaaaaatttaaataaattgggtttttttttgcca

SEQ ID NO: 647846 - DNA, 131 bp, Homo sapiens
tgcatggtgtgcacttctgtaactcccagtcatcctggtcaagggatcttcgatagacaccactggggtagtcttgatggaggattgtacaggtcagacagctggtcaggcgagatgtactgaagagatcg

SEQ ID NO: 647847 - DNA, 121 bp, Homo sapiens
ttcgagctcggcacccgaccctgtctcagaaaaataaatatcccagatcttttcacgtgcaagtttgtgaacaacagaatgaagattttaggcatttaagtgttgcctactaatctgttct

SEQ ID NO: 647848 - DNA, 157 bp, Homo sapiens
cgcagaagccacgtgcagtcagatcccaagccgggccggcggtgcaagatctggagtccagccgtcagggatagcgctacaattccattctctgcaattagtacaattcgttctgtcaagcaatcctgctccaagcttcaactgcaatcaagctggc

SEQ ID NO: 647849 - DNA, 543 bp, Homo sapiens
ctggctctaccttgtttactttaatctcttaatcctgtcatcttagtaagctgagaatgtatgtcgcctcagcaccctgtgatgatgcgttaactgcacaaatggttgtaaagcatgtgtgtttaaacaatatgaaatctgggcaccttgaaaaaaagaacaggataacagtaatgttcaggaaacaagggagctgaccatcaggtctgactgcctgagagccgggcggaacagagccatatttctcttcttacaaaagcaaataggagaaatattgatgaattctttttctcagcaaggaacagccctgagaaagagaatgctttcctagggggaggtctctgaaatggccactctgggaatgtctgtcttatacagttgcagataagggacgaaataagccccggtctcccatagtgctcccaggcctattaggacgaggaaattcctgcctagtaaatttcagtcagaccagttttctactctcaaaccctgtctcctgataagatgttatcaggagacaaggtagagccgaggggtacc

SEQ ID NO: 647850 - DNA, 120 bp, Homo sapiens
aacctttcccgtcaggaacttaaatgggtgaccctgcttttcctcccatcttttccgtacttcgcaatctccaagctgtggccccattatgaaattagcctttttgattcacgcccctga

SEQ ID NO: 647851 - DNA, 136 bp, Homo sapiens
aagtgaagtattacagtcaattctgtggttgtaaatagttgctcttgttctatacctcgcaagacaaatctactttcacattgaacagctgtaagacaggacatattgagatgccatgccctatgctaaggtattc

SEQ ID NO: 647852 - DNA, 669 bp, Homo sapiens
gggagggtgctcatagagtaatggaataccctgtcattttagcacctcttttataatgatactgtgtcctccccttgttcagtgctgccttagtcatgggctctggctcccggttctgcaatcgtgctagtgactctcaaccctctctgcttgtctgtatcttgggatgatatacgactcccacaggtctaggtgtgaggcgtgggtgcgtgggcatcagccaggattgcacgttacagtctttttctctaggagctacaaagatctcttcctgttactaatatggtcgcacacccatgcagcctctcttctgcacaaccggggccctgcatgtcagatcggcgtggtctgcagggggtagctctgtgccttagtggctcttggcaggacactgagggccatgcctgtggtgtagcccaggctcttgccactcccagggaggggaagggctgctcagctcaaggtgtcctgttcggtagagcaagtgtcctctgacagccgtgtccccggacagttctagacacccttggggatggcactccacacacgacagagatgcaggggccagggaagcccagcgctcggtgcccttcgtccagggttaaaatcggcctgtggggtgtggtgagtaggcaggtgtgcgggtgtgatacgacgtatgtttcctaa

SEQ ID NO: 647853 - DNA, 117 bp, Homo sapiens
  misc_feature (51)..(51): n is a, c, g, or t
tctgcttagaccgtgttatgcatgctgtcctcagtagagagctgtgtgtantcagcagcagtgactggggtaaacggcagaagaatgggaggcagcagtcatgagcatggtcagcct

SEQ ID NO: 647854 - DNA, 194 bp, Homo sapiens
  misc_feature (70)..(71): n is a, c, g, or t
gcaaggcacattgcagagcccatgctgcgcagagctgacactgcgcaggtcccaggccctcagtgtattnntatgatacctgccaatactgtaggggagttcttggcatgtcttcagccatgtcttgagttttttattaaggacaaccaggacagggaggcagtctaactctcactctctatagtacacactgc

SEQ ID NO: 647855 - DNA, 201 bp, Homo sapiens
gaactagactcgagattttcttttttttttgttaggaattaataacactttgtatttagcacattcacactagaaatggatctaaattatcattcgttaatcacttttctgtggtctacagagatcacatattaaaaagttcagcgttagaaaagtattagcatatgcagcagttaatacaagtgttacagagctcgagcc

SEQ ID NO: 647856 - DNA, 196 bp, Homo sapiens
  misc_feature (138)..(138): n is a, c, g, or t
agatattgactgtactttaagacaggactttcagaagcagggaatttagttgttgccagagaggtgtgtcaggacccgtggaaggagcatgcggacatgaggtggaaggctttgtcccaacactgttacaacactttntgtacatgacgcaaaacatctttaaaaaatccttataaaattcttttataatattgtt

SEQ ID NO: 647857 - DNA, 216 bp, Homo sapiens
accatgccaagcatgacttcacactcgccacacagatgctggcggtcgttctgccactgagagggctgctgaggatggagcctccagtcatgctcccagcagcagagggctctggggagctggacttcacctattgcaacctcgggtgcgaatactggctgtagtgtgccgtgtgatgcctgaccgccggaactcggtcagaggtggggtacctga

SEQ ID NO: 647858 - DNA, 331 bp, Homo sapiens
  misc_feature (164)..(164): n is a, c, g, or t
  misc_feature (303)..(303): n is a, c, g, or t
  misc_feature (313)..(313): n is a, c, g, or t
agtcagatctctgtgcaggtaaccacagccaaagaccttacctcgttagttttcctgctggaagcctgacttgtacccctacccagcccccgctgaagagcagcccttgggaccatttgaaacaagaggcttgggggaaagccctgccttccgccgtgagtggncttccctcggccgggcaggaagttgtcgacggaactgctgcaggatgggcacgggtggggactgcgggcatggctggcttttagttgttttgggatatgtaaccttgaagggggaattcctgggatcattttgataacntctgttaaanttttatggcaagaggcaa

SEQ ID NO: 647859 - DNA, 335 bp, Homo sapiens
  misc_feature (68)..(68): n is a, c, g, or t
  misc_feature (199)..(199): n is a, c, g, or t
  misc_feature (229)..(229): n is a, c, g, or t
  misc_feature (261)..(261): n is a, c, g, or t
  misc_feature (284)..(284): n is a, c, g, or t
cccacatatgggtatataaatatatactttcctttcccatacacataagggtatgaggccagattttnttcatatacttcaacaaaacaacctatcaaaataaattgaatgcagaaatagataggagaatccaatctctattaagccaaacattaaagaaatttaccaaaatgtaacacaatgccattcttctcatttncttttgttttgggaaacatagctatttttnctttaaaactatagctttattatgggtttgtncttgttattttttaatgtttttngatttctccattttaatttctaataaaatatttaaatatttaaatattaaa

SEQ ID NO: 647860 - DNA, 314 bp, Homo sapiens
catccagagtacagaagccagttgatggaacagaaggaaaggtgtatcatccggcacatctaggtccggccactctttcttcttcactttctccagctgatactttagattttttgctgacctgcaaagagcatctgaagggcttcgttttagagaatgatcttcatattctcttattctggtttcacctatatttgaggattggactgctattgagttggtatcgattcatctgtgtttgggagaagttgccaacgttctctgaggagggtggcgagagctagtgggagttgaagaggggttcttggcccgtt

SEQ ID NO: 647861 - DNA, 200 bp, Homo sapiens
ggggcccaaaatttttccccccccgggggaaaaaaagggggggccacccttttttggaaaggggggggttttaaaaatttttacccttgcgggggaaaaaaaatgggtcccccccaggaacaaaaaaaaaggcccccgggtttttttgttttttggtttttccccccctttaaaaaaattaaaacggtttttgggcccga

SEQ ID NO: 647862 - DNA, 567 bp, Homo sapiens
ttgggtgtggcagggtaccttacccctaagctctaaggccttgaacggatgacctgttaaggcagttactttcaatgtcttgaacgtcaggatatgcggtctctactaccctacctcaacccaaacagctctgctttactctggttgatctactaactctctggattgaacttcattagtgacgttcttacctccttccctgccttcctcaactgaggagagcaccaagtgaaccctggctgccagacgaagtcagacttcgcattagctccagcctctttgctaagccagtcagatgagtgccccattccacagatacatataggttaagccctcttgatccatccagaggcctaatgctgcctctttgcctgattgacctatcactgtttcgttaacactttgctcgcgagctgttgagaccgcagtggcctctgcaaccctaggcagtacctctattcggctcctactctgtagccagttccaaatcttggcctcaataaagaccccccaatcttctgctgtcccctgtgcacgtcttaatccagccctgccagtttgagctct

SEQ ID NO: 647863 - DNA, 329 bp, Homo sapiens
aatcacaagcagagctcatatagccggcaaccatataataacgcaggaacagcaacaaaacatggactcatctgtgaagccaaggctggaatagcaccttcctcataaccagccacgttaatggtcaacaagattcatatgaccagcagctcaggctataatcaacatcaaggctcatatcatgagcagtcaaattatgatcagcttttttgattcctatagtcgaaaccagcagtcctatcattcacaaagggaagactacagccaccacacacaagatgaccgtcgtgatgtgagtcggtctggagtcaatcatagcgaacccgcga

SEQ ID NO: 647864 - DNA, 250 bp, Homo sapiens
cttgtggtcgttctctagcaggatccccctagtattattatctcatcttgttgatcacgtcttgattctttagtaatgttgagtacttccccaggtcattacttttgacctgtgggtgctggatttttcatcacttatagctccatagctcccagctctttttattggcttaggctgtggattcctctggaagatggtagatgtactttaagtaggcaccttaagtcagaaaacaaactaatatgcccga

SEQ ID NO: 647865 - DNA, 392 bp, Homo sapiens
ctcccagttaggaggtcaacgctaagacccttgctctctttccgtcgaacatgagatgccaatttctttctgggcagaggacaaaataaaaattgtctataaactttggccaggtgtagtggctcacgcctgtaatcccagcattttgggaggccgagatgggcagattgcctgagctcaggagttcgagaccagcctgggcaacatggtgaaaccccgtctccactaaaatacaaaaagttagctgggcatggcagcgtgcgcctgtaatcccagctactgaggctgaggcaggagaatcgtttgaacccaggaagtggaggttgcagtgagcctagatcttaccactgcactccagcctggatgacacagtgagactccatctcaaaaaa

SEQ ID NO: 647866 - DNA, 474 bp, Homo sapiens
tcgaccctaagatttgagcatacctatcatctatgtagcccatctatctttattgtctgcctatctatatctacctgcctatcgtcatctacgtatctatctatctatgcatcatctctccattatctgtctatccatctatcatctgtctgcctatctatatctatctaatctatctctatctagctatctatcatctgtctgcctatctatatctatcatctatcttttatctgtctgtctgcctctatctatctatctatctatctatctatctatctatcgatcggtctgtttgcctatctaaatctacttatctatcatctgtctgcctatctatatctatctatcatctatctatctatcttttatctgtctgcctatctctatgtatctatctatctatctatcatcggtctgtctatctaaatctacttatctatctatcatctgggtgatgctcaaagatcttgg

SEQ ID NO: 647867 - DNA, 738 bp, Homo sapiens
tattgcggagctgtctgcggtgtgcgagcggcgcctctcgtctacccggctggcccagcgctcgcaccaccgcttctccctccctgtcgcagccgcgccgccgcgcagggccccagttcacacgccggcgggcagaagccgcccgctctccggaaagtgataccagaattcattgaagtggcgaatttttaaagaaggtaacacaacacgagaatgaacaatgccgaaaccaatcaagcgtcagagtaactacactggatgctgagctggaatttgccattcagcccaatacaactggcaaacaactttgtgaccaggtggtgaacaaccagttggttcgcgtgaggtctgggttcctttgggctgcagatatgtagacagcacaaggttattctacatggcttacccctccatacaaacggtaacacagcaggatgttcacgcacacgagaatcctttacagttcaagttcagagctaatttctttcctgcaccgatgtctctgaggacttaccttcaaggaaataacccagagactcttcttctgcaagttacacgaagccattcttacactgatgacgctatatggccggccagaaactgcagtctttcggcttcctatgctgttcaaggccagtatggagatcccaatcaccgagatccatcacgccaggctaactgggctcaggatagactccgtaccccaggctgtttggcaccactcacccttacccacga

SEQ ID NO: 647868 - DNA, 694 bp, Homo sapiens
ctaaccaagggcctccggtgtttggaaacaaaaagtagtgcctctacagaatacgtgttcttcccacaaggtgtaactgatggacactcctcagaaatactggtctcttcgctttaccgaaggttacccaaaccaggattgtgctcatctcgcatctttgtcagctggcgggtctcaatctaaggaaagcgtccatgacattcaagggtgtatgattcgtcctgcgacgggatttttgtcgcctaagatagcacgcgtcttaaaaagctcctgatatatgcaggaaccctgtcgtaaggattaagaaaccatcgggacatcattgaaggtcagaatagatccatagtcagcacaccattaagatctgttgattgaattgccactgaagcaatcaagctgatatgtccggccgtttctcgatgtgcataccacgtgcatcaagtatagcatgagttacagtagtgacccgatgttgatccgaagtaagcgctccgtcatgtgccatctatatcatcatgatcagctgatgcacgtcagcgagttcctactcagtcgttctgaacacctgcagttctacacgagtgcatagtagtccctctatcagtaagagtgcactttgcaatctacagcataaggttcttgagcctaagtggaacagttctagggtgaactagacacctaagcgccctgtgtc

SEQ ID NO: 647869 - DNA, 991 bp, Homo sapiens
  misc_feature (623)..(623): n is a, c, g, or t
agggcggtggtagatctcactctttgttgtgggcgtgtgttggtctcagcccacgaggctggggcccgccgcgttgtgtgtgccgcactcttttttcttcttgccggggcgcggcgtgggtggtgtggtggggctcgcccctcgccgcctctggtccaccgccgagagtcgttggtgggcgggcgcgccacccccttccgtgtttgttccctcctcgcatcgctcttctgttgtgtagtcgagcgtcgcctcgtcttcgccgcctcgctctcgtctcccacgcgtgggtctcacctcttctgtgtgttgctcgctctccccccacctctctctctctctgtgtgtgaggccgccccccccgcccgcgaggcgccgcctcttctctctctctccccgcgcgcgcgcgatttttcttctgtgtgtgagagataatgtgtgtgtttcccctcccaccgcgcgcttgggtcgcgcgctctctctctctcgttcgccgcccccgcgctgcgctgcacccgacgcgcgctgtgtcttgtgtttgttcctccccgcctctctctctgtgtctctcacctcgtgttctctctctctctcacatcaagcatctccacctctttctttgtagngtgtctctctctctctagaaaacacacacgctctcccccgctctgtgcttttttcgctctcttccccgccccgtcgctgctctcgctccccctcgccgcgcggagatatgatatataatcctccgtcggggcgcgcccctctctcgcgcggcgccgcccccgcgctccccgcgcgcgctgtgcctcctctcttgtgggtgctctcttctcgcgcgcggcgctctcttctctcaacagaagaaacaccaccctcgcggggagagagagagagagagataaaagcacaccacaaacaaaattaatataaacttctctctctctcgctcgccctccgcgcgggcggaggagaggaggggggttcccccaca

SEQ ID NO: 647870 - DNA, 227 bp, Homo sapiens
  misc_feature (48)..(48): n is a, c, g, or t
  misc_feature (62)..(64): n is a, c, g, or t
  misc_feature (67)..(67): n is a, c, g, or t
accactttttgcccctggatgagctggagcacagcctgggggagagtncggcccagggggcnnntgnagtggtgctctgggtgagctgggaaaatacaagaaccaaggaatcatgtcaggccatcaaggagtatatggacactacactggggcccttcatcctgaacgtgaccagtggggcccttctctgcagtcaagccctgtgctccggccatggccttgtgtcc

SEQ ID NO: 647871 - DNA, 178 bp, Homo sapiens
cagtctcctggcagctatctcacaaatagggagtatctgtggcgcttttcccccttccactttcttttcattgttttctgtactactttacctaatgttcacactgaccttcacttttactgggttacagagagtttacgaacttctgatttgccttatgtttttggaaatgaggtcg

SEQ ID NO: 647872 - DNA, 802 bp, Homo sapiens
agcgggctgttgccaccccctagcgccgatggggctgaaggtctctgtcagaggcagtggacgccgcgtgcctctgttccgttcatggatgggggtccgtcaaagtagtgaggaataaggcctacttttatgagatacctatggtgtgaatttacggcaagacgacggaggagtggtagagaacgtggattattgaatgtctaccgggcaagaacgcatgtgggtgagttagcaatgagtaacaaagataagatattagacagggcaagtacaggatgatagggtgtcgggtgagtaatacatgagtatatcatttgtcatgacttgcgatactgcgccgtatattacgatggggggattatgattacgtctgcgacagagtattgcacacggaaactgccagaaaactagtggatggtgaacgcgttggaccctgacctataactcagtgctgcaacattatatgatatctggtcctgacatggatgagcctctgtgaaagggctgttctttcacatggtaggatatccggtgcgactggagcaaaggattggtaatgtaagaggacctaagtagagagagctaggcttgggccgagtgatacgttgagattgatgggatacaggcaattgactgggctcatgttcagtgatggccctataacgcttgacgtaatatcgggagtgcctgggcacttgacactgaaaactgaccacaggggaatgtagaggtactcgggtggccctgaagtggaagctggacagactggacagcttggtggaatcgcctcaatagtacccaa

SEQ ID NO: 647873 - DNA, 376 bp, Homo sapiens
tttcatggacaaatacacttgtcccttctatctgtgaatagtactccatgcattgctccccgcatactatgcccaatgcttccctgcagttagaccacagcatttggataggctctatcatagaatttctcgaatcatgtgcccattgtacttacattagatccttgcagggtgggcactgtggcttatctgacccctgtattccctgtagttagggcagtgatttgcagaaataggcatttaataaacacttgccacataaaaaaaaacaggcaggactaaaatttaagagcaaaaagaaaggtcggaaattgtctaatctaagccccctatttggtaggtacagaccgtcacagggtctgtaccaccaaaatta

SEQ ID NO: 647874 - DNA, 103 bp, Homo sapiens
ccgcggtcactgtcttacagattctgtatagggtctagacacctgcccggtgctggacggttaagtgaaggtgcttacgaataacttcgaaggccttgactga

SEQ ID NO: 647875 - DNA, 434 bp, Homo sapiens
cttttcggcccacctcgtgaccatgtactcacagacgccatgagaaaatgtgactaacacacatgtgtaataaccacacggctcacagacgctgacacagcacacgactcacacagatgctgacacagcacacgacactcacacagaccgctgcacacagcacacaactcacagacgctacacacagcagagtcacaacagacccgcacatagcacactgtcactcagacgccgcacacagcacacaactcagatgccgttaacagccacacgagactcacagaccctacacacagcacacaaactcaggtgccgcacacagcacatgacactcacacagactgctccacatggcacacaactcagacgccacacacagcacacaacactcatacacatgcacacagcacatgactcacacagatgccgcacac

SEQ ID NO: 647876 - DNA, 820 bp, Homo sapiens
gtgtgtgctcttcctgtcctcttcttcccccacaccccccccagacaccgacgccgcgttacccacccccgccacggtatactacactgtgggcatctatttgttgcccacaaggaatgcatgagagccctatgatttaaaatatgaaatggtggtctgctgtgtgaataaattatttctgaagaatgaagaacattaattttgggagttctttgacgaactttgatgtgtggaaaaagtatttatacttcgttgcaagaagaaagcaaactattgttagtcggcctctccagaggacccaagttaataatataaataatcattatcttttaaccatttcaacagttcgcatcaaaacgcttcttttttcccgacctcgatacaacatcacttcccccgtgtttccctcttccttgccactcctatctcttctcgcccttgccggggggctcgtttcctttcctctcctctctcttccgtttctctcctgtcttcgtcctctcgcccccatttgttttgtgtcctcccccgcgtttcatcttttctcactccattcccgtcgctccccccttcatcctcgctttcgtcatccagccttgctgtactcgttcctcctaacaagcttcatttatgggtggttttcgatgggtcttgctccctccgtaacgtatcaccagcgacccgcttgacatttttatattgtacactcaccggtcttctgttctgtccccgtctctgctacccgcgctattgaattccggtctcttttgtttctccattctgttttcgcgttacccgtcgatcctatcttcgcgcctat

SEQ ID NO: 647877 - DNA, 123 bp, Homo sapiens
actttctcgctgtcccatgttgtccatgggccgccttccatggccttggcggccatcgccccatgttcttgcagcacctcggtatggggcgctcggcgttgtgccaggctcccgcagctcgca

SEQ ID NO: 647878 - DNA, 1544 bp, Homo sapiens
  misc_feature (1025)..(1025): n is a, c, g, or t
  misc_feature (1300)..(1300): n is a, c, g, or t
gctgagtctccagacattacctgcccagatcattcctgagggtcgggctgccatggagtcccattgtgatctctgccctcacaatgttggagagtgccagggggacttcatcgcatgatatgccctggagccctctgcagtcaagtctcccgggatcccctccggagctggagtcaggtgcttgggcggtcgcaactcccgatacgttgttctcagatttccaatcaattgaaagctaatttacagatgcattagacgggacaaccaggcttccagtggcgacgcttggaagtgtggacaatcgggcccagtttgccagcctacgttgatagcaggatctgtcgtacagagtgtacccgtacaacctagggcgttctccttctgcgtgctatgttgcatgctctatggcacggccttagctgcccctcgctgagtgagctagaatcatcgtctagagatgctgccttttgccaagcaatcgtacagggaacttggcgttcaaccctaggccacgttgcacaaggcgaaagcattcatcgcccagatacatctatttagacggcacggcttggcggcccaaactttgtcgtgctccgcagcgcggccttgtgagaggcgcttccctcatgccattgcgttgaagcatcatactggtttgatccccccatcgaatgtcgtgcggcaagcataatcttattagtggaataggcccgtggaatcgaactcccttagtggtcctatgctacgcgatgtggggcttgtctaagtcccttctgcacaaagagagaccccatatagcaggaccccaacaccaccgagcaaagtcatgggcaagtttggcccactctttcccagtttgtggcaaccccaatggaattctttgacacaacaagccacgttattgggccgacggaagtcccctttggctccattttggcgatgtattatggctttattttatgccatctgtgggccccataattgcgccataggggccgtttgcagattgggggttagaaaactcncctcaaccacatgtggcgaccactgcccatgttctataccaaaccaggcccctcgaatgtgtgaaaacgcgtccacccccttgagtggactggtggggacgtgtggcccttgcgttggcgcaagggacattagcaattctggcaacccccggcaccgcggtgcccccgagctacagtgacaggcagcgaaccctcgttagcaacggaacattgcgaggagactcccccctttccaaacatctgggaagcgtgggtcatatgtcagcccagagggntggcccttagcgctatgcgcgcgggtaccagcctgcagcggctttgggccacattgggggtagtagcacattcccaaatttcatacgcccccagtgggccccaagttcaatagtacccacaggcctcatgactttgagcaactgcgggacccccaaattggttgggttttgcaaactccagcggccatttggtttcccctttccaggttgggatatttaacccgcgaatccagagcgcatcatg

SEQ ID NO: 647879 - DNA, 1638 bp, Homo sapiens
  misc_feature (129)..(129): n is a, c, g, or t
  misc_feature (244)..(244): n is a, c, g, or t
  misc_feature (1478)..(1478): n is a, c, g, or t
ggttaacgcgagtcactcactccaatgggcgtagcgagccactggcagcaggtctgcgacgagagagcccttgcggcgtgacaccagatcgaaaggaagagcacgcactgatggttccccagtctgacnatgtctacgagcagccatcgcctaccgtgtgccaggtctctatcgcgatgtcaagtctccaatatcatgataggcacgatatacgaggaaggacgtgcagagtcaagacggttcngcgtacggacatggggtaggggaagggaatatgtcccgtggacctgacccttgtacgacgcacatagtgcctctgcacgcgaaagggcccttggccacgcaccgagcgcagtcctgcgaagtatctagacgttctttggagtggaggtcgccaaggcaccgtttgaggtcgtggacgccggcacgatcgcccaaggaaggtctcttgagaccaggcccactatagaccagcgagagagttctaacaccttttgactctagctgaccgagggcccgtggttgtggagacccccccgtaaccatttgcgcttagtgagcctatcgaacttagtgttgtgggacgcaagcgaatagcgggtcccgatcttgggctatattccataagtccccacgagacactgttggtcctttacttcagggggcatttccttgtgcttggtcgttcggttaccgctatccgccggtacattgggggtcggcaccccttcgtggcattgcggcgttaatttgtatactttgtttgtcgccggttgcgcctttccgcgcctttcataccccgatacgcggcgaaagtcccccccccggataggggttacccctccctatttatcttcgaccccggggggctcccttgcgtttacgttggctaccgtttcgtgctccatcccccctattgtcaaccattcccccgcgttggccaaacggaatccgatgtgaaccttgggactcctagggtggggcctattcccgggtcctattgttggtggggggccaagaccctaggggctcggtccatccttttcatttttggcccccctctacccggttgggcggcgcggtaccaccctttcgcggcattcttttcccccttgttgtcgcgccgaggcacctccccgggtggttggccggtcttccccaaacaccaggggccgtgcggaccttcctctaagggagcgcccgggaaaccggaggccagggttgttgggcccccaattcccaccttcgagaggcgcctaatcgcggcccccatttaggggcggctccattttccgatgtggccattttaatcgctgccgccttttgggcaggcgacaccgccattatagtttaggaggccgcagttcaaatcccataagaaaagtccgcaccagagtgtacattgcgcagaaagagggcaacacccgcggtcaacattcccccgttcgcgcacagaggccaattacgtgtggggcacncttatcgcgtaacccccttccaccccaaggtggaacatgttgtgtcggggggcggtgaaaatagagagggcgccacacagtacatcagcaagagggcagaaaagccagtcacctatctgatatgtgaagcgctgtcacacgaacagggcttcaacaccag

SEQ ID NO: 647880 - DNA, 287 bp, Homo sapiens
agcgtgtgcagactaagtttattactcacactggcctatgtaggcccagacactacgtcacggcagagtactcagaacagtctattgccccacagcagcatccagcgggacggctccatcgtagacactgctctgtagacccagctgatgcctcctcagccttctgtccaggccttgctctttctgatgtcgagctcactagccccagctcatgcttctttgcaggctctccaggcgcagctcctgcatcttgctggcccctccaggcccagcctctgactcccgtc

SEQ ID NO: 647881 - DNA, 549 bp, Homo sapiens
  misc_feature (445)..(445): n is a, c, g, or t
gaagggtgaagtcctccccacacctggccaggaaaccctttccccatccatgacctctctgcctctggtgtcctttttaagcttgattcacagacccccctgtccaagaaggctgctgctcagaagctgaaaaaaggggaaaatggggtacctggggaggatgcaggtctccacctgagctccccttggatgcagcaacgagcagtcctaggtcctgtgccgctgacccgtacctctcggacccggacactacgggaccaggaggatgaaatcttcaaactctgatgtccccagaactgactgagagaagcaagatgttgaaagagaaacttcagggggagaggagcctgaggtgaggctcaagaacatggcttatgagcctgcctccctccactccagccatcctccccagccttcttgtctgccaaaaattccttggcctggngcagttttattggcaagattagggaatgggaactggacctttcccagttcttgggctgaatctagagttgagtcctttagactcaaaaggctctttttatatcc

SEQ ID NO: 647882 - DNA, 312 bp, Homo sapiens
  misc_feature (146)..(146): n is a, c, g, or t
  misc_feature (155)..(155): n is a, c, g, or t
ccagaagagatgagactgggaatcatcaccacacccagacagacttcatctattcttctgagagcagctccaagagattgcctggaggactttatctgcttaataagacaagctttgttcctgtacagctccgcccctcaccttcntgtaatatntgcctcccacctccccagtccatacatctcctccctcctgtatgaaaaagggtatacaagcttctgtgccccattgggttattgggaaatcattctcctgtgattcccctgtgccatgcacactaaaataaaattttgtatgccttttttcctaaaa

SEQ ID NO: 647883 - DNA, 109 bp, Homo sapiens
ctagaggaccgaatgacgaacatagggtgttctcggtgtgaatgagggtttatgttgttatgtggtgggtgagtgagcccattgtgttgtggttaatatgtagagggag

SEQ ID NO: 647884 - DNA, 408 bp, Homo sapiens
  misc_feature (22)..(22): n is a, c, g, or t
  misc_feature (72)..(72): n is a, c, g, or t
  misc_feature (152)..(152): n is a, c, g, or t
  misc_feature (162)..(162): n is a, c, g, or t
acctccaaaggcctggaaactntgcaacccatgtctaaataatcccatgggtcaaagaagggctctccaagngaaaatacattgaatttacatgaaaatacaatatgtcaaaatttgtgccacatagctgaggcagtgctgagattataacncgtaaatacncacattagaaaaagagaaaagtcttcagtggataatccaagctctcacttcaagatcccagaaaaagaaaatcaaaatagactcaaagcaagcaggaggaaataagttataaagattagaaataatgggagcaggatgcagtggtgcacacctgtagtcccagctacttgagaggctgagatgggaggattgcttgaacccaggagttacagttcagcatgggcaacatagcaaggctccatttca

SEQ ID NO: 647885 - DNA, 245 bp, Homo sapiens
ctctgagtagctagtattacagacacctgctaccatgtccagctaatttttgtatttttagtagaggtggggttttaccatgtgggccaggctggtgtcaaactcttgacctcaagtgatccccctgcctcggcctcacaaagtgctgggattaccggtgtgagccactgcggccgatatctacgtttttaaagactcctgtaggggtggcaaacttgaggctcctggacatgcaagaagggacg

SEQ ID NO: 647886 - DNA, 386 bp, Homo sapiens
acgccgtggtgtgatcttagtttactgtagccttcatttctggcggctccactgactcctcccacctcagcctctcaaatagcctgcgactacaggctgtaccatcacaccccagctcattccgaaaacaaaatttctttgtagagacgggtctcattttgttgcccacgctggtcttgaaccccagagctcgagtgatcctcccgcctagcctcccagtgctgggatcacaggcggtgagccaccacgcagcccccactgtgactgacacttgtgcccggttgcctaggagtgtgcaacatcagatctgggggcacgtgctttattaagagttcagaactggggccaggcgcggtggctcatgcctgtaatcccagcactttggg

SEQ ID NO: 647887 - DNA, 438 bp, Homo sapiens
gtgatgcccatgccttaccttctcgagaacctgcattacaggtgcgggccactacatgaaggtactgtgggcatcgttagtggagacattcttgccttgaggccgccccactgatctgaaactcctgaccacaaatgctgcacccgcgttggtctaccagactgctgggattaccggtgtgaattaccatgccacactggggaacttgtgggataaccttcgctgggtgctaacactggttgatcctatgctggaatagatgctttactttctggactcccagattcttgcgcccctaatctacgacagcatgagggggtataaagtctcttgatatgcacctgtcgtacaacgggccccatttgaaggtacgttcctactgttttctcgtgctgtgggtggcacttgcatgcatgggcgcatacctggacgacattg

SEQ ID NO: 647888 - DNA, 2021 bp, Homo sapiens
  misc_feature (520)..(520): n is a, c, g, or t
  misc_feature (1382)..(1382): n is a, c, g, or t
  misc_feature (1595)..(1595): n is a, c, g, or t
cgcctccttactcctcattgtacccattctaatcgcaatggcattcacataatgcttaccgaacgaaaaagtcgtaggcatagcatagaaggtacgcagacagggcccaacgattgtatgcgcgcgtacggggctactacgaaggcctttcgcatgacgccgataataacatcattcatccaggaggatgcccactaaaacacacgccagcatcttgacctaatacaaaaccatcataacaaattcatcacgccgcgcggactcgtgtgagggctgcgtgcaacctattgctgacttcctctcatgagctaatttgcaagagcgcacgcgccttgcgcgcgccatgagcacgcaaaatcgcgcgcgcgtgagataccacagcgcgtacgagatgcgcgtaaaccgcctgttcacgtaaataatcactctggcgtaatgtgtctagccatgcgtaggcacctctacgcaccgcggcgtggaaacctcacaacatagcacgtcagtacaaatgcatgtgggnctgaaagacaaatccacaaaaaaataccaatataactgggctggtcgcgcgatggaaccttcgggcggtgtggagcctttgcaccgagggccgaagatgtgaaggggtcgcactggagaggcagactttcgtggcgggttgaaatcgggaccagagatgggacctccacctaaaactggtcccaactggccaagtggtcccctaaaaaccttcaggtgggataccccaatccttaattctgggaacctcccaaaagatagggaacttacacacatattataaataatctctttacgataaccacaagctgcgggttttaaataacaacaaccgaggggggaagagaaaaaaggcaaccacgccaggctatacccttcggacacttatataaaccattcacaccattaagacacacacaataccaaagttggggaactcccgcgggaaggcacacgccggaggtgaagcagttaaggtggcgaacccctgtcagtacttttcctccacaccaaggttaaaagaaactcgaggggaaagacaaagaaccagagaagagctggccgaccaaaaaacacggagggggcattttaagcgccgcaaagtggaggagacggcacaccaagagaggttgagggaccatacgagggggaccctaccaaaacagcagattttgggaacccataacggtggcccgaccctggggcacaccacccttaagcgggggcaccactaaattgagacgcgaccagaacaaacaggtgcggtgcacgctccacacaccaacacgacccaactacaagcatcgacgggggagggaggagcgcggcgcacccacaaaagaaaatatcaaccaccaagaganggagggcgggcgcacacaacaaatacgacacaacggcaacacaccaacgccgatcctccctgtgagaagaccaaacgaggtggcgcgcccccaattaaataggggagagagcacaacaaataacacagacgaatagcaaaaaacggatggcgcgcgggtaattaatcaaaacagcctgcgagctacacgggtcggaaacacaaccagagactntacgaaggaaggaacacaacatctagggtggaacgagaagcccacacaatacacagacagagaggcgcgagacaaacacaactgagcagagcaaagaccacccatagacaggccgaatacgcccagccaccggcagcgaagatagaaacgaaacagcacgccgcaactagcgatacatacaacacagaacggagagtcgggcgagagaaacgaacagccgcgaggctaacatatagaccacacacagctgacgccacacagccaccagacaatatacagctagccatcagcaggaagcagcacgcaagagaagtagaactcacaactagctcgagccgcaacccatacctaacgccctcacacacagcgaacacatcgccgacgagtagcaaagtaacctgacgcagcagcaaccactcagcacct

SEQ ID NO: 647889 - DNA, 404 bp, Homo sapiens
gcttgaattagttggtctcgattgttctgtactagactatggtgagctcaggtgattgatactcctgatgcgagtaatcagcatgtgtttaggagtgggacttctaaggcatttagcagggtgatgcctgttggagtccagtgccctcctagctcataggtagtcactaggctggagtggtaaaaggctcagtctcatcgtacgtgctcaggtcgtgtgtgctggccctgtgtatgtgctctctcgtgttacatcgcgccatcattggactatggttagtgtgttggttagtaggcctagtatgagctagcgttatgctagtggaagtgacatcacatggctaggccgcaggtcattactaggtctgagagggcccctgttagcggtcatgggctcggtttcac

SEQ ID NO: 647890 - DNA, 365 bp, Homo sapiens
tttcaaaaagcccttgttgaggattaggtcccccatgggataaaaatctattaacccttttaaataaaaagagccccagggttgggatgggcaagaccctctcttggaggttttttgcaaagcaattaaagggggggtattggccaggacccctttttttgcagtgatttgaagaccaaagttgttttccagcggggttcccgttaaaggttttttttttttaaaagaattaaacccatttatcactgtttaaagctttgaaaatctgcaatcttggcccagggacttttttatttaaaaaaaaacaaaactttgtaaatattaccccgtaatattatataaccttaataaacccttttaagcta

SEQ ID NO: 647891 - DNA, 434 bp, Homo sapiens
  misc_feature (126)..(126): n is a, c, g, or t
  misc_feature (152)..(152): n is a, c, g, or t
  misc_feature (208)..(208): n is a, c, g, or t
  misc_feature (215)..(215): n is a, c, g, or t
  misc_feature (241)..(241): n is a, c, g, or t
  misc_feature (298)..(298): n is a, c, g, or t
ggtacgagggggttctgaaggttgcgattaggttaaatgagattaaattctaggaattactgtctaggttaactacttgttagtgctgtagagattaaagaaatctatagttataggaaaaggagnttttttggatatgcccagctttaaantgtctcagggggaattggtatagcctttatatagcccacccctttttggcctcacngtggttnggaaattggccagagggtccacatcntgcccaaaccactctccttttgtcccaaggcaaaggtgatgccttgaggcttagggntggataaagcccagctttggatgctgctaacccactctgctgccccaccccatcctccaatttttatactaggctctttgccattgtgacgtcccatgacatagtctgatgcacgataaaacaattatttctttaa

SEQ ID NO: 647892 - DNA, 804 bp, Homo sapiens
  misc_feature (380)..(380): n is a, c, g, or t
  misc_feature (657)..(657): n is a, c, g, or t
tagggcccatttgagtatttggtttccaattagggagatagtgggaataaggataaggatggtggtgaagtatagtacggatgctactgtgtccaaatgatggtaaaagggtagcttacgggtggtcctccgattcaggttaaaatgaggaggctcgtgcggcttaggagcccaataaaggtgattgggctttaggtgggcgaaaatattagtgcttgggtgtggttgggaatattagtggaggagtggggattttatgtgcgtagagattgaggagtggaatagataatagggcaagtgacgcctctcctataagttgggtatagaggcacggattcgggaacaatggggtgtagcgcagaaataggaaagaatactcnatctgcgggcttgagtgtgtgggggagcggggtgttatataaaggggggtttgggactaggggtaataatggggtcgtggggctcgccctaggggagggctccgtgggtgagcacctagtgtgtgttaaagtggctccatataagggaaggagcaaaggtacagagcaaaaggttaaggccggagaggggcgtcttgtgagtgtggtgtctaatgtacagggtgtggcgacagcgttgaattttaatacgcggaaatgtgggagtgtgagtatcccnctaggggggggttgtgttttgaggaccccccgtttttcgggtgcaaggaaatattaagggaggtgtggcggagtgcgcttcgctaaagggagctgggcaataaaattggaagcgggcaacgattggcctttggaaaatgggttaaca

SEQ ID NO: 647893 - DNA, 186 bp, Homo sapiens
  misc_feature (17)..(17): n is a, c, g, or t
  misc_feature (123)..(123): n is a, c, g, or t
  misc_feature (164)..(164): n is a, c, g, or t
tttgaatgttttaatcnccagatttatgaactttttttcttgagcaattggtaaagtatacttttgtaaacaaaaattgaaacatttgcttttgctctctatctgagtgccccagaattgggnaactattcatgagtattcatatgtttatggtaataaagttntctgctcaagttcaaaaaaaaa

SEQ ID NO: 647894 - DNA, 298 bp, Homo sapiens
caccggtcctcatagcttacctttggtgcgcggtattctctcgtggctattggacgagatgtgataagcttaagaaaagcaaataagaagacgtggagcaggctgatgcctggtcccgcagtgtggaagagtccccattgtgaggcctccctggggatgtggcggtggccactacagcactggccgtcgatatagactgtgattgtcgttgtactggcaattgattatcatctgtcctcaatggtgacaatgctgactcacctggaggtggaatgatggccatggtgacactgaggag

SEQ ID NO: 647895 - DNA, 101 bp, Homo sapiens
catgtggagggggcattttgtccgacgactccccggaccgggcggcgcgctgggagaggctgcggagtcgcggtcgctgccctcggaggcactggacgccg

SEQ ID NO: 647896 - DNA, 463 bp, Homo sapiens
  misc_feature (14)..(14): n is a, c, g, or t
  misc_feature (67)..(67): n is a, c, g, or t
  misc_feature (94)..(94): n is a, c, g, or t
  misc_feature (119)..(119): n is a, c, g, or t
  misc_feature (143)..(143): n is a, c, g, or t
  misc_feature (152)..(152): n is a, c, g, or t
  misc_feature (156)..(156): n is a, c, g, or t
  misc_feature (161)..(161): n is a, c, g, or t
  misc_feature (164)..(164): n is a, c, g, or t
  misc_feature (166)..(166): n is a, c, g, or t
  misc_feature (170)..(170): n is a, c, g, or t
  misc_feature (177)..(177): n is a, c, g, or t
  misc_feature (225)..(225): n is a, c, g, or t
  misc_feature (257)..(257): n is a, c, g, or t
  misc_feature (277)..(277): n is a, c, g, or t
  misc_feature (323)..(323): n is a, c, g, or t
  misc_feature (427)..(427): n is a, c, g, or t
ccccccaggctggnaccaccatggtctagaccccaagtgggcctgaatgctgtggatcacttccttntccccttccacagtgtttggggatttngggaggaagggaagggagaggagtnttaacgttcgcagtgagggggtcntgggacaantcantttgntancncggnagggggnagcagacagtggcccgcacgggctgaggggcctcctgtctgtggtgcncatcccaccgagaggattttggctcgcgagcnggcagacactttttttttcngaaacactatcgtcgtttccacgggcggaaccaacaaaagcaagtntctccaagtcaaaaataggttttggattcttggtggcggcagtatccgctgaaaaaatagactgaacttctgaaattatcttagtagcaaaacaattacaaganaaaagttgcaacttcagtgctatgactggaaagggg

SEQ ID NO: 647897 - DNA, 169 bp, Homo sapiens
aagtagagatggggtttcaccatattggccaggctggtcttgaactcctgacctcaagtgatccacccacctcagccttacaaagtgctagggttacaggtgtgagccactgcgcctggccccttccctattctttaacaccaccttccatcccttctgtcgtcttctc

SEQ ID NO: 647898 - DNA, 532 bp, Homo sapiens
gccgaccataggaaacatgggaaaactttatttgtgctgtgtggctacccgggtgttcaagccctggttacgggccccttttttaatatcgggaaacaattgggggccggggtccccttttttcccccccgttgggaggagttggccttaaaaaagttggttaccttaatgtgcttggcaccgggtttaagccccaaggaggtgttggtttgttggttgcaggggtcaaaggaattgccccgcaaaaagtcctttatttgggtttccggggaggggcccagccggggccccccccctttttttgtgaccagaattttgggggtggaacccaaggattgaaaaaagggggacccttttttttgaatggtgggccagagggccctgcgggtggcttttaccaaaaaaaccattggccggttgggggggtaaacccccccatgtcattgtttttttttttatgggggggggggggggcccttgtttttgagcggccggcttgtccccccccttgaataaattccttgttccccca

SEQ ID NO: 647899 - DNA, 694 bp, Homo sapiens
ttctcgacctgcaggtagtcctggccgagccagcccctggaccccctgatggcccccaccttcccatccagacagccgagctcgctccggaacttgtcatctccaacgacaaaaggagcttttgccactgactcggccgtgtcctgacacctccagaacgcaggtgctggcgtcccgttctgcctgggaccccggtgaacctctcctgctcggaagccggacggcagggatgggtccccaatcttcgccctgcccaacttgacttcatccaaatgcccttcctggagactgaacctggtgctcaggagcgaaggactgtgaacttgtggccctgaagagccagagctagctctggctcaccagactgggcgacgtcaccctgactcccatcccatccccaagttctaaggtcttttcagagcgtggcaccggtgtggacagcgagtggctgcgtctcccaagatcgtatgccaagagggcggcggcagagcgtggtctgtctggtctccttggagacaaggttctgttgccctgatttatgaactctatacatagagtatataggctagtacctttttgtacaggaaggtgactttctgtaaacaactgcgatgtgatattagactttttatacaaagttaacaatttgcatataacgatttttaaacacttgtgttacaacacaaaacacaaa

SEQ ID NO: 647900 - DNA, 966 bp, Homo sapiens
gattgttgttcgcaacgcggttgggcgccagaacactaggtgtcgtggaaacagtagccctaaaagccaaaatgggaaaggagaagactcatatcatacattgtgcgtcgattaggagcacagtcaatacgagtgcaagtccactcgacgtatctgggtgaatcttgatcgtataaattggggtgggattggactaaagaaccatggaataaatttgatgaaggatggctgtctcgatgatggtgcaaaaggggtaacttcaagatagtgcactgggcactgtggataaagtgaaaagacatgtagactgtcgaacagtgtgtattcatgcgattggatgatctgcgcattgatggaatagttgagagaacagtaaggtacgtattgtgactataatttgatgcccacgagtgacacagtagagtttattgacacaaagaatgtatcacagggacatctcaggctgaggagggcagtcgtgatcggtggtggcatggtgttggtgggaccagagaaatggtatctccaagaatggtgcagaagccgaaagcatggccttcgggttagcgctctgggtgggaaaggataaagtgtcgggtgtgtacaaatgtggattcccatgaagccatcctacggcgagactgagatatgaggagtggtaagggaaagtgcgcgtacattgagcaaactgcctgttactccgaccatgatcattgtgcatttctggtggatggtgcttctgctggagcgcaggtaactgctggtcacggtggtgctgccgtaggtgtgagtcggcacccctggttggggggctgctcgttcacatcgccgtagaactgcgggtccgattcacaggggggggggcttccacgggaagggggcaccttgtctcccggaatagtgaagtcgcacggcaacttggcgggcggccaccgctctccttcttttccttcaccctcacgtccc

SEQ ID NO: 647901 - DNA, 897 bp, Homo sapiens
tccacgcttaatccactttatttttctggtttaaaaaccctttgttgtacccacagcttggagcctgagttccgcttgcacggagaactcgggggtgtgggtcttgacgaggtggtctcagtgaactccgtgatagggagactggcgtgaatacagtctcctctccagaggtcgggggctcaggtagctgtaggtcttagaaagtggcttcaaggggtggcctgggcgaagtttgcccagggtgtggcaggtgcacgccccgggctgaggtgtagcagctcactcgattcccagccatcttgagcagctctctataggcccggggtgcggagacgattgccagtgccccgtgggttgcagggattgaggcgttaccagcacagagccgaaggggcctgtgtcacctttgcaggggacagtgtgtggggctttgccgactctgtgtccccccagatagccttctgtgcgcacggggacagatggaaagcttgggccaggattgaatggccccacggattggcgggtgggccaccttcctttggagcatttaaacacccagaccgacgtgtggccattggtagctccccgattagcaacaaatgtgcctttgaccctggtgcgctggccggcacgggtctgcttctgccacgggcataatcttcaaaacctcatccttgagagaggcccccaggaagacactcagggatctcggatcccttaaggggcaggacgaacagatagatctcctccaggacttgatctccatgtccttgaccaaggggccaatttgggagacgggcatccatccttatcctcggctagcctcgggagctccggcgccggcccgggcccgcaaggccggacccgggccgatgccttgcgaactccgggaaccag

SEQ ID NO: 647902 - DNA, 441 bp, Homo sapiens
cttccataacactacatccaacagccgctggataagtgctaggaatatatacgagaaggatgaaagtagtcccatctgtagcaaaaatataggtccctaggcatagagtgggtcagacagactgaacaagggcagtgcagtatcacaggatgctgcggaggcaaaacagatgcataatctcacagataagggcttcagtatcctgaaggggatatcacctgagtaggattttgaaagagggtcatgattggccagtaaaaccaatgagggaagacattccaggcagataacacaggatgagcaaaaggtaacaggcacaaaagcatgcggggtgttttgggaaactcaggaagatgggaatgatttagactttggtaaacacagaagggtgtgggaggtgagagaagaaacgcaagagggtaccaggtcataaggagactc

SEQ ID NO: 647903 - DNA, 711 bp, Homo sapiens
  misc_feature (516)..(516): n is a, c, g, or t
  misc_feature (571)..(571): n is a, c, g, or t
gtattattgtattgcactataggagcgggaagatgggtattctaccgaccctatcacttcgaattctagaagacatctgtgaggatcgctgttacatctactaatgacatatcctttacgcagtctggattacgaacaggatgtgcatttatgatccaggtatgccttatattagggtatagagttacattatttacacatttgagatatctttgaatgcgtggagctcaaggaattgagcggatatttctatatcatgtttacttaggctttagaattaaagcaagtgtatttattaccttgatggaaatatgggaaatgtctaatacatgcaatatacagggatgatacttgagctgagggaaaattgccgctttttatctgtgtggaggggtgcatatataatctttcacctgacagactaagaaacccatgaaggtctgcactggttagagatactttttcgcttcgtcagatgcgcctggtgtctagcgcgaattgatcactagatactgnttcaaggacaccagaacgaggcctcccaggtcctatacacaagagctgtcaatgnaatacgacacgcagtgatttattgcatgatgcacaggaatatggctgttccttaagacatgcacgttcagactgtccataccagacgcaaagattctatgtttatttatacggctaccattgaaaacctttatgtgaggt

SEQ ID NO: 647904 - DNA, 123 bp, Homo sapiens
agagaaaaaaggaatagaaaccagaagaaaaccatccataaaatgacaggagaaggctcacttatcaataatcaccttgtaatgtaaacggattaaattccccctttaattcaaaaggagact

SEQ ID NO: 647905 - DNA, 419 bp, Homo sapiens
actctaagatcccgccacggaaatttctaactgaaaatctcccatataataacagattactaaaatacagacaaggcacatttatttcaatacaatatctgctagagaaacgctctatttaaccataaaagaatcagaagagctcctagagctcacttttctccattatcattattgtagttgtcattgctattatcattattatcattagcatgacaatcaccattaattaagtgcttattctatgctagtgattgacatgcaacaactcattttatcatcacaatactattatgagaaagatattaccatccctatgctacttaaaggacactggggctcgaagaagtaaagaaactaatcaggccgggctaggaggctcacatttgtgatcccagcagtttgtgaagccgaattgg

SEQ ID NO: 647906 - DNA, 541 bp, Homo sapiens
tatctcaaaataactatattgagtgacaagaggaagatataaaataacacatgccgtgtggttttattcatgcaaaattttgtaaaatacaaactaagttataatgacagagtgcagatcagtggtttgttcaggtgacagaggggtttgttcgggtgacagaggggttagggttcggaagagtgagattacaaagagctatgagaaaactattggggacaatggatatgttcactatctttattgtgtgaatggtttcacaggtgtttacatatgtcacacttaccaaattgtatacttaaaatatgcaaaatatttctggtaaaatttcactttgttttaaatgaaaagaggctaagatgtacatttttaccacctcgagtctccattatgttagagaacctgggcagtacaataaagaaagagggagaaagaaagagagaaggaaggaagaaaagaaggaaggcaagaacggagagaggggaaaaagaaacggaaagagaaagagagagggaaagaaatagagaaagataaaggagaa

SEQ ID NO: 647907 - DNA, 319 bp, Homo sapiens
tctcaaaaaaaaaaaaaaaaaataccagaaatactcgtcatttaggattaccagctaagaagcggtgactctgacggcccccggaggaataaagtgagggtgcgggggtgtacctagcatgggttgggagtatcttaaaatagatcccaatttacagggtaaactttcctagggttatatggagtgaggagattggttttaaattctaaaagtgctttttatcttagggggggaatgtctatgtgcgtctctatggggaaattggggaaatggtcttacctggtaattttcacaaacaatgccagtgtgggaaagaggg

SEQ ID NO: 647908 - DNA, 272 bp, Homo sapiens
ccacgcgtccgtctggcaataccaagtgttaaggaagttggccagaaccctcatatgttgctagtgagagtgtgaaaggtggtacaaccactttggaaaatagtggcagtttcttatgacattaaatttgtacttgtcatatgacccagtaattccaggtatttataggcatctacccaagagaaataaaagcatatgtctaaacaaagacttgcacctgaatattcataaagcttttgtgataggctgagtaatgcctccctcaaaaaaaa

SEQ ID NO: 647909 - DNA, 333 bp, Homo sapiens
  misc_feature (35)..(35): n is a, c, g, or t
ctgttgccacaaagatctgaagaattgctttaatnaaaaactccaggccgggcacaggtgttacgcctctaatctcagcactttgggaggccaaggcaggtggatcacctgaggttgggagttcgagaccagcctgaccaacatggagaaaccctgtctctactaaagtaatacaaaattagccgggcatggtggcgcatgcctgtaatcccggctactcagaaggctgaggcaggagaatcgcttgaacccgggaggcagagtttgtggtgagccgagatcgtgccattgtactccagcctgggcaataagagcgaaactccgcctcaaaag

SEQ ID NO: 647910 - DNA, 154 bp, Homo sapiens
ttctggactgacaattccgaccctgctggccccaggtgctgcctcctctgtgctgtcgaggaggtggacagcaagaggaggtggacaacaacctatttagctgttccccaaccttttcctccgaccccctaacaacccccctcctctgtgctgt

SEQ ID NO: 647911 - DNA, 222 bp, Homo sapiens
tctggcatccttctgatgacacgtgatgctcgctcatgcagctctccctgtgtatggatctgttccttcacacctattaagggcgcctcaggagctctctctccctccaacatcagttttcctctctgcaggttactcccattagcacaaacacatgctctcataatgtccatgtgacgaaaacaaacctccctcaggagcttccacatgcatgcacccagg

SEQ ID NO: 647912 - DNA, 86 bp, Homo sapiens
cgggctccggctccggctccggctctggctctgcgcggtggcagcggcggcggcggcgcggggaccgagcatccacaacggggtga

SEQ ID NO: 647913 - DNA, 96 bp, Homo sapiens
tagaggatcccgactgcaactctgtgctccaaagtgctgggattacaggctgtgagcaccgacctggcttatcttcttttaagaataacgtttgtt

SEQ ID NO: 647914 - DNA, 269 bp, Homo sapiens
gaacggaatgtaatggaatgtaatggaatggaatcaacccgagtgcaggggaatggaatggaatggaatgcaatggaatggaatcatccggaatggaatggaatggaatgcaatggaatggattggaacggaataaacccgagtgcaatggaatggagtgaaatggaatggaatggaatggaaacaaccagaatggattggaatataatggagtgtaagggaattgaataggaggaatcggaatgtaatgaaagggaatggaacggaga

SEQ ID NO: 647915 - DNA, 232 bp, Homo sapiens
  misc_feature (94)..(94): n is a, c, g, or t
  misc_feature (96)..(96): n is a, c, g, or t
  misc_feature (115)..(115): n is a, c, g, or t
  misc_feature (117)..(117): n is a, c, g, or t
gtacagacaaggtttaccatattactttaggtgaactcctgacctcaagtgattctcctgtcttgccctcccaaagtgctgggattataggtgngnccctggcctggcctaaagngngatttaaatgttcttattacaaataaccatttatcgtgagaagatggatatgttattagcctaatttatattctacaattatcatggatataattgacccccaataaatttgttg

SEQ ID NO: 647916 - DNA, 1146 bp, Homo sapiens
  misc_feature (224)..(224): n is a, c, g, or t
  misc_feature (257)..(257): n is a, c, g, or t
  misc_feature (334)..(334): n is a, c, g, or t
  misc_feature (470)..(470): n is a, c, g, or t
  misc_feature (1146)..(1146): n is a, c, g, or t
gcgcggcgtgagaagccatgatgcatgcaaagtctctcgcgagaccctgtagcgaggcggttgcgggagagtccgtgcgagcgggtaatccgagcgcgataggtcgccgcaacgttccataggagacaggatgtcgcagttgcatgatccaagcttgcacaggaagcgtactgaatcacccatgaaggcacccaggcgcattcgtcgcgagcactcgtctaggncatatgaagctcctacctcaccgcggcacacantaagttctctcatgctgctgattgtctcatggagtgcgagcctatgtccagcagctgctgaactgaggtctgaaggngcgatggaagtatccgccgcacaattggaacatcgtagggacggcttcgaaagaagagcatctgaatctaagcacacttaaaaaagactgggatccaatgtaaagcatgggcctgaaggaagcatatggatgtgtngttgtatctattgggccctgtctgggaccgatcgtgcttgaattcaaggcatggaattcgcagcgcatattctcgtcgggagccagagggtgttaataatgaatggggcaggtgagaacgtttctccatttcacctgtgctctacagacgaactagatcggacaccaacatggatgggggcaaatagatgggtaatgacgggtgggatagctaccaatcgaattcaatgtttccacactttgactcgaaatggtcgtaaattgtcttggcatgtagactgtttgggtcaccgttgaacgattgacagaccgatgaagcttgttgtattaagcatttcaacctgggcctggtcaactttacttgggtgtcattgcttcaagaagaaactgggcagaaatggtccgggccttatattatacaagagcaccatgggcaagcccccagcgcctattaattaagggcccattttgcactaaattctattaccagtcacaaaagcaaaaaaccaaaaaaaagaacaacaaaaaaacccgagggacacataagagagggggggggaacgaaggagacatagaaaagagacgcagtgaaaaccggggggcagcaaccgacatttgtgcacaagggggaacaatagggggaaccacaaaagaggaaaaaaagcagaacgggacgn

SEQ ID NO: 647917 - DNA, 712 bp, Homo sapiens
  misc_feature (5)..(5): n is a, c, g, or t
  misc_feature (78)..(80): n is a, c, g, or t
  misc_feature (82)..(82): n is a, c, g, or t
  misc_feature (84)..(85): n is a, c, g, or t
  misc_feature (121)..(121): n is a, c, g, or t
  misc_feature (123)..(124): n is a, c, g, or t
  misc_feature (127)..(127): n is a, c, g, or t
  misc_feature (139)..(139): n is a, c, g, or t
  misc_feature (163)..(165): n is a, c, g, or t
  misc_feature (176)..(176): n is a, c, g, or t
  misc_feature (182)..(182): n is a, c, g, or t
  misc_feature (198)..(198): n is a, c, g, or t
  misc_feature (222)..(223): n is a, c, g, or t
  misc_feature (228)..(228): n is a, c, g, or t
  misc_feature (234)..(234): n is a, c, g, or t
  misc_feature (248)..(248): n is a, c, g, or t
  misc_feature (260)..(260): n is a, c, g, or t
  misc_feature (264)..(264): n is a, c, g, or t
  misc_feature (266)..(266): n is a, c, g, or t
  misc_feature (336)..(336): n is a, c, g, or t
  misc_feature (405)..(405): n is a, c, g, or t
  misc_feature (454)..(454): n is a, c, g, or t
  misc_feature (459)..(459): n is a, c, g, or t
  misc_feature (489)..(489): n is a, c, g, or t
gtgtntatatgtgtcataataaaatgagctagaggcacaaagccagtaacacatttatggtctgttcatctggaaaannntnanngcgcactccccactccttttttcccttttggaagtngnnagntttatttttggnattttaattttagagaaaatttannnttccatgttgntttgtngttttggttaatggtntttttttttctagttatggaatgnntgagnaaattngggtgtttttgatntttgtgtatttnggtngnttagtttattgattgttctcattttattctttttccaatcatgggaaatatttagttaattttggttttnaagattcatattaaatttaaagttcctccctccttttggtgaggaagacaaccctttagagcgaaacanaaaagagcaaatgtaaaatccatctggggcggggcatggtggctcatgnttgtnattttagcattttgggaggttaaggcaggnagatgacgaggtgaagagattgagaggatcctggccaacatggtgaaaccccgtctctactaaaaatacaaaaattagcttggcgtggtagcacatgcctgtaatcccagctactcgggaggctgaggtaggagaatcgcttgaacccgggaggcagattttgcagtgagtcgagatcatgccactacactccagcctggcgacagggcgagactccgtctcc

SEQ ID NO: 647918 - DNA, 287 bp, Homo sapiens
  misc_feature (163)..(164): n is a, c, g, or t
ccgctgacaagctgcagctcatccactgatgacacacgacgcttctgagagaccatcccaagacagagtcagcagacccccagaccctcaagccatctgttttcatgaggatgaccccttcttctatggtgaacacctccggaaacgggggctgttgtcgcanngtgctgtcatcacaggcatcatcatcctcaccagtggcaagtgcaggcagctgtcccggttatgccggaatcattgcaggtgagtccatcagaaacaggagctgacaacccgctgggcacccg

SEQ ID NO: 647919 - DNA, 109 bp, Homo sapiens
caaaagattgaggattagactttccgaggacttacctgtcttattggagtaggcaagcactatccactaaggagggggtggcggaaaggaatgacacatgacatacatg

SEQ ID NO: 647920 - DNA, 105 bp, Homo sapiens
tcgaaccggtaccgacagagtgaccttgtctaaaacaaaaaaagtacatagatgtgataatatatgcgtaacagtatcaatgaataggccaagtgtgatggctca

SEQ ID NO: 647921 - DNA, 354 bp, Homo sapiens
gggagtcatgcagcaattctcattcatggtcgctgcgggatcccttatagagccgactccatatgtatggcgtagcgtggccccacctccctcaggctgatctcctagctggccttcaaatttctcatggagtccaggtcgctctccataggactggcctgtacgtctcagctactgtgagcctcgtctcagcagctccaaacctcagcagactgtgagtgtagaccactgtggggctctcactcaatctgctgagacacagtacttgtctagctcctctcggaacttccgagccagctcgtcataaattgggcccggatgtctgccatgatcttggcgaggtcctgagatttg

SEQ ID NO: 647922 - DNA, 276 bp, Homo sapiens
gagagggaccaggggttgcgccacagctctcatttcagtctgacagttcagctacagtctgactctggacagggtgtttcgttgcaaaatacaaacaaaagcgataaataaagcgtttcatttggtaggcggagagtgaattaccaacagggattgggcttggcctatgctttctgttgtagttgggcagtcaaggaacctctggggtgtgaccaaggcactacttgccacctgccacagtaaagcatcttcacttgacttaattgctgcccggag

SEQ ID NO: 647923 - DNA, 104 bp, Homo sapiens
tgagacagagtttctctcttgttgcccagggtggagtgcaatggcatgacctcggctcactgtctttctatgaactcaattataccatcggtcccaccttgtct

SEQ ID NO: 647924 - DNA, 793 bp, Homo sapiens
agcgggtcggctcccggccgggccgcgggcgccgaccgttgagccaccggctgagccgcactgctgaagtccctccctcaggaacccctccggccgaccctccaccgtgccgaaccagctctcgcggcaggccgacccatgtgggggttcaggctcctgcggtcgccgccgttgctagcatccatgcatgccaggagcgtgcggaatcgggcaacacgccagtcgtccatgcatcttcaggcaccgaaccgatgaaggacggtgcggcagcggacggcgcgcgatgctccagtactcggccgagggtgcgccagccgtcacgtgcctgcacggttgccaccgatgccttggagccgatccgcaaggcgcagacagccgacatcgcatcactggatagcggcggccgggcacgggcgacgcggacctgggaaggcgggcccgcgaaacctcacacccgcggagcaaccacacgccgacaaggacggacagcccggcagaccgaacgcaccccaaggcacatcacacgctccttcgttatataccactgagcgcgactgtggcgaggcaaactttaagccaatggaaaaccatacacgtgacgctcccggtccagtcccgtggcacggcacattgactgcaacacctgagggggacagcaaccgtgggaaggatcctgagtacaacaacgtggtaggggactcacaccaacctacgctgaagggcgcacaagcagggggtgtacgccccaacacgtcgaggtctaagtcactatgcgggggcagggacagtgacg

SEQ ID NO: 647925 - DNA, 453 bp, Homo sapiens
gagaaataaagttttgcctatagtaaaagatgaaataagccaggcatggtggcatgcacctatagtcccagctactcaggaggctgaggtaggaggattgcttgagctcagaagtttgagaccagcctagccaacatagcaaaaccctgcatcaaaaaaaaaaatggaataggccgggttgcggtggctcacacctataatatcagcactttgggaggccaaggcaggtggatcacttgaggtcaggagctcaagaccaacctggccaacatggtgaaaccctgtctctaccaaaaatacaaaaattagctgggtgtggtgtcacatgcctgtaagtcccagctactccagaggctgaggcagaattgcttgaacccgggaggtgaagtttgcagtgagcagaggttgtgctactgcactccagcctgggtgacagagcaagactccggctca

SEQ ID NO: 647926 - DNA, 343 bp, Homo sapiens
atgagtggcatgtgctagagataaaaagcagtgacatcactatacgagactcggtgaaaaaacagaacaaaatgaggtctctgaacgttcgactgaaaaggagactttggctgcaaacgtatggaaactgtgacatatttcaagaaacgtcgctacaagggactccggtgagtttaaatataggttaagacgtctattctgtgccagtcatagcttaccttacggggagggggccacatctggaaacagggagttttagtggtaagcaaacgagtatgtaaacaatcgaatccattaatccccaaacatccaagaggccctagcagagcaggatgcacataca

SEQ ID NO: 647927 - DNA, 894 bp, Homo sapiens
tagaaggaactaaggactcctgccaacagcagacacaaagctgtgacctcctgccaacaggcatgcgaatgagccattgagaagcggagcctctaaccatgttcaagctttcaagtgattgcaagcacggctgacatgctaaatgcaggcatatgagaaaccctgaggcagaaaaacccaggctagagtacaaatgtgattaacatctacatgccagtcatgcaggagttattcaatatgcactgatgaccccaagagcagtgaaaataaccgtgacagaagcttcctgatgactggtattcttaaatgggtgacatcggattacaaatggccagcatgaagaggcatcagaatgggcaagatgcagtcttgctgtcacccaggctgagtgcacgcggcaccaatctccagtcactacaattccacctccgggttcacagcgattctcctgcctcagttccctgaactagttgggattacagtgaagcctaaagagtcatcctccaaccttgacaaccttcaccattataactgcaacaagtcccagatgagaaacaacagccatctcaggcagtcacaattttctgcagtcgacattcaatggagagctctgactggataccaccgcactgtgtcggaagctgcgggaccagatcgaccggacccaggatgaccttccaagaaataaaacgaggcaagagtctaccaagagggaccaccctaccagcaggcacgcgatcacacgctgacgccaacttccgaaagcgcggccccccgcacctcagcaactcccagcatccagcaaccgccgcctcgtggctccccaaaacgcgcgcgccccacaaaccctacgcgccaccagcacacgcgcaaccaggcacgcgcgcatcctca

SEQ ID NO: 647928 - DNA, 963 bp, Homo sapiens
gaaccccctacacccccaccactttcacaggtaatccatttctccctccagtaagtatctccttggaccagaactctccagcatcatggttccgagttcctgtctctcatctctgggatatgcattcagggagaaggtcatttcccccctctttgctccctggctcagcatctagtaggcggtacgaactctactttgtcccacctggcttgtatccgtcatgctgccgcagcgcttctggcacccatctgcacggcctcggcactgcacggcgacactcttataccccctacttcctcttggcaccgcaccgcgccctttagttcaactttcatactaccattgggcgtacacgcccaagtgcctacttcgtcatacctcctcttaccgttgggtccccaatgcgtacatatatgcttacatcaccaattctatgacgcccgctctctgtatgcgtacttctcaagcgctggccttagtgcgccatttctaaacctctgcggccctatatcggcccatttacgctgtctcggaccgaagtcttaaacgacttctacgcacaggctccacatccccaatcgcagcaatcttggcaggggccttcattccgagcgccggccttctcccacgagatgcggtcgtccgcttgtgctccacgcggcacacgctcaatttacatcgtcccgtgggcacacacccctcctcccagagccctcctacggcttacacagccaagctcactttgtccacaaaacacaccacttttcgaaccaacgcgcggccactttccaagtcgacgtacggcaccccacggggaccaacagcgcaccctcttagaacaaccaccacttgggcaccccctctcaacaccaatcgtcgaactggtggcaccgcgcgccataccgtctacacgcacactcctacgtcaaccacaaccattccgcataacaacgctaaacagga

SEQ ID NO: 647929 - DNA, 251 bp, Homo sapiens
acatggatcagatattttgtattttaggtagagatggggtttgccatgttggccaggcaggtcgtgagctcctggcctcaagtgatctgccctcctcggcctcccaaagtgctgggattacagacgtgagccgccatgcccagacacctatgtatgtcttgatgcttagtcacaatgttctgattagttgaggcggtctttttctttcaggaaaggtatgtttaacattccacactgaagatgtaattgtc

SEQ ID NO: 647930 - DNA, 308 bp, Homo sapiens
ctgaagtgtactctatgaacagtcataacacactccagtgaagggttctctactgaacatgcttacacactccagtgaagggttctctctgaacaggcctaacacactccattgaagggttcccttctgaacaggcctaacacactccagtgaaaggttctctctaatctggcctaacacactccatgtgaagggttctctcttgaacaggccttacacactccagtgaagggttctcttttaacaggcctaacacactccagtgaagggtttcttctgaacaggcctaacacactccagtgaagggt

SEQ ID NO: 647931 - DNA, 207 bp, Homo sapiens
  misc_feature (165)..(165): n is a, c, g, or t
ctaagatcacgccatgactccagcctggtgacagagtgagactccgtctcaaaaaaaaaaagaaagttatgtaggataaggaataatcattttttaaaaaggcaaggagtgtaatcgtgaccttgtgttaagagtggtttcttactggccactacattttctctnggttatatataactctttaaaacaacttgtgacctcactggt

SEQ ID NO: 647932 - DNA, 808 bp, Homo sapiens
agcggggcatgagtgcagtgtgggttggggccgggggtggggggcagaggggggtggtcaggtgggctgggaccccccctctgtgtaaaatgagtatggattacagcgggattgatgttcgcgtgtatgccgatacaccccccgcatggatgccagcggaaagtccttagccatccatgctctcggcgtggcgctctagtctcttcgttgatccatctaatagacaatcatacaagtggcgaacaattgactgatgggaaatggggctttctccacgaaaaagccgatttgacaatgattgagcgaaggtgggtgtacgctccagatgccaatggcctgccacagtcgacgttaaagggccctcacatggctggtctcgctgcagaagctgacgggggtcaacgaagtggatccacaggtcacaccatcggaactacttgggaaggctcctgttgtatggttgattctaatcctgctcgcagctgcgatcggcgtggtacctcgctcgtctttcctaccattggcaactctactctttgattgcatagcgtatggaccggtcatggattctccttacatatgccgcgtgagttgtatcagtccagtcgaggccagacctggcaggacaatcgaggcgagggaagtcaagtcgagggcgagttcggctgctaccatatagcgaagcggaagggtggctggaagtacaccttaccgggacgagaaactccacgacgataaagccacaatgccacgtcgtgacgccgtagtcgccaacgagtcggccaaagccaagaaaggatggtacagg

SEQ ID NO: 647933 - DNA, 138 bp, Homo sapiens
agggcaggacatgggcttctgggcagctggggcaggttcgggctccaattccatttaattttggtttcttggttggtctttcctcaaatatacagtccatcaccttggtcagtgcctggcccccacagggtcctggcc

SEQ ID NO: 647934 - DNA, 937 bp, Homo sapiens
  misc_feature (31)..(31): n is a, c, g, or t
  misc_feature (70)..(71): n is a, c, g, or t
  misc_feature (105)..(105): n is a, c, g, or t
  misc_feature (121)..(121): n is a, c, g, or t
  misc_feature (125)..(125): n is a, c, g, or t
  misc_feature (138)..(138): n is a, c, g, or t
  misc_feature (154)..(156): n is a, c, g, or t
  misc_feature (160)..(160): n is a, c, g, or t
  misc_feature (215)..(215): n is a, c, g, or t
  misc_feature (237)..(237): n is a, c, g, or t
  misc_feature (310)..(310): n is a, c, g, or t
  misc_feature (313)..(316): n is a, c, g, or t
  misc_feature (360)..(360): n is a, c, g, or t
  misc_feature (521)..(521): n is a, c, g, or t
  misc_feature (555)..(555): n is a, c, g, or t
  misc_feature (576)..(576): n is a, c, g, or t
  misc_feature (749)..(749): n is a, c, g, or t
  misc_feature (780)..(780): n is a, c, g, or t
  misc_feature (789)..(789): n is a, c, g, or t
  misc_feature (798)..(798): n is a, c, g, or t
  misc_feature (805)..(805): n is a, c, g, or t
  misc_feature (843)..(843): n is a, c, g, or t
  misc_feature (858)..(858): n is a, c, g, or t
  misc_feature (869)..(869): n is a, c, g, or t
  misc_feature (876)..(876): n is a, c, g, or t
  misc_feature (936)..(936): n is a, c, g, or t
gcactgggggaatgggacacaatcttgcctnccatgccccagccactctctcacatgcggaatcaccaannagggaaagatagagtccctgagcaatcaggaaanggtgtgctcccggatnaaanacaggtagtaggncacatcggtgtagacnnntggnttgttgcggtcaccacagcccgatccccagctgatgatgccttgcagggtgagcnggcgctctgcagcttggtcctnacacaccagcgggcctccggaatcaccctggcacgcatcggtgccgccctcgaggaaccctgcgcagagcatnttnnnnaggatggaggatccgtgcacgtccggggctgagcagcgctccanggagaggaacggtacctgcgcctcctgcaggaaagctaggcatatatcctccgccccctcgaactggtggccccagccggccacctggcagagcgtggtctcggagggtcgcgcggcgccgcttggcaggcacaccggctgaacgtaaggcgacaggagcncgcactgccgtccgcatcctcctgaaggcgcaanagagccaggtcgtgctggtanctgacgggcgagaaggccatcgagcaagcggtaggagcgcacggccaacgtctggcacggctcacagctgtggttacggcgttcctggccgagcaccaccgtcagaacctcgggtgcgggcctgcggggggggtaggggagaggcagcgctctcagacctggccacaagcgtnctggggaagcccctgctcccgaaccccaatnacgtgttcnaaaaaaaanccgggancaccggaggggcgtggaaagaagggtggggcgggaganggtagggcacgggtncgggtaaaaanaaaaacnccctgggagacggagagcgcggccctgggcggctctgggcggcgggtctcgcggtctgcng

SEQ ID NO: 647935 - DNA, 647 bp, Homo sapiens
cgacgaccgaacgcccccgagagtaacaccgtggaccccagagctcggtcccgcgccctgatggatccgtccactggggcatagataggcatgcgtcgagggcgcgggacgcaggaggtgatgctgggctgctagggagccagaagagccacccatgacctggccctttgcctccagacgcacctagcgggaaccccagaagacaggcgctcgaccatccctaagccacgccacaataacatatcagattattctactacgctgtagagcaaatcggtggacgtacctaggataagataccttctgtctatcaaacttgatggcacataatccagagcactataccacatgcaccacattgaccacttggaaacccttcatagaggaggtgagctagcaggacgataaacatgtttgcctgccctactggactgccaccaagaacaggattgcgcaacaaaagagccatagttggggaaggtaaggagtacaccctacctaggtatcacacgaacaagaggttagaccgaacaacctaagggacgaccacacaatggctttgacggaagtagccctgggagatgggccttggaacttccccacccaagggacccgaacaacttctgtgaatagggtttggatactgt

SEQ ID NO: 647936 - DNA, 170 bp, Homo sapiens
ttatccccacaagcactttctcggcctatccggaatgccccgacgtttactcggactaccccgatgcatactaccacattaaacatcctatcatctgtaggctcattcatttcctctacagcagtcagttaagtatttactaattttttcagtgagttttgtacgaaggc

SEQ ID NO: 647937 - DNA, 761 bp, Homo sapiens
  misc_feature (31)..(31): n is a, c, g, or t
  misc_feature (67)..(67): n is a, c, g, or t
  misc_feature (97)..(97): n is a, c, g, or t
  misc_feature (116)..(117): n is a, c, g, or t
  misc_feature (124)..(124): n is a, c, g, or t
  misc_feature (188)..(188): n is a, c, g, or t
  misc_feature (205)..(205): n is a, c, g, or t
  misc_feature (290)..(290): n is a, c, g, or t
  misc_feature (406)..(406): n is a, c, g, or t
  misc_feature (701)..(701): n is a, c, g, or t
ctctctctctctctctctctccggaaggaangctgttagcctgagactcaggaagacaacttctgcngggtcactccctggcttctggaggaaaganaaggagggcagtgctccannggtacanaagtgagacataatggaatcaggcttcacctccaaggacacctatctaagccattttaaccctngggattacctagaaaantattacaagtttggttctaggccctctgcggaaagccagattcttaagcaccttctgaaaaatcttttcaagatattctgcctanacggtgtgatatggggaggcaccttgctgcaattgtggatcactgcagggctcctagtgacttcgcacaactgatgcttatacaagctcgcatctctggacttgtagagactcctnttaaaggacgatcgtcggtcacttgactacctcagaccagaatcctgcaggagctgggagaagttggctgaggaaggagccagaggcctgttgacctggtccccagtggctgaaccatatgatgtgtgatctgtgcaaggggaaacagacgtcatagggtccacgagaagcgacggacgaatggttgaagacagagcggtcatagcacggttgctgaaaggtgtgactgtggacctcatgaggccaggcctacttgggggccggtccctcgttagcccgcgggctggacttggcngtggctctagtcacaactgtgtcgtgggaatgccgacctgcccaatgaacctccccaacc

SEQ ID NO: 647938 - DNA, 578 bp, Homo sapiens
  misc_feature (515)..(515): n is a, c, g, or t
  misc_feature (552)..(552): n is a, c, g, or t
tggctattatttattttttttgagatagagttttgctcttgttgcccaggctggagtgcaatggtgcaatctcagttcaccacaacctctgatcctgggttcaaatgattttcctgcctcagcctcacaagtagttgttgggactacaggtgtgtgccaccacgcctggctaattttgtatttttagtagagacggagtttaaccatgttggtcagactggtctcaaacttctgacctcaaatgatccacctcggcctcctaaagtgttgggattataggcatgagccattgggcctaacccagtatatctatcattaattagaattcagtattcgttcaattttttgaggtataatttacatacagtgaaacttaagaatcttaagtgtacttttggatgagttttgatcattgcttccaatttggtaatccaaagccctatacaaatatacacataaacatcattacagacagtcactggacacttcttcctattcagtccttccctgaattntttgagacagggtctcaacttctgtcacttccaggcntgagtgcagtggctggatcacggctt

SEQ ID NO: 647939 - DNA, 549 bp, Homo sapiens
  misc_feature (31)..(31): n is a, c, g, or t
  misc_feature (67)..(67): n is a, c, g, or t
  misc_feature (97)..(97): n is a, c, g, or t
  misc_feature (116)..(117): n is a, c, g, or t
  misc_feature (124)..(124): n is a, c, g, or t
  misc_feature (188)..(188): n is a, c, g, or t
  misc_feature (205)..(205): n is a, c, g, or t
  misc_feature (290)..(290): n is a, c, g, or t
ctctctctctctctctctctccggaaggaangctgttagcctgagactcaggaagacaacttctgcngggtcactccctggcttctggaggaaaganaaggagggcagtgctccannggtacanaagtgagacataatggaatcaggcttcacctccaaggacacctatctaagccattttaaccctngggattacctagaaaantattacaagtttggttctaggccctctgcggaaagccagattcttaagcaccttctgaaaaatcttttcaagatattctgcctanacggtgtgaagggagacctgctgatcgacatcagctctggccccactatctatcagctcctctctgcttgtgaatcctttaaggagatcgccggcactgactactcaaaccagaacctgctggagctggagaagcggctgaagaaagaaccaacagccttttgtctggtccccaggggggacccttttggtgtgaccttgaagggaaccacatttacgggtccagaataaggaggcataattttctgacatgctgttaa

SEQ ID NO: 647940 - DNA, 284 bp, Homo sapiens
ggacagtgtctctcacccagtctggaatgcaacagcgtggtctcggctcactgcaacttccacctcccaggttcaaaggattcttgtgcctcagcctcctgagtagctgggactacaggcatgtgacactatgcctggctaatttttttgttatttttaagtagagacggggttttgccatgttggcccaggcaggcggatcacttgaggccagaatttgagaccagcctggccaacatggcgaaaccctgtatcactcttttagacccttctgtcgtcttctc

SEQ ID NO: 647941 - DNA, 346 bp, Homo sapiens
ccccaccccccatttttattttgtgaagggcccctcgaggggtaattcccccccccccggttttccctgaaaaagatcaccccccttgggatcacccaagggaaatgtttcaacaagggccccggcccccatggaggggggggggttttttttaggggggggccaaaacccctttgggggggccctccccctagccctgtttggggggccagccctttgggcatttaggttaaggccccgggggagggatgcccccccggttctttgggggggggggccctccccccccctggggcccgggggttgagattccccccgttggcccgggaaaagcctttttggggca

SEQ ID NO: 647942 - DNA, 660 bp, Homo sapiens
ctcagtggctcacacctgtaatcccagcactttgggaggccgaggcaggcagatcatgaggtcaggagagcgagaccatcctggctaatgcagtgaaaccctgtctctactaaaaaatacaaaaaattagccaagtgtggtggcgagcgcctgtagtcccagttactcgggaggctgagattataggctcgagtcaccacgcctggctctgagcccttttcttaaaaaaaaaaagttcgtttaagttggttggtttggtttttgagacggggtctccctctgtcgcccatgctgcagtgcagtggtgtgatcacagctcactgttactccagcctgggcaaacagagttagaccctgcctcaaaaaaaaaaaacatacaaaaaaaaaaaaaaacattttgtggggagcgccgcctgggcccacgggagagaagagcttgttacagaaccacttgcgtggggcggccgaggcggccccaatgaggggatcagtaacaccctgggcacagacgtcgcccccaaaagaaagcccggcccaggaagcaggggctgggattctccccccgataaaaaagccccggggacacagcgggttcggaacactccacaggggtcagagacacggggaccatcacgggcccaagacgcgaaatagcgcggg

SEQ ID NO: 647943 - DNA, 868 bp, Homo sapiens
  misc_feature (738)..(738): n is a, c, g, or t
agcggggtgcgcgcctttgagtcagcaaactccgcggcgcggaatgcccggtcggcccggccctggtctgtgctgggccggaggagccgcccattgatcatgtcctgtgcctgccagagatgttctccgcggacacagagagcaataaggaggcaacttgtgtgaagctgctcctggggttccgaggactcctagcgtattcacgagaaggcatgggactctcgtggcgatttctttacgattgggacctatgcatgggatatggtattcatgactatagtgagtcgacttgtgctttgaacaagatgaaaacatccctgtggtgacgagaggaacgatcatagaggaatatcagtagtagcgttgcgacgtgctagagactcccaaaaagtaattggcggtagcgtggcgctaagaacgtgtgccaagcaagtgtcctgtcttacatacacaccgtgtttgatgcaacaattgaagaattcggcacagcgacagtaggactcaacgccgattcggcgcaagagagtacgttggcacaagggagtatgtcccgtactaggaaagagacggtcccctatcgcgaaaagttggccatcctttgtgctaggccttgtactccataggatctgaggggcaacgcgctgctttccgaagccctaccatttttccctttttcaaaccgaaacagtaaaaaggcgcccccccaaaagtatttcccttggtggggataaaaatttntattccccagtaggaaaaccaagggaaaccacatttcggtaaacgcagccgagtttgtacggtaacctcctgggaggcgccgatggaaccataaaggggttagcatccattggttgcggaaaggtacatg

SEQ ID NO: 647944 - DNA, 351 bp, Homo sapiens
agtgtggtcgtgtggaatgcattgtcccgtcttacaggcacgttttctcaagggcgccagtccgtttgtacggtgggttgactgcgcccggctgttctggtggcagagcgtcgccccttcgagaggagggctcggaaggggtgctcgcgagctcagagcgggctgctcaccttgagctgtgaggagctggtctggtggaacttgagctggcagggtgactgagtgctacgaggaagcccccacagcagggtgcccactgcttttgtccagaggaacccctgcctgggagcctaagttgagctttgttacctgagaagaaagaaggatgtaggacagaggacatcacaggat

SEQ ID NO: 647945 - DNA, 263 bp, Homo sapiens
aatgggcggtattttgatgccgaacacgatcggctaatgctggatttagctaatggtatgatcttccgttcacgtttcccggccaaaatgttaacgccggacgccttcgatgaatgcgctttttgcgtggatgacgccgccctttatttcacctatgaagaacagtgcaagcagatcaaactcagccatgagcagcgcgccgagctggtgttgaatgcgctggtcgcctaccgcttcctgaaaccgctgatgccgaagagctg

SEQ ID NO: 647946 - DNA, 267 bp, Homo sapiens
ctgtttaaaagctctttagcgaggtcccacttttctatttctgtttccattgcaattgcttttggagattttatcatgaaatgtttgccaaggcctaggtccagaatggtatttccaaggtattttgctagagtttttatagtgataggtcttacgtttaagtctttaatccattttgagttgatctttgaatacggtataaaaaaggggtccagtttcaattctctgcatatggctagccagttatcccagaaccatttgtcgacg

SEQ ID NO: 647947 - DNA, 130 bp, Homo sapiens
tgtgtagactgccttacttctataggttctcgtctcctctgaattatacctaacagtttactctccgattatctaccgtgcctccctttaccaggttctccacaccaccctttccagtccattgactgcc

SEQ ID NO: 647948 - DNA, 260 bp, Homo sapiens
ggattaggtgtgcccaggcctccagagccgggcttgctagttaacccctgcatgtcaagctgcctggtgtcccaggtcctcaccgcaggcctgtgaagtgggagcttctggaagttgttttctcctctgcattggctgagttggccctagtctgtcttggaaagtgtaggcagtcacagatgtccccaaatcagagtctcacagtgagtgagcgccctaagcttcagtctgaaataacagaatccccactgaaagacaga

SEQ ID NO: 647949 - DNA, 168 bp, Homo sapiens
agcggggaagcggaaggctgcaggaagctaaggagggagtccaggggctctgaatggggtgcatgcttacccggacaggggagagccacggatggtacagttggtcactggccgggggaaagagaattcagagaagcggtcacttaaagaagtgatggttccccgctg

SEQ ID NO: 647950 - DNA, 503 bp, Homo sapiens
  misc_feature (44)..(45): n is a, c, g, or t
ggggggggggtctcccacggaaaaggggtaattttttttttttnngcccttcttccttggcggggggaaaaaatttttttttcaaaaaaaaagaggggggggggggcgcccccccccggtgttttataaaaaaaaaagggccttttttttttgtggggaaaaaaaaccccccaaataaaaacaccctttctaacaaaaaaaaaagagggcgtggtttttttttataaacaaaaaaatttttttttaaaaaaaaaaaatggggggggatttttcaaacaccccaattgggtgcccccccaaaaaaacaaataatttttttataaggggttgggggaagaaaaatttaaagcttctcccattttttgggccagggggggaaaaaaatttgcgccgggtgtggaacagcgcgccttcgggggtatccttttgaaagtaaaaactgacaacttttcagtatggtgctcacgtagcattagatatgttgacgactactacgtctcgat

SEQ ID NO: 647951 - DNA, 511 bp, Homo sapiens
aatccccagccatccaagggccctttttcacccaaaattgaaatcaggcaaggagatacctgtgtttccataatcaggcgtttaatgaaaatgaatcgaggaattaaagccctttccaaagtgaaactgatgagatttgatgatcccctgttggggcctcgacgagttcctgtcttgggaaaggagtcccccgaaaagccccccatttttgagcatgctgttttcaatgtggccctcatgagcaaaaaaattcttttgattgaaaatgggataagggtggatattggcaatccaaaaatctattgggttcattaaactcaggcccattggagatttatcctggttttttaggaaaactactactctgattgggtttactgatgggctatcaaacccttaggggggccctaaatagattgatttcatttttacccacccaatttggcaggtattcataattttaccaagtcatttttgattccgggcccaaataaattttttttccctttca

SEQ ID NO: 647952 - DNA, 310 bp, Homo sapiens
caaacccccccctaaaaaaatttttagaatttgggcccgttcccccctttggggaatttgaaatttaggggcggaaaaccctgaaggaaacccctgttccccgaagtctttccattgaggggggtggaaacttttgaaaaaggccccgttttaacaaaaaaaaagggtttccccggggggggttttgcaaatcccccggaaaggagttaaaagcaaatgtttttgggccggttttttcccccattgtaagggggcccgggtttttactgtggcccctggcccccttccaaaaagcaaataaatgttttta

SEQ ID NO: 647953 - DNA, 547 bp, Homo sapiens
gcggggcaacgtgtgtggggacatgcaatgtctgaccctgccgcattgagtgctgctcagttcacctcccagtgtcatcatcctgaaccacccgtgggcagattagctgcctgtgctactcccctgtgtcatctgactgccacacagcccacatctgcctgcaaggtttgctggagcttgaagtgagaatgatttgacctgtgcgctctgtgcaatgaatgctggatgtgacaaccccagagtccctgaatgtctggagactgctggccatctgtggagatggtgcctgggaaagcccatgtgttgatggagatgcttctcccatggtaccctgcctctcggcctgcgttctgcctgttgctgctgacattgatggcagactgtgtggcctgtaaggctgttcactcaatgaacctgtgggatgaatgacatgatgcgtgatgtgcgcccgtgcaatggtcaccaatgtcggctgcatgaatggccgcagatagggctgggcaatgttgacagctgctgggcgcccccgtggcgcggaccctccccg

SEQ ID NO: 647954 - DNA, 869 bp, Homo sapiens
ggcctccgcaaaaaggggtcctggtgacgagtcccgcgttctctccttgaaatccactcgccagcccgtcgcctctgccgccgaaccctgaaacccgcccctctcctgtgccaggaacttgtactaccagcaccatgcccttaccaatatccagcactgacccccggagcagaaagaaggagctgtctgacatcgctcaccgcatcgtgcacctggcaaggggcattcctggctgcagatgagtccactgaggagcattgcaaagcggtgcagtcccatgtgccaccgagaacaccgaggagaaccggcgcttataccgcaaagtgttgcttgacagttgaacgacccgtggttgaacccctgcattggggggtgtcaatcctctttccatgagacaatctaacagaaggcggatgatgggcgtcccttccccccaaagtatcaaatccaagggcggtgttgtgggcatcaaggtacacaagggcgtggtccccctgcagggacaaatgggagataacaccaagggttggatgggctgtctgaacgctgtgccagtacacgaaggacgggagctgactttcgccaaagtggcgttgtgtgctggaagatgggggacacaccccttaggccttcgcatcagggaaaatgccagtgttctgggccgtatgcagtaatctgccagcagaatgcattggccctcggtggaggctgagatctccctgatggcgacatgacttgagcgctgagtttggccgaaggcgggggggcacaagcccgatgaccacattactggcgcctttggaccatggccggcctgtgtccaattctagagacacggcgcaaggccaagccgagaacctgggaagagc

SEQ ID NO: 647955 - DNA, 245 bp, Homo sapiens
atatttttgggataatgaagaaaacccaccccttcagggaaaaattgagattaacttatttttcttaaaaggttcatttcaaggagggcaacaaagtccagcttgggcccccaaagggttttacatgatcaaaccgggtacagctttttgggtgaacggttgactacaaacatttaccaaaaacataaatttcttttaaaaaagcccttttaaataaagcgagaccccgttttccagaaaaagga

SEQ ID NO: 647956 - DNA, 991 bp, Homo sapiens
  misc_feature (149)..(149): n is a, c, g, or t
  misc_feature (553)..(553): n is a, c, g, or t
cccttggaacccgttgtaaaagcgttgggcccccccgggtcctgataccctgcgaacacttccattgggagcttccctcctatgggggtcttgctccccccccgtggggggtagtcctctcccccggtgtctcttggtatcacggaggnctgttgggcgcccacactttatccccgccgccctcttgtggggggggtgacacttctccccgcttagatttcccctctcgcttgggagacttgtataaccacccccccgagaggagagattgtccccccccagagggactctctctctgtgaaaggcacacacctctctatagggctcttataaaagagccctctttcagcacactttgagtgccccgcgcgctcgtttgggcgccctataaaattggtggccccacacgaaacatgggctccacaagcacacccacgaatcgcgctgtgtgtctctcgagacgctctgggcgccacgccgctgtcgccctcttctctcggagagggagccccaaggctgtgctttctgggccagcgcgagactccacacgctntatacacgagccccttctttagacccctctgcacggcgctcgccgctatacacgcgagactttccccgcgagaccctctataccccaccgcgctataccccggggcccacagcggccacaccccgtgaaccacctcggttgaaagtgagaagcacacctctcttttgaggagcccacgggccgagggcccctcggccgaacttgggagaccctatggcccaccgcccaccccttcgaaggaaaggtgtcacacctggagcccccttcacattccaccgcgagaggaaactcgaggccaccacagggagagcggccacatccccacattgggaaaggggccaactccccggagagaccccgacgggcttttgcaacccttccctctttttgtttttaaaataaattgtatttttgaatccaagggaggataaaggatta

SEQ ID NO: 647957 - DNA, 103 bp, Homo sapiens
ggatttgctggtgcagtacaactaggcttaatagggatcgaattcgagcctcgaattcgaggctcgaattcgaggagcaaggctccgtctcaaaaaaaaaaaa

SEQ ID NO: 647958 - DNA, 187 bp, Homo sapiens
gttaaaaaaagtaaaaaaatagaatcagctgagcatggtgacatgcacctgtggtaccagctactttggaggctaagttgagaggcagtgatgggaggatcatttgacggcccagaggttgaggctgcagtgagctgtgtttgtgtcattgcactccagcctgggtaacagagtaaaaccttctgtc

SEQ ID NO: 647959 - DNA, 110 bp, Homo sapiens
attatatgcgggacgtatacgatttccgggtgtagtaggtttctctaattcaggcttatactcatgaatcttgtctgaagcttaatgagggcagactgccaagtcctgga

SEQ ID NO: 647960 - DNA, 114 bp, Homo sapiens
attgcctttatttcctttcatatggtaacaccagcagtgtatgatatttgtaaataaaatacactgctggtgttaccatatgaaaggaaataaagtcaattgataattgcctca

SEQ ID NO: 647961 - DNA, 109 bp, Homo sapiens
ttggtgttcctctaattctccaagtcccccaacaagcacaaccgggtgtacattgaaggcgcggcccttccccgacggcctggccgaggacattgataaaggcgaggtg

SEQ ID NO: 647962 - DNA, 879 bp, Homo sapiens
ggtattgcgtacacttcatagcacatgcacgtctgtcccagactttgacaacctgcacaagacaaggcattcctaaagcaggagagacctccctagggtttagtgtgtgtgcacactaccctcactccccaactggccattaccctagttctgcccttgtctgtggagttacagcctcaaggttgtagcatgtgtgctggcaatcagggccgcagtgtgttctgcgcctgcccagagctgactcctgatttaaccgctggcgtaatcgcgcgggtcgcacgccatgcgtgctgaaaagcctttcaccctcacgtggtttcttattcttaaccaggtcatcaaggcgaggctcgcgcgcaggccctgcgttggaaacatggcggggaagctgaacacctctgaatgtgcgaggcgccagaagctgctgaggaggctgaaggtagtgagggcaagtgggctgcactcctttctctccaaccagggcagaaacggagggaggacttcgtcccagttacaactaatgaaataagtgatagttctaatttttgtctaaccttagaacatgttagagccttccgttacttgaacgaaacaaacaattttataaaccgttcagcacacggtggagataacttaacaggcatattcttatcaccgagattaacgtttagtcaactgtagggtatacgtcgtcgagagtaaacaagatgtagttcagtacgaaagtcttcaaaccaaaagtggggcggtgggggatgtcctcataaccaatcaccgtgcttgcagcacccccttaattaagcaggaattcccagggtccgccaatttcacaccttaacacctctgacaccttgatggactcgtaaactcttatcgaaa

SEQ ID NO: 647963 - DNA, 367 bp, Homo sapiens
  misc_feature (297)..(297): n is a, c, g, or t
  misc_feature (312)..(312): n is a, c, g, or t
  misc_feature (357)..(357): n is a, c, g, or t
aaaggatgatggttagagttccggggatgccccatgcactggggtgaaacagcaatgcttttttttcaataggttcactaccccactttggcacagctgctaaaaaccatgtgatggtaagaattaccccccataccctgccagccatagtaaaaaaatagggtttaataaaaggctgggcccgggttttttaataaaaccctggggtccttggggaacccttaaattgggcagggatggatgcattgcgggctactcgattttcaagcaaaaatccaatgaagaaaattaaggatnccatcatgtagcagnctgcataaaatataataggcctttcaggaaaacggacttttgtgncctccatcca

SEQ ID NO: 647964 - DNA, 132 bp, Homo sapiens
ctcggttcatgtgacaggaaggtaaactccatcattaaactagctaatgattataactaataaataaataaggtggggagaggtggctcacgcctgtaatcccaacaccctgggaggttgaggcgggcagat

SEQ ID NO: 647965 - DNA, 464 bp, Homo sapiens
tcagactcgtacgcggcgggcgatggcggctgagatagcgtgcgctggtgtgtaacaagaggttgacggagcggagatgcaccactgcactccagcctgggcgacagagagagactccgactcaaaaaaataaataaataaaaataaaaaggagatttatttgagaaacacttaaaaacacaacggaaacttcataggccagtttgcagaagaagataggtaataataacgtatgtatttttgtgactgtacacactgaggtgtactgatgacagtcacataggtgtaacagttacgagaagatgaactatattcataaggaagtaggtctaaaagcaaaatatataaatgcatatcactatagttggtaattctgtgcaacccagttttgtaactggtcatctgacataccttgatggacaacctaagtcttttgatgagattgatcaaaaattgtgacggat

SEQ ID NO: 647966 - DNA, 148 bp, Homo sapiens
gaaaagctgggagtcatttgtaaaggcatttaagaaaatctctgtccaatcattagctgacaactaagctaactgggctaactgctctaacagagcagacttcagtggctgcactttagtctgggtgacagagtgagaccctgtctca

SEQ ID NO: 647967 - DNA, 1288 bp, Homo sapiens
  misc_feature (212)..(212): n is a, c, g, or t
agcggggtgctgtgtccgggcgtgtgttatgcgaggagtctgagtgtgtgagcttgagatgcggggcgcctacgagctaaccctggaggatggagtgcgaggccaacgaggagctccgggctgacgcgagcccacgggcaagcatccgtgcatttctgcgtgcctggatgaggtgctcgaaaggtcgcgctgaacgttgagacagcgtgacncgggctttgttgaatgatacaatctaccaggaaaacgacgagctagtggagacgagccatccatgagctcaagcgcatagagaaactatctcggtgagaacgaggtgatgtattagatgctagaccgtgggacatgatatctctcgatgagcctcgatgccctaatatactgtcgacgcatcgtagattgcgaggagcctcggggagaaggacgccttgtttgaaccagaggtctgggtggtgcccacaggtaccccaagggaaggtacaattatgggtggcttggcgtgtggctatccaggtgttgtacttcgctcgaaggtgacatcaacctttgcaattaattgcttttctatgtccatgtgtaatttacttttatctgtgtctaagaccgttcgtgcatacgcgctgcgttcggggtacaacccgtgttgaagtgattaggtcctttcatatgtctcctccttgtgatggaaccgtcgctgaatcttcgctttgcctggtttcttctcaatcgcaatatcgtgctcttctgccccttttggaagcccaattagtatcatggttcgtgactaccacgcgaactcattggccatcgagggattctaaaagagcattccaccgcgtagcagacttggtcgccttgaagtttagttagagggtctggtagcgtatggaacgtcgtgagccatgcagagccctgtggaaaaagctaccatttcggggagttagagattatcttttcacaaccattacaccttagggagagactagagcatattcacacgacaagcggtctccctcgagaggaccagctgatggcgcaattccttggcgcaccccatagagccgggcgcaccagtgggaaccggttacatacgtgggtggtggcgcccagcgttatctagcccctatggtgtgtggcgcccttcttgggggcgtggtttttgccttgttgcgaaggccaatgggcgttagatattcctggaggccgcactatagcgtgggactgacacgaggttgtccaagcggatgttttggaacaccgagccgggtagaggttttccgcaagtagg

SEQ ID NO: 647968 - DNA, 290 bp, Homo sapiens
tatatagcctcacactcttggaatttccaggctatggcgggtagccccaaaaggaggaatctcctatggccaataaggtatcttgacttctatcaaagtagaagagagggccacttcgccagctcaaactcatacactagcgccttatgatgccttcaacttcattctttcagctttcacttaaccagctaacctacctaaaggcaaagcgcttaaccaacctattccgccctctaaacaacggcaactcaaacaccctagcgcaagctcacctcacttctaacaaaccg

SEQ ID NO: 647969 - DNA, 635 bp, Homo sapiens
  misc_feature (499)..(499): n is a, c, g, or t
  misc_feature (508)..(508): n is a, c, g, or t
  misc_feature (527)..(527): n is a, c, g, or t
  misc_feature (531)..(531): n is a, c, g, or t
caggtggacaaagtcaacttccacatgtttgacgtggtgtggcccagcgcgatgcaacgcacgcaagtgtgatcccagtgcttcaaacgcatgtggaggtgcccatccatacttacgtggctggcccagccagccagctcaccacacctgcgtccattccgagtgcaggcaccaagcctagcacccaacccagccatgccaggcagcgctcctgcaacgctccttccaagcagaccatctagcgacacacaccagcactgcggcttgcagccagcccatcctcctgatcgataccatgtgtccctccacaccagaggccacaggcatctggcatacgactagcagcaaacagctcacatgtacactggggcaaacatccgcaacgcatttggacgggacctcacatattgcgcatgacacatatgtggcgtccggactcacacaacatgagcatacacatggagcgcaatggcataacatacgcgcggacgaccaccgngcacgcagngcagcacgacagacgctgnaccncgtgcgaccacaggtcagctctacgagctgccggcacggaactggcaagactatcactacacttagggacagagggcgaaattacacaagggacgacccattgg

SEQ ID NO: 647970 - DNA, 275 bp, Homo sapiens
gctgaccctaactgcagaccatgaagtaaatattgtaactaggtttttgcttctccagtggtgaccaccccccccatcccgttcacaacttgggttctcttcagcaggcgagctgagaagcgtcaatgagcacctggggattttagtaagcgtgtcttctagattggaggctctcttctagagtgctacatagtggtaatcttgatgcataggtagatgatatcaagcaatctcttactgaggacctcctcaggttatagctaagcagtggctga

SEQ ID NO: 647971 - DNA, 190 bp, Homo sapiens
tcccactatggtgctttcagggcagttgtctgtagtagcatggggaacagttgtggccttcaagtgtcgctgtgatggacagtggtacagctcatcccttgtggctgaagtcagatgacactcgcagaggtgcatctcacggctcgagctggttggcatcatcaccaggggtacgagctcgatcgtatcg

SEQ ID NO: 647972 - DNA, 229 bp, Homo sapiens
cgccctgtcgtagcactcccatgctggtttatactctcttggtcgtggattgtcgtccgtgcgcgacctactgactgtctgctttgtttctgtggcgtgtgggttacgtacctggggtttgtggggttttcttcctaccgccttctcctactttactgggggggctcctctacgacgtcgcccagccggcctagcccgcttgagccctggccgtcgtatacccccgtcg

SEQ ID NO: 647973 - DNA, 1208 bp, Homo sapiens
gattgcgagagagcgggtatgccgacggatgacaggtgtcgctgaataaggctacccctcaagatagtacatgatgggagttaatagcgagaataggagtgcattcatcgatctgtgtggtccgtcaatgtaggcacatacattttgaatatacagggcgttagtcacaatattgattgtgacatcatagatctaatgatgttgcgaggttggtatctgaatgagagagtcgattgcaatatatttgtgagtaaggagagctagtttggatagatgggacagagggtctaccgtgtacgatacgttgatagactctgagggtgcatctgggattcaagatctcgcaatggcgtagaagtcagtggtaagcagatgcgatatcaatggaatctgaataattcgttattatgttgggaaaatttttgacgaatccagaaaacgttaccatatgtagtacatatcaagttgatggctccgcttagggacataagaagtaggtctttactcgagaaaaacagtcgatgtaatataccatgggtacgatacatctagtgggcattgaacatagattgcctggatgcacatgcaatgatggttggctagacatggggttgataaaggagtgcacatgtttggataagctgggatagttcttcaaaggtcacaattggggaggaacaaagccctggaaggagtacatttgggcctccgttctcctttgggaacatatttatactactaggagaggaatggttgtagagaaacaaatgcttaaagttgatggttccaggggaagatttatagctaaaacataattagggtattttcccaacttgtaagacacacactctcgataagtgaaggcccaaggaaaaatggaaagaactcaattggacgggggaaagaagtataggtgtaagaggggaaaacggtacaatggacgaacgttttaacgaattttaaaggaaacaaacattttgtgagttgagtatacaccacgagaaacgataaagatacagacgatttgaggttgaccctaggatttacacatgaggttcgagggaactggatggtggaacacaaccaatcttggattctaggagagcccagagcagaatggcctaaacacttggccttgtggggttttcgaaagggggaaaattgtatgcaaaatacgatcgagaaccacgagtacacggtgacatgag

SEQ ID NO: 647974 - DNA, 167 bp, Homo sapiens
gaagtaatgctggaggtagtataacgaattacccctaatacttagaggctgcaaagtaatcacgtttcttatgcttgtggactctgggttagggattgggacagggcactggggagtggcatctctgtgctctatcatatctagagtttcaacgagaagcggcgaag

SEQ ID NO: 647975 - DNA, 335 bp, Homo sapiens
  misc_feature (66)..(66): n is a, c, g, or t
tcctgtgaaaataggtaagaggtggccctgccctgtaaaattgaatactaggcccgagtgcgttgnctcatgccctgtaatccccagcacatcatgaggccgatgctggtggatcatgaggtcaagaaattgagaccagccctggccaacatggtgaagccctgtctctactaaaaatgcaaaaattagccgggcatggtggtgtgtgcctgtggtcctagttactcgggaggctgaggcaggagaatcgcttgaacctgggaggcagaggttgcagtaagccgagattgtgccactgtactctagcctgggtgacagagtgagaccctgtctca

SEQ ID NO: 647976 - DNA, 397 bp, Homo sapiens
  misc_feature (40)..(40): n is a, c, g, or t
gcaagccccacctgttccctttcaaggtgacaggcccctncgggtttgtggtgggcgcctcatccctgccccccgggggcctgggattgtttccgcccctgtgcctaaaaaactgctcattatgggtgggatcgatggctggtaccccccaggccgggggtgccctgcccccctggggaaatttgcccaggcccccttttatgcccttttttagacccccagctacctggccccccccctttggaagggggctggtttcccccagtttccccttccgggggtccctggccccctcgtccagacccccccccgagtttccgggccgcgggctccgggcccccctgggggttccacctaggggtttttttccaaaaaaataaagtgaatttagggggga

SEQ ID NO: 647977 - DNA, 1172 bp, Homo sapiens
agctggctgtggggtgattcagctgccctggctgaggcggatgcggccgcaagaggaggaggggagagcccgtcctgcgcctgtggctccctgtgtggtgtgcactgatgccctgctggcctgtgatgtgctgatggctggagtgcgaggatgtgcctgctggtggactgggatgtgcgatggcctggcctggtggccccctgaagccaatggatggaactgctgctactacctgatgacctgtgttggagggacgtgtttgctgtggccaacagttctgagcgtcaaaccgagacgtacgtggggcttgatgccctgtgaacagggtcacggaaaggcttaacggacgaacgcactgggggctccaaacggaggttaccgtgctttgagacgacagggaaaaaaaccttttgcctggaaacctttggtagacttatgaggcaaggtttgacacgacctttggcataaggtatacgggactatatatagtttaacttggtgcatgcgattgtaattagtcgtatttggtattatggggcgtgtggggtttttggaacggacacacgtgttgacgcggacaaacagattttacaatgcgcttttgtgtaggaaacccttttttggtaactttttacctcaatacttagtaggccaaagtgcaactttgtggggttgtacttggggcagtgacaatgaaacttgcgttgaaaagatttgccaatccgaaaggccccttttaaagcgacacttattgaaggccttggaaaaagtgtgcaacagtgtggtattccggaccacggggacccaggaacaggaagttggtgcacgcggcgcttacaaggcttaaccacgaacactaagatgtacttggtgcactaatgtggacggacaacatttggggttgggattggggtggaagcacaaggtttcccatcggggtgagagacatataaagggcgttaaaagctgttaccaatagaagagtttattccaccgacgttattcgagttgttggcaccgatggccacagaattcaacaccagggggtgagaacactcgagtgcgctcttgtggaacatcatcaggcgacaattggtagaccaccgcggcactgtgtacccacaggagaacttggggcaccaccagtaatcaacagagatcgtcgggcctct

SEQ ID NO: 647978 - DNA, 973 bp, Homo sapiens
cactgaagcacaccaaccacaaaaaaacataacacaaaatacaatataaaataaacaataacacatccacatcaccagcaaaccaacacaaccataaaaaacaaacaaaaaacacaacaaaatacaaacacaaaaatcatccaacaaaacacacacaaagaaaaacaaaaaatacaaaacacaaaaccaaaacaaactacaacacaaacataataaaacaacaccatacacaaaacaaaccagaaaaaatctaacaccaacaaaaacacaactaaacaacaaacacaaacacacaataaacaccaaaacacatataaatcaacacaacactcaccaattacaaacaacaacatacatacacaaccaacagcaaatcaaaaaacaatacaaaaaataccactaaacacacacacaaaacaaccataccaaacatccaaaataaccacacaacaacattacacacgaaacaaaccacaaaaacaagaaaaaacacaaagcaacataaactcaaacatccacaaacaacacaacatatacacacataactacaatacacataacaacaccacaaaacaccacacaaaccaatcaccaacacacatcacactaagtccacacactcatcaatcaccacatctcaaaatcagacacacaataagaactcaatctacacaaacaacaataaaaacaactctcaaatacaacacaacatcacgaaaaaacaaatctatataactaaaaaaacataactataaaatcacaactcaaacaaatatctacacatacaaatactaaaactaaatatctatacacacgaaaaacgcaaaaccacattattaacaaaacaaatacacataaacaaacaaaaacaaacaaacaaacacaaccacacaataaccatacagaacaaaaaataaacatatataaaatcaacacacaaaatatacacaaaacaacaataaaaatacacaac

SEQ ID NO: 647979 - DNA, 743 bp, Homo sapiens
  misc_feature (1)..(1): n is a, c, g, or t
naggtcggtcccgggccgggtcgggaccaacccccccggtgcgctccccccttgtgccccaattcccctggggtgaggcgccccctgtgcgccacaacacctggggccttttcatgagcattgggccagacttgtggcccgtcacaggggttacactccacgcaggccgcgaccacccatgcggccgcacacgaggccgcccgctctacaaacacgacagaacaagaagaagaatcgcacacacgagacttctccatcgttgtccaggacaagacaccaaacggcacgtgcccccccagcagcccgcccgtgctggggcctcccccctccggccgtctagagagaagagagtggttgttctcccaggcgcctttctctggcgagctcgcccgctctctgcccctctgtcttggggagttccacccccctctcgtcgttacatgtctctttatcgcggtgcgagcaccctccctcgtgcgtttattgcggagagtcccggtggtccccctggccgcctgcgacttgttggtcccctcccagcatagcacgccccacgtccgcccaccttcttcttgatggacagtccttggcgcagcaagggctcccacttgaggggagccattctcccccacgtctgcgcgctcctcctcctctccctctatgcaacgacgccaccttgttacgcgtcgattcttctaacaaaccacaggcaaaaaacaacaccaacaaatagaaaaaaaata

SEQ ID NO: 647980 - DNA, 198 bp, Homo sapiens
  misc_feature (166)..(166): n is a, c, g, or t
  misc_feature (173)..(173): n is a, c, g, or t
tacacaggaggttgaccatcttaaccattctagagtacagttcagtagcattaagtacattcacattgttgtgcagccatcactaccatccatctaaatgactcttttcatcttgcaaaactgaaactttatacccattaaacaacagctccctattccctcctgnccctgtntctggcaagcaccattgtactttgt

SEQ ID NO: 647981 - DNA, 152 bp, Homo sapiens
  misc_feature (41)..(41): n is a, c, g, or t
  misc_feature (103)..(103): n is a, c, g, or t
  misc_feature (106)..(106): n is a, c, g, or t
gaagactcggcggtcgcacctcttctgtccaggcctcggcnttcctgagcatctctccttcctctcccagatcgtcttctccttcagtttcaaagccagtggntcngcggccacctcccgggctctctctgtaaggatggtggggttaagcc

SEQ ID NO: 647982 - DNA, 249 bp, Homo sapiens
  misc_feature (67)..(67): n is a, c, g, or t
  misc_feature (233)..(233): n is a, c, g, or t
  misc_feature (235)..(235): n is a, c, g, or t
tgggggagcgggaccggacgaggaggggagggccggaccccgagacaccgccccgggcgtccggcgnccccggaaattgagaggggcctgggcgagcggctcgatagcctccatcaaggccaggttccgccgttaagctcctgtgccccccctgggcccggggcggaatgcggaaaatttccaagagggaagctttcgctttggaaaaactcacttaatccagggttttcccngnacagaagattttcc

SEQ ID NO: 647983 - DNA, 234 bp, Homo sapiens
caggatatgatgtctcgggcttcggcgcttctcgatagatagatgatggtgacagcagcagcactcagccacgatcccaggaagggccagagggcgtgcaggtggctgcgcacgcggagcgtgatagatggcctgagtcggagccccttggagctaggtgccgtttgcaccgtgtacatggcgcggtggtcgagcctccagtgttctaggttctcaattgtgtatgctctgacc

SEQ ID NO: 647984 - DNA, 801 bp, Homo sapiens
gtccctttatctgccatcttgcgtccccgcgtgtgtgcgcctaatctcaggtggtccaccctgagaccccttgagcacctaacccgtagtccccacgcgcggtcccttattctgctccgacaatgatgaacagacacaatcatgaaccaggaaaaactcgccaaactgcaggcacagagtgcgcattggtgggaaacggaactgctcgcagaaagaagaaggtggttcatagaacagccacagcagatgacaaagaacttcagttctccttagagaagttagggcgtaaacaatatctctggtattgaacgaggtgaactatgttgacaagccataggacacagtgatccacgtttaacgaaccctaaagtccaggcatctccggcagtgaacgtcttgtcaccattaacaggccgatgctgagacaaagcagctgagcagaagatgctacccagcatcttaaaccagcttggtgcggatagtctgactagtctaaaggagactggccgaagctcttgcccaaaccattctgttggatggaaaaagcaccacttgctactgggagaggatgatgctgcatgaagttccaggatcttgtgcaggaaactttcgatgaggcttcccaagaaattgagggcaaactgaattggaggtcaacttctgaagattaaaaccttgaagaaagttactggggagctgctattttatcttattgacctggctttttaacgacaatttgggtcactgggcatctgataacaaatcctagaatctctaatatttttcaagacccaaagccct

SEQ ID NO: 647985 - DNA, 267 bp, Homo sapiens
tctggagtgtgggctagtatgctccaagagcagctgccctgtcagtggaactccggcgcacttccagctgggtactgggcctgttaggccgatctgacagatcggcctaacggctcagatcggcataacggaatcaagtgttatggttagagtgatggcacgcagcagggccccaagaaacctctcagtgggagcgtcgctgtgatcgggacagtctccagggtgtcgtcttgagaattcgaaggacgatggtatgctgatgggtgc

SEQ ID NO: 647986 - DNA, 173 bp, Homo sapiens
ataatataggaaggtggggatcaatagagggggaaatagaatgatcagtactgaggcgggataggcctaggattgtgggggcaatgaatggagcgaacagatttacgttcattttggtcctcagggtttgttataattttttatttttatgggctttggtgctgccggtgaaa

SEQ ID NO: 647987 - DNA, 365 bp, Homo sapiens
ggtacatggtatggggtagacacccacaacaaggacattgctgccccctttgaagcttttgtgtgggaccccgctatggtggggatcaatgcgctgccaccaccctttgaggcgggggccctgtttgggtttgtaaatgaacccctcaaaaccccccgcttgactgtggatgctcccccaccaccaggccggggccgtggttggggccccccccctttaaaggccccccccccatcacatgggtgggggggtgtggggggcccttcccccccctgggttggttacttctttttccaaggaaggggtggtaattggccccccctctttttcctgggggctttttaaataaaatgtaagccttccga

SEQ ID NO: 647988 - DNA, 1508 bp, Homo sapiens
  misc_feature (275)..(275): n is a, c, g, or t
  misc_feature (492)..(492): n is a, c, g, or t
  misc_feature (734)..(734): n is a, c, g, or t
  misc_feature (1259)..(1259): n is a, c, g, or t
tcttgctggggaccgaactcgccgttaccgtaccagatggcgtgacaacaagagtggaatggcctggtacacaaagatgggttgtgtagtctccagtttattgccttagatggaagaggatatgcgataatagtattgcttggagacaagactatccctggacgtaagtagattccaagttataaaggataaactcatgttgcggtaaacgcatccgcgtcgatccagcgagtgaccccacaaggacactcacccatatggcatctgtatggttntccagagggtgctcgctgagtgctgtttgatacattgctagtgtctgtgtgaccttgcagtctgtagcgagtcatagtcgtagtcgcacacgtctagaaattctaagacagaagtgtccaaagggctcggatttcaccgtggacacgggatcgtctccaggggtgttatgtagaaccgtgcactgcacataccaggctctccctaactgagggcaantggagaagtccatttcaagcgcacgtggtgggaagcgaatatacaccttggtaggttttcccccatccgagatgtggatacagaatagacttggtgcctatgtaaatcgacacgttgaacgatatggtacaagacgttccaatggggctgtgatctggtgttcgagagggaagctttatggcggaatttgaggggtaaaacgcatttggcgcttcgggatacgtgtatccattggtgcatgntgggatctatagaacataaccgttgagacctgtgcaagacaagatccagggcgagctgagcagggaaaagggaacccgttccatttacttggctttcacgggaacacgaaaagcgaagagattcccggggtccaatagatcgccggggtaacagcaacagactgagtgggagaaaatcaattgaacgctccgggaagcaacggggttgctccatgacggacaaaaattagtaacttttcgcaagagacgggatacgctttgggatcgaaattcaccacacttgtggcaattttccctaggcgaaccctggccactttcggtgaaacacaaacaggaaccacttatgcgcacaaacatagtggccttttcgagctcgaacagtcttgaatttttgactccccctttccttctccactagtattggtttcgtcccgtggtaaaatagaaacggtgagaaacaataccttgtcgttggcgacagcaaaaagaccccaagaggtctcttgcgacattttcggcgaaaanacgaccttccatttgggagggcatactcattggggaggcaagcggggccagtcacaggtgactcgggggaaacaccgtcacacctgtcggtgtgcacctgtcccaaacaacgggtgtgctttcataggcttgtgaccgccagtcacgaactgtgagtatttgcgacgtctcacccagttctaccaaagaaacatcgatgttagacagagatagcaacccctagcactaacatggtctcgcaaaacaggc

SEQ ID NO: 647989 - DNA, 890 bp, Homo sapiens
gtcaggggtctatggagcgggaggcgagtgagtggcgctgagtgctaatgaggaccttgcgctgacgcgagtaaaatcttcaacaggggagcccctaaaacccgccacatctaccatcaccctctacatcaccgccccgacttagctctcaccatcgctcttctactatgaacccccctccccatacccaaccccctggttaacctcaacctaggcctcctatttattctagccacctctagcctagccgtttactcaatcctctgatcaggatgagcatcaaactcaaactacgccctaatcggcgcactgcgagcagtagcccagaacaattctcatatgaagtcaccctagccgatcattctactatcaagcattactaataagtggctcctttaagcctctccagcccttagtcacagacacaagaacaggctctgattactcctgtgcatcatgacccttaggccataatatgatttatcctccacactagcagagaccaaggcgaacccccttcgaccttgccgaaggggagtccgagactagtctcaggcttcaaccatcgaatacgccgcaggccccttcgccctattgcttcatagccgaatacacaagcattattataataaacaccctcagcatacaatcttgcctaggaacgaagatatgacgcaatctcccctgaatctacacaacatatatgtcgccaagacctacttctgacctcccgtgttcttatgaattcgaacagcattaccccgattccgtacgaaccaaatcataacctcctatgagaaaattctaccaatcaccctagcattaagttatatgatatgtctccataccattacaagctcagcattccccgtcaaacctaaaagaaaaaa

SEQ ID NO: 647990 - DNA, 500 bp, Homo sapiens
  misc_feature (39)..(39): n is a, c, g, or t
  misc_feature (184)..(184): n is a, c, g, or t
  misc_feature (229)..(229): n is a, c, g, or t
  misc_feature (406)..(406): n is a, c, g, or t
gatcttaaggcagtcgggtaggacgcttgatgcaggagntggaggctgcagtgagctgtatttgcaccactgcactccagctgtgcatagagtgagactcagtctcaaaaacaacaaacaacaaaaaaagaaaatgaagattaaaatgggaccgcaggatgtggctggatgggtctgtggctgnggtagtgcggcgaagggagaatgctatggcaggctacacacaggncaaagaccaaggaggcattggttgatgcctctgatacatcccctaaggtggttacggagagtgaacaatggattttcaaacctggaagactagcagagtcccaatcatcttcatacaaaaacttgaggactactggactagcctggagccttagactttccaggccacacacatgtntaccatacacagtggccccaattgtggccagagagtgtggccactgtgtttgtgtgatgctggcttaccctattctgggtcccattcagatgtg

SEQ ID NO: 647991 - DNA, 410 bp, Homo sapiens
  misc_feature (14)..(14): n is a, c, g, or t
  misc_feature (117)..(118): n is a, c, g, or t
  misc_feature (149)..(149): n is a, c, g, or t
gacctagagtgacnccgatttgacgcgtctcctggatgggcttatatgttgatatctctcatccctaagcatccttcaatcaaaaacatttttaagttggttatagctctttgtgannagcaaaacagcaaacactgtgaagttatatntggctgctgataggaaaccaccacagcacaggtagcataaataattagcttaaatttattagcctgcattagaggtacaaaatacagaggtaagctgcttcaagactggttccttcaacaaggaaccaggtttttcctatatttttatttccaacatacacagcagataaattttatttttagtttgtctgcctcaatgttacaagattgcagcttcagtaacaagtgtcacttacagacaggacaaatagaaggaggcta

SEQ ID NO: 647992 - DNA, 1243 bp, Homo sapiens
ggagagagagagaactagtctcgagttttttattcattctattatttaaaacctcccccaccctttatcctgaaagcttgtgtttcacaacgcttgtgaatggggtttttagtggtgaggaggttggtattacatttaacaacgggtagtagtagtagtcgtagcagggtagtagtagtgtctagagtagtagtagtaagtagagtaccccgatgagtcatccatgtctggctactgaccgcctaccgacccgattatgcaacacaccccacaaccacttgacaagaatcaacacaaggcagagcacacggagaaaaaccccaactccaaccaatcaggcacaaatacccagacggtgcacccaagtggacacgagcgacaccaaagtgcgccatcgatgaacaagagaaaacaaacgcccgagagagtgacaactcccctacaaatactacccacgcgacgacccaaaacaagacagctaaccgcgagtgaaagagaaaatcgcataacaaccacaaaaccacaaagaggggctataacgagcacacggcgcccgtacacaagccactcagagtggcaacacaagtgggcaccaaaagacacaggaggctatactcaaacagggggggcgtggagaaaacgcgcaaacaataacacgcgacaacaacagaaaacacaccagctgggagagaacagaagaccaccatcgcactggaaacacacccaggaaccaaaaaagacaaaccacagctaaatcaccacaaacaaaaacagaaacaataaacgaagaagcaagcaaaacgaaacacaccaacgcagagaaacaatgcgtacaaaaaacagaagagggggaaccatatcagaacacggcggcaagcacacaacagaccaacacacaacctactaacagcaacagaggaggagcaaaagaaaacaaaagctaaactgtcccccagtagcaagagggagcagcggcgccctcacaagtataagaaacaagagatgtcggaaaagaccaaaacaaaaacgcgacaacaataagataaccacacacgacaactccacgaccgcacacacgcacacgagaaacacaaacctaacaacacacaaacgaaacacacagggaagaacaacaaaagcacgacactatgacatcacacgagacggcggcagaccatactcaccaacaacacaccgaccccgaaaacaaaaagagtgaacaacacgaagaggcacaacaggc

SEQ ID NO: 647993 - DNA, 1109 bp, Homo sapiens
gtgcaaattgcggatgactgccgtgtgcagcgtgggtggtgccctggagtgccctggtgtgccctgtggatggggaacctgcggtggcttcctgctgtgaggtttctggcagatggcattctggtggcctgggggtcgctggacgatggactgtgggccaggggtgcctgatgttgccagctgagagactcagcggagtgcaaagtgcctgagggataatgtgacgtggcatgccctgtcaaccaaggtttggagccgatttgagtcaaagtgacattgaagatcacagtcccttgtgaggtgaagaaatctatctcatatctccctagcccaattacaatggaaatcacgatgatcaattgattatcattaccttaggggagagcctactctcaagtgatcgagggtattcaagacaggattattgccaagtgcaagaaagcaggaccctgtgcctgagccagctgaaccagtgttccaatggcgattatagttagctaatcagcgagcgactaccaattggccacagtcaggtctcgggtagttaaagttgcatccgaaaagtggaaggttaggccaacactggccaataccagtagaggagcacaatctatttccataggaccaaagcttcttccgatacaggtaacacacagtagcagcaggaagagcttaacttggagaggaaccaaaggaatctgagccacaggaccccaacaacttgtcacctttgacaaagtggttggaacaatgggccgggttgcagggacttcttgtagcttgggtacgcccattcaattccccattgacaaaaccaaaaggagacaacatagtgacattcggtactcgcgaaaaacccttgttaaaccctaacaggacaagcacaagcgttcaatttgaaattggcaacttgggttaaattcgaattgaaaaattaggattaaacaaagccatcaagaggaccccagaaggatacatatggaacattagcacaagaacgcacatatagcaacaaaacctcttcagaagcaaaagggagaacaaaccgttttatgaaattgccacactacaacacttaagcgaaagaccaaaacaaaggggataagtct

SEQ ID NO: 647994 - DNA, 381 bp, Homo sapiens
cagtctcacagttgcgtgataagctgggacagagatggaatgatgcttgcgagagtatcagcaactatagttatcaagttgggactctctcaccgtgttattccttggccccctaacccaaaggcaggaagagagggaaacctaaaaaaagtcaggcctgggggcaaccttcaggaatgttcctgtctaggaaggcgatggaaggggtccaaggacagatctccctcctgatctccctaaggctttcagagcttgttgagtcgacactttatcctggccctgatgaagaaggcacccctcctgcccccatactcttcccatgtttagctcattttctaaggtgccttgaaatcagtgaccttgattaggattcccatctgc

SEQ ID NO: 647995 - DNA, 435 bp, Homo sapiens
atatcagctcggtaccgtcacgccacaggacttcgggaggcgaggcggtgatcacgaggtcaggagatcgagaccatcctggctaacacggtgaaacccagtctctactaaaaatacaaaaaaattagctgggcgtggtggctgggcacctgtagccccagctacttgggaggctgaggcaggagaatggcgtgaacccgggaggcagagcttgcagtgagccgagatcacgccactgcactccagcctgggtgacagagtgggattccgtcaaaaaaaaaaaaaaaagagaaaaaagagacgtggtcggggggtttacccttgtatccccggcatttggggagtccttttggggggtgtagggggaaccctcaaaagtcaaccgggtagggtttgagggttggagaccgggcgcgccgtttttacaaacggtcg

SEQ ID NO: 647996 - DNA, 1885 bp, Homo sapiens
ccagaacacaggtgtcgtgaatactacccctaaaagccaaaatgggaaaggaaacgatctcatatcaacattgtcgtcattaggacacgtagattcgcgcaagtccaccactactggccatctgatctataaatgctggtgtgatcgacaaaagcaaccattgacaaacattcgcagcaaggcaggctgctgccagcatgggcaaaagggctccttccaagtcatgcctgggtactaggataacactgcacagctgcagcgtgcaacgtggtcatccacccattgcatatctccttgtggaacatctgcagcactagccaagtcactatgtgactatcattgatgaccccaggacaccgagcactttatcaaaaacatgattacagggacatctcaggctgactgtgcatgtcctgattgttgctgctggaagtggctgaatctgaaagctggtatctccaagaatgggccagaccgaagcagcatgccacttactggcgttaccaccacagggcggcgccaccaccgtaacaagtcggagcaacacacaatggattcccacgtgcgcccaccctacacgccagacgagactcatgaggcaacgtaggtacaggaaagcccagcacgtacataagcacaatggggacaacaccagacacaaggagcatggggtgccactaacagggtaggaacgggggcaaaccagctgggagcaacggagaaacagcgcgggctcaagggaaggcaacatacacgacaggagaggaaggcaagggacacacgcgcagagggacccgagaggcaccacaacacggcccacggaacagcatcagccgccgcacgaggtgacaaaagggcgacagcacgcacacgcgcgccagagcaagggatgcacgcagaaggcacagcaaacgaacacagcacaagaacacacgacacaggaagacacagacaagacgacagcaacgcagcacaacaaaacaccccgataccagcatagtcaagaacagaaaaggacaagacagaagacaccagagcacaacagaacaaaaacaaccaaaacaaaaaaacaaagaaacaacaaaagcagacaaacagcaggacagacagcaccacgcaaccaaaaagaaccacacagacaagcccacagaccgagacaacaaggcagcaagcagagaagggagaatgacgaacagaccgcacggacagccgacgcggacagcacaggcccgaagcgcagacagaggacgaggcagacaggagagacaagagcgagcgaagggacagagcagacgaagagcgacggagaacagcgacaaggccaaacgagaaagcagaacgcgagaggaccaggccgaaggtcagcaagcgagaaagaaagcacgggacgcggaaagggacgacgccacagcgggaacagcggacacgagaggaaaacaaccccgccagcagaacaacggcagaaagagcgacagaaacagagagaaagaaagaagacggacgagaaaaaaagggaaggaaaagaagagagtacgaacaaagagcaacgagacgcgaagcggaagaacaaagaagggacaagcaaggacagaaaaagggaaaagcaagacaggagaagatacagacaccaaaaacgagcgaacacacacgcaaggaaagcgacacacagaacaacgcaagccacaaacagagaaacaagagaaacacggagaaaagagaaagagacacgacgaagacgcagaaggagacggagcggcacgacgacagagcgagagcggaaggagaggagaaagcgcaagcacagagaggggcgacacacgcacgaacacacagagaacgagacgacgagaaagaacgaaaacagcacagagcaggcgagcacgcg

SEQ ID NO: 647997 - DNA, 237 bp, Homo sapiens
tcggcctactaggagaagctgtaaggctatcgacagaaacaagagtaggagtgcagcatggcagaggccctggtagcccccaaacgagacaacccttctgctgccaggagggtgtggagtcagccaggacttggtgaccgtgtatgatgacagcattggtgacagtgccacccagcagtccttccacctgcatggcactggccagcccaactttcatctatcctctttccagctgcc

SEQ ID NO: 647998 - DNA, 417 bp, Homo sapiens
cacgaggcgtgcccccatccaggccgttgcggcgcagaggatcaggaggacacccccgaggagccatgcgccgagccgcagaccacgcctacccatcgctgaacacctccgcctggatgcgccgggtaagcgctccgggcttccatgcccgattctccagggtcgcgatgggccacagccggatgacgctgtttacgagaaaagcttcctccgcggtgagcagctcgtccagggtcagatcccgcacttcgagggggatgcccgcggcgcgggcaaacgccatgatccgctcccgttgcactccttcgaccccgcaacggctgagatcgggggtcaccaggcgaccatggagcacgcagaacaggttgctcatggtgccttccaccacccgtcccccatcgtccaggagcagccctt

SEQ ID NO: 647999 - DNA, 206 bp, Homo sapiens
caagctttatttaggcttttgaaccaaagttattccttaaaatttccagggatcatattttcaatgtaatgacatctgttttattggctattgaaaaaatagcatttttttaaatcttttattttaaggttcacggggtacatagggccaggattgttacatatataacggtgggtactcgagcttcgaatacgtaactccatggt

SEQ ID NO: 648000 - DNA, 297 bp, Homo sapiens
gcgtcgacatggactgtcagtaacctgcaagcccagtcgattaccgggctgttcacctccaacggcatccagttcttcaccaccagcaccaacgccgtgacctatccgacgcaaaagggttggtacctgccgctgatctacaacaacgtcgcggccggcgagcgggtgatctacccggcacagatcaccctcggtcggatcattttcaccaccgcagcggtggataccaccgacccttgcgtcagtttcggtaccggcaaggtggtggaattggatgcgtttaccggcaagtcgacg

SEQ ID NO: 648001 - DNA, 814 bp, Homo sapiens
ctttcttggcggaatcaccatggggtgcacctgtacacgtatcctgaaaatgagggcctcaaggctctcatcgctgctcagtacagcgggctcaggtccggtgccctccgacaccccattccatttggcaaaccaacgacccttgaatttctccgcaaatttcctgccgcaaggtcccagcattggagggtgatgatggattctggtgtgctggagagcaacgcattgccttactatgtgagcaatgaggagctgcgggaagtactccagagttagcagcccagttgtgcagtgggtgagcttggtgatccgaatatagtgcccccaagccagtacctgttgtccccacctgtggcatcatgcacccacaaaaacaggccactgagaatgcaaggagggaagtgaggccgaatctggggctgtgaatgctacttgaagacgaggcctttctggtgggcgaccgagtgacattggtgacatcacagttgtctgcaccctgttgtggctctataagcaggtctagagcttttccgccaggcttcccaataacacggggtcttacctggataacagcccagttcggctgcctgggcgatgaaatggttgtacaatgggcctttgtgccaaaacgttggggggccccccttaagggacccggcagacggtccggaagacaaaccccggttggcagggaaaaggctcctgcctaggaagaatttgccgtgtgcacaagcccccctccaacttgttgtgagagaccagcactgtttgtatagaccggacgtacaaaactctcgtcgtacactttcacttt

SEQ ID NO: 648002 - DNA, 217 bp, Homo sapiens
accgcgctgcttcataataccaatctttatacagcggatatttacttcggccgcatcggtttttattgggcgcctgggtgcagacggtatgagacctaaaatggcgtcagcaccaaatgagtgctgagcaggggttttacagtgtcctgtaaacaggaagtgttccagtctgacgggactgctactcagcaaccggatggtctctcgtgatcctcag

SEQ ID NO: 648003 - DNA, 495 bp, Homo sapiens
  misc_feature (233)..(233): n is a, c, g, or t
  misc_feature (251)..(251): n is a, c, g, or t
  misc_feature (258)..(258): n is a, c, g, or t
  misc_feature (313)..(313): n is a, c, g, or t
  misc_feature (431)..(431): n is a, c, g, or t
  misc_feature (462)..(463): n is a, c, g, or t
agaatgccgaatgtgatgttcttaaaatttgtatttcggtgcatagacacttaaggtggacttattttttaaagcagtctattctgtttttcattttggatttcctctcctgcactccctcgaccattgcaggagcatcgtgcatcaagtcaccagggtggtccattcaagctgcagatttgtttgtcatccttgtacagcaatctcctcctccactgccactacagggaagntgcatcacatgtacaggntgagagnttttgcagatgctctcgtgttttcacatctgaggataaaggtcctgacctggaanaattgcctccatagccagtgctccctatactccgtggctgttagaataatcattttcttgtcgcaaactccgtgtttggcgcaaatagtggtggagaaggttgaagaaattgccacangatgtgtttttataaaacctctcgaattaannaggtatctatcttatttgtggttttaatctta

SEQ ID NO: 648004 - DNA, 511 bp, Homo sapiens
ggtcatgggggcaccctcctgaatggttggataccattcattcatgctgtgtcaagcctggattggtttgtaggggaatgcactagttactgggagcatggttgtgataaagccaagccgtccctcgggtttggctcactgcccttgaccttctctgccctgtttgacacagcaaatagtcctcaccagaagcaggtcagatgccagtgctatgcttgcacagcctgctgaaccatgagccaaataagcctctttctaagttacccacagcctcagatatgtagcaacacagacagactaagacaccaagcatgatggaaaactgggttatgggcaggactgcaagtactggttaggcagatacctgtatttctcttcctaactctcagaacgtgttctgtgtcacttagggcaacttatgccctcctgtgtgaaaatctccactcccaatgtctgagggttcctcagagtaagataaaatattaaaggaccaattgtattaaaaaaaaaa

SEQ ID NO: 648005 - DNA, 321 bp, Homo sapiens
  misc_feature (5)..(5): n is a, c, g, or t
  misc_feature (15)..(15): n is a, c, g, or t
  misc_feature (37)..(37): n is a, c, g, or t
  misc_feature (111)..(111): n is a, c, g, or t
  misc_feature (273)..(273): n is a, c, g, or t
  misc_feature (281)..(282): n is a, c, g, or t
  misc_feature (284)..(285): n is a, c, g, or t
  misc_feature (315)..(315): n is a, c, g, or t
  misc_feature (318)..(318): n is a, c, g, or t
ttccnctttggaaanggaaaatacttcggggccgganacttggtcttgcaggttagtgagaactcggcttcggccccctgtgacgcgaagcaccctgccgtgtaggttttnccgagcgcgaactgcagcgcgggggtcatcaggtagcgcacgctgccttcgtagttgttgaaagcatcgcgccgcccgtctgcaggttgaacagcgaactggtgtacagcagcccgaaggtcgcggcgccccacgcatacgtgccgcccgcgccccagaatnctgctganncnnaacgcccttgatgaacgtgtagtagttgtnggnacg

SEQ ID NO: 648006 - DNA, 1545 bp, Homo sapiens
  misc_feature (295)..(295): n is a, c, g, or t
  misc_feature (1076)..(1076): n is a, c, g, or t
  misc_feature (1093)..(1093): n is a, c, g, or t
  misc_feature (1158)..(1158): n is a, c, g, or t
attctgttcgttgtcttgttcgttgtgttctttttcttcgttgtctgttgcttttctgttattacttctgtctgttgtttgtctgtttgatttgtgtatgctgtgtcgttttggtgtgttgtctgttttgtgtttgttttgttgtgttgttcgtctgtgtcggttccgtttgtggctgtatcgtgtgtttgtttgtttgtttggtttgtagtttgtcggttgtgtgtggtgtcctgtcatggtctgtgcgtttcggtctgcttccgtcgtcgtcgctactggatcgagtttcgcnccccattaacccaccgccttgtgttgacaaacccccccaccgggttttgggcgcgcccccccttttgtgggacctctcgtggaggtgccacacatgggtggacccaacgagaaagcacgaggggcttgtgttatactccgcccgccccctcttttcttattcccgttccctataagggtaaccagagcccctttggggtggccgcaaattttcggccccacgaaggggggtgtcctttgtaatccccctggtcgtgatgttatataaaaaggggagagattgccccccttttcccgtggaaagaaaattccactggggcaaactcccccaagaaaccaagttggggccacaagaatggaaaagcctttttccctttagaggaaactttttcgctttgccaccaaagaccaaggaatgtgcacccacctttttttgagggaaaccccccccggggcttccaagcaagacccactgttcaagaggcacctctggaggggccctctggcgccctctcgggatattttgattgggacccccgggcaccaacccagtgggcaccccggcaccattggccccccaaggtttgaacgacccatggtgattacaaagaactgggcttctcctcttggtgtggatagaagattttttaagggagctctgtgtgtgtacccccacccacgatgtcacccctctctcctgagaagggagaatagttttcccccaaagagtgagatacaccactcgattatatgtgagaagggtttctctggagacgccaaanaaggcgcaccaaaaggntgggagagtatattccaagaaagagaggagagcttgagaagaccccacacaatgccgccaaaggngtaccctcgggcacaagttcacctgtggcccactcgctgagaaagaggcctcgtccgcggcttatcgcggctcgaaagaagtggttctgaagaagccacggagagctttctggaaagccctcaccccagcaccttccacggagctgacccgaggccgcgcgtcccagctgcccttcccccagtgtggcccaggctgcctggccttgtcctccagcccagtttaaatagtgtttttcctgagcttaggaagagtttacccgcacacataaagtcgagggactttaagtttttgaggctttctgttgccctggtgatggtgtagccctccccctttgctgttcccctactttactgccctgaattaagagccctaagtttgtactatta

SEQ ID NO: 648007 - DNA, 1071 bp, Homo sapiens
tcagcgagaataacaaaaactttgctcaggacatttgaggtcaaattgaagactggaaacctggaaaccgttttcatttgtagagcccactagagcgcgagcactcagtgtaaaggcatacaatcaggtagaaggggagaagcgcaggaggacagtggcacacatcaagaacatcgaagtattgatgccacgatcttatgcctgtctattttgaaatagggcatatctataaaggatttggagtctttcgagtgtctggtttataggggtatcggtgaactaagaaatcctgtgattaggttgtaagactgtaaccatggttgcaatttgaggtgtgtaaattattgttaaatggcctaacaaaatttaaaatcattggtttggcttcttggggaaggagtaattctagtttttctttgaggcactttatgaaatgtcttgtggtaaaggaaagcttgctcagaagtccagttcgagcaatgtgttcgtaacacacgtgtcgaaagttcgatatatgtataaggaaggtggtttccatcgctatatgaggccactgtaagtgctaattctgcacgctttgtatgaaaacaaccgtggcataagacaaaaagttactagaataaggaagctttgttggccccctaattgtaaacttcgtttatgactaaaggtcacattgggctacctacaatatgtgacatgggtgataaacgccctaacaattaaacagccgcagtttgggcgtaaacatacccaatgtgctttagacaagggaagcgaggacaaacctttccgttgaggttttaaccacgccttcgagggtagacaaaggtccgatggcaatgaacctcacgactggctaggtaagggccaattatacctggaagcacactagggatataaagacgcaatgaatgactggagcaaaacgataaaagcgtacatcttgggactgacttaccgtgtagtcgcccgtcatggggtggaaacaaaaagcctataaaacgggtggagaaaacctttgagtgcccccgttcatctaagaccacatgtccatctgtcgcaatatcc

SEQ ID NO: 648008 - DNA, 346 bp, Homo sapiens
tgaactgatgtgatctgatcatgctcccagacctactggtggccccatataaaatctgtgtgtgccagctcccccgagcagcgccagacgacccctgtgacacgaagagtttgagcatctgatgagccttggagaagaggaaccaatgcgactgagctactgctcctggaacaggggggacattgttccaatgaggccagacttacaccgaacagacgttgtgtggcggcaagcgtgtcatgcccacctgtgcttgtgtgcaaaggtgacagatgttgactccaatcaaaaacatccctatcctggatcaaaataacaaacactcccaaaaaaacgtttgcggccg

SEQ ID NO: 648009 - DNA, 526 bp, Homo sapiens
gacgtgcctgtggcctctccagcagtccctggaccatacctgaagcgctgagcccatcgtgagtgaggaggagtgggccacacaatgcagctggtggatgacgttcaggcctcaggaggtgtaggggagcgcctgcagaaggggctggagcgtcgggccaggaagacggagaactggctgtctgagtgttggctcaatgagcgcctacctccagtacctgccagcctgtggtcatctactcgatgcccatgtcgtgattgtacccaagcaggacttctgtggacctgcaggttcggctccgatttgctgccaaactcattgagggtgtgttggctttcaaaggtcattgatttgacaacgataccctgccctgtgatgaccttgggggagaaagccactgtgcattgaaccagtactatcagatcttgtcctcctgcctgagttgcgggcccacgcaaggacacagtcaagcacttctgcaagaccaagaagctcccacgcacatcacgtggtaccacaactacca

SEQ ID NO: 648010 - DNA, 114 bp, Homo sapiens
acacatgggaatcctcattcacacggagaaaacaccctcatgtgcatacagctatcccccgagtctcctcctatccctcgaaccccgacatcattaccgggttttcctcttaag

SEQ ID NO: 648011 - DNA, 137 bp, Homo sapiens
acttgattacatcactctgcggctcaggtccaccccagaaacccgctgtttcgcataaccatgaggtaccagatgaacttcaatcgcgaggcggactatgcacactctctgaactgccactccccgccagtccgggc

SEQ ID NO: 648012 - DNA, 226 bp, Homo sapiens
  misc_feature (20)..(20): n is a, c, g, or t
  misc_feature (27)..(27): n is a, c, g, or t
  misc_feature (102)..(102): n is a, c, g, or t
  misc_feature (201)..(201): n is a, c, g, or t
  misc_feature (206)..(206): n is a, c, g, or t
aggaggctaagcgagcgcgnggggacncatgagcaggcaaagtcgcagggccgccagcatgttctcccgaaaccaccggagccgggtcaccgtggccagggntccgcgtggaagatggagttcaaacgcggccgcttccgactcagcctcttcagcgaccttgcccgaggacacggagttgcagaggaagctagaccaatnagatnctgatgatggaagggggcct

SEQ ID NO: 648013 - DNA, 340 bp, Homo sapiens
  misc_feature (183)..(183): n is a, c, g, or t
  misc_feature (218)..(218): n is a, c, g, or t
  misc_feature (220)..(220): n is a, c, g, or t
  misc_feature (242)..(242): n is a, c, g, or t
  misc_feature (336)..(336): n is a, c, g, or t
acaagccacgcttacttgctgggtttgggtggaattttttcctctgtcccctccagtttcctcattggagtgacctgaaggtgtggcttccccccctttttttcagtattactttgccttagttttccccaaaagggaaggctggaacttttaactctgtaccccttgaaaggtatttaattntgtttttcctagtggttcccaattgaactgaattnanatggggtcgggtgggtaagganacccctcccctctccttccccattgggccgcctttatcaattgcctgttttgttttgtttgttttttaactttccataataaaaaggagttttnttca

SEQ ID NO: 648014 - DNA, 1218 bp, Homo sapiens
gctgcgcgctacaccgtggtcgctgtccacgtaggcgctcggccgggggcagttgcgcccatggaagctggctcaagcggtactggcgtggcccgcctggagcagcgcctcgcagacgtctcgccacctgctcgggcgagaagcggaggcccgtgtggcggttctgtgaagccggactcgcgggagtgcgacccgggggtacgcccaggggatcccgggccgcttctagcgtcccgtcagccgtctgcgcctcgtctcggccccggtcgccgcagcccgcctcacgccttcggccgcttgctaagagtctcgcataagagcttgagtcgcgtctttccgtgcctcacttcgctcttgcggtctgtccggcctcgccgcctgtcgagcgggtggtcccatctgctagtcacgcacgggcctcctgtgccgtcaggggtccacgagagggcctagggcgaggctacactcgatttggtgccaacctctagtggcgcaccgtggcgcgtaaccctcttgcctcatacttcgtttcgcccgcttcgaggcctgtcttgcctgccttggtacacctctgcgtcagcacaccctctgcgcgcgcactacgccagcgcacgcggacaagacctccaccttcgttgagaccgccattatcacccaaaccgcggtcttgcacgcgccaacaacaacggccaccttccttaggcgcacccttgtggttgtccacgaaggcgcacgccaagacacccctaacccaggcgcggttgcaacacgactttcaacacaggctgcggccaacgctggaacgggcgtcggtcggcctcggggtacgggtcggggattatcacatcaaccgggggacaggttacacacgcattagcacttcccagggccactgggtcgtctcgaaaagtatgagcgacctccaccctggagcacactcccccttacacaaagcaggacacaaatcacttcttccaggaggccccacgtggggcagcatcaacactccaaccccgatcgaaagcgcccacaatccacgcctggcttgacttacctggggctcctctggcaccaatgggcgcaatcatccctatcgtcccctgggcatcgcttacctcgtccgcccttacctcacggacaccgccctaaacggtaccatcacctatagggggttcacctcatgggctatgccgcccgccacgcggtccttatttgggc

SEQ ID NO: 648015 - DNA, 304 bp, Homo sapiens
ttacaaatcacttaagtgtacatataatctgctgttacaccagtgtactgaatttcattcaacactggttattatatttcttgattctacaatatctgtttggttctatgttaaacggtatttcatatttaacagtttcagagtactagtaaaattttcaaacttagcttacattttcatcaacatagtaagcataatttttcatttttttttattgaaattgatctcacgtcacccaggctgaaggccaatggcacaatcatggatcacagaagtcctgacctctatgaccatcaattgtgcc

SEQ ID NO: 648016 - DNA, 119 bp, Homo sapiens
acgaatcaatcagctcacacccagtctctcacaagtgtcattccataaaagtggtactactttcaggatgagtggtccggggatattttgctgcagttggttgaggaatggtttgcaca

SEQ ID NO: 648017 - DNA, 329 bp, Homo sapiens
cacctagggacaagcatataatgggcgaaggattatacgaggaaaatagaatcaacaggctgggattacaggcatgaggcatacatgccacaggactgggaggatgaatcttcggggatatcttgtaacttctaccggctcttgctaccagcgatatatactttacaatctatgtgccagattttccccattttcttttgcacgtagttcatggaaataacaactttggtatcatttccctcgaaaagggaagtggactctccttcctatctgcagcagatgcatgagtctaagcctacggtgagagcaatgcctctgtgaagttacat

SEQ ID NO: 648018 - DNA, 475 bp, Homo sapiens
agcggatgctgggcctggacgcgtgcgagctgggggcagcacggctgtctgagagactgctcgcggcctggcgactgtgcggcgccggaggtccgtccgtggactgtatcaaggaaggtgtgggctccggcctggcgccagatgcgacgatgggtggtgggattgagtgcttgtgtcctcgaggtaccgggcagccggtggggaggaatgagtcctcttgagaatcattccggcatgcttgagacctcggtgacggacgagtgagacctggcgcaaaggttactaatgtcgggttgtcgtgcttgggagcccacgtggccaactcggtgtccagctgtgacaccaatgcacgtgctcgcgaaatgttgcaagggggtgaccgaaggccttggaaccagatcgcctgatcagtggaagcagggacgtctcgcgggggcctcgtgcgttccaatggggagttcgttccaacaagggg

SEQ ID NO: 648019 - DNA, 111 bp, Homo sapiens
attaggagcctcccacttccttatttcattcattttcattacggacaatcaatcaacttcctttttctttatacatttaagtcacggcacacaacaacataaatatctgtc

SEQ ID NO: 648020 - DNA, 207 bp, Homo sapiens
tcttaactcaaaatctatcatctggtgactgtgatcacttccaactacattccatacttactctatccacattgttaccatcaccaaagcaaccaagagcttcagatctttgagctaataactctcctaaagactgacgttaattactggcattatctttactccaaatctgatgtgctacgttgatttcctcatgcagggaggagt

SEQ ID NO: 648021 - DNA, 107 bp, Homo sapiens
tcatgtcctaggagggtagcagctcagtgtagggctagggcatgaggccctaaggggtctaagggtcttctacaactcccactaccggagttcccaaagacccccag

SEQ ID NO: 648022 - DNA, 248 bp, Homo sapiens
cgaggattcaaagcttacgaggcacaaagactgtcactatgccttgaacgagtcaagaatcagtgtcagaacagaaaaagatgctccttgttttacggaccttatcctggggtgccgggacctttgacaggagggagataccagcccctgatctgaattgtccctgctcttgaggcacttggctggggagaagccgctttctttagcgacagggaaccccctttgcctcacctcccccttccctcgtt

SEQ ID NO: 648023 - DNA, 243 bp, Homo sapiens
cgaggtggcgaggaaatattgccgagcctcccgttcagatagtgtccacgagccggggtcgcgctctcgtcagtccgaaatctgtactctggacctgcagtcggtaggagtccaggcgctgtggcctggtatacaactgcagttgatctctccaaactgctacacaacgagcgcgcactatccgagctagaggagcgccttcgctccgtgctgcctcaccatcccgcaacgaagaatctttcg

SEQ ID NO: 648024 - DNA, 432 bp, Homo sapiens
gaaaggatgggagaggggctggaagcattggctagtagatgatcgaggctttctataccaccaccaaggtgtgtattttctcatcatcctggttgtgtcaggctgtccctagagatcaccctgacctcagtgtttaagaagaagggccagatgcagtggctcatgcctgtaatcctggcactttggaaggccggggcaggcggatcacctggggtcgggagctcgagccagcctggccaacagggagaaaccctgtctctgctaagggtgcaaggattagccaggcgtggtggtgggcacctataaccccagctacttgggggctggggcaggagaattgcttgaacctgggaggcagaggttgcagtgagccgagaccgctgtgttgcactccagcctgggcaacaagagtgaaactctgtctcaaaaaaa

SEQ ID NO: 648025 - DNA, 264 bp, Homo sapiens
  misc_feature (254)..(254): n is a, c, g, or t
tgttggtcacacctgtaatcccagcactttgggaggccgaggtgggcagatcatctaaggctgggagttctaaaccagcctgaccaacatggtgaaacccctgtctctactacaaaatacaacaaattagcgtgggcatggtgtgtgcatgcctcgtcatcccacgctattctgggaggctgatggaaggaggcggggcatgcctcaggatccatggctgccccagtgcacaatcccgctcaagtctacccggnactcgccggt

SEQ ID NO: 648026 - DNA, 278 bp, Homo sapiens
gttgcagtgatctgagattagtgccactgtcactctaggtctgggcaatggagtgagactctgtctcaaaacaaaacaaaaaacaaacaaggccaggcatggtggctcacgcctgtaatcccagcagttcgggaggctgaggcgggaggatcgcctgagagcaggagttcagcaccaggctgggcaatatggcaggacatcgtctctactaaaaaaataaaaaattagccaggtatgatggtgtgcacctgtggtccccagctactcaggaggctggt

SEQ ID NO: 648027 - DNA, 1569 bp, Homo sapiens
tgattctaagctctcgtataacatacgtctcgctggagtgatgtccttgtcattccctctcacatgataggagagagcaaagaagggtaggagactgaatcaacgaagacgcctgaggtgacttatgagaccacacattcccttgaacgtgtgcactgtgaattggtagaaactcgtcgccatcgtaatgcataatattaactcaaccatgaggtctgtgtacgcttgagtggcgacacatacggcgctagtaaatgctcgatgttaggtctggcgtaccagctgatccctcgggacctatcgtataggggacgcgcaagagaaggcgcacggacgtctactaccgagagggagtgctatctcattcggcgcacggcaatgcacgtcacatacacaatgacgctctgaaagtctaagactcgcagtgtgcgtatgaccaaatctcaaaataaacacaatattggagatatagatagataggaataagaaagatatataatagagagattatgaaaattattgctgaataaaagatatatataataatagggacaattcagagaatagacataataaacggataagagtttgcccaacaatctgtgccttcgccgaaaaaggtggctgaggattaacagatccgtgagacctactgtggcgatccagtgacgcgtagagagctgaaagttgtggcgtaggaattgaattggaatagacaagtagggtccgtttgacatacgaagaataagtgagctatgggttgtaaaatggcccgttaaataattacgtaactttaatttaactttaagagatgtttaattacactaggaggtggataaacatggttacaggaggtaaccttaataaggcagtgaacaataactttattggcgttatgcaaggtaaggtataacctgttaggagacgatataaagtgtgtgaaaatagtaaataaccgtgtaagttagccccatgggcaaaataattaggacacactggaggaaacaggaaacaggcaagcggcgcaaaccggatgttatgaccagcacaccgaggccgagcaatcgttacacaaaccacaacagggggggggcacatgtgaccacccaaacacaccggggcgatgccaaccagcaatcataacggtagagccccagaaaagcgaaaaactacgaacacagataacacagctaaacaacacacgggcccagcgtgtgtacccgacaaaacctacagatcaacagccagacaacccgttttcaacaggccaaaaaacaaccaagaggatgttgcaacccgaggacaaacagatgggccagaacgacgacaaacagccggggccacacacgagcacgggatcatgaggcgctacaactaagaagcagggtagacaaatcgacacgcaggccacgacacgggacgcgcgagcactacgagagcacgagatcaggcgagatgacaaatgacaagacaagcacgaaccagcgagcagacagcaaatgacgtagatactgtgtgttgtatgtcccgtccttcgtctgcagtacgccggggcagagggggaagggc

SEQ ID NO: 648028 - DNA, 572 bp, Homo sapiens
actccttttagacattgttgtgggtctggagggagacgtggtgtcaaggtcctcatcccatcctccctctgccaggcactatgtgtctggggcttcgatccttgtggtgcatggcagggcttggtgacactgcggctttctctcccagtccctgccttgtggcatccgtcaacaagatgccaatgccagtgcagcacttagtggatcttcccaggctgggttagtggcagcggccttgtgaaactgtgcattttgcagaaactttctgacgcggtcgttgcaatgactgtgtagcagtgcctaccagtgtccctttcatctttgacgagggacatggcccttgttttctgcagcttccacgcctctgcactccctgcccctggctaagtgctcccatctgcccggtgtccaccatagagctcccatgcatcctgatctccaccaccacatttcaagggcagcctggaaccagtggctagttcttgaatggagccccatcaatcctattaatcctcagaattccagtgggagcctcctctgagccttgtcgaactgggagcgagaaaaccgag

SEQ ID NO: 648029 - DNA, 98 bp, Homo sapiens
aagccctttaatttttttttttggtcggttccgggaacttattttccaacaattgcttccaactgaaataaaacaattaaaagcctgttcaggaggga

SEQ ID NO: 648030 - DNA, 327 bp, Homo sapiens
tcttttaatgtttacctaaatttggcatgcttacaggacagggttgcctcttactttttttaacattgtagaaatgtaatttattaacaatgctcactacaccagtttaaaataaacgttctcctttataatatttttccaatttggtcagttaaccaaacttaatacccccatttaaatatttttacaaattagaaaggttaccattttaattttagaacctgttttggatgggattatatggacgaaaattgtgtaaccctatggtcatggttagaaccggcattacagaattacttgaattaattgtgctgttagggatggaaa

SEQ ID NO: 648031 - DNA, 101 bp, Homo sapiens
ccctacaacgtatcctgtacggtcatggtaccggggtcgttaaacatgatgtcactagtgcaggcgtgtgcctcgtatctaactgggtgatgcgtagacgg

SEQ ID NO: 648032 - DNA, 881 bp, Homo sapiens
  misc_feature (344)..(344): n is a, c, g, or t
aggtaagtcacgcgatgttcataggctttaaaatggttaaaagtggctttaagatggtgaccagccttggcattggtaacctggtgattctcggtgaatctagataaagttaagaacgtgaaaataatttaaatatcaccgtaatactgggattagtgcggttaagtggtgctggtttaagaaagtcagtaagagatgtgtaggaactaggttctggcagtctaatagaattgaacagatggtcctaagtcgtagagagttcatagtactgttcttcacttacctgatggctttcccatgacaatagagtgtgctcaatacgatacactggtgattctattaanttgatgcaagaaacattggtttggtctgaatgcacggaagttaagtgaaactgggaggttcagaatacatgagtgaaccagtagagtagaataagagagatgtaaacgaatattcatgaatcagaataatcgtgtttcttggatctggtttattagcaaggtaggggatattaaagacaagagtaatttctatatgtggaggacatcctgtatagtaaatttccctaatcctagagttggcatagactttaagaaacgagggtagatatagaacatgtcagggaatccagctatgtgaaagatgggtcgggagtaaggtcatgcgtgcacagtgcagtgagtgtggaaggtgggcgggcacacatttgggccttgaaactcctttgggagcggtctggtgagcccaacaacttacgaagtccagtgacatgggggttgtaaaaccggatctggcataagggatccaatggtagtggagcgagcctgttggctcggcttggccgtaaagttacccttatatgaatctttccaccccta

SEQ ID NO: 648033 - DNA, 208 bp, Homo sapiens
  misc_feature (12)..(12): n is a, c, g, or t
  misc_feature (14)..(15): n is a, c, g, or t
attcgcgggcgngnngaccaataagatacatttatttaattaatggctggtcttgctttgtggcccaggctggagtgcagtggtgccatcatggctgactgacctcctgggctcaggcagttctcctgcattggcctcccaaagtgatgggcttacaggcatgagccaccatgctcagccagaacacattttaaaaagtatcattgtg

SEQ ID NO: 648034 - DNA, 1391 bp, Homo sapiens
gttttctgataaccagaagctgtgggagcgaaactataaaactctcactcttgcgaactgtccatgaccaagacaacttaacctgactgttcttgaaacttggggtgtgcgggtgggtgtaaacgttataaacggaacacgtttccttttttacaacgaatggtactaacgactactctcttggcacgccgcctcttttctctctctttctcttcagtccttcctcttaaaacgccatccgcagctggtcacacttaccttacacactgacgcagctcctgacacactttacgcacgcgctaaccttccatgctcccactactcccaagacccccaaagcacactcttgcctaactttcccgctagatctccactgctgacttacgcttatccaaaacggctttacccggattccactaaacacgacaccctcacacacactgcgtacccttttcctacagaacactctgcactactctctctcactacgcacccaccaaaccttaagtaacagccacccattttaacagcaggcggaaaagccacaacagctctactcgctcctactcttacacacacctgacatagccacagctctacacctcctcctttaaccctccccctttattatacccctacacccctcggctctggcctccccagcgaagcacgcccctcttctgcaccacccacgcgacgctctcgctctcggggccccgaacccgctgcttccctgacccctattcgccctgccccgctcccctctccgcccttcccttacagctctctctcccctttatcggccccctttggccccggcccccacgttcaccctttcacctagggttattcgcctcggcctattcccgcggggattccacgacgctctgcgctccttaccgcgtcttccgccccatgtgtaacccctcgtcgcactctctgcgcatctgttcaccctctccccttcatgcgggtcgcgtgcccaagcctcactatgctcccgcatggaccacccctctgcgtccccccgtacctccgcttccgcaaacgtcgccaccctcacccaccgaccaactacccacactccctaaacacttccccccaccaacctcgcgcaacctctcagcacccgcggtcccttcaacaagacgccccccaacaatctggcttcttcgacagcctcggcgcggcacacccacaacgcgctccccaagaacccacctcctcagctgactacaaccgacctctatgtcgccagctccaccccctgacacactccacgtcgtgtatgctcacccctccctctcctcatcatcacttactgtatggtcatgatgttccggcccactgcacgagtagcaagccgtcccaggcgaccgacctgacaagcg

SEQ ID NO: 648035 - DNA, 813 bp, Homo sapiens
agcggaggcaggaggaggagggaccacggggtggaggggagatagacccagacccagagctctgagatggtttcctgttgcctgtctctaaaccactccacatttcccgacggtccttcagactgcccggagagcgcgctctgacctgaacgacatgccatgcctgccacatgaggtgttcccagccaccatgagggcctggatcattctttcatccatttagccctggaccgaggagggccattggcaagcacccatcagcaagaagacccatgcctgatgagacagaggtggatggacagaaactgtggacagcaggtgactgacggatcatcatgctgggagcataagtccatgataccaggcgtggaccacgctagagagacatatatgatgcatggctgcacgaggaaaaccgaaagaggagagtggaaggcggaaaatcacactggcaccgagaaaaccaagcacaaattggacaaacgaaacaggacgaaaaggtgatgcagaagacatggggaatggagagaaacagacaaccccaccagtgatggcggtgatgcccaaagagagcccaacacaagaaaggaacgcagagcaacaacaaataggaaggagatagagacgacaaaggagatgacacgaaaaaaagaacaaaacagaagaaacaaaacgaagatcaaaccaagacacaacatacacaacggacacaaaaacgatggaagaccgagagaagaggacacgagaagaaaaggggacacgaaagacacaaaccaaggaagaacaatagaagacaaggagacaaaaaaaaga

SEQ ID NO: 648036 - DNA, 820 bp, Homo sapiens
  misc_feature (277)..(277): n is a, c, g, or t
cctctcaacggcccgcttttgtcccggggcgtgcgtcgcaacgtccggctcaacaagtgtttgtctaggcgcagatgagccgtcttttgttccgctttcctccccgcgctctctgtaggaattttcccctctctaaggtcggggttcacggtgcgcccccgtgtctcgcccattatatgtgtctgtctccctctcgctgcgcgcccataaattgtgttgtgagcgcgcgttcatgagatagcgagcgcgtccttatatattgcggtggcagccctcncggtggtcccccacgccgcgggtagaagcgatttcttattgatctatagggggccctatacaatgggaagcaaaacccttctaaatccgttccttgcagccgttgcttttatgtctatacatgccttggggtctctccctttcccaagggggaaacacgaattcttttccctgtcgttgccgacaactgtgtttgtttatatacgctgctcgcaagactaccccccctgagctaggtatactcgcgggtgtatacaacggacgagatatcttgcagtgtaaattcctagggcgcgtccctgtgagcaaacaacaacatgatgtgcagcacaatgttaccaggtttccgtggtcatctttggtatgatcatgttatgaatgcccgttgagatgttagtagcaccgctcctttcccagatccccacatttggtggtcccagcatctatctcacacacatgggacttcatggaccttgttcatgggttcaattaacgacgccccgcccacgggcatcattttggttgccgccgcccacaaagatca

SEQ ID NO: 648037 - DNA, 137 bp, Homo sapiens
  misc_feature (48)..(48): n is a, c, g, or t
ctccgtggcagaaatatcgttatggggataatttggcgcacagctgcngcagcgtgtagactttaacttcgtgacatcccatgccggaaaagaaactgtcgattcagatttgacttctcaatggtgtccatgtctat

SEQ ID NO: 648038 - DNA, 345 bp, Homo sapiens
aaaaaagggggggccccccgggggggggggagaagcccccttaataaaagggggggaacccccgggcccccgcccccccaattttggggttttttttcccccgggtcccccgggcccaaagggggggggtttttttttaaaaaccggggccccccaaaaaaaaaaaagggggggccggaaatggtttacttttggcccccaaaaataaggggggttagggaaggggcccgggcccaatttgggaaggggcccgcctttcccccccgggggggttttttttttggggtgggcccccccccaaaaaaaatttttttggggccccaaaaaaaagggccggccttggga

SEQ ID NO: 648039 - DNA, 155 bp, Homo sapiens
gaggatcccttgtcactcctggactacaaatctcaggttgagatttcagcctatagacatatcaacaagattctatatagctctacatatatagcaaggacatggggcggagtgctagggcaacattgtggaccaggggcctagtaatatcttac

SEQ ID NO: 648040 - DNA, 1016 bp, Homo sapiens
ggtgcagttcccggagttcgtgcccaccaggccgccccggaggatcctttgtgttgacaagggcggcgccgcccccgccccgctgttacgcgaggtgtttgtgagaagcaacccgcgcgctgcccgccagtttccgtggtttttatcggacggggggtcgccctgctagccgcaagaaaggatgccacttttgtttacgtcgggggcgggtaaaagacgaccacaagatgtgggttgttgtttgtccccctcctgtcgggcgacacacaaccgagcggctgtccagagcatgtgattgtaggagcccctcgttctttctctctagcaccacgctcggtgtggtggccgcccgccagatttggtgtcgccccacaacaaggatgaatgtggggaagaattcgtggcgacaacaaagaggcgatgctcaaatattcacagaggggggagcgacgcacaccccaccgtcgacggttcgttactgctccgctcgctcaccaagaagagaatgttctgctcttcttctgggggagatgcaaagagagccgccccaccaggagacaagacgaagcgtggccgcctcttgtgtatatcacccccgcggcgcgcccttgttcgcagaggtgtctcaacatgtcgcccagaggttatttaatcgatcattgcccgcccatcgatgctgtcactcaagacgagcatatggttgtgtatggagccgctcccggccggcgcgcccacgtttagagatgttttctgtcgcgcccccaagaagaacaccaaccatctctcatcagatgatgatgtggggtgtccacccacgtctgcattgcggtggagttgattttataaagcacgatgggtggtgttcaataaagcccggcttcatccaaccaagaaggtggtgggggggaagaaaatcaaccacccggggcccctttaaaaggggggggcccccccacaagggggggtccaattccccccccttttttttttccccccttttttttttttttccccca

SEQ ID NO: 648041 - DNA, 727 bp, Homo sapiens
gacttgaggaacacaatcagtacttcaggtatcgtaaatagtgagctaagcctcaaattttctatcacccagttgccctatttcagtgaatctaaagcaaattatctggtgtgattggcattgtttctaagccacggtcagcgtgcgtcattgtataacacgtacttctctgagtttgtatgactacacttattgtgatatagtatttacttattgtatagactcagtgtgctgaccacgcagacagtctgtaatctctaagacctattaacatgacacagttctatacttatgtgaattgttaactttattaatcattagagcagagtacatagttattctctagacattccgcttacttttcatatgtggtatagaattaaaggtaaactttattgacatctaaacacctacgaaatcgtctgcccatagtctccattgacttctttaccatgcacacacttctatttcacatagagtgactagtcaaaggattcactttttgcactataaatcagtgcagcattgatgatctaaccacgtatagcttcatgcttgtgtgagagattatgccgatcgcagtgatatgtggccggtggtaattcaatggtcaagacttgaataccgcaggaattctgcctacgcaggttttcctaatatcgctaccagtgcttgttacctatttcctttctggcttcctgacatgtggagtataagtacactgatg

SEQ ID NO: 648042 - DNA, 380 bp, Homo sapiens
cgcctttgtaaaaaagttaaaaatgaaaaaaaaaggaaaaatgatttgtatatttaatgaatgaacatggccaatttgcccctgggaggaggttcctttttgttgggggagtttgcaagtgaatttccctgaggttgaaattcattggggggagttttatttcggtcccagccccgtttccttttattttggagctaaagccagcggggggtttagttttgagggcagtaaaaaagaatcagcaaatcccttttatttttcacccttttccgggattttttgggttgtttttgggggagcaggggaccccaacttttcctgtaaattgcctttttgctggaaaatgttgtatgttgaaaaaaattttttataaaaattta

SEQ ID NO: 648043 - DNA, 301 bp, Homo sapiens
gtctgccatgtcaaagagaacatctcagttgtgcagaaagaattaacatagcaggcctgattgagactgatatgcttagcgaggtctgcttgcaaggttggcccttggctggcatctaggaacttagatttggggagggttcctacatttccagaaccaaaaagagtggcccattgtgcctaagctgtttgtataaacaatgtggtttatagagaacacctttctttctgggagtctggaattttgctgtgtagtaggcagagggtgcttatgtgatcaccccctaagaagaaccttggag

SEQ ID NO: 648044 - DNA, 382 bp, Homo sapiens
ctaatttcacccccaccccaccctccaggttaggggggagcagggaagcccagataatcagagggacagaaagcaccagctgctcccgcctcatcccgcgttcagccatccgtgcgcgcctctccctatttatctccttactctgctttccccacagtccccgagactgcttgcagacagctcccaagcccaactcccttgccggttgataaatcgaagtatgcagcacctccatgtcagaccacaggtctgagaatcggatagtattcatgggacaagggtcctcggcacaagacgtggtgcgcaccgcattaactccaggttcaccccaagccacattttcccaattatcagcccgaaaccaacagggtccgccatcttt

SEQ ID NO: 648045 - DNA, 358 bp, Homo sapiens
  misc_feature (170)..(170): n is a, c, g, or t
  misc_feature (178)..(178): n is a, c, g, or t
  misc_feature (312)..(312): n is a, c, g, or t
  misc_feature (351)..(352): n is a, c, g, or t
agttccccatactcccccatgtgtccgtgggagggacccagtgggaggtgattgaatcatgggggcggttaccctcgtgctgttctcatgatagtgagtgagttctcacaagacctgatggctttatatgggacttttccccccttgctccacgatcctccttcctgccnccatgtgnagaaggacatgtttgcttccatttctccatagttgtaagtttcctgaaggctccccagcactgtggaactgtgagtcaattaaatctctttcttttatacattaccctgtcttgggcaggtctttatagcagcntgaaaacagactaataaagatggaatttctggtaaaaanntataaa

SEQ ID NO: 648046 - DNA, 912 bp, Homo sapiens
ggttccaatctgggaagctgctgcaatggttcccgcacggaccggtggcgatagtaaacatgggccgttctggacttcaatgcatagttgcgtaacccgatcaatgacttctcatctgacatctcattgaggcgtcaatcgcaatgcgtatgtgtgtgcattcatggtaatgacgtggtctccacctcagagagtcacttgctgacaagaggcatcacgcgaagagtatggggccgaatgcaacggccgtatggcgaacctccgatggaatgttcggcgtttgatcaccagggtactactaaagtcttggtactgggtgccacgcgggaatagtattctggagactcgttgcgcaatacccgaaacattcccgattgatgccgagacgtggttgctcgagatgaagcgtacactgactgggactgaaagaattttcagacaacaatacacggcttataaatatgctgatcgggatgtaaccgtgtgtatatccgctaggtttacgccaacttatctacaaaagaaaatgcttaacccaagtaaaacaccggaacacatctgggtcgagatacttggaaggaaacctcgtaaaacgtttcgcaccgttggacatttcggttctatggagctttcaacacttggagcacggatcctgcgtcacagcaacatctttcagcggagaccccattaaattatggataacagaaacatatcacatgggagcattcaagggtaaattgcaacccgtgcttttccttcgaagggcccttatatagacaacagaggtcttctccgccatttgaaaaaggtggtggtccttagagagaaaacacctcgtacgcgggaccggggaacgcgttccttgcgttgcaagttctgcaagagaaattgtcacgtaacattgatcgttcc

SEQ ID NO: 648047 - DNA, 111 bp, Homo sapiens
atagcgacggatattagccgtattacagtcgcctatatctcggatgtcttgtcgtcactgaggctgtggataatggctccggagcatatgaatagtattgctttgaagaaa

SEQ ID NO: 648048 - DNA, 467 bp, Homo sapiens
ctagaggattctgctgactttctcaggctctacaaaaatttggcactggactgtggcacttttgtatagtttcaatgagatgaaatctggacgttgcagaacacagggtcaggcgcacatacacgcacgcacgcacacacacacacacacacacacacacacacacacagagatatccagcagcatccgtggaactaccctgaacgtcaaagaaaggaacagctcgtgtcgtgcccagatagaaagaattccaaaaaacagccaagaggttgggccagagaatttccagagagagaaatcatacaaacgtagggggttgatttcccagttcctgtcatctcagcagtcaacacacagagaaggatttttctcgtgacgctgccacctccaattctgaaatactcccatgtttcagagtggggccgggacggtggcaaacctgcagaccctgacacaatctctacaag

SEQ ID NO: 648049 - DNA, 1681 bp, Homo sapiens
  misc_feature (380)..(380): n is a, c, g, or t
  misc_feature (956)..(956): n is a, c, g, or t
cctaggacgtcggactttgcatagaagcacataattggaatcaatcgactaatcaccacacagaccataattattagcatcattcacctcctactattattgtgtaaatcctagaaagtcaacgaatcacacccttcatcttacgcctggattcgctcctaaacgttttcacttctctgtagtcgcctctgagagcgataactccgccttacactgagattaactatagcttagcgtgatcttcctgacccgctctagtaatcattggcaaggacacaattcgcaccatgcatgtaatacacagaatgtacattccatcgtactgcaacgcacatacaaccaatgtgctagcactactgctatttattctatatgtactncacctactcgaacttcttccgttaatttgattctaccattttccaacaagacccagcaggacacactataggtacaattaactttctctccactaaatactttttccctttgctggaccaaacgcgattcgagcttttgagttctcgccccatccctttcgtgtcctaattccaaatcaaaccctcagcattggcatgcgtcggatagcgcacgtctcccacggtagagcgggcccttgaataccagcctagggtaaacatatagcttttccatatgttcttacaaaccctcctagggctaaggtctttccgcactttttgcctctccatagggttccaaatcgaccaccgtacaaatgtctagctaagcgtcatcataactatctcgctttagtgtgcttctaccatacatagcgagttgcgtaccattacgtcgagcgtcgtcatggtagtccccaacggaatccttattcataactgtccctgtaagacccaaagaaaaactttaagtactgaacctaaggcgtttagcgaccacatagacgctttggtaactacgttagacagtgacttacncggtaccgtatataacagcgaaactacacgaggtttagtcgatcgtccccgttacaatggcacttcaattgttcaggaaattcctccccactttgcgggttgggaggtcagacctaagctcaacgggtggccctggccagtctaactttcctttccaacacatcatcaaggggcaggggcccatgagggggccaccttaaaactcccgggcactcctgtgacttccaattttttcttcaaccgcggcgctccgttgatacaaaaagacggcacattaagagcctttaaaaccccatattgcgacgtgtcgtcgagtgcagatacacgccctaaattatacaggcgccgtatagacactcaattaaacaaagggcgggccaagctatttgtcagctaccgtcgacaacaaacatagagacctcacaaaaccgctgtgcttggagagatagctccttgtagagacagcagcaagatgaccgccgcgttgtatagcgagcgcaatttatcccacaaggcgaccgttaatgatttcaccgcgacagaacacacttagtctaatgccccggaggtcagtcgtcctaacaacagggtacaagcagcacaaagagggcacgcggccaaacatcactctgcggaacatagccagccagacttgtgtcacaaccgcatcctcccaggccgagagcgatgcgcgacctgcagcccagatcctagtgtcctcactg

SEQ ID NO: 648050 - DNA, 115 bp, Homo sapiens
caggctgtgaggggactgcttgctgtggtggttgctagcccagatgagcattacctaccaccttcccacttggctagctgtcctttggaatatgtgctggtaactggggaaggca

SEQ ID NO: 648051 - DNA, 981 bp, Homo sapiens
ctataggcaatacatcgaagtcacagagctgcattaaagtcatgaagttcttgccctgaagcccactcgcaagtgaagaagacttaaaagaaataccccaagtacccctgggggagagaaatctatacgttagaaggtgtgtggagtggagctccagtattccatgatttctgacttcccttggctgaggtcattacgatgctgcagagcccaacagctgtcgctcgatagcgagctttgaagacgatgaagaaacgcactcatctagtgctccgtagaaggaaaggacagactgtctgcaagacatctgtagtggatagatcgaataggagaggaaattgcagagatgcgtcaggatgaaggaagggtgtacttgtcaagcgagtatgtggcaattattgtatccactattgtgatgtcaagtggagagccgagttagaagatgagcgtacatttaagtgtggtcccatcacatgccgtattgcgcgagccgtattatagtgcgagtaagaggcacagtaagggcgcgatccagtcgtgccatgaggtgctccagcagggacttgaggcatgcaggtgggaggtcctggctcggtgtagcgtatagtagggaatatataagggaagatcgacattggtatacaagagagttgtacttatagaaatatattcaaaggacgcttcctagagtaccaacattgatagtgatatgtttatacaatttagatttaaaagattcattgtaaggaaagacagatagatttgaaagagttggtgtaaaggttgaccttgaattcatgaagatatgatcgctgtgaatggaggtatccaatgattgattcattcgttaatgaatttttgggtcaatccgcttttaaattgtgtggctgttccattgtttgagggaaagcttgtatgaggtaaaactgtggcagagttgagaaaaatacagaaaataataggaagagaagaaatgagacg

SEQ ID NO: 648052 - DNA, 284 bp, Homo sapiens
cgctactactactaaattcgcggcccgtcgactttattattttttttcctctaatcttaacttcacactttatttcataaaggtgatcttcaatctctgatatcctttcttctgctttggctgttgatacttgtgtatgcttcacaattcttgtgctgtgtttcagctccatcaggtcattagttcttctctaaactgcttatttaggtagcattcccaaccttttcaaggtttagctcctgcatgggttaaaatggtccttggcttggaggagtttattattc

SEQ ID NO: 648053 - DNA, 953 bp, Homo sapiens
  misc_feature (527)..(527): n is a, c, g, or t
caccacggtgctgaccatgtccaccatcatcacgggcgtgaatgcctccatgccccgagtgtcctacatcaaagctgtggacatctacctctgggtcagcttgtgttcgtcttcctctccgtgctggagtacgcagctgtcaactacctgaccacagtgcaggagcggaaggaacggaagcttcgggagaagatctcctgcacctgtgggctgccccagcctcgaggggtgatgctggacagcagctacagtgatggagaggtgaacgacctgggcggctacatgcctgagaacggagagaaacccgaccggatgatggtgcagctgactctggcctctgagaggggctctccacagaggaagggccagagaggcagctatgtgagcatgaggatcaacactcacgccattgataaatactcaaggatcattttcccagccgcttacattttattcaatctgatatactggtcaattttctcttagatgcctgtaatgtgtatgtctcagcatgtcctacagaagtngctgtgaaatgaaaattagggcttaaagccatcccactgggttttcactgtccccttttcagctattcaaagctgcactgacaagacacctctgtttgcacttattaaatatcagttctctacacaacattatactaggtgttgccggaagttgcatgatagtacctgacattaggtggtcccagatccaggtaaagcccgaggactatggctgtcgcaatcaggagccctgaatcggtccattgcgggtcctctcacggcggggtcctaacaagggggccggagacctcataaaggtctgtggcccggcctaaacctgtgaaggaggtgggtggcgcccccgagagaggggccagcccccggcgggctaaaccgagccccacagaatgcgggggaacccgcacactaaacaacgttggtctcggg

SEQ ID NO: 648054 - DNA, 476 bp, Homo sapiens
gctgcgtgcagccccactctagaagaccctttatgcgaacacccgtcaagggctgtgaacccgcctggggataaggcgctgttcttgtggaactgaacttatctctacaggggctgtacacgctctgtgcccacagggggggatgtgaatatttcgcgtctgcgcctcgggacacgggcccaagccgggcccaccctggtggaacgtccacgtctgggtgccaaaccaggccccttggccgaagttaagggtggtcttaagaatgatgtggaattaaagcgccattcttaccggtgactggtgccgcacctatcatgtttgacaagccgggactgccaagcacccctctccggtggtggggaccacattgaccaacgctttatttttcaagtggcagtgctccttttggacttttctctagggttggcgcttaactcttcttgggagcttaattcaccccttctttcttcctttaa

SEQ ID NO: 648055 - DNA, 222 bp, Homo sapiens
tcgcccattcgtccagacactaaccccctcattcacacaccctcattcacgagcactaacacactcacaggtaacccattcacacactaacccactctctctctctctttcacacacacacagcaataagaatggaataattctctctttaaaggacaaagaactggagttagagtatgaagttataaagagtcaagatgttcctaggatacagtagggaga

SEQ ID NO: 648056 - DNA, 496 bp, Homo sapiens
gatcaagtgttttaaacctttgatatttgacaaactttccaaaatcaaatgtaaaattctaacttaaatgttttcgacctcaagctaacttttggcattaaagcccttggaagtccaaatagggcccctggaagtccaaaagaaacatattaggctaatttggtatattaaaatcatacaggaagctgatcaaataaaaaatgttgtttaattttctttgagttgtatttgtataaatctgttattaatatgcatcccaaaattgtatcatattgctaaaatgttgatagatcttgttatatgttattggtaataattgttatcctgttaaattattgtataccacagaaataatgaaatttctttgtcaattgcatagtaatcatggctcttctaagtcttttgtcattcacagatgattattgttttacttggattcttttcaaaagtggtttgtaattcgctacagcctaaaatctgcttgttcaaaaaaaaa

SEQ ID NO: 648057 - DNA, 284 bp, Homo sapiens
ggggatctggtcgcacccgtgtaggcattcctgcccacagcggtggggcccgcccttcgctagggtggatggcgacttgcgaggggggcttcatgagcggctacaagatggatcccgcgggggtgcagaaggtgctccaggcggtgggcgaccgcgcgagcgagctcggcactgccctcgacgacgtcgagtcggcgacggccgacgtggtccagggtagcggaggcgacggcatcgtcggtcaggctctggcgaccttcctcaccgaccagaagtccgctctc

SEQ ID NO: 648058 - DNA, 116 bp, Homo sapiens
  misc_feature (70)..(70): n is a, c, g, or t
agagtctaagagctactttatagatattgacattgacacacatacacaaacaaaatgctacacacaggangacatcactgcagtataacacaagtaaaaataaaaacaatagaatg

SEQ ID NO: 648059 - DNA, 403 bp, Homo sapiens
tctctagcaggatcccctacacatcacgctcctacactatgaggctcctttctctcatacaaacagattctctctctatctgctgagctgcctagggctggggttgaggtgacacaagcacccatgtggctgttttaggccggaactgaagcttagcacagcacagagtcttgctcaaggcccactgtaatcactacctggctaccacctaagttcactccaggccccaggcctctacaatcagcaggtggtgaagccgaccaggcttgcatccttcccattagggtagtgagctcccccaggccccaggctggtccattaatgccgtccgggacctaggggctagagtaaaaaacttcataagtctgccttgcattctcctctgctgtgtatgaactggcca

SEQ ID NO: 648060 - DNA, 153 bp, Homo sapiens
  misc_feature (26)..(26): n is a, c, g, or t
  misc_feature (39)..(39): n is a, c, g, or t
  misc_feature (55)..(55): n is a, c, g, or t
  misc_feature (124)..(124): n is a, c, g, or t
tagcagtgttttgtattttttctaantctttagctttcnatattggattaaagtncttgtttgtgaatatagtttccgtatgggcaaatgatttcttgcttattagtcttttgttaaagaatgncttagtaagagctaagcttttaaaagtaa

SEQ ID NO: 648061 - DNA, 413 bp, Homo sapiens
tggaaatcagcctgggcaacctggtgaaaccctgtctctacaaaaaattagccaggtgtggtggcatgtgcctatagtccgagctacccaggaggctgaggtgggagcatcacttgaggctgggaggtcgaggctgctgtgagccaagattgtgccactgcactccagcctgggtgatggggtgagcttctgtctcaaaaagataaagaaaagaaaactcatactctggaacaatagaacccttatagatgggttgttgttcatagtaatgttgatatcaaaagaaggtaggctgggtgcagtggcttatgcctgtaatcccagcactatgggaagccaaggcaggcagatgacctgaggtcaggagttggagaccagcctgaccaacgaggagaaaccccatctctactaaa

SEQ ID NO: 648062 - DNA, 1334 bp, Homo sapiens
cccctggtgccgtccgctgtatcggtcgtgtgcttgtcaatctcttttctcacgcttgtggttttttgctcctgttgtgttctctcttgtggttctgatctgtcttgtcgtccgtgttgtaggtgccgtctcgctggttccgctccagtggttggttcttgtgtctcatggtttgttcttcggtttcgctcgatttgtggtcttccctagttaatgctcgctgcccttagatttctgtcttctcctccgtctctcccgcctcgtttccgcgcgttgtgtccctttctctgagtgtctttcctttgtgacttgaccttcttggtactttgtgtgcgtttttctactgtgttcttgtgctcctgtttcctctatccaggttttggttgatccttcttgttgttcgtgttgttcatgtctgttttggtctttttctggtttttctggtttcttttttggtatttttttgtctacaagtttactttttggtcttttttgggttctgttatctgtggtctgattccatcgttgggtattagttgtactctcgcgtcagttgtcgtcgtctccgtcgttgtcttccggtgtaccgtgtcgtgctttgccgggtgtcccccgttcgtcgtccggtccctgtccgttctcgtgttcgtttttctgctttctgtctttctccctcgtccttgtattgctttccttctagatttcgtagcttgcagccgttcattctctccttcatgtctctcccgttctctctccttctctgtttctcctgctcttctctcctgccagtctcttgtactctgtgtcctggtccctccgtatgtacccctgtctttctcctcctgactggtggtctatctgcccctacctctggccctcgctttaccggtagtaggtggtgggagagggaagtaggagagataaagatcagggtactttgaacactaggcctatctcactgaggccattttcacctcgcacctatgtgggtcagtgggagcatgctaggtgtcagcttttcgtctagtaacttaagtgagagagaaagggcagcagcacacagaagcccctataacgcacagccatcagtcatacgcccctccatccattctctcattggcagaggcccacgcacacaacacagcagcatcattcctacccagggacatgtgaacataacaagcagcatcccaggcatgagcagcagcacaccacacgagacacagacacagaacattagccagtcgtccccagtaatgcccatcaatgtgaatgattcattcagggaaataatttctcgcatttttattattataaataacaatagaacatag

SEQ ID NO: 648063 - DNA, 331 bp, Homo sapiens
gggccccccccccccccggggggtttttttttccccccccccggggggggcccccccccccaaaaaaaaattgggggggttttttttccgccgggcaaaaaaaatttttttgggggggccggggggggggtttttttttttttgccccccccgctccccccccccaaagtggtttttttccccccgttttttgggcccccttttgttttttcccctttttttttttccccccgggggggggggggggggggggggggttttgcccccccccccgggcctttttttttttttccaaaaattttttttttttttttttcccccggggggggga

SEQ ID NO: 648064 - DNA, 227 bp, Homo sapiens
tggggcccaaggcggggtagtagctgaatcatggatcacaaacacagaactcagttcctgaggacggctgcaaggagacaaccccgatgtactcctacatggccttcaccgctacctttaccaaatcatgttcacacgcttagctcacacaccataggacatgttcacacacctctgattcatcccggatgaatcagacctgacacaactctaagtaaaagcaggca

SEQ ID NO: 648065 - DNA, 211 bp, Homo sapiens
taagtaggagagagtggatagtagagtcagaagcgttatgtggatttatgcgggtaaagccatatcgggggtaccgattataaggggaactagtcagcttgccaaagcctccgattatgatgggtattactatgaagaagatagttacaaatgcatgggctgtgacgataacgtcgtagactgctggctcgccacctacacaggtgccagg

SEQ ID NO: 648066 - DNA, 102 bp, Homo sapiens
tgacatctagaggatcccatgtggaccatcaataacttaagctttgcgggagaacatgggtgacgtcattaaaagttctacattttcatcaggtgggtacgt

SEQ ID NO: 648067 - DNA, 150 bp, Homo sapiens
cggcacgagggatctgcctgcctcggcctcccaaggtgctgagattgcaggcatgagccatcatgcccagtcccagttataacgtaatataaagtgattttcttgttttaaaatttgtcaatattgaatttaagttttaaaaaaaaaaaa

SEQ ID NO: 648068 - DNA, 2156 bp, Homo sapiens
  misc_feature (128)..(128): n is a, c, g, or t
  misc_feature (186)..(186): n is a, c, g, or t
  misc_feature (424)..(424): n is a, c, g, or t
  misc_feature (458)..(458): n is a, c, g, or t
  misc_feature (1228)..(1228): n is a, c, g, or t
  misc_feature (1998)..(1999): n is a, c, g, or t
  misc_feature (2003)..(2003): n is a, c, g, or t
caactaacaaccgtactcaaaaaacttctagatcctaagcttatctccacaaaagagaacacacaaacagcaaaaaccatagggcccctctcaacccctccctgcacacacctcatcacttgaaaaanggtcctgctcacaacatcacttttaaacttctgaaatccgcccacaactgcccaaatnacaattgaaacccagccacccaaaatttctaaaggaaaaaattttcttctacttttccacaatttaccccaaaatctttctggctacatttggtacaaaaggcaaataacatacctctaccattacattacatcatatgtattaaacggtcaaaaaattatatatagacctacatacaataaaaaaaaaaaaatatattccaattcatcccttctaatccaaaatttcacgcaggaanatgcaggatctacacttacacatcgtaaaacgangcgatgggactggaggagtaactggacatttcaccttcaccttatacctggagactcccaagccctccatctccagcagcaacttaaaccccagggaggccatggaggctgtgagcttaacctgtgatcctgagactccggacgcaagctacctgtggtggatgaatggtcagagcctccctatgactcacaggttgcagctgtccaaaaccaacaggaccctctttctatttggtgtcacaaagtatattgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaaaacctctacttgtcctgcttcgcggactctaacccaccggcacaatattcttggacaattaatgggaagtttcagctatcaggacaaaagctctttatcccccaaatnactacaaagcatagcgggctctatgcttgctctgttcgtaactcagccactggcaaggaaagctccaaatccatgacagtcgaagtctctgactggacagttccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattctagcagaataaaacatgtaccacnnaaanaaaaatcgagacacagaacagcaaaaaaaaaacatttctttggcactgtcggtcctctgtgagaagtttcttgggaaaaaccctgccgttgtggggccggggtcccgagaggtaactgtgacagtcggtccaggaaggtgtctcaagggagac

SEQ ID NO: 648069 - DNA, 2118 bp, Homo sapiens
  misc_feature (128)..(128): n is a, c, g, or t
  misc_feature (186)..(186): n is a, c, g, or t
  misc_feature (424)..(424): n is a, c, g, or t
  misc_feature (458)..(458): n is a, c, g, or t
  misc_feature (1228)..(1228): n is a, c, g, or t
  misc_feature (1983)..(1983): n is a, c, g, or t
  misc_feature (1989)..(1989): n is a, c, g, or t
  misc_feature (1991)..(1991): n is a, c, g, or t
  misc_feature (2004)..(2004): n is a, c, g, or t
  misc_feature (2009)..(2009): n is a, c, g, or t
caactaacaaccgtactcaaaaaacttctagatcctaagcttatctccacaaaagagaacacacaaacagcaaaaaccatagggcccctctcaacccctccctgcacacacctcatcacttgaaaaanggtcctgctcacaacatcacttttaaacttctgaaatccgcccacaactgcccaaatnacaattgaaacccagccacccaaaatttctaaaggaaaaaattttcttctacttttccacaatttaccccaaaatctttctggctacatttggtacaaaaggcaaataacatacctctaccattacattacatcatatgtattaaacggtcaaaaaattatatatagacctacatacaataaaaaaaaaaaaatatattccaattcatcccttctaatccaaaatttcacgcaggaanatgcaggatctacacttacacatcgtaaaacgangcgatgggactggaggagtaactggacatttcaccttcaccttatacctggagactcccaagccctccatctccagcagcaacttaaaccccagggaggccatggaggctgtgagcttaacctgtgatcctgagactccggacgcaagctacctgtggtggatgaatggtcagagcctccctatgactcacaggttgcagctgtccaaaaccaacaggaccctctttctatttggtgtcacaaagtatattgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaaaacctctacttgtcctgcttcgcggactctaacccaccggcacaatattcttggacaattaatgggaagtttcagctatcaggacaaaagctctttatcccccaaatnactacaaagcatagcgggctctatgcttgctctgttcgtaactcagccactggcaaggaaagctccaaatccatgacagtcgaagtctctgactggacagttccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattcttaggcagnaattanancatgttacccccntttgnttaaaaaacacaaaaacacacacaacaaacaacacacacacacaaacaccccttactctcccacaccataccccacaaaccatcccctaacacaccacacaaaacaacc

SEQ ID NO: 648070 - DNA, 2310 bp, Homo sapiens
  misc_feature (128)..(128): n is a, c, g, or t
  misc_feature (186)..(186): n is a, c, g, or t
  misc_feature (424)..(424): n is a, c, g, or t
  misc_feature (458)..(458): n is a, c, g, or t
  misc_feature (1228)..(1228): n is a, c, g, or t
  misc_feature (2023)..(2024): n is a, c, g, or t
  misc_feature (2028)..(2028): n is a, c, g, or t
  misc_feature (2035)..(2035): n is a, c, g, or t
caactaacaaccgtactcaaaaaacttctagatcctaagcttatctccacaaaagagaacacacaaacagcaaaaaccatagggcccctctcaacccctccctgcacacacctcatcacttgaaaaanggtcctgctcacaacatcacttttaaacttctgaaatccgcccacaactgcccaaatnacaattgaaacccagccacccaaaatttctaaaggaaaaaattttcttctacttttccacaatttaccccaaaatctttctggctacatttggtacaaaaggcaaataacatacctctaccattacattacatcatatgtattaaacggtcaaaaaattatatatagacctacatacaataaaaaaaaaaaaatatattccaattcatcccttctaatccaaaatttcacgcaggaanatgcaggatctacacttacacatcgtaaaacgangcgatgggactggaggagtaactggacatttcaccttcaccttatacctggagactcccaagccctccatctccagcagcaacttaaaccccagggaggccatggaggctgtgagcttaacctgtgatcctgagactccggacgcaagctacctgtggtggatgaatggtcagagcctccctatgactcacaggttgcagctgtccaaaaccaacaggaccctctttctatttggtgtcacaaagtatattgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaaaacctctacttgtcctgcttcgcggactctaacccaccggcacaatattcttggacaattaatgggaagtttcagctatcaggacaaaagctctttatcccccaaatnactacaaagcatagcgggctctatgcttgctctgttcgtaactcagccactggcaaggaaagctccaaatccatgacagtcgaagtctctgactggacagttccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagagtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaaaaaaacaaaacaccanncacnacaaaanacacaaaaacacacaacaccccacaccaccacacataacacacaacgaatcctctactcactcccacaatcaaactcataaaacacactcaacacacatcccatacaacacttatccttgcagtcccactcccctccactcaccattctgtgctcctcaacaaaaaatccctctcctcacgccccaacaactacctgattacacaagacacacaacacctatgagactcaataacacacacacacctcctccccgtaccatagccatcttaatct

SEQ ID NO: 648071 - DNA, 918 bp, Homo sapiens
ggacacacccttgaatgctatagcttatccatgaagctctatgaagaaggggcagcagccagaggatggaagacttatgggctggtgaccagatattcagaggttaagtggggttgaccgtgtacggaatctccagaccacgtaagtaagccaatcacaaagccctggacggcatgagcgccaccagaaggtgtcggcgtggtggtgtatagcagatgatggctactactatcgctggtgatgaggagaacttggagattgtccctgtggatctgcagaagataatgctggccggtggcctgtggcctgagcatcgtatgggaaacgaagatgtgaagcggagtgtatatatatctgacatcgtgaaaggcggagccgcagacctggatgggagagttgattcagggatgatcagatctctatctgctgaagtggggaggacagtgaggaaaatgcctcataggatgacagatggcacacacagtacctcaatgtgtggcacaagaggaggtattgtagcgtggcatagacgaatatggacaagagttccgagactgaggtaccgtgggatcctgttgtgaggtagtgacattcatgaggaacaggttcaggggttagtcgaggagaagattggcaaatcgaacggatggtagctagttacaattcctcgtccttgtccgcatcacttgttcgagtcgagcagtggggcgcttgccaaaaaaccatgggttgtgggaccacaatagataacgaaggtctcaagagatcctttgcccaagaaaacaattggcaagagcaccagcattattgggaaactcatagggagctggactagacggagtaatacaggggcatgcttcagtaggtaggccccttgggaatccaagtaattggtgggagggcacagcaggaaagtcg

SEQ ID NO: 648072 - DNA, 321 bp, Homo sapiens
ggcacgagcatctagaatacggatataaaagaaaatactggccaggtgctatgggtcatgcttgtaatcccagcactttgggaggccgaggcgggcggatcacaaggtcaggagatcgagaccatcctggctaacacagtgaaaccccatctctactaaaaatacaaaaaaattagccaggcgtggtggcaggcgcctgtagtcccggttactcaggaggttgaggcaggagaatggcgtgaacccgggtggcagagcttgcagtgagccgagatagcgccaatgcactccagcctgggtgacagagcaagactctgtctc

SEQ ID NO: 648073 - DNA, 2448 bp, Homo sapiens
  misc_feature (128)..(128): n is a, c, g, or t
  misc_feature (186)..(186): n is a, c, g, or t
  misc_feature (424)..(424): n is a, c, g, or t
  misc_feature (458)..(458): n is a, c, g, or t
  misc_feature (1228)..(1228): n is a, c, g, or t
  misc_feature (2038)..(2038): n is a, c, g, or t
  misc_feature (2040)..(2040): n is a, c, g, or t
  misc_feature (2043)..(2043): n is a, c, g, or t
  misc_feature (2046)..(2047): n is a, c, g, or t
  misc_feature (2050)..(2050): n is a, c, g, or t
caactaacaaccgtactcaaaaaacttctagatcctaagcttatctccacaaaagagaacacacaaacagcaaaaaccatagggcccctctcaacccctccctgcacacacctcatcacttgaaaaanggtcctgctcacaacatcacttttaaacttctgaaatccgcccacaactgcccaaatnacaattgaaacccagccacccaaaatttctaaaggaaaaaattttcttctacttttccacaatttaccccaaaatctttctggctacatttggtacaaaaggcaaataacatacctctaccattacattacatcatatgtattaaacggtcaaaaaattatatatagacctacatacaataaaaaaaaaaaaatatattccaattcatcccttctaatccaaaatttcacgcaggaanatgcaggatctacacttacacatcgtaaaacgangcgatgggactggaggagtaactggacatttcaccttcaccttatacctggagactcccaagccctccatctccagcagcaacttaaaccccagggaggccatggaggctgtgagcttaacctgtgatcctgagactccggacgcaagctacctgtggtggatgaatggtcagagcctccctatgactcacaggttgcagctgtccaaaaccaacaggaccctctttctatttggtgtcacaaagtatattgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaaaacctctacttgtcctgcttcgcggactctaacccaccggcacaatattcttggacaattaatgggaagtttcagctatcaggacaaaagctctttatcccccaaatnactacaaagcatagcgggctctatgcttgctctgttcgtaactcagccactggcaaggaaagctccaaatccatgacagtcgaagtctctgactggacagttccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaaaaaaacaaaaaaaaaaaaaaaaaacctttntnggngcnnccngggccccacaaaaacgtttctaaaacacattggcgtggggccgcagggccccaaatagggaaagggaacactggcgcaaacaggtgtccaaagggaaaccgggggcacaaaacaaaggggtggggttcccccccaattaaaaacccgccggggggaacacacggagcgtctcgtgacaaaaccccgaaaagggcgagctccgagagagggcacatcacgaggggtctctacacaacgcaggggggctcaccaaagagaggtcccagaacatcaaattaacccccgcccagcgcggcgtgcgcaaaacgaagaagaagagacgaaagagcacaaacaacaacagcagagaagaaacacaaagcgaacaaagatgaggaagcgacaagaacagagaacag

SEQ ID NO: 648074 - DNA, 1646 bp, Homo sapiens
  misc_feature (128)..(128): n is a, c, g, or t
  misc_feature (186)..(186): n is a, c, g, or t
  misc_feature (424)..(424): n is a, c, g, or t
  misc_feature (458)..(458): n is a, c, g, or t
  misc_feature (1228)..(1228): n is a, c, g, or t
caactaacaaccgtactcaaaaaacttctagatcctaagcttatctccacaaaagagaacacacaaacagcaaaaaccatagggcccctctcaacccctccctgcacacacctcatcacttgaaaaanggtcctgctcacaacatcacttttaaacttctgaaatccgcccacaactgcccaaatnacaattgaaacccagccacccaaaatttctaaaggaaaaaattttcttctacttttccacaatttaccccaaaatctttctggctacatttggtacaaaaggcaaataacatacctctaccattacattacatcatatgtattaaacggtcaaaaaattatatatagacctacatacaataaaaaaaaaaaaatatattccaattcatcccttctaatccaaaatttcacgcaggaanatgcaggatctacacttacacatcgtaaaacgangcgatgggactggaggagtaactggacatttcaccttcaccttatacctggagactcccaagccctccatctccagcagcaacttaaaccccagggaggccatggaggctgtgagcttaacctgtgatcctgagactccggacgcaagctacctgtggtggatgaatggtcagagcctccctatgactcacaggttgcagctgtccaaaaccaacaggaccctctttctatttggtgtcacaaagtatattgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaaaacctctacttgtcctgcttcgcggactctaacccaccggcacaatattcttggacaattaatgggaagtttcagctatcaggacaaaagctctttatcccccaaatnactacaaagcatagcgggctctatgcttgctctgttcgtaactcagccactggcaaggaaagctccaaatccatgacagtcgaagtctctgactggacagttccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctccctggatgagggcatggggtaccgagct

SEQ ID NO: 648075 - DNA, 1864 bp, Homo sapiens
  misc_feature (128)..(128): n is a, c, g, or t
  misc_feature (186)..(186): n is a, c, g, or t
  misc_feature (424)..(424): n is a, c, g, or t
  misc_feature (458)..(458): n is a, c, g, or t
  misc_feature (1228)..(1228): n is a, c, g, or t
  misc_feature (1307)..(1307): n is a, c, g, or t
  misc_feature (1333)..(1334): n is a, c, g, or t
  misc_feature (1381)..(1381): n is a, c, g, or t
  misc_feature (1384)..(1384): n is a, c, g, or t
  misc_feature (1403)..(1403): n is a, c, g, or t
  misc_feature (1411)..(1411): n is a, c, g, or t
  misc_feature (1416)..(1416): n is a, c, g, or t
  misc_feature (1419)..(1419): n is a, c, g, or t
  misc_feature (1427)..(1427): n is a, c, g, or t
  misc_feature (1443)..(1444): n is a, c, g, or t
  misc_feature (1449)..(1449): n is a, c, g, or t
  misc_feature (1461)..(1461): n is a, c, g, or t
  misc_feature (1468)..(1468): n is a, c, g, or t
  misc_feature (1499)..(1499): n is a, c, g, or t
  misc_feature (1774)..(1774): n is a, c, g, or t
caactaacaaccgtactcaaaaaacttctagatcctaagcttatctccacaaaagagaacacacaaacagcaaaaaccatagggcccctctcaacccctccctgcacacacctcatcacttgaaaaanggtcctgctcacaacatcacttttaaacttctgaaatccgcccacaactgcccaaatnacaattgaaacccagccacccaaaatttctaaaggaaaaaattttcttctacttttccacaatttaccccaaaatctttctggctacatttggtacaaaaggcaaataacatacctctaccattacattacatcatatgtattaaacggtcaaaaaattatatatagacctacatacaataaaaaaaaaaaaatatattccaattcatcccttctaatccaaaatttcacgcaggaanatgcaggatctacacttacacatcgtaaaacgangcgatgggactggaggagtaactggacatttcaccttcaccttatacctggagactcccaagccctccatctccagcagcaacttaaaccccagggaggccatggaggctgtgagcttaacctgtgatcctgagactccggacgcaagctacctgtggtggatgaatggtcagagcctccctatgactcacaggttgcagctgtccaaaaccaacaggaccctctttctatttggtgtcacaaagtatattgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaaaacctctacttgtcctgcttcgcggactctaacccaccggcacaatattcttggacaattaatgggaagtttcagctatcaggacaaaagctctttatcccccaaatnactacaaagcatagcgggctctatgcttgctctgttcgtaactcagccactggcaaggaaagctccaaatccatgacangtcaaagtctctgctccttcaggaannaggacatcttcctggccttaatccattatagcagccgtgatgtcatntcngtatttcaggaagactggnagacagtngcttncanttcttccncaaagtatttaccatnnagctngcagtccaaaantggcttnttgttcaaggagatttatggaaaggtctctnacaaggactcttgaatacaagctcctgataacttcaagatcataccactggactaagaactttcaaaattttaatgaacaggctgataccttcatgaaattcaagacaaagaagaaaaatactcaatgttattggactaaataatcaaaaggataatgatttcataattttctatttgaaaatgtgctgattcttggaatgtttcattctccagatttatgaacattttttcttgagcaattggtaaagtatacttttgtaaacaaaaattgaancatttccttttgcaccctatctgagtcagaattggggaaactatcagggagtattatatgttaaggggaataaagtatttggacaagttc

SEQ ID NO: 648076 - DNA, 1414 bp, Homo sapiens
  misc_feature (128)..(128): n is a, c, g, or t
  misc_feature (186)..(186): n is a, c, g, or t
  misc_feature (424)..(424): n is a, c, g, or t
  misc_feature (458)..(458): n is a, c, g, or t
caactaacaaccgtactcaaaaaacttctagatcctaagcttatctccacaaaagagaacacacaaacagcaaaaaccatagggcccctctcaacccctccctgcacacacctcatcacttgaaaaanggtcctgctcacaacatcacttttaaacttctgaaatccgcccacaactgcccaaatnacaattgaaacccagccacccaaaatttctaaaggaaaaaattttcttctacttttccacaatttaccccaaaatctttctggctacatttggtacaaaaggcaaataacatacctctaccattacattacatcatatgtattaaacggtcaaaaaattatatatagacctacatacaataaaaaaaaaaaaatatattccaattcatcccttctaatccaaaatttcacgcaggaanatgcaggatctacacttacacatcgtaaaacgangcgatgggactggaggagtaactggacatttcaccttcaccttatacctggagactcccaagccctccatctccagcagcaacttaaaccccagggaggccatggaggctgtgagcttaacctgtgatcctgagactccggacgcaagctacctgtggtggatgaatggtcagagcctccctatgactcacaggttgcagctgtccaaaaccaacaggaccctctttctatttggtgtcacaaagtatattgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctcccgaagctgcccaagccctacatcaccatcaacaacttaaaccccagggagattaaggatagagagcaagagaagtgagacagggacagaagattaaggatagagagattaaggatagagagattaaggatagagagattaaggatagagagattaaggatagagagattaaggatagagggcaagagaagtgagacagggacagaagattaaggatagagagattaaggatagagagattaaggatagagagattaaggatagagagattaaggatagagagattaaggatagagggcaagagaagtgagacagggacagaagattaaggatagagagattaaggataga

SEQ ID NO: 648077 - DNA, 242 bp, Homo sapiens
ttgtgcctagaccaccgaagttatactctcgaactgacactgagccacaacccatacaacccagctctcccataagcttcagactagactacttttccataatattcatccctgatagcattgttctgttacatggtccatcaatagaattctcactgtgatatcataaactcagacccaaacattaatcagttcttcaaatatctcctcatcttccttattaccatactaatcttagttac

SEQ ID NO: 648078 - DNA, 124 bp, Homo sapiens
cacatatcacgccaatgccgtgtggttttgtttgaatataaattggtgaaagtgttggtttgtttaaggcagtaatttttttgtttgtttttatgcgatttcattccatcttgagcctgtgtct

SEQ ID NO: 648079 - DNA, 211 bp, Homo sapiens
  misc_feature (182)..(182): n is a, c, g, or t
attcctcagttgaagaaggcacaggctgctgcaaacaagaaacagactccacgacgttgggtccctccctccgggcaaaccagccctgcaccccgggacagccctaaactcgactccttttcagaaagtacgctgcagggccaaggcgcggtggctcacgcactgtaatcccagccactttngggaggcccaaagtagggccagatccacg

SEQ ID NO: 648080 - DNA, 408 bp, Homo sapiens
  misc_feature (15)..(15): n is a, c, g, or t
  misc_feature (17)..(17): n is a, c, g, or t
gacctagaggatccncngctgctcccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattctagcagaataaaacatgtaccacctttgct

SEQ ID NO: 648081 - DNA, 196 bp, Homo sapiens
ccccccgggggtttttttaaaaaatgggccccgcccccgccggggggggggggggccccccccccccccccccccttttggggggggggggggttttttcccccggggtccccccccccttttttccccccccccggggaaactttcccagggggggggaaatagggggccctttttccttttcccccctttttta

SEQ ID NO: 648082 - DNA, 1189 bp, Homo sapiens
  misc_feature (902)..(903): n is a, c, g, or t
  misc_feature (907)..(907): n is a, c, g, or t
  misc_feature (914)..(914): n is a, c, g, or t
cacttatgtaaacaatcagaccacatttgaagaaactccacctattttgcaaacaaacttattctactgaaattatcattggtaaaagtagagatgcccatagagggaaaaattatgtggaaaataaaaactgtagtatacctgttatgagactgcagctctgttcattgtttctgtgtttttattatccacctgtagactggacagttccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagagtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaaaaaaacaaaacaccanncacnacaaaanacacaaaaacacacaacaccccacaccaccacacataacacacaacgaatcctctactcactcccacaatcaaactcataaaacacactcaacacacatcccatacaacacttatccttgcagtcccactcccctccactcaccattctgtgctcctcaacaaaaaatccctctcctcacgccccaacaactacctgattacacaagacacacaacacctatgagactcaataacacacacacacctcctccccgtaccatagccatcttaatct

SEQ ID NO: 648083 - DNA, 394 bp, Homo sapiens
aacccccccccgaggtttttgttcttgggggcagggcccgggccccaagttttcctttttggggtccccaccccccttaaggaaggggatttttttccccccccgggcctgggaattttgggcccccccttttttaggggcgggaaattttggggggggggggtttagtcttacccccccccccccccggttccaggaaggtttttaacttttcttttcccggccctaggggacccctggggggttaaaaagggcccccccctaccgtttttccttaaccccctttttttaagggggagccaaggggggagatttttttttgggggggggggccggggtttcccgggggccaaggttttttgtttttttggcccttaacttttttttagtttta

SEQ ID NO: 648084 - DNA, 1566 bp, Homo sapiens
  misc_feature (1004)..(1004): n is a, c, g, or t
  misc_feature (1083)..(1083): n is a, c, g, or t
  misc_feature (1089)..(1089): n is a, c, g, or t
  misc_feature (1100)..(1100): n is a, c, g, or t
  misc_feature (1150)..(1150): n is a, c, g, or t
  misc_feature (1201)..(1201): n is a, c, g, or t
  misc_feature (1476)..(1476): n is a, c, g, or t
tgaattataaaaagtttgtaaaaaaagaggatggtaaggtaggaattaagggatagagagtgaaagagtgataagagagattatggataataggataatataaaaagaggagaagaagaaggaagaagagaaaatggggaaaataaaagaaacttaatgaaaaaagagaataaaatggaaggggatcatgataaaagaataaattttaaaattttggaatatgcacaaaaatgctgaagttacgattgaagcaagaataaaagtttttgaggggaaggatgttattataattgttaaaaatttgaaaaagaatattaatggataattatggtaaaaaggggaaatgaaggaaatataaaattaaattatatagtatatagttgatggtaaaataattatatatgggaatgaataaagtggaagagaaaaagtatattaaaaagaataaatgatgatatagaatgtaaaaaggaaggatgaaggaaaatacaaattaaagataataaagagaggtgatgagactagagaagaaattcgacatttcaccttcaccttatacttggagactcccaagccctacatctccagcagcaacttaaaccccagggaggccatggaggctgtgagcttaacctgtgatcctgagactccggacgcaagctacctgtggtggatgaatggtcagagcctccctatgactcacaggttgcagctgtccaaaaccaacaggaccctctttctatttggtgtcacaaagtatattgcaggaccctatgaatgtgaaatacggaacccagtgagtgccagccgcagtgacccagtcaccctgaatctcctcctatggtccagacctccccagaatttacccttcattcacctattaccgttcaggagaaaacctctacttgtcctgcttcgcggactctaacccaccggcacaatattcttggacaattaatgggaagtttcagctatcaggacaaaagctctttatcccccaaatnactacaaagcatagcgggctctatgcttgctctgttcgtaactcagccactggcaaggaaagctccaaatccatcacantcaaantctctgcttcnacaagaataggacttcttcctctccttaatccaacatagcagctgtgatntcatttctgtatttcaggaaaactggcaggagatttatggaaaggtctctnacaaggactcttgaatacaagctcctgataacttcaagatcataccactggactaagaactttcaaaattttaatgaacaggctgataccttcatgaaattcaagacaaagaagaaaaatactcaatgttattggactaaataatcaaaaggataatgatttcataattttctatttgaaaatgtgctgattcttggaatgtttcattctccagatttatgaacattttttcttgagcaattggtaaagtatacttttgtaaacaaaaattgaancatttccttttgcaccctatctgagtcagaattggggaaactatcagggagtattatatgttaaggggaataaagtatttggacaagttc

SEQ ID NO: 648085 - DNA, 274 bp, Homo sapiens
gaacaggcctccatacgtgttcatagccctgtgtagtaacgcgccttgaggttgtgcagcaccgagggttcgttgaggcacgtgagctctgtcatgtcctccaccttggagcaacctgggcgggcttcatctgtctggatgtcatccttgttcatcttcaccttcttccccttctccaccagctccacgatggcctcttcgcccagctcctccttaaggctggctgggcccaagccactcttgtctggaaggcatcccccaacaatgcctcgtg

SEQ ID NO: 648086 - DNA, 301 bp, Homo sapiens
gaacagatgcatgaatttgcaagatttcagagtagcagctatatacccatcctagggatcaggagatagagattgtaaacataggataggtactgcttattggatatacttcacataagtatgagagccttcttttggtgctctagagtaggaaattaccacttcctatcggcgtgtgtgttggctgtcttcctcctctgtgcctcaggcccttcagtctgtgacaatggggtcacagcatctgcctctcagggtcagtgtgtggtgtcaatgtgagcaaggcgctgaggcttgggggctc

SEQ ID NO: 648087 - DNA, 790 bp, Homo sapiens
gctgatactaagagcaccgatctgtgggcagggggctgcgtctatacttactagtcttgtgaacaatggggaaagaactggtgggtttgttgcacaaagatctcctgtggtgcggaggtccctgactgtcgtattgccccattccaggagagggtgttgatctggtgtgggggaatgctgtgggcgtgtctatgagctgggacagacgaacaaagttgactccgacattgatgtgacgacataggcatagtcgccaattcatatcatcgtggggagtcctagcactatcgcgacatggggcgtaagtttgtatcatgactgtccagagaacagtttcatgctggggttttcgctacacagtcgtgattgataaaccgagatctttattgatactgttgactgaatgaaattaccctgaccgcccgatgggatcactagcagtgcagccctacctgggactgatgataggtggtggtcctgggggcaagcacaattttcggcaccaccgtagtgtggtgggtggacggctccccagctacacagccagggtgtttggaacgtaggagtgaaggaatcctagtagggaaaaccagaaggtcaccctgtggggggacgcggtggagcgtatgcatcagagtggggcgcccttccacagaagatgtgctgaagtgtgatcgattgtaaccttacccaaatgtctggggggacaacggatgcgtgtccctttgcttcacaggatccacgctgagtcccctggaggggtgcaacaaatcgggttgtgtagtaccac

SEQ ID NO: 648088 - DNA, 256 bp, Homo sapiens
tccattcaggaaagtactctcgaaccagctcggggtctcctcgcggccaggatccagtttccgccaggtgtatgactcgtagtccaccggccatctggactcagcggaaaggcaagctccgggcctcggaagacccagactccagaaagggagctgctatggtgggttccaaaaaggatgacacgggcgaaggcattcttcctcagctggtccagtcgcgggaacattccagtgatgagatggcggtacggagctc

SEQ ID NO: 648089 - DNA, 421 bp, Homo sapiens
ttaggggcaagattctgcctcaaaaattcctcccttcaggggtcaaaattggaagacggatggtggtaatccccaaaatcatggtagctcccaccacctccaaaatggcttccatcataaccaaatccataatagccatccccatggccaaccaatatcaacaaccaccaagggttgccaccaaaagccaccaaggacaatggaagtttcctcaacggaccggaggtggtcatccccaacggaaaccacctccaggaccaaccaccaaagtttccagaaccacttcgacctcttgggctggatgaggcactagccatctctggcttggaaaggggctttctaacttcacagtggtggccatccacagtatggtattgctgaatgacaatctaatccagggagcctgggtcgtcaaagggta

SEQ ID NO: 648090 - DNA, 136 bp, Homo sapiens
gactatggggtcatcaagagtgacttgttccagagtgttgccctctttgaagtgcaaagacattgacgcagtgcaaagtgaccctgatggcttatgggcagcttggcagtgaccaagaatgatgggcactaccgtg

SEQ ID NO: 648091 - DNA, 780 bp, Homo sapiens
ggagagagagaactagtctcgagtttggtttttttttctattttttttaaaaaaaccctgatccttgggggggggtgggtataatactaaattggaaataattatatattaccggggaaagggcccttttgtagaagttaggcgcctatatttcctcttatgttccttctcgtaccagggtgacgacaatttgcgaagataatatagaaacccagcccttggattaacctccgggctctagaccctcagactcacggatagagacgttaaatctcggtgtagaaacaaacgaaacccctttataatatagcgcggcgtgtgaacccacatcccgggaaatatgctccttgatctcacaaacactcagaggagcccgtaaaacaccaccatatatgtgtttgagtatatatgtgagcctctctagtaagacacataggaggatttctcgcgcgccgtggataaaacatcccccataggaggcaaccgcgtgtgatcccccggaatatagttacaaagtctacaagtgtgggactctcccagactgtggggagtcttatttgaggcgtgaagccatcagcgcctttatgaagaaagtgtagcgtgtggaaaggttttctcagaaacctgagtatgtggaaccgtgaaccatcgagagaggagtaattcgggagaattatatgtggggccccgccgagagggcaccgccccccccaacccgcgggaaaaattctcttaaactgcatcgcggtatgttcggggaacagattatcaacggacacc

SEQ ID NO: 648092 - DNA, 1455 bp, Homo sapiens
gcagaggggtccatacggcgcttgttctggattcccgtcgtaacttacaagggaaactttcacaactgtccggagcccttgatgctcctgcaaactgaaggaggaggactgtccttaagcttccttgcagcaggaacccacttagcgctggcaccaatcttgacttccagcatggaacacgtacatctactaaacaggcacaacagctgatggccactcctactactcactacaatcctcacagaggcacctggcgagcaaacgccttcctgcctgcgccacgcctcgctgccacacctctgcttgccactctgaaaaccctgcgtgaatgctcagctgcttactactccctcccagcgcaactacctggccccagcagcgcgacctgctgcctgcaagctctctgccgtgcctgcccacctgcgccagcccacctccgaaccttgcctggcccgcctctcaccctccttgcgcaaccccttcacctacaccagcactccacggccacgcccctttcccgcgcgacgccacgcgcccctctcctctgctggctctacctgaaccccccacgggccctgcacacaccaagcccctcttcaccggcaggcgccactcctctactgctctcacaccctacccctacccaacttgccgcctgctgctacacaccacgcacttcatcccttctgccgcctactgctggaccactctggccactcctccattcgcaacaaaccaagcgcgcacgcctcaccttcagctgcgcgctctctgaacctgctgcgctgcgcactgccctgcgcctccgcggcaaggttaccttgccggcaattgccgcgtgggccacccacttcttcccccgctgcgaacccaccccccactgcgggcatgcgctcaccttgccccttgcaccttcctggcttaccttttcctacccaccacgcaatccctggcccgtagccactttgcctcccccccaccgccagccagcgccctctgcctcgcctgtgacccaaagggcccagcctgacacccaaacgcggcacagcacactttccacacgcgaccgcatcaccttcggcaccctgcgctccccaggctccacggacagctatcaacccatggcctacattccagccccctgagcaacagcgcgcgacaacccgcggcccctcggacacggcgcggcacccgcgctgcccccccccggcgcccctcactccgcccacctcccccttacctgccacaacgggacacacatcccccagcacccggcaccacgcaaccaaccggcctctgcgacctccaccacgacactcacagccccaccgatactgcgccgccagccccccccgcaccgtgcgcccaaaccgaccggcccaaagacgccaacgagcctgccaacgggctgccgcgccatcaaagcacccccgcacacagcaccacaccgcgcgc

SEQ ID NO: 648093 - DNA, 269 bp, Homo sapiens
accccttgggggggggtgggcccccaatggggttttttccccctcggggccgggggggccaaaggggaaaattttgacccccgttaaattttttttaaacggttttttaggggccccgttttgggaaaaccccggccccctttttttttgggggtttggggaaaatttttttggttgggggaaaatttgggggggggggggggggggggggggtttttttatttttttttgtccctttgggcccgggcccaaaaaaaggccccccttta

SEQ ID NO: 648094 - DNA, 279 bp, Homo sapiens
accgtcctggctgacatggtgaaaccccatctctactaaaaatacaaaaaaattagccgggcgtggtggcaggcacctgtagtcccagctactcgggaggctgaggcaggagaatggcatgaacccaggaggcagagtgtgaagtgagcggagatcatgccactgtactccagccctggtgacagagcgagactccgtatcaaaaaaaaaaaaggaaatgtcctgaatatgaacttgggacaaagcaaggaagtttttacttactaaattttctaaatt

SEQ ID NO: 648095 - DNA, 481 bp, Homo sapiens
ttttttttgagagggtgtctctctctgttgacaggctggagcacagtagcacgacctcaggccactgcaacctccaccttctgggttcaagagattctcctgcctcagccttccaagcagccgggaccacaggcgcatgcaccacgcccagccaacctttgcaccttcagcagagacagggcttcaccattgccggccaagctggtctcggtctctttgaccctgtgatccacccaccttggccccccaaagtcctgggattacaggcgcgacgactgtgcccagccccggctcaggtttttcaatacagtcttgaccttggcattcagtatcctcacagcatggttctaattaactttctagctctatttcccttttcctgctccctctctctacaactagtctttctctgattgccccgccctcaacccatctaaactagaccccagggaagcaccttggtccccttcctctctcccac

SEQ ID NO: 648096 - DNA, 912 bp, Homo sapiens
  misc_feature (319)..(319): n is a, c, g, or t
ttgcgggggcctcgtcgccatatatttgggaatctcgaattctgttgaaggggaacccccccggtgtgtcccgcacgctggagccgccctgtaataagtgccagccactctttggtgtggcgacgcccctttaggaatgggtacccttgtgggccccctccccaccgccgctggggagtagatctgtctctccctcgcgggggcccccctcttttatagttgtcgctgtggcgtcgccgaggacactttgtctccgcccggtccgctctctctgccccgcgttgtctagggccatatacacacgcacgggggccgcccnagatagggccctctttttcttcgaagatggtttggggccaccccagaagtttttgtatagttccccgttgggccacggggcatttctgtgaggacgcccatgaactcatttcgtggacccttgtcctctggggggcgttattaaccaggccccccccctgctccctccccgcgggtcgggcgcacccgagcgtcctttgcattatgggtgtcccgggacccccacggagttttttcgggggcaagggtcgtccccttgggcgcaatccccggcggagtggacgtccccgttcttgagaagagcgtcctcctgttgggcggttggtttctcccgtatggaccctgcggttccccgtcacccccggtgtttgcccacgaagggcaccccgccccctcttttctcccgggggtccctgtgttcacggaaagtggtctgtgggtttgttggccccacgcccttttcccccggtaccccaaatttttgcccctttccccaaaccccgggttccatttgaccttgtaaaaaaaattgggggttttttttttttttttggcttgttttttaaataaacccaagtccaaaacccaaaacca

SEQ ID NO: 648097 - DNA, 1943 bp, Homo sapiens
  misc_feature (1132)..(1132): n is a, c, g, or t
cctgctctttagtgtttcgtacggttcgtccaccacgttgtgggtcccagtaaacttcccgcgggctttgttgatactctcggtccgtcgtccttgctatttattttccccgtgtgctctatactggtttcgcgcgcgtcgtctctcggggtggggtgagttcgtttcggccgaccgaagtcggctgtataggatcctcagcccgccacatcggaccggtctgtcgactacgaagtacactctcgcccttccctttttctctaggtagtgcgcgcgccgcctccatataataggggggagcgtctctcctcatcgtaggagaaagatctggtggtgtagtaataacaaccaacggtttgttctggttagaagaagtaataggagtttgttggtggttgttaataaagtagttttggatagatagccaaccaccctcgctgtttaagatgtggttctcaccacatatgttgtatgaaggaaaatattgtgggtggtgagataaatagcacacacccgtttgtgttctctacaccatcgggggtgccgtccccactaaggggtggagcccccccgctaaagatgttggcaactatctgtcgtgataaggggtgttctcttcatcaacaaggggtgctttctgtgtgtgtttttttttggacatgatgggtagaagtttcgtcttgttctttggtatatatttttgtacgcacgataataattgtagattagtagatcatattggtgccccactacgtgtttgaggaaaaaatgtttttcgtcatagcgtgtggattttgtactctggtcgtagaagatgatatgtttctcctacgaggagatgttgtatataaaattagtcgcgccgccttcggtgatcttttattataattcttgttcctccaccgacggtggcaccaacatacgtggtgagtagttctgttgtatacccccgcggtggggagacgacgacaacatagtgttgggttggtgtctcacccactctggtgtttccctcacataagttggccgcacgacaccccgcactgagttttttgttgtgtagtagtcttctcacgccgctgtgggagtgtgtctcatcagagcagttttttctctcgcactgtggggtttnatacctcctgctgtctgtgtgctgctttgtgtgtgtggtgctgtggtgtgttgtgtgtgtgtgttttgttttcctttgtaaaatacacgcgcctccactgccactactgtgcttactagagaattattactggggagatagacgacgctctgctgttgagttatagtggtgtcctccagccacactcccacagcacaggggtcctctcctctctcactatattgctctctgcagcagagagtatagaagatagtagtgttgtgagaaatattctactatgaggaccctccagaagagagtagggcgacacacacacacacatagtgagactctgtgatgatatagagatagtgtggggtgtctcacagtgaaattagtgagagtgtctcacagcagacacgccagcctgttgtggaatatagacacacatattgagaatataggagtgctgtgttccacacagtctatgtgtgtgagtatctcgctctgctctcacactagagaggagtgtgtgtgttgtgcgttgaagaaaatagatatataaaatgttctgtatagaaaagaccctccacgagtgtgtgtgaaatgtgtggagacagacgtctcactgggagagctgttcactgggtgtatagagccacgctagagtttgtgtggataaaccccctccgggggaacgcagaacacacgcgtggctatataagtgtgtgacacgagactgaggggataatggaccccccctccccaaatttgttttaagtttcagacgttctcaattaggggcccaatttataagtgctattttggataa

SEQ ID NO: 648098 - DNA, 688 bp, Homo sapiens
ggttccagattctccttgatgcattgcacaagattaagacaaagggcaaggtaggcgcccttcaatcaaaagttggacccgacttcctgcctgttcccggcatgccgggtactcctgactctaccagggctcattcaccacgccgtccctcggagaacatgccttgtgtgcgccttgctgatgagatgagtagccccagtgtaacctgtgcagctcctgactctgcactggccaggctgcggacgctccgccttcttccagatgcgtgtatcaacttgacccacctcgagtgcctctttgtggctgcattttggggaccgtccacatggcttttcagctacagggtgatgaccagtgttccctgcaaaactgggtgtggctgggattcttggcccctctaccggacagtgctccctgaccgattgatagagctgcggtcctgtgcgctcctttgctggggctccagttcgtccacgtctattgcattcccttccgcccaggcgctcctcgagtgtcgatgagcattgtggtccccaccgatgtgggtgactttgtgggctaggagtttgccttcgacgaaagttctgcatctagactgcgtttgatttcccttccgatctctgtagtaattccctcttccctatacacgttgaccttttgggctatgtttcacaaggaccacgactcg

SEQ ID NO: 648099 - DNA, 198 bp, Homo sapiens
  misc_feature (86)..(86): n is a, c, g, or t
  misc_feature (136)..(136): n is a, c, g, or t
  misc_feature (186)..(186): n is a, c, g, or t
  misc_feature (197)..(197): n is a, c, g, or t
gactacactgtgtttgaccgtgacaacaacagggtgggcttcgcgacggctgcccgcctctagttcccaaggcgtccgcgcgccanacagaaacagaggagagtcccagagcaggaggcccctgccacgcggcccntcccacacacacccacacactcgcccgcccactgtcctgggcgcccttgnaaacccggggnc

SEQ ID NO: 648100 - DNA, 128 bp, Homo sapiens
acctgccctcatcatagtgccccagtgtgcgctcacgcggcctcatcatagtgccccactgtgccctcacccggcctcatgatagtgtcccagtgtgcactcacctggcctcatcatagtgtcccaga

SEQ ID NO: 648101 - DNA, 464 bp, Homo sapiens
ggctgcgctccgagcccccttttccctccatggtttcgtctcctgcatcccgctgaagtaacgttggcatccggggggctcctgctctgcctgccctgcatctgcctgacctgccaccccaggaccgctgcctgtccggccttcctgcacgctagggcacaaacctcttttccgaacgcgcgccctctcgaccttgcagacaaacgcccggggaccggacacttcttccacacaccagtccggcgcacccgacctgcgtgacacagcttaacgttatgaaagagtgcggcggaccgaagcgcggacaccagtcggcacactgaaagcagtgcaggaatccaaaacatgggaagcccttgagagaaaacacggtaccctccgtgcaagacctgtttccgaggcaactgtgctcatcgtggacaaaattggctaaaatctactcttgcatggggaaaaactcggac

SEQ ID NO: 648102 - DNA, 188 bp, Homo sapiens
acaaagaccaagctctcaactaacatacgctgccacattctatgagtgccataaaagcagcaacacaggaaggggagcaggactcaaggaccgcagccctgggcaaaagaagtgtcaacacccaggccaggcacaggcaacatcccagcgagcagtgtccatgtccgtggcaagcccaaaggcaggca

SEQ ID NO: 648103 - DNA, 344 bp, Homo sapiens
ggctgcaaggatattcggctacgagtcctttggccctcccaaaagtgttgggattacagttgtgatgccaccatgcccagccctatttttgaaattttagttatgttaaattaaataatagatactcattaaatagctgggttatttccaatttaaaacgtatgttttagcccaggcactgtgctcacgcctgtaattccaatactttggaaggccaaggccggtggctcacccgaggtcaggagctcaagaccagcctgatcaacatggtgaaaccccatctgtacttaaaaatacaattaaaatagccaggtgtggtggtgggttcctgtaattcccagcta

SEQ ID NO: 648104 - DNA, 443 bp, Homo sapiens
attctttttaggtttcatagaaagactaaattagccaggtgtggtagtgcatgcctgtagcgtcagctactcaagaggctgaggcaggaggatcgcttgagcccaggaggttgagactgcagtgagccatgatcatgccactacactcccacctgggccagagagcaagaccctatctcttaaaaaaataaattcaggccgggtgcagtggctcatgcctgtaatcccagcattttgggaggctgaggctggtggatcgcctgaggtcaggagtttgaaaccagcctggccaaaatggtgaaacccagtctctactaaaaatacaaaaatgagctgggtgtggtgacacatgcccgtaatcccagctatggttttttgtgtttttttttttgtatttgtatttatatttttttgagacggagtatcgctctttcacccacgcc

SEQ ID NO: 648105 - DNA, 225 bp, Homo sapiens
ctgctgctgcggtcgcctctagcaggctccccccgctcccctcggacacctcgcttcacagccgggtgctgtgtgtgctgtgcgtttgtgtgtgtgctgtgctcgtgtgtgtgctgtgttcatgcgtgtgctgtgtgttgtgtgtgtgtcgctgcggggctgcctcccgtctgcgtgctttttcggctgggaattgcgctgtccgctttgccgcaggtggcagcg

SEQ ID NO: 648106 - DNA, 777 bp, Homo sapiens
tgccccagtcagttccttgtggagccggaactgggctgctgattcgcctgaggcacctgagtgcactcagaggaggcgccatgtcagaacctggctggtggatgtcctgtcagaacccatgctggcagcaaggcctgccgctgcctcttctggcccatgtgtgacatgctgagcatgctgagccgctgactgtgatgctgcataatggctgggctgcatccaggaggccctgtgagcgatggaacttctgactttgtcacctgagacaccactggaggtgtgacttctgcctgggagcgtgtgcggggccttgtgctgcccaagctctaccttcccactgtgtgcccctggctgaggccgggatgagtttgggatggagtgcaggcggcctggcacctcacctgctctgctgcatgtgttgacagcagaggaatgaccatgtggacctgtcactgtcttgtacccttgtgcctcgactcaaggggagcaggctgaagggtccccagtgtggacctggagactctcagggtcgaaaactggcggcagacccagcatgacacgatttctaaccatccaaaacgccgggcttgatgttcttccaatgaggaaagccctaatcccgccacctaggaatgcctgcagtccatggaagccgcgatgggcctcaatggccgctcataatcttctgccttagtctcaggtagtgtgtcttaatatatttgtgtttagttaacacttctatttcatccctggcgccttgcccgcttggataaattt

SEQ ID NO: 648107 - DNA, 230 bp, Homo sapiens
ccatgcacagttggtggatacccacgtgatataaaacaaatgtctacacaaaaagcttgtgcacagatgttctttgcagcattattcataatagcccaaaattgaaacagccctaatttctatcatactaacaagtgaataaacaaaacgtggcatatccattacaaggcaatattattcagcaataaaaataacgagatgacagtacctgcatatgcaccacaacatgg

SEQ ID NO: 648108 - DNA, 313 bp, Homo sapiens
  misc_feature (24)..(25): n is a, c, g, or t
  misc_feature (72)..(72): n is a, c, g, or t
  misc_feature (215)..(215): n is a, c, g, or t
  misc_feature (279)..(279): n is a, c, g, or t
  misc_feature (287)..(287): n is a, c, g, or t
ttttgtattctctacaatataaannaaagcactcaagaaatacatagatgaaaatgagttaagagcattatntataaagtaaaatataaatgagttcaggcatggtggctcatgcctattatcatagcatcttgggaggctgatgcgggtggttcacctgaggtcaggagtttgagatcagcctggccaacatggtgaaaccctgtatctactantacattagccaggagtggtggtgcatgcctgtaatcccagccactctggaggctgaggcagganaatcgctngaatgtgggaggtgggctgcagtggc

SEQ ID NO: 648109 - DNA, 308 bp, Homo sapiens
aatacgagatatcagtgaagtcattgctcttggtgtgcccacatcctcggacttccaatgcagttcagtacgaccaaaggctcttcaaccagtccaaggtactacgcgtctaggaaaatgcatgtcttaagtgttgatgtgaataccagtcctcagggacaagaaaattaacgtatcattggcttggatcagcctaaaatatgctggcatagtgacaggaaaacaattggaagttgcatgttgtaacttgagacagtagaacatcagttctgcatttgacctcttagaattcagccaagatttgaggc

SEQ ID NO: 648110 - DNA, 174 bp, Homo sapiens
agtgttgcagggccccagaggccgcagtctctgcttcactctcagtagctgcacgtgcacaggtctcaggcgggggcaagggggcagacgggagcaggcagtgagtccggaacgcacgtgtgagagctccctggaactatcctggcacttaccctgtgagtttgcaatagtatt

SEQ ID NO: 648111 - DNA, 1665 bp, Homo sapiens
atcaaagcccaggttcaccgtcctcccccaaacacacacacacacacacacagcacacacacacaaattaaggtcggtgcaaccatgcagcgagcatgagagagaagtaagcgttcgtggaggggatgaaaactacccatcatcatacagcgatgtgacgtccagattcataacaatatcaacctcgtgatgaccgtggctctcgatgaaccgcctcttgttctgtgacgtcgtggtgacccttatcacgaccacctatccttcgtagggtgactcagacggagacccaatgacgacatcagaagcgtcatccaaagagaagacgcagtccaacatgaggagtgaatacatgaaggaacgccacccagtgagagaagcacgatacaacggactggcacaatacagtgatgcatcgagtggcggcagcacaagcaggacgtcaaccacacagcagcactcacacggaagcagcacaatcaaacaaatgggggcagatgacatcaaacggtcgataatatgcagaaccacgaacagcaggagaacacaacacaggaacataggcaacgaagagcgacaaccgcatgagaatgaaaaaagaaagacaaggagacaatccatggagattgcctacgcgccgcacccgaaggcaacacacacataacaacagccactacaaccaatcgagtggagaacaacagcgccagaggctgcgacagccctaccaaccgaacacgttccccaagaaccgcgccaaccctaccacacaaggcccagacgaggacagcagtgaccaccaaatacaaataacagaagtatggacaacccgacagtagaacaacacgccaagaggagcaccacagatggaataaaagaaagcgagtagcggtacgaaaccaggctagtaatgaagacatcacaggaacaaaccaccgcatgaagagaaagaaacaacacgaagagacgaaaaacaacaaaacagcagaagccgacatggaaaccaaaacggaagggacacaacggacaaaatacaccagaggtggccaacaaaacagtagagaccccagaaagaacacggcgacaagcaagaggaaaacagggagagcacagccacaccagcagccggacgagacgaacacgacacgaacgagaatagaaggaaccagactaaccatccaagagaatgcaaaaagaacaaacaaaccatacaaccacaggcgtcgtgtggacagtacgtcaattgacactaaacaaccagcgagcgagcacactcatgaggcgcaagacacgccagctgcgaggacggacgcgtcagcgccgacaccataaggaactggcaccatacgactacacaccaacacaacacaccaaacaaacgggacggagacaagagaaaccactacgcgcacagggagcgtcgaccacacacagcgaggagacgcacgacacgaactcaccaccacgacagcacgcagcaacacgcaaaacgcacagcactgacacaagcaagacacgacagacaacagcgatacggacacgcacagcaccaccccaccacaagcccgatccacacaacgacacacggaccgagaggaccgcacgcccacgagagagagcgaacacgtagaccaaagccgaacaacagagacgacgcgagccagcaagtac

SEQ ID NO: 648112 - DNA, 121 bp, Homo sapiens
gtcttgaggtccctggcgcacctgatggactgcatagctgcatggatctcctctgtgctgtcacctcctctgtgctgtccacctcctctgtgctgtccagctgtccacctcctctgtcctg

SEQ ID NO: 648113 - DNA, 372 bp, Homo sapiens
cccttaccctgtgtttaaaaagtttttgtcccaagccggcggcgttccgggctctcctgcccacaggatgaacattttcggcttccttaggagttttgcccgcccgtattccaaagcgtgtggtggtttctcatattgtttgtaggcccccccagcccccagtttatgtgtgggcttttttctatgaaaaatgatgggttttgccacttcccgtgccaaagttttattgtaaatgttttttgtgctttgcattcacaggggccacgttggtgcaattgtttcagtaaaactggtttgatttttaaaatgttcctgtaacatatcttttatgaacaaatttgaacaatttgtgaaataaaacattgaaaacca

SEQ ID NO: 648114 - DNA, 223 bp, Homo sapiens
gatccagaattgatccttgaacacctagaaaaggaagcagcctactcttctatcatggttcgctcaactagaaaaaacgttgctcaaagggcgatatcaccgtatgaacagatgacggctatcaccagccattaggaaaatacaaaacaaaaccacaacgcaatgccacttgccactcattaggatgcctcttgctttcattgaaccacctgaaagctaagaa

SEQ ID NO: 648115 - DNA, 961 bp, Homo sapiens
  misc_feature (875)..(875): n is a, c, g, or t
  misc_feature (919)..(919): n is a, c, g, or t
  misc_feature (947)..(947): n is a, c, g, or t
  misc_feature (957)..(957): n is a, c, g, or t
tgaattataaaaagtttgtaaaaaaagaggatggtaaggtaggaattaagggatagagagtgaaagagtgataagagagattatggataataggataatataaaaagaggagaagaagaaggaagaagagaaaatggggaaaataaaagaaacttaatgaaaaaagagaataaaatggaaggggatcatgataaaagaataaattttaaaattttggaatatgcacaaaaatgctgaagttacgattgaagcaagaataaaagtttttgaggggaaggatgttattataattgttaaaaatttgaaaaagaatattaatggataattatggtaaaaaggggaaatgaaggaaatataaaattaaattatatagtatatagttgatggtaaaataattatatatgggaatgaataaagtggaagagaaaaagtatattaaaaagaataaatgatgatatagaatgtaaaaaggaaggatgaaggaaaatacaaattaaagataataaagagaggtgatgagactagagaagaaattcgacatttcaccttcaccttatacttggagactcccaagccctacatctccagcagcaacttaaaccccagggaggccatggaggctgtgagcttaacctgtgatcctgagactccggacgcaagctacctgtggtggatgaatggtcagagcctccctatgactcacaggttgcagctgtccaaaaccaacaggaccctctttctatttggtgtcacaaagtatattgcaggaccctatgaatgtgaaatacggaacccagtgagtgccagccgcagtgacccagtcaccctgaatctcctccgctcttatttaatggacttgccacaacaggaaacantgagggaaaaaggggggcaaccatggaaaacgtggggaagtttnttgacggacaggaaattgggcattcagncttttctttnacat

SEQ ID NO: 648116 - DNA, 311 bp, Homo sapiens
ggattcatacatcatattctggactggctgtgagtgccttccaggcagggaatgccatagcaatcatggatccttggtcacctgcacacagtagggcgctgtcaactgtttgcgaaaacaatatgatgtgtgctgagcatgggtcccttttgcaatgcgatgtgcttatagctattttggggtgactagtttttcttttattattcttcgtgaagtgtattccaaattccttcacagctgctcaatggaggctcaccagtgctcaaaggagggctccacagtgctggtgtaccgtgagctcgaaattcgta

SEQ ID NO: 648117 - DNA, 764 bp, Homo sapiens
  misc_feature (764)..(764): n is a, c, g, or t
taaggctcgccgagcggcgaggcgccgcggacggctctgggactcgtctggcgtcctcagatgcggggagaggcctggaccttggcgcacacagacccaggagcagatgagcacggatgtctgcatccacacctggcgtgcacctactacctggagcccaagaggcgatgggttactggcacacgctgtcgcttaacatcgctgtcgcgtcaggtgcatgactgacagttactggtagtagattctgtgtccagtgttcccccatctccatgcatagttgagtatcaagcatagggatgcttcacattttatcttcagctccatcaccatcctgggagaatggtgccatgccaagcattggttcagctccctgtggccaagtcgaaatgtggtcttcagtatcatcgacgcagtttctggagtgcgagctgctgctgtctcagcctgagagccgttggacctagacgcatactgtcctcaaaggacccctggtgctgagagagctgaccgggatctctagtggtgtggatcccacgaaacgcctggagtgacacgagcgaggggatcctgcacccaccagggtcctaggctaagcatttgaacatgcgtccatgaagagtgccttggacaacgattggagtcagaccattggaggtggcgtgacagattgcttgacatgaatcttggaagtctcctgactatggttggcccgtttagctccaaaggctttggcatggatgaccaccgtaaaacaatagccccan

SEQ ID NO: 648118 - DNA, 196 bp, Homo sapiens
actatccagtgccgtgctagcctagcccaagcaagacggcagagtcagaagacgaagagcaaatgaccctgacgccgccctcagtgagctggctccgaccagcaaagagcccttttcatggtcatcccgcaatgcttttgaattgtagctaggatgtcatggagggccggtaaattctatgcggggagctagacga

SEQ ID NO: 648119 - DNA, 1203 bp, Homo sapiens
  misc_feature (4)..(4): n is a, c, g, or t
  misc_feature (16)..(16): n is a, c, g, or t
  misc_feature (31)..(31): n is a, c, g, or t
  misc_feature (33)..(33): n is a, c, g, or t
  misc_feature (43)..(43): n is a, c, g, or t
  misc_feature (55)..(55): n is a, c, g, or t
  misc_feature (141)..(141): n is a, c, g, or t
  misc_feature (156)..(156): n is a, c, g, or t
  misc_feature (166)..(166): n is a, c, g, or t
  misc_feature (171)..(171): n is a, c, g, or t
  misc_feature (179)..(179): n is a, c, g, or t
  misc_feature (482)..(482): n is a, c, g, or t
  misc_feature (840)..(840): n is a, c, g, or t
cgancgtcgcgcgcantccacccgacacacngngcaacgatcngacgaggaccancgacgcggtgagaagacgctgggaccagtcagcgacgcgccacatacatacgtagacacaataccacaagagagcacacgattcgnaattggaaaatccgnatgcggaacnccccngcacgtgnggttataggagaatacaccacacccgggacgggtgacatatcgaaagacgaaacgatagcgtgccactttatcggagaccagcggtagtgtatatgtaacaggggcgcgcacaataatacgggcacaacaacgacggaggtcgcaggcgatcttcaaggaaaagaaaaacgagcgacaacataacgcgagcgtacgagcgcctcacaaggagaaaagcacagatggacataccacgcgagggcggcggataacacaatgtgacgcgaggatgaaaaaagaaggccacaattaggagatattanacacgagaaggacgacacgcggagtgctcacaaccctggtgagtgaagtccagaggagagtggggagcatgcggagcacatctgtgcggcagcactatatgagaagaacgcagcccgctcgacctagggcgggcagcagaacaaaagagagcgttggggaaggtaaacatgagatgggggaaggcacaaatacgagaactcagaagacgcataatttgaatttatagagggagaaggagagagggcgtgaaacataacacaacgcgacaaggaagacatatggtgtaacaaataaacgggaggggcaggagcgcgaaatgggcgaagcaaaaccggtcaaccaagtggacaaatatcnccaccgggaaaaatgagggggtgagggagagtctccaagaaagggagagaaacaaattggtggaaaacaaaagggagaggggagagaaagcgggggggagacaacaatggcgaaaacacagggagagaagtagatgggccctccgcggagggaacacaaaggggaaaagacctatgcggcgaccatcacagacatatactggaagagaggaggtggaggcataacacacgacggatggcgagaacacacaagaaaggccggggaggctgaaagaggtatgagagaaattacatgtgagtagaaagaaccgacaggatatccacaccataaatgtgtgcgaagagggaccgggtgtccgagacg

SEQ ID NO: 648120 - DNA, 245 bp, Homo sapiens
agactctgtcggatattcgaaaggtcatcgcccttccgcctggcctccgttttcagtgaaggtcaggttggccgcgtcggcccaggattggagggagcgccgggcatcttgtttctggtggtaattgaattccttaccttgctcgctagtgaagtaataggaaacctcggtcttattgttttggttcccgtcctcccatttttttacaaaatgtcaaaaacatgtagttttaattttaccatgat

SEQ ID NO: 648121 - DNA, 136 bp, Homo sapiens
agaaaaatcacggtcttcacccaaatagaagcagtcttttttatttttttaaggggctatggaaacttctaaaccctaggcatgcggggccagatcctcctttcccgggctatggaaactagttttagaagtttca

SEQ ID NO: 648122 - DNA, 118 bp, Homo sapiens
acgtaatatgtacttcaataaatcataatataaaaagatactgcaccatatgttattgcagcactattcacagtagcaaaaatattatgggctgagtatagtggctcacacctgtact

SEQ ID NO: 648123 - DNA, 234 bp, Homo sapiens
  misc_feature (136)..(136): n is a, c, g, or t
  misc_feature (156)..(156): n is a, c, g, or t
cttgggtcagtgatcctccaaactatccagatgtatctttaaggcacaccaattcctctgctaaggacttctgttcacaactgaactgtattagttattcttaacattcaaaagagaaagttctgatcagagcccnaccatgtccagccattgtgncctgagatcccaagactgtggggatgagggcagagcccattaacatcagggattctggtcactggggtcacacttgag

SEQ ID NO: 648124 - DNA, 393 bp, Homo sapiens
tccagaatgctccacaggttctgtgattcccgttctcacgtccaaccattccttgcaatgcgtaaacccgttacggtcgttgtaatcctcccaagtgtctttcagggtctccataaagatgtcctccgtggctttgggaagttgactgtcgtgcttccaatcctccattcctccaccgtgtctccagagtcccatggcttgagccttcctgtcttacgggggtatctaaagctctggaggccattgagtgacccaagggcttgaagccgggaacgtctcaacatgttgcacagccagttaatataggtcagagagtaacgcccatcgtggttctcctgggggacaacaggacacagacacagcagcagagacatcagcacaggcacctttcct

SEQ ID NO: 648125 - DNA, 662 bp, Homo sapiens
  misc_feature (460)..(460): n is a, c, g, or t
  misc_feature (487)..(487): n is a, c, g, or t
  misc_feature (536)..(536): n is a, c, g, or t
  misc_feature (539)..(539): n is a, c, g, or t
  misc_feature (558)..(558): n is a, c, g, or t
  misc_feature (571)..(571): n is a, c, g, or t
  misc_feature (605)..(605): n is a, c, g, or t
  misc_feature (622)..(622): n is a, c, g, or t
cccggtctccaagtgtttatttgggagggtcctccctggtaaccccccaagggtcctttgaaaatggacataaaataagttggctcccttccccattgggacccggattctgggatggtttccccattgtacttcgggtccactcgtgccaatttgggccgaccaaaggtaaaacaggacatgcctcccccggggggtattggcccatgactacaaaacgaaactttccgcgtcaagacttgtcgggttacagcatgctggccatagggattggaaccctgatttacgggccctggagcataataaagtggaaccgtgagcgcaggcgcctacaaatcgaggacttcaaggctcgcatcgcgctgttgcccctgttacaggcaaaaaccgaccggaggaccttgcaaatgcttcgggaaaacctggaggaggaggccatcatcatgaaggacgtgccccnctggaaggtgggggagtttgtgttccncacaacccgctggtgccccccttgatcggggaactgtacgggctgcgcnccncaaaggaggctttccatgncaaccccggcttnatgtggtacacgtaggccctgtgccctccggccncctggatccctgccccncccccctgggacggaataaatgctttgcaggcctggaaaa

SEQ ID NO: 648126 - DNA, 469 bp, Homo sapiens
agacatatagaaaacaaaatataaaaagataaaaaaagctagagatcctatcatatccactacatgatagtaagctcaagctagcagcctctaaacctgcataacacatcaggcaagacacccctcctctaggcgggcagatggactagaagtggctacagacagtgtgggtacggcaagcctcccgctgaactgtgatcatgtgacacctgcagaccctggaaaaggactgatctgaatcctggcagcaaactcaacctctacttaagcttggggggcttgtgtataatacaggtcattagcgatggaagaagtctcagagtctctctcacatcaagaggacagatggggacagggatcctgagagcttaacttctcctgtgttctggttgcatacttgaatcccaggaaacagtgtgacacggtgccaatttactgccaaacatgcccggtttgtcaccagagccag

SEQ ID NO: 648127 - DNA, 138 bp, Homo sapiens
atttacatatctttcggttgagcccagcttacatcagttagcttatttatgcttggataggacaatcttaatgttgacgtgtggtcttatagaaatgagatcttatatgcaaatcattagccgtggcatcgataagca

SEQ ID NO: 648128 - DNA, 480 bp, Homo sapiens
  misc_feature (327)..(327): n is a, c, g, or t
atcccagcactttgagaggctaagaagggtggattgcttgagtccagaagcttgagaccagcctgggtgatgtggtgaaaccccgtctctacaaaaaaataaaaaaattagccgggagcggtggtgcatgcctgtagttccagctacttgggaggctgaggtgggagtatcacttgagcctggaggtggaggctgtagtaagttaagatcacaccactgcactctagcctgggtgacagagtgagaccccgtatcaaagtaaaataaaagatagaatggactttaggcagaaaacagtgatcctaaatggaagaactgagattcaanaaagaatgcaaagcaaatatgtgagcaaattcaaattagcattggaggggtgcagtggctcctgcctgtaattccagcactttgggagggtcacttgagcccaggagtttgagaccagcctgggccacatagggagaccttgtctctacaaat

SEQ ID NO: 648129 - DNA, 604 bp, Homo sapiens
  misc_feature (339)..(339): n is a, c, g, or t
gcagagaggctgcagtctagagattgaccagaaaataggatgcatgagaatcagtgaggcccagactcaagaacggcagactcgttgtactccccatgggtaagacagctaggatactgaggacacgatgaggaggaagatgacgaatggacaagggaaaactgaagcccaattctagtgcaacaggggcagacctgtgccaacttaccgctggatcccagaccctgtcggatgctgtgatcctggacgcgtcctctttctgcttgtgaacgttcgcggcatagagaagggggggaaccgtgaacactcgggtttgggcttggggaccagtttcgccangactgggttgcgtagcgctcacggagtgcggagctcacatggtggcactgcgcacccgatcattttgactagagtggaagctctatcaatcgagagtgagaggtgggaggagagctcagttggcgtctatgtcgatggacgtgcaaaggtaggctgactgtagcaatctcgagacgaaagatcaataagtatgcgaagtggaggaagccagctggtggtgtccagatgaaccctgaagatcaatcaccaggaagattaaccctga

SEQ ID NO: 648130 - DNA, 150 bp, Homo sapiens
aatctcctcactgtggttcaagccacccaaggaggattaatgctgattggttgtcgtcaggtaaggaagctgcagataccgtttcattgagaggggggattgtagaagtggaaggtgaatcagatttcactgcagagcttgttgcacctt

SEQ ID NO: 648131 - DNA, 236 bp, Homo sapiens
gggctacaatacgactagagtttacgatagtaaggatagaaagcttgttaatctaggccgtcgtataactaaatatacgagagtgacgaaaaatccagtgcgtgagtacaaaatattgaagaaaaggcacagattagcaagtaggaagcgcagacttgagaaagataggcgtaaaaaaaacctgagtgaccgggtaggttagctgaggtaaagttggatgggtaaagcaaattcta

SEQ ID NO: 648132 - DNA, 101 bp, Homo sapiens
ttttgtatttttagtagggatggggttttaccatgttggccaggcgtcttttatataaaatggtatagtatttggccagttgcggtactcccacctgtaat

SEQ ID NO: 648133 - DNA, 276 bp, Homo sapiens
tcagtttctgatatatgagagagattttaagaaactgactcatgtaatcgtgaaggagcatgtccgatctgcagtgtaagccatcaggctggaaactcagagagagttccaaaccccaaaggcagtacgctggcagaataccttcttgcttggaagaagtatgtctgttttattagggtttccaactaattgaatgaagcccatctaatctgttttactcaaagtccgccaatttaaatgttaatctcattaaaaaaaaaacaccttcacagaatc

SEQ ID NO: 648134 - DNA, 262 bp, Homo sapiens
  misc_feature (72)..(72): n is a, c, g, or t
tagacatgatacgattcgagccggtaccggcatgtgctgtaggccagcgaatgatacacggatgtcctcctncctatcagacatttgaagaaccgacatatatcaacctaaattaagcataatgaaaggaaggaatcgaaccctctcccactggtttcaagccaacgtcataaccactatgtctttctcgataatcgaggtattagtaaaatattacataactttgtcgaagttatattatagcgctggcctacagcacatg

SEQ ID NO: 648135 - DNA, 179 bp, Homo sapiens
ttttttggcaattgggcctttttcagggggtttcccatttaaaaaacagaaattttttttttttagaagaacccaccaagacatgggagggcgggaaccctaggggtccccccccccccctccagcctaatttgggaaacagggacagcagcaggggatttaatttttcccccctgcca

SEQ ID NO: 648136 - DNA, 393 bp, Homo sapiens
cctttaagggtcttcctctgaaagactttttccttctgtttcctttttttttcctctttcacattttctgtattgagccaatatgactactgtaatggaggggaaccctttatttgtagttagctggtgataggctttattttacaagttggccccattaccagatggcacatctgactatcatctcatagaggcctcagctgaagggcacataaaaggtagggtgggggtccccagtggagcaggtccctggggtgggctgctccctctttcattccttctcttgcctcttggaacctggaggatccttgtgggaagggaaaccattggcaacccccgcaagtcccacccgggaatccagaacctttcactttacccattttttaggaatcc

SEQ ID NO: 648137 - DNA, 194 bp, Homo sapiens
tatgttccattccatatcttgaaatttttgaagtggttatatttggcctcccaccttgtgacatatattgaggtttgtcgtagcatcactcgtaaatccatttccatcatcttggtcatagtgatcaatttgaatggaaaaggggctaccatgtgcaggagaatgtgtccgaggccaatgtaggggggtaccga

SEQ ID NO: 648138 - DNA, 398 bp, Homo sapiens
cgagccaagattgcagcactgactccagcctgggcgacagagccagactccatctcaaaaaccaaataaataaataaataattagctgggcggagtggcatgtgcctgtagtcccagctaattggaggactgaggtgggaggattgtgtgagcccaggagtttgacgctgcagtgagtcgtgtttgtgccactgcactccagcctgggcgaccgagtgagaccctgtctcaaaaaagaaaaaagaaagaaatgaaagaaaagggaggcatcctgtatgacacacacgacgagacgtgaaagagtaggcatgatttcggttctttttttgtttgttttttgagacagtttccctctgttacccaggctggaatgcagtggcgctatctcggctcactgc

SEQ ID NO: 648139 - DNA, 406 bp, Homo sapiens
aatattggtgtagtgagagatctgggcatcatcagatgtgagtactgagtgtcaagagagactagttgtgtcaggccattgatagaaagacagacatttatttgttgggagaataggacaattgcttactaccgtgacacctaatttactgatgcgtgatgacaagattcgtttgtatacctcaccgtatgtcatgctagattgattatgcgtggatctgtctgacatgaagggcataaccatatctgaaacctatgatcacgtataatgagtaacctgtagactgcaagttccgtctagcatacgtcctctctgctgactgtgaatcgtcagatgacaatatgctctgtgttagcgatgcaacgaatgacatggcagttacatgcgatactgtcatgcgggtttc

SEQ ID NO: 648140 - DNA, 164 bp, Homo sapiens
gttaattttggaaaggcccctgtaagctcccctagtggctgaccttttacagatggcagattgaagcaagcagcaaccctgaatgctttatcagggcaattgctgaaggtttctttttggatttggatgaatcataaatttgggccactctgtaaatttttgga

SEQ ID NO: 648141 - DNA, 219 bp, Homo sapiens
ctcgaagacaagatccgcgacaagttcgaagcccagaaccccaacgtcaagatccacatcgtcgggtttgccaagaaggtcggcgacctgatcgacggtctggtgatggtggtgatgttcttcggtatcgccttcgtcatcacccggtgctgctgctgtggtttaccaactgcctcgcagtaccgtcgcggtgttgagcaccacgctggtggtcgacgc

SEQ ID NO: 648142 - DNA, 177 bp, Homo sapiens
tatatggtctacacagtataatatccaatacagtagcagtgctgcagtaaaagagactttgtggcactccaaacaaaatcctcaatagagccatgccagtgttcctcctacagctccttcataagatcagagagcacagaaaatctaaagttatgctcaaacattctagcacaatat

SEQ ID NO: 648143 - DNA, 527 bp, Homo sapiens
aggttgaaattaaccccccctaaaggggacaaaaagtgggggtcccccccggggggggccggtttaaaaatagtgggtcccccggggtgcaggaatttggcccgaacagggttgggcccaatttaaaagtgggtttctgcaaacccccccaaagtttggtatttagcccatcccctaaaaggccctttttattcaagaaatcccatttttttcccctgggggcggggaaattttttttagggatgagttttttcaacgaaggggggcccttttcctgggaagaggaaaaatttggggcccctttttcagggtttggaaaaaaatgggttttgtcaagggggaaaggggaaaagggttttatttttggtttaaaatattataaagggttccaaaaaaaaaaggaaaatttttttggtttaaaaaaaaaaaagggaaacccaatggaaaattttttttttttatttatttttgggaaggttggcagaagataaattgtaaaaaacaaagattaaaaagtcctggtttta

SEQ ID NO: 648144 - DNA, 127 bp, Homo sapiens
tctgtgcctgcattaggtctcctcagcgaccaggctggtctagtgagcagaaatacccagagaagagtgcaggtctagtgtcagcaaggctgagggagtggtacctgagctctgaattctgtacatc

SEQ ID NO: 648145 - DNA, 475 bp, Homo sapiens
aggcatccatccttccatgcatgcatccatctgtgcatccatccatgcatccagctgtctatctatctatctatctatctatctatctatctatctatctatctatcctacttaaatagacattactgatggctactgctttccaggtattatgctaggtagtaaagatacaacaatgaaagagctctccactctagagagaggaaacataggttagaacaaatgcagcatatgagaagtgcccccataaaagatgtgggaccctgtaattgaggaaagatgtgtagaaggcaataattattaactcaaaaccaaatagacacatattatttccatgatttccacaaatggactctctagccttcagaaatcttggaaggataagaatggaacctcacctctgacttctatcactgaccctaagcaaggctcccacctgccttgagtgtagacgcgcccgcgaatttagtagtag

SEQ ID NO: 648146 - DNA, 260 bp, Homo sapiens
atgatacaatcgagctggtaccgtgagagtgaaagggaatccctcacctggtgagtcatgatgctcgaagcatccgctaccagatcctgtcatcaagggtgaacagatactgtgcagattgatttagggactggcaagataatcaactttatcaaattggatacaggcaattagggtatggtgatgggtgagagccaacctcggtctgtgttggtgtgatcaccagcaggtaaagacatccgtggttctgttagatgtgg

SEQ ID NO: 648147 - DNA, 140 bp, Homo sapiens
  misc_feature (74)..(74): n is a, c, g, or t
agaaagtcggtacattcattgcggtgagcatcactcctggtctccatgcttctctaagtaggtcttgctatgtnggcccaggctggagtgcagtggtacaaccatgctcactataacctcaaactccttgtctcaagcaa

SEQ ID NO: 648148 - DNA, 187 bp, Homo sapiens
gaggccaaaattcctcaggaccagtttgttttccaagtgtcattacaatgcatcactattaagtaccaagtgagcgggaatacatatcccagttaaagcatttgcgtctagctacacaccgctaacaaagtcatttagttatcaactgtaggctttttagggcgctttacgctaaggaaacatttcg

SEQ ID NO: 648149 - DNA, 102 bp, Homo sapiens
gaaaatcaaggggtatttggtaatggccaaacaaataaaatggtttgtgtagtgtataggggaggcaaaggggtgcacagctgtggggagctggtgcaaggg

SEQ ID NO: 648150 - DNA, 150 bp, Homo sapiens
gcaccattggcgggttagcaagaacaagcgtcttacggaaggcggcaaaaagggcgccaaggggaaaggtgtgatacccatttatctcaagaaagtttgtgtatatatgtagaaagcatctctctatgtctcatatataagagtactatt

SEQ ID NO: 648151 - DNA, 348 bp, Homo sapiens
tcaaagtaaaaactgccctaaaataaattatctgacctaccttgtttgactgtagttcataagactccccattcttgagaaggcctgccccacacccagaaggaaggaaagctgcacaaagaagccaagaaggacctagacagaccagcctcactggtaaccccacttagtccactagcattaggtcatatcctttttgtctaatcatatttctacacagctgttcatactttgttaacctaagcataaaaatggacacttttctcctgtatctgtcggtcttcattctgaatgctcctgtgtatgcacatttaataaatgtttatgtattttctccaattaaaaaaa

SEQ ID NO: 648152 - DNA, 287 bp, Homo sapiens
ccctggacagtgattcgcattgattctttactttatttacttctttgaggacggagtctcgctctgtcaccggctgagtgcgcgtgtgcatctctgctctactggaacctccatgtgctgggttcaacgtgattctcctgcctcagcctccctagttgcttggactactggtgcacaccaccaagttcaggctaatcttttgtttctttagttacagacggggtttctgcactgttggcccggatgttcttgatctcttgacctcttgatctgcccgcctcggtctc

SEQ ID NO: 648153 - DNA, 129 bp, Homo sapiens
ataagatatgcagacgtactcacctacgaagaacatgccccatttcatgccggcgtataaactgtggtctccgtcggccagttcctgttccgcttccggctggtcgaacgggtgacggtgagtcacggc

SEQ ID NO: 648154 - DNA, 891 bp, Homo sapiens
  misc_feature (18)..(18): n is a, c, g, or t
  misc_feature (22)..(23): n is a, c, g, or t
  misc_feature (25)..(25): n is a, c, g, or t
  misc_feature (35)..(35): n is a, c, g, or t
  misc_feature (86)..(86): n is a, c, g, or t
  misc_feature (98)..(98): n is a, c, g, or t
  misc_feature (116)..(116): n is a, c, g, or t
  misc_feature (123)..(123): n is a, c, g, or t
  misc_feature (270)..(270): n is a, c, g, or t
  misc_feature (272)..(272): n is a, c, g, or t
  misc_feature (294)..(294): n is a, c, g, or t
  misc_feature (319)..(319): n is a, c, g, or t
  misc_feature (371)..(371): n is a, c, g, or t
  misc_feature (385)..(385): n is a, c, g, or t
  misc_feature (387)..(387): n is a, c, g, or t
  misc_feature (398)..(398): n is a, c, g, or t
  misc_feature (414)..(414): n is a, c, g, or t
  misc_feature (421)..(421): n is a, c, g, or t
  misc_feature (423)..(424): n is a, c, g, or t
  misc_feature (431)..(431): n is a, c, g, or t
  misc_feature (433)..(433): n is a, c, g, or t
  misc_feature (435)..(435): n is a, c, g, or t
  misc_feature (437)..(438): n is a, c, g, or t
  misc_feature (442)..(442): n is a, c, g, or t
  misc_feature (444)..(444): n is a, c, g, or t
  misc_feature (453)..(453): n is a, c, g, or t
  misc_feature (455)..(455): n is a, c, g, or t
  misc_feature (462)..(462): n is a, c, g, or t
  misc_feature (470)..(470): n is a, c, g, or t
  misc_feature (476)..(476): n is a, c, g, or t
  misc_feature (478)..(478): n is a, c, g, or t
  misc_feature (482)..(483): n is a, c, g, or t
  misc_feature (485)..(485): n is a, c, g, or t
  misc_feature (493)..(493): n is a, c, g, or t
  misc_feature (517)..(518): n is a, c, g, or t
  misc_feature (523)..(523): n is a, c, g, or t
  misc_feature (534)..(536): n is a, c, g, or t
  misc_feature (553)..(553): n is a, c, g, or t
  misc_feature (560)..(560): n is a, c, g, or t
  misc_feature (576)..(576): n is a, c, g, or t
  misc_feature (583)..(583): n is a, c, g, or t
  misc_feature (585)..(585): n is a, c, g, or t
  misc_feature (591)..(592): n is a, c, g, or t
  misc_feature (717)..(717): n is a, c, g, or t
  misc_feature (883)..(883): n is a, c, g, or t
gctcacccccagcagtgnaggnngntaactcaggncagtgggcaggggacagactccacctatgggtgacttcagtagcagtgcantgatgtctaganggtctcacttctgcctgngttttgncaaacccagtggtctatagggatgtggcaaaagaatgacctaccgcagtgtgattatcagtgttttctaaaataaagagcacggttttgcctttaaaataattcacatcaacggtatttgggagaacatggagctggcataacattngngcgtagaaaggcagggcgccanggcccacccacggtgccctcgtgtnggggacgggctgcctgcagccccctgcagcccctcgagccctctgggccacngctggctgcctgtntnctgttgtctcntctgtcccaccccganaagggantnnaacaatntnantnntctntngcattgganantgcagtngttacatnggtgtntnccanntngttagctntgccttcaggcggtgcgtctagcnnggctnatgggggccannnctgctcctggctttctntgggcanggcttgcctccagggnccccgantncttgtnnccgctcggtgacagtggctggcaggtctaagtgctgctgctggatgcaattcctttggtagacttttttttttttaagaaaaaaataaaaccaatttttggggttggcacctgaggtaataagtnaagaataagcaccaaaatggcccttcctggcacgcgcgggctcacaggttcttcatgcacacctggcagcggctgatgtgtgtgcggatgaggccggccttgagcgtgtcggcggagggcgagccctggaagctctgctcgggaatggtggtcagcagaagctgtnattgttgg

SEQ ID NO: 648155 - DNA, 336 bp, Homo sapiens
tcagccaagcagacacagaagggagttatgtataggctgggcactctccagccccactgcaatctaatgtgtggagtatagtggagtgtggcattaacaaacttccaagtgggatcacagaaaaatcaaggcaatcagaggcactggtaccagttggtgtgatttaaaaccttttaagaaactgaggccaggcatagtggctcacacctgtaatcccagcactttgagagtccggggtgggcggatcacaaggtcaagagttcaagaccagccttgccaacatagtgaaaacccatctctactaaagaatacaaacattagtttggcgttggctgg

SEQ ID NO: 648156 - DNA, 318 bp, Homo sapiens
ggcgactctagaggacctcaccgcaatctcagaacacagtggaataaaaatagaaatcaataccaagaaggtctctcaaaaccacacaattagatggaaattaaatgaaagaatgatacctgctacaacaaaaatacacttaacttgctcctgaatgacttttgggcaaacaagaaaattaattctttgaaataaatgaaaacagagacacaacataccaaaatctctggaatgcagtaaaaacagggttaagaggaaagtttattccactaaatgcctatgtctaaacattagatctcggccagattgcggtgtttg

SEQ ID NO: 648157 - DNA, 600 bp, Homo sapiens
  misc_feature (312)..(312): n is a, c, g, or t
aacccttgttttttgtttcgttctccctgcgccttttctcccccatttaacggccccccttagtttttttaaaaagatattcgcccccttaacccggggcccctttttcccccgctgaggggttttgtttttttgcagccccctttcttcaaagcgcgcaaaaatttttttttcttttggtcccaaaattccccagcgcccctttctttcaaaagggggaggttttttttttccccagaacccccccccccccatctttccccgagggggattttttcccccaattttttttttttcccccgggtttttaancccccctttccccttttttttttggaaagccccaattttttttccccccaaaaaagcccccttttttttcccccccccccccaaccccgggggtttttcccttttgggggttttttttttcccccaaagtttttggccccccccccccccccccccccaaagggggggttgggggttccccccatttttttttaacccccttcccttttttttttcccccggggtttccccccttttttttttttttttttcccctttttttttttaaacccttttttttttttttta

SEQ ID NO: 648158 - DNA, 584 bp, Homo sapiens
  misc_feature (10)..(10): n is a, c, g, or t
  misc_feature (78)..(78): n is a, c, g, or t
  misc_feature (101)..(101): n is a, c, g, or t
  misc_feature (147)..(147): n is a, c, g, or t
  misc_feature (162)..(162): n is a, c, g, or t
  misc_feature (167)..(168): n is a, c, g, or t
  misc_feature (209)..(209): n is a, c, g, or t
  misc_feature (212)..(212): n is a, c, g, or t
  misc_feature (234)..(234): n is a, c, g, or t
  misc_feature (242)..(244): n is a, c, g, or t
  misc_feature (250)..(250): n is a, c, g, or t
  misc_feature (260)..(260): n is a, c, g, or t
  misc_feature (299)..(299): n is a, c, g, or t
  misc_feature (305)..(305): n is a, c, g, or t
  misc_feature (341)..(341): n is a, c, g, or t
  misc_feature (466)..(466): n is a, c, g, or t
  misc_feature (497)..(497): n is a, c, g, or t
  misc_feature (528)..(528): n is a, c, g, or t
  misc_feature (571)..(571): n is a, c, g, or t
tgtgcatgangactcagcctgagtgaagaggcacatagttgcaccagggggaagactggtttttgcatatgctgcagnaactcaaccaggttttggagtgntctccagaggcagtgttcctcttcaatgttcgcatcccagattatngtctccttctctggnctcanncacatttctactttctttgatctcttcctgatcctcacagntgnctacccagacgagctgaagtgnctggatgnnncggtgntgagccaggntgggtgtaaagcctcctacccatagcgggagcccgattncgactngggaatgaagcccagcggctgcacgctggagttttnatcttctttgcgctttgtggtaggacgctggagtgaatgcgcgacagctaagagcgcagcgccccactgctgacctcagttactggttgctttgcgagaatgcccttgtgtcctccaccatgccnaccaagtttgccaaccttttttttctacagngtagaagtatccacaaagggtggaacgagtnatgtagggagattgatagcttcctactttcagagacaaaattnaaacctgctcaag

SEQ ID NO: 648159 - DNA, 510 bp, Homo sapiens
  misc_feature (30)..(30): n is a, c, g, or t
  misc_feature (75)..(75): n is a, c, g, or t
ggggggggggtgccttgtggggggccaagnaaaaggcctcccccctcttatggggggtcatggaaaaaaatcttnttttttttgggggcccgggggcggccctccccgggaaattttttttccaaggccccttgggggaggggggccccccccctgggtctctttctcgggggggtttgaaaaaaggggggggggggccccccccccaaattggggggggttttcaccggggcccccttttttgggggggggattttttttctgggggggggttgggcccccccgggttttttttttttcgggccccccccccttcttctgggttattttggaccccccccccccggggggtttgggggtttttttgggccttttttcccatttttttggggggggggggggggggttttttttttaaaaggggggggccccttttgttttttttttgtttttttcatcgggtgttggggtcccgaaatttttttttaacccgggtgggggcccccccca

SEQ ID NO: 648160 - DNA, 156 bp, Homo sapiens
gacctaccattcagtccatattcaaactattgatattctctcctccctaatcaagtttcatttgtaagcctatccaaaatatatatatctcatttctccaaaaaaagtttatattacctaagaactaattgtatttttaaaaaaaagtcaactcac

SEQ ID NO: 648161 - DNA, 485 bp, Homo sapiens
cagaatgagcacgagaaatggtccattatcatttttaccaacaacggcaagacctccaagattctgtgcatgactgcgcaaattcagcttccccaccgtggtctgcactccatgatgaagcagaaagaacgtttgccgccctagccaagttcaagtccagcatctaccggatcctgatcgcaacagacgtggcctcccggggcctggacactcctacggtacaggtggtcatcaaccacaacacccccgggctccccaagatctacatccaccgagtgcgcggacggcccgtgcagcaaaggtgaatcccagctactcgggaggctgaggcaagaagatcacttgaacccgggaggttgcggcaagaagatcacttgaacccgggaggttgcggcaagctgagaatgcaccattgcaccccagcctgggcaaaaagagcaaaactctgtctcaaaaaaaataaaataaaataggccagaaaaaaa

SEQ ID NO: 648162 - DNA, 715 bp, Homo sapiens
  misc_feature (339)..(339): n is a, c, g, or t
  misc_feature (365)..(365): n is a, c, g, or t
  misc_feature (432)..(432): n is a, c, g, or t
  misc_feature (444)..(444): n is a, c, g, or t
  misc_feature (508)..(508): n is a, c, g, or t
  misc_feature (586)..(586): n is a, c, g, or t
aacatacagacacatgtacactacaggccagcgatagaggatattgggtctcatccctaggagaatgggaagcagctcatgggaccctgtgtgggagcatatgaggagtctggacatgtggttactactacaggttttgccctgattaataaatctcccacagccccagattcctgttagccacgtggaggctgctgatacgtgtatgagactatgcagaagtacacgggctgagattcttcgtgtatagctgtgtgaacgtgtatgtacctaggatatgtgaaatgtatagctggcaccttagttgcatgaccacatagaacatgtgtctatctgctnttgcctacgtgacaacacacatttgngagggtgagacactgcacagaagacagcagcaagtgtgctggcctctctgacatatgctaacacccnatactctgaatntggagtctgactgtgcccacgtgggtgcaagtggctgtgacatctacgtatggctgcacacctncaatgctgcctgtgagccagagtgagagtctgggtccaggcctggccatgtgggcctccactgtatgagagggcctgnctgcttgatcttttctgtggcccatccaccgcagcttccctaactacctatacatattcctctaaggaagggggatagacctaagcctaaaataaattattccaataccaaacctgagctgcgggcttt

SEQ ID NO: 648163 - DNA, 713 bp, Homo sapiens
ctttttttttattttttgggggtttaaccagttgttatttctagactttcatgttggtctttgggtcttctgctggaaacatgccggttacatgtgggtgctggaaagcgccgcggtgcaaccagaaatgcacagacccagccgcccgccgcccagaccctcagactgtgcgcgtcacaggacagactccgcgtggtgccccggtgcactggccaccagccttgggcctctcgacacacacaacatccaggactgtgtgcccgttgtgccccatcacgacagacaaagcgtccctcaaggcccccgcgtggttcagacagacgccgcagccaggatggttgaggtaagcgtgagccgagtactggagcgggtggggcggcggtgtggcctgtgcccgaaattggcctccgagcacagggatgaccctgccaggcagggcccccaaccagcgtgggcccgacagcggggtgcaaatacctgtgggtacggcaagctgtgctaggtgaccggtggcaacaccagcactgtgagctggctccatggagcattgggagtctcttttaaatacacgcttatagggtgtaacttaaccaaacaaaataacaaacagaaaactaagtacataacagataaacttaccccacagtttgaacaaattccaaaggctattccagtcatcccgaatgacgagtccaacaggccacgcgtgttgc

SEQ ID NO: 648164 - DNA, 107 bp, Homo sapiens
ttacaatacctttcttttccatcctatcacttatgactccatcttcccaagtaattgcaaattgaagattccatcacttatacatccacattattcaactgacaaat

SEQ ID NO: 648165 - DNA, 540 bp, Homo sapiens
cattggcccttctacaacatctcagctgctatgcaggcggcaaggcccactcagataccagcgctcactcaccctgagcctttcttaactatcctctggaagccttccctagttccccagtgtctatctccattactgcacctatcacacagaagcattgtcaatctgtttatctgtgtgtaaaatgacaaggttattcattgccaaaaaagactagaagtcacctgcacattcatcaatgaataagagaatggcacatccaggccgtgcgtggtagctcatgtctgtaattccagcactttgggaggccaaggcggcagatcacttgagatcagaagtttgagaccagcctggccaacatggtgaaaccttgtctctactaaaattacaaaattagccaggcatggtggtgtgcacctgtaatcccagctactcaggaggctgaggcaggagaatcacttgaacctgggaggcagaggttgcagtgagctgagactgtgccactgcactccagtctgggcgacagagaggctctgtctc

SEQ ID NO: 648166 - DNA, 593 bp, Homo sapiens
tggtactgtagctactgctggagtgagcagtgagctaggttgaggcagaagcagtcaggatggtggtgccttcggtgaagcttcatggacctcatcgaagagattcgcggggacaagactcaggctctatgtgagcgggaggtgatccagagaaggagtgtgccctgatccgggactcgttccgcgacggggacccagtgcacaggcaccggaagctgtacgaacttgctctacgtccacatgttgggctagcccgtccactttggacagatggagtgcctgaaagtgatcgtctcctccagattcacaggcaagagggtgggctacctgggggtcatgcttctattggatgagaggcacgatgcgcacctgctcattaccaatagcatcaagaatgacctgagccaggggattcaggcagtacaaggcctgggcttgggcagtttgagcaccaggggctctgctgagatgtgacgagacctggccccagaggtggagaaactgctcctgcagcccagtccctacgtgcgcaagaaggctattctgactgcagtgcacatgatccggaaggtccctgaactctccagtgtctc

SEQ ID NO: 648167 - DNA, 1579 bp, Homo sapiens
  misc_feature (1)..(1): n is a, c, g, or t
ntgtttctcttcgcactctctcgttgggagtacttcttggtgtgggggtggcgtttctctctacccctccagcctccctcgttgtctgtctactctcgtctgttgctgtgttttttctcgttctcctctgttgggtggcactcactgctagtgtcttctactcatatgctttgtctgttgtagtgccctcatttcgtccctggtggagtagtctccgttgtgggctcctgtgttgtgagatacccactgtggggggtgccagccggctttttttcgtcactccccgggtgttttgcccacgacattgtgtttcttcggtcaatatgtgggtgcccccgctggcaggtgttttgtttgtcgtccgtcccccactccttggtggtgctcccacctacggtccccttccggggggtggcccaacgattgctccatctcgtcgctagctggctgatatccccccggtgggggtcgcctgctgtcgggtgatggcacccacgtgtggtgcttgcccaccggagtggttgctttcccatttccccttcctcttgttctacaggagatgtggttgtttgttgtaaatattggtgccaccacaagggtgtacgaccacttggtcgatgtttggtggctcttcgtggacggcttttgtgccgaggaagacgtccctcacgctcctggcgcaatcaacattctggtgccgaccggctcgtgtattattcgccgttgttgactccgcggttgtttcactccgccaccgctgtgtgttttccaacagcggggggcgctccgcctcaacatattgtgttgtccccaccttggtagaaaagggtagtaggtgttgtggtagttgtatgtgcctcgacagatggcgctcttattaaattggtttcccctcacattacccaccagtttctactctactgctcacgcgctgacattttgtttctctggaaaatggtgagatctccccctcacacgcaaagtgttgttgataaacacggccgttgtgtctctgttggagcacattctcccaacacatctcagtggggcgctctataataaatgtgtctccgcgcaccacactgtctatattgtgcgcaacacagcacacaggcaccatctccagggagacatgtttctcaagacggcgcattttctctgagacacagattctcaccggcccatagtgttctcggggcgccaagagcgccttctcttgccacatgtgtcacacaccgggcgtagggccatgtgaccgagaatggagattctcaccggaggcccgagtagccaacacatggaatggaccctggtgttctcggagatacccagccagtacccagggatgcccaccagccggaggtaggtagggccgagttctgagagaggaggctgaggaggaggtggcctagagccttctagtcactggggaaagtcagggaagaccagtgtgaacatcttttattctactctccagcctgtccctgtggccctgtcccactgtgtgcacttgctgtttttcccctgtccacatccatgctgtacagacacccacccatttaagcatttttatagtgga

SEQ ID NO: 648168 - DNA, 333 bp, Homo sapiens
  misc_feature (124)..(125): n is a, c, g, or t
  misc_feature (127)..(127): n is a, c, g, or t
  misc_feature (323)..(323): n is a, c, g, or t
gatagctgtagctcagctgttctacagcccactgcccttgctatctccagcagctcccgtgggaagtggccttccccaaaccctcagcagtgcaactcaggtgtttggatctctgtcagtttcnncngcagaaaaatagaatctccttgttttaatttgcgtttcccttatgagaagggtttagcgttatttccagtacctaagctattggaatttcctttcctgtgagctgtatgtttataagcctttgcctgttttcctaatggctgttggtttttcttactgatttaaaggacttcctttaagataattgaaaggagggnatcccttaaa

SEQ ID NO: 648169 - DNA, 603 bp, Homo sapiens
gtgtgacggcccgttttgcagccgccggatggtactgcagggggaaaaaagccggagtgggaccgtgtctttgggaaactgctgctctttcacttctcaggcgtcaccgagagctcaggacccaaggtgaattcttgttaccattgtggaagaaacggggagctgatggcattctggtggaccatgtttcccccaaatgtcctgggagcatcagcgtgtttcagaattacccaaatgtgtgtgggaagacacattgtgcgatttctggaaattcaaaaaagttgcaatcagatggatgagggatgcacttggaaagcgcttttaaagagaaaagagaatccaggccacctaagggaaaggttcaacgaggagaaacacacagcaactgggtttcctaaaagggacctatggggcgaaataccagagaaatatccccttaagttgcaaagggaagacttctttcccacagcaacgtccacgggagcagttgcacacacatggttggttgtgccattttctcacgggagaacttcccacattccaggttgttaaaaatactaaaacagactattgtggcaattattggtccaagaaacacctcga

SEQ ID NO: 648170 - DNA, 935 bp, Homo sapiens
ggactgttccgggagcgccgcgtgttagcgtcggcggtttgggcatggcgactttttctggcccggtggcaaatctgtcgcttaatccgcaagaaagatgtcgcagttccaaacggaggtggcgcaagtgttcgggaagcggatataaaccaagggaaaaaaacaagcaacaatttacactcgtggagtaagtctaatgttgcgcccaccttaacttaaaccttattgtggaggaaaaaccaaagaatcttttcaatattttctccccagttttgggcccttcttgtggacaccgggtccggggcttgccccaagaacggtaccacggggcgttgacaataggcaagaggggtctactgcattgtggggggaggttggagtctggaggggattgtgcgccaaaattatgtgtgctggaaacaattggacaacaactttaccttgttgtgggtgggaaagggacttcttggggggtggcccattttagttgcccacgctgaaaacagaggtaaataaagaggaacttcttttaaaaggatgtgaattattccccatttacaggcaggcaatttattatccattcagggggaacagcgggtaaataaatgcggaactcgggacacttaaagcaacaaaaaaggttaacgggactggggggacgcgatttaacaacaggaacaggaaacgatttactcagggaacgaacacttaggcttaaaaagggggatgtgacttatggatttttcccttctgttgatgttacaggcaaaccggaacaggttttcacaaacactaatgggcagaacgtctacaaaagggctgggtttaacgtaaggaggacgaacaaaggttccgttgtgtgacccaacaatttgtggggggcggacaatcacagtggtgaacgagtgtgtgataactggtgaacatgttcaacg

SEQ ID NO: 648171 - DNA, 384 bp, Homo sapiens
cagcatttccattggtctaagtcttttataacccaaggcaacaactgggtgaacacaactgaaagacaccttctacacctgccatcagaccgtgggttgggctgggaagacagtgtagaaagatatttaagcggaatgtctggcttcccgggaaaaggggctgtcagtggggaaggcagactctcactccctgctggctacactgggaggctgtgaggcaggggtctcctctgaagaggtgcagaccctttgaatgaaaggatgccctccaaaagagccgtggcaaatatgaaagagggatggaaaaaaatgtctgtggccagaaaaaagtaatttaggagaattatgtgagctctatgatcccaaaatgcccataccccatta

SEQ ID NO: 648172 - DNA, 416 bp, Homo sapiens
  misc_feature (140)..(140): n is a, c, g, or t
  misc_feature (156)..(156): n is a, c, g, or t
gtcgacgttattgtaattggccgcgatgcacagtgactgacacatacgagccaaatggttccgagcaggcagccccgtcgtcatttgagaaggatgctcaccctcgggaatgctgtattgaaaattccccaactgatctngaccgcgcgccgcccntacatccttgagatctcgggaaagagtgccctggctcacgactattccctcggcagctagcctacgcgccaattcagcttgggaagatatctgctcagatcgaattaaagcgctaatgcgcgacaaccttgccgccctagatacgagaaccggtctgtgatcatcgttcgacaacgacaccgcccctttcgcacacacccgtcacgaataccctagagcctgtggatacgcgctcgcaattagaagtagtatagtcgacc

SEQ ID NO: 648173 - DNA, 159 bp, Homo sapiens
actagtcctgcgtagtcggtgtactcgtaggtcagtaccattgatggccaactgatatgatggtaagggagggatcgtgacctcgtcctgttatgtaacaggatgcgtacgggatgggacgggcgactgacggactaggactgactggcagggcacgga

SEQ ID NO: 648174 - DNA, 441 bp, Homo sapiens
tgggcccttacttcccacgacaccattggacacatcaatgctgaaaacaacaaagacacattggacttaatccgcactacagaccacatggacctaatagatatttatagaaaatgtcatccaatggctgtagattaaacattcttctcctcagcaaatgaatgattctcaaggacagaccatatgttaggccacaaaacgagtcttaaaacattccaaaaaactgaaaccatatcaaatatcttttctgaccacaatgggataaaaccagaaatcaataacaagaggaattttggaaactatgtaatacacgaaaattaaccaatacactcctgaatgaccagtgggtcaatggacagatgaagaagaaaattgaaaaatttcttcaaagaaattataacggaaacacaacataccaaaaaccttgggatacggggaaag

SEQ ID NO: 648175 - DNA, 470 bp, Homo sapiens
atagagtcttgctctgtcacccaggctggagtgcaagggcacagtctcggctcactgcaacctctacctctgggttcaagcgattctcctgcctcagcctcccgagtagctgggattacagacgcctgccaccatatctggctaattctttgaacttttagtagagacggggattcaccatgttggtcacgctggtctcaaactcctgacctcaggtgatctgcctgccttgtactcccaaagcgctgggattacaggccctgcctagaattcacattttcaaagacagaacttctgttgcacaatagtaagcttgttaaagggtaccgccgatgacgttttaacgcaagagatttccctcttaacagtgacctacacgttactaagtcatagagagttgaactaagcataactagcattcgtttcgttctcaccttctttggaggtgtttgaaacgatctgtgtttaaa

SEQ ID NO: 648176 - DNA, 245 bp, Homo sapiens
ataaatacacacggagtgagccagaatggagctacagcaatgacagaatggtattaccaccaaatgagactagatgttataatcttttactatccttttttcttagaaaataattagttattcaattattgtctaattctagctccagcctaaaacccttttaaacattagccacatctgatgcctattggaaccacactaagagccattgcagctgcctgcctatgcgttcattgccagggttt

SEQ ID NO: 648177 - DNA, 219 bp, Homo sapiens
tgtggctaaggaaacagaggacttgaacaacactaccgaccaaatgtatctaacaggacatacaaaacaccattcccaacagctgcagaccatacatcgttctcacgcacacataggacgattcttcaaaacagatcaccagtgtggtcacaaaatatgtcttcacaaatttaacaagattaaaactgggcatggtggcccacacctgtcatctcagca

SEQ ID NO: 648178 - DNA, 1128 bp, Homo sapiens
tccgtcggtgttatgccttattgtctcggggtcgtcgtcgctgtagctatatgtttagctcccccgccccgttgggtcttataccccaaactgtaactgtgtgcgccgttcccttgcgcgaacacggtgtttcttcccattaagtcccgctccggttcgttcggctaactgcgccttattcccgggtttctggcgtctcggtgggtccccgttgctttcggtgggtttttcccatatctcccctgatttgtcctggtcctttggtctgcaccccgattatcgtatctcggcgggtgtaatgtagtccgcgagtatagcccccggtcttgaggccccccatttgttgtgaaccacgcgggcaccaactggccaaccccccaacacgtatttagcccatctgtctttcgcggcagcccgtatccttaggcgcttctacggctaagggcctttcttccgtttgcccttcgtctttggtggcttcttccttatgggcccaatagggctccgccgtttaccgtgttcgtaaagttttcccgttgtgctctcggacccacatcggtgcggtttacgtgtcccgataactcctcggttcgctttctcctataggccgagcccttccggactggtcaggtttttgcatcccgatgcggacttttcttgcccttgctcttgacccgaagtgggcgcctcggggccctattagccatagcgcctagtcttttggcttctgttgtcggtttccttttcgtccggggggatctcctggttctctacgggggccttttgtgtacttattagttcccccataagtccgtcgtttacggtatcgccatgtatttccctttgtgctattagtcctcgactggttcattttgggcccaaggaatcattccgctggcgtcctgctttaacttcggcttttgtagtgtggtatagctggtgttgctatgttagcgctcgtgtcaaatgttattctattgcttgaattttatgttaaggtttgtttgttgtacgctaattctcgattctttgaagagatgacatacatattttggttttctactgttatgtgagtacattaggccccagcaacatatccactgtgtaaggaaatataaaggctccgcg

SEQ ID NO: 648179 - DNA, 183 bp, Homo sapiens
tgaccggacctagaggacccccgtccttcatcatacctaccaggaagaaggcagaaagacaaagaacgaaggcggcggagaggcaggagacaggcagaagaaaacgaaggagaaggaagaaggagaagaataagaagaagaaaggaggagaaggaagaagaagaaagaggaaagaagcagaac

SEQ ID NO: 648180 - DNA, 857 bp, Homo sapiens
gtccctgcgccccgctccgccgcgcctctctcccagcgccgcgcctcgggtcgttaagagcgcgcccctcgcgaccgcagtccagtgccgaccgcagcagcccagccccagccttcctccgcctccgcctctctctccttcctcctcctcctgccgtccgtgacatcgcagtccgcatgtgcctgggatccgggactgcagctggggagtcacgggactgcgcgctatgccatgccctttcctcgcctctcgtgctccgcgaatccgctcgggcgccttcctccgtcgctcctccgtactctctcccatcgcactgtcgtccgtctcgccgtcttattccgtcacctcctctcctcatcccgagcgccctgggtgtgcagacacgcaatgatccgggaagggtcgacgagtatgagcggagctccaacttggatgtagataacttggcccttacgtctgcttctttgcagggggcagtcatcacgcggatctgggtgtaaagacatcggagtcgtcttgcatattcctaaggggcttactcttgtgagccgcacctaagtcttatcggcaacccaaaagtcatttccacgggtggccacacacctacgttcgcgaagtttgtactcttcttgggctgcgctgataacgcccaggttgcatacgctcagtcgacgcgcattcgctgacgggtggccaaactttgcccagcttcctgagggacactaggcatgggttccagcgatgaggaggttccctgcaaaggcttgaagtcccccctgctcgtaacatctccggtgccgcccaccggcgtggctagaatttgcgttgtacgaagccgtcacgagctcgtcgacctc

SEQ ID NO: 648181 - DNA, 775 bp, Homo sapiens
tgaatgtgatctagccactggcagtccccaaggggcgccgactctgctgtgaggtgtgcgaagccccagtccgagcgggtgtgcgcggcctgcaaagctcacttattactgtggcgtggtacatcagaacggctgactgaggagcagacgtccatggagaaaatatggtcagcctccttgatgtccacgtgcgcatccttccagtgccgcattactacaagtctcgagaggcacagaaacgcgagagcgagtgggcactgctaggcgagcgtggcagtccatgcgggccagtaagtatcatgagtctgtaactgtcatgcggtacgaatcatagtccgcaggaaaatagcagtcttttgcagaggggaaacgagcgagagcattgcgtgtatcgcagacgagcttgtggcacgtcccgcttacggcgtataccgtggtgaaagtctgtgataggcccgtgaagcgtctcggtagcagcgttgatgctcatgcgtaaaccatgcactggttgggccgaggaccagtcgctttggatcttgggtcccgagagtcgattgcaagactgcacacgacatactcttacttttcacccaaggctcccaagttcgggtagcgaggtcacatccaagatccaacgtgtaggctgttaagtgtaaatggcacgacgccaacgtgcctttgagcgtggcagtcgtggaactcgtggggaactgtcttctattgatagcgcgtaagcacaaaaggatgatgaaagaaggtcccggggaatcatccg

SEQ ID NO: 648182 - DNA, 574 bp, Homo sapiens
gaatgtggatgattgcggtggagccttcactatgggtgtcatcgagtggcggagtcttccaggccatcaagggtttccgcaagtgccccatgttggaattcagtgcgaccgggttgagaggtagtgccactgctagtgaggatcctgagccccccaagaattggcaggtagcgttcgcagtcgtgcgcgggcggccgtgctttcatccaccgattgactgtggctggtgcggcttcggggcaaggaggatcgcctgtgaactctatcaccagtggacgcacttgaccggggctgtgctggctgcccgcaggtgtcccactggcccatggtgggctcagccaatgcatgcgggggcactccctgcttggccctcattgagcgccgttggcatcctccgtcactcgctacacagcgccagcagttcccgaaactgcgcccggcattcctggaggaccccagcagctgcccctacggatggcacccgggcccaggctaccccagctatcagccagtaccacctgagggaagccactgccaccatggcagctaccttctcgcgctccctcccgcgatg

SEQ ID NO: 648183 - DNA, 260 bp, Homo sapiens
tccataatgtgtgcccagtctgggcactgtgagaccctgtcttccaaaaaaatggcattctagtaagagcatgttaaaaacatagtcttgagaatgcttatggtatgttttcagaatgagaagtttaatgtggtgtagcatggtaggggatcctgctggtcagatgggtggggcgcacatgatggaggggtgccagagcgcgagttgggaatcgtggacataggtgcactcgggctccagcctgggcacacattatggag

SEQ ID NO: 648184 - DNA, 1448 bp, Homo sapiens
  misc_feature (572)..(572): n is a, c, g, or t
tggaaagccatattggggtatttttgaagtggaaagtgtgtttgaataacagcaagggaagagctttcttacatagagaggtatgcattctttccccttgagccttgagaaaccgtgtctcaacacgggggcggggagggggcagctgtgtggttctttctaaccctctccaggtcagggaacaaatttgcccctaaacttccacaggaggcacctcttacccttcgtgggccagaagctgtgggcacgaggtggcaaagctcagatttaaaattctctagaagtttctaacgagcgatttcccaaccattttccctcacctttttctttcgtgtttctcccgaaattcccagagggcgagggaaaaattcccgtggcgtgcctctcttccttcaatctttctataacttacaggcgtgtatagagggcggattttagagaagcccgtcgtggcagaaatctcacagtggccatctcgaccacaaggggaaggggggtgtgtggcaaggggaatttttctcctgtggtgcctataaccctacgtgatctcaccgagctataaaggtgggaanatctccttatttaaaccacgagcgcggaaatctcacattgtggagcgcgccttcgctatatacgcggcgccccaggggggagaaagaagggggggcgggcgcccccacacaagattgttggcatctcctttgaccgcgagaattagaccgcagaagaagagaaaacggcaagcccatgggggaagggggctcacacgggacacacaggatacgcctataaaaaacgtgacagggggggcgaaacgcaaaaaccaagggacacgacgccgtgcgcaaacacgaagcgacggcaagtccaccttgctccacaacagggcgacaccactaggacggggtggaagtaagggcccaccaggtgtgggcgcccccaacgaagcatggttgggtaccctcccgggtaaaagaacccccaaggaagttttcccccttttaccccctttttcctgagcgggaaatggttggaaacaccgccgttaataggccccacgaggccatagtagagggtccacagagaattcttctgcaacgtctctcccgggtggagtggagccctcctatcacttactgagggaaagcaccgttggttccaccagttttccattaagtgaaggagggggccgccagtaaaatataatcacttatgatagaagggagcccgggaaaaacaagccgcgccttgttgtataaatctaacacacaaaaacgatacagaggtgtgcggccatgagagcagaggtagatccaccacgtgatgtggtggaggagccaccctttaaaatagccccggagaagaacaattactcctcgagaggggacaccacaaagagaggcggacagatgagagcttcaacgacagatataaactatgcgcgatgg

SEQ ID NO: 648185 - DNA, 726 bp, Homo sapiens
tcctatgaagaaaatttttacaattgctggggcggggacgataacgtggtaaatggggtcgtcacctaaaaggttgccgggtgggcccagctcggctcaaataaggaggtcttaaagctgtgcctaggactccagctcagtgcgccgaataataggtataggttgtcccaaggtcttgggggttggtagagaatagctcaagggtcggcgaacatcaggggggggtgaggtaaaagggcgttgagtgaagcatgggacggtaaatctaaagacaggggttaggcctcttttaccagcctccgaggtgatttcatatggatttgcaattccgaagaagcagttcgaaccggcgggggtttctcccgcctttttccccggggggggggagaagtagatggaagccagtggattagggtgctaagctgtaaactaagtgttggggggttaagtcccatgggtctagtaaggggctagctaaataaaagggggggattggcgtcagttgatgcgaggggggtttggacagatgacccctaagaggggccctctaaggcctccctaaggacctcgggcatagcatgtgattcacttccactcaataaggctcctcaaataaggctattaaaccaaaaagtaccattataccactgagtggcgcgatgtaaccaggagaagcacctacaaggcacacagaacacggtcaaaaaggctcgaaaggggaaaact

SEQ ID NO: 648186 - DNA, 357 bp, Homo sapiens
atagagagttataatataaaatgattaaaggctatatttaagaatgtaggtagtaagtgtaatggtgttgaagaaaattttctatgtatgcttataggatgaaaatatataattaaagtcttctgatcatagcttgagaccatcaagggaatgtttagtttcctccacaaagagccaccaggattttctcataatctcctttggtttcatccaggatggcttggcaaagggagataccatacatcttctgatagaatgctttgatatcattcatgtcaatttcagaacgggaaaccataatcctgatcaatgccttatggcgagttccaacacctttcatggcttgatgaagcttct

SEQ ID NO: 648187 - DNA, 1049 bp, Homo sapiens
gcatatgtcgatccacgctgttcgcctaataatggtagacggcggcggctgttgcggctgtgacaggagccccatggtcatgctgcctcaggccctatctcagcccatcttgacgacaaatctaatggctccatggagccagcacggggccccctgccaatgcggagcctgagtccatacccggtgcagtagtgagcaccgtacaaagtatacctgaccaagcaagcaacgcacggtggtgactgtccgggatggcatgagtgtctacgactctctagacaaggccctgaaggtgcggggtctaaatcaggactgctgtgtggtctaccgactcatcaagggacgaaagacggtcactgcctgggacacagccattgctcccctggatggcgaggagctcattagtcgaggtccttgacgatgtcccgactgaccatgcacaattttagtacggaagaccttctatcagcctggcgtactgtgacttctgccttaagttactgtaccatggacttccgttgccaaacctgtggctacaagattaccaccagcattgtacccatccaaggtccccacagatctgtgttgacatgagtaccaaccgccaacagttctaaccacagtgttccaggatacgcgccggaggctacagacagccatgaggcatcccatcgaacacagccacactgaatgacaaagcaaaaaccacacagagcacccgaagcgcaagcaagacacgacacacagaagcctcgggggaaggagaggcgacggaaccgcgcccaggagcggagaagacgaggagagagagaagacgaccagggaggggggcgcgccgaggagagaagaggagggacgagaagcgcggaccagcaagaacactgagacgggacacggagaagagacggcgcaagaaaagcggcgcaagagcgggcacggagaccggacaaaacgaagggcagcaacggcagatgcgagacgcagacggggcggaagctgagaaggagggcacgaacgcgggaaggaggcagaggggggaaaaaggcgcg

SEQ ID NO: 648188 - DNA, 1131 bp, Homo sapiens
gggggttcctgacgtgttgaatagtccccactaacgacatagccgaatccgatgctccgccctgtgccgcccctaaggggtctcctttgtcgggtcaaaaggggaaacattgctgggtccctttcttgggagaatgggtttattaaactccttctggaccccctcgcagtgttgttggttggcctcgcgttcattggccttacagggcacaccctctcgtttgcaaaacgggcaagtccacacagaacccttaggccatgtttctctatcgatggtgtctcttgaacggggcgctttttcataaggtgctcccctgcgcggttggatacctcggggcgcgcaatggggcaactgagcgcccttcggggggcttccggttccctattgtgccccacgtacccagggctttccacgttcacgacagcgattgtgtggtgacactctttcctgcggcaatatggacggaaccctcctcggctcggaagttgctggccacatgttccggggagagccaatttaggagtcaaagacatgtcgcgcagatatagagggcccacaaatttgtgtgcacaaaagtttggtttgcgaaacaccagcagtttggacccttgagattcacgactctatcgctgtaagacgggcactcctcaaaaaattaaccctggccacacttcccgtttcacgcgatctacgcgcatcatcgcatctcacaaggtgctatatacttcattgcccttcgtcccggagtgcggcgttgtttaaccagcgcgcgcacttgaccgacgaagcacaccattgcggtccacagcgtttcgcagctcctcccctagggctcatctaagcacactacctcggccgctgggcctagcacatgtcatgacctcacagatgcctacgtttgtggatctccatcttagtctcctccacgtggtgccccaatgtccttcagctcgcgcggggccaccgttttagggtcccatcctatgccatcacctgaagacccccacgccaaacactggaatgtcacgctgtgcatgccgcctcggtcacaaccttgcggcccgctcgtttgactcaactcagctcctttaacgctaatatcttcataccaacatgggatgcttggtctct

SEQ ID NO: 648189 - DNA, 124 bp, Homo sapiens
tagtagtggaccccgctaacggctttttgcccaaatgggccattatcgaagaatcacaaaaaacaatggcctgctcccaaatcttcatgcctttccagatggatcttgatggaagcgtgcgcat

SEQ ID NO: 648190 - DNA, 364 bp, Homo sapiens
tgtacactgaggagaatcaggtattagctgatatgtatagatacactgaggtggtgaggagtaatgtgatacgagtgttttggccgtggaaagctatatctctagggtgacgaaagaactggcagtatgattgtgaatgagagagttttgccagttgcatatctacctaaaatgctctattgctctgtattagtagtgagagaggaagaagtcattttattgtgctgaaaaacagtggaagtaaagttaccaagcgagtaatattaatgacttcaattcatagatattgggataatgactaatgtgccaggtattatattaggtatttaatatacatgatgacacttaaatttatactatggtc

SEQ ID NO: 648191 - DNA, 793 bp, Homo sapiens
aaaaacaaaaacaaaaaaaacctttgtctgtaagacagtatagaaagttgggagaaaggtctactccaggatcaagacctcctgaaagggtctcgaggaccccaatggttcctggaccacactttgaaaacctatggatctgaaagtaatttaggattgcattctcctgtaatgccgcgtcttagcaatgtaaccttgggaactgaccaaaaggacccaagggagagtatcaaaggcaaaacaacaggacacatgaggaacaaccaatactcagaaaaaaaaaacgagtaattcattggattcaaaacggggaaacaacagtagatgactatagaggacagagaagagcaaagcttatgatctcaaaatgatttctggtcagtttggattccatcgaattcaagtcttagaatttacagaaacatatgtgatttctcagatacatgggtatatcttcaaaaacaaaaaccaaagcaccacaggcccgacacggcacatcgaccagcccctgggagaaaacgcatgcatagcaaaccactaaccgcagggagccacccagccccacacaagcgtaaacggaacccagtggccacatacgaactgattcaccaaagacagacaacgggacacaacaaacccaacgcaatgagcatatcacaccacaaaaaacaaaacatgaccaggcacaaacagcacacacatcgaacgcaaacaccacaagcaggacacccgacgcccactaacggataccgacacaacaggagcatcaagaacaacaagccactcaaactaa

SEQ ID NO: 648192 - DNA, 548 bp, Homo sapiens
  misc_feature (6)..(6): n is a, c, g, or t
  misc_feature (69)..(69): n is a, c, g, or t
  misc_feature (110)..(110): n is a, c, g, or t
  misc_feature (134)..(134): n is a, c, g, or t
  misc_feature (178)..(178): n is a, c, g, or t
  misc_feature (220)..(220): n is a, c, g, or t
  misc_feature (222)..(222): n is a, c, g, or t
  misc_feature (243)..(243): n is a, c, g, or t
  misc_feature (249)..(249): n is a, c, g, or t
accaanccctattccggcccccctttaatgcccatcttggctcaggggctggcctttccgggggggatntaattaagccataatttggtttttgggtatattcctacccnagtattccaccttacggctaaatncgggaaagtgccgtatttttaagcctttagtggttttctttggngttatctgtccctttttcctttttcatacattgaaggtgtcncnttttcaccaaatattgaaatngggagncctgaattgttgtgcctggctaattggcaattatttaccatataataagtgtagcgcctgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgac

SEQ ID NO: 648193 - DNA, 423 bp, Homo sapiens
  misc_feature (130)..(130): n is a, c, g, or t
gccaaagtgcccaaatgctattgcaaattgtcagcagtaagaaacatgtttaactataccccagagaattatatgttcttttctacaactgttgaacaatccacttacatgtaccaacaaaatgaaatgntttccctgttcctactgtcaccaaatcactcacagtctgaatatcccattcatttttgtctcttcatttatcagtaaatgtatgctcctaatttagtgtaatatactggcttgtatgtaatagatttttaccaagatgtcataccttccctactctggtgcttagaggatatcaactcctttcattcatgaaagaagcttgttagaactccttagatttgcaaactggaaagatcaaaatgaggttaaatggttacagtaattgacagcagcatataggtaaatgcatgagcc

SEQ ID NO: 648194 - DNA, 474 bp, Homo sapiens
gagcgtgctgaagtatgctgattgctttgcccagaacaatcacacacagtgagcgtctgctcctcaacgtgggtgctggtgcctgagctgcagctcccgctgcagccttctctatagatacacaaagatttaacgttccttaaacaaaaataactgaaaggacttctagagaatatccacttgtcttataaaaggactctcagcccagagagcttctgtgctttgtcgatagtggcagaactgggatcccaatgcttctgccctgctggtttgagtcacattctccatagagcagtttgcccttcccagttctgtgttagtcagccccgttctcacttgcatcctgcctcgagtcacttgagcagcctctgggttcttccacagctccttgttctctgaaatgaggcccatcctatgcctgatgccgaggctgctcttcactcttcacgatcctaactcttgggaccgagctcg

SEQ ID NO: 648195 - DNA, 756 bp, Homo sapiens
gcggagtcggacgcaggcagatcatgtgtatcctggtgatgctgggtggcttaacagcggggctggtggctggaacgcggtgctcagatggtcagttctgccctgtggcctgctgtgtgtaccccgggagcgagccaggctacagctgctgcagttgccttctggacaaatggccgacaactactgagccaggcatctgggtggccgccgtgccagtgtttgactgccgccacctggcctcctgcgcgggccagtctctggcagtacttaaaactgtcatcaggggaaccttcagattgacttgcgccgctttcacgcaagcagtgcccggtgtgcagtcgcggcgggattcgtgccgaatcagcttggcgtcggcccacgggtggtccttcacaccttgtggctgtcacgactggggcgattccttggcttcccagccaggactcagtgtaaagggaagctccgtcgaggttgctcactccatgttgtgtcgccttgcaactcaccgttcagcgggtccctgaatctgcggcttgaactttcgtatcccgaacaggttggttgcgtgtcaaatgggctccgactcgggcatccccttgctgggggggttgcgtgtcctcggagtggtccggatgggcttctcgtgtcttgttcgcaatgatcaaggggggttgttgactcgcgcttgtcgcccgcaccctgtgttgccattctctagctgacctcgcgcctctcgacatgcgctcgccgtgttat

SEQ ID NO: 648196 - DNA, 159 bp, Homo sapiens
  misc_feature (75)..(75): n is a, c, g, or t
aatgactcgtttataaaataactttgacgaatacatacagtttcctcgggtgttgaagtcgatgtgttgaaaaanataactttcttgagtatgaaaaacatcgaaaataaagtgtaaattaaatttcactgaaaatcgtgattttacggatcttctaaa

SEQ ID NO: 648197 - DNA, 547 bp, Homo sapiens
  misc_feature (33)..(33): n is a, c, g, or t
  misc_feature (36)..(36): n is a, c, g, or t
  misc_feature (38)..(39): n is a, c, g, or t
  misc_feature (61)..(61): n is a, c, g, or t
  misc_feature (183)..(183): n is a, c, g, or t
  misc_feature (290)..(290): n is a, c, g, or t
  misc_feature (458)..(458): n is a, c, g, or t
  misc_feature (521)..(521): n is a, c, g, or t
  misc_feature (527)..(527): n is a, c, g, or t
caccacaatcctaataaatgagcctggcagagntantnncacaagcccatgtccacgaagnacgggactccaacaatggcagctttggcttgcataccaccattggactgaccaaacctttcttagaactgccagtgtgacagagggacctctgggggagggcgtcttgctttctcttgggtnagtatatctcactaccctctttgtaggttagcagatttgtaacaggatgttactggaggaaggggaagtgggaaagctggagagtattcccactcttttcccttacnacaaaaactttccttctcagtcctgtctccaggagatggaagaccaaataacacaacagccagtgtgcttttcctacccaatcctttctttcaccctcttatcctaatacatttccagcatggttaattcttttgcagcatagacaagagaaccccatacacgctggnaaaactggcaaaagggcttaggtgggaaactccccagtttcttggttgacattttcaagtggnatttanaagatggtaatttaaaaaac

SEQ ID NO: 648198 - DNA, 154 bp, Homo sapiens
aagaagacactctgggggggaagcggcggggcgagcgaagggtctggagggagaagaattgactgccccttttggctcttggagttaagccgaaatctacaaggagaaaggcaaagagaatcttgcgcttccgtggcggtcagtttccttccta

SEQ ID NO: 648199 - DNA, 309 bp, Homo sapiens
ggatcccgcatatgatacagattgattctttctgtgactcatcagttcctttcctgtacaatacatgtcttgcatgttgatttgtgaatatgaaccagatgcttgatataaacctctttatatcatgtccaggagtttgcaagaaacaggtgctttacactaattcacctcctgaacatgaaaaatggtctgtgaccggaactgcgcgctcatcgctggggctgtcattggtgctgtcctggctgtgtaagcccgtatgctaatgccagttggagacctgcttatccagaagacaattaaaaagcaagt

SEQ ID NO: 648200 - DNA, 356 bp, Homo sapiens
  misc_feature (29)..(29): n is a, c, g, or t
gagctttggaggagcctgacaattcaaanctgggcccaaacctggatcagaaaccatgccactgaaataattacatgcctgcggggggaaggcaaccttgacagagacccagcacatgatccaggcgacgcagtccatggagctctgtgaacgggctgaagctctctctcagcaggaagggtggtgggttgttggaaaggaaaacttcccacgggggaagggccaatgttcaaaccaaagcctggccaagttttgggaggaaggcttgaacttcccgttataccaaggggttctttcccgttccggaaaaaccattccccaacaccagccacggaggtaatttcaaccaaacacac

SEQ ID NO: 648201 - DNA, 239 bp, Homo sapiens
tactgacacccctgtctgggttggagggatgcggatgggtgtaggggcgaggcgcctcccgccctcggctggatgacgacggccgcagacccctttctcacctcttgcagggggtcctccccactcctgtgtgctccctctggtgtccccctgagttgtattagcaagcttaactggtatctaggagccatggaccttgaactctgcacctcactaccatcttcactgtttacataata

SEQ ID NO: 648202 - DNA, 155 bp, Homo sapiens
ttgagttaccattaagattgtgacctccagttctgtctcttttggtttgcatttccgtagtataactttatccatccttttgtccagctttcttaaacacttgtgagatgttctttgtatacagcatagagaatggtatgtacttggcaatccag

SEQ ID NO: 648203 - DNA, 657 bp, Homo sapiens
tcgaatcgacggttctcccatgctgttctcatgatactgagtgagttctcatgagacctgatggtttataagggactcttttcccacttgctttctctgtttcctgccaccatgtgaagaaggtccttgcttacccttttgcttctgccatgattgtaagtttcctaagcctccccagccatgtggaactgtgagtcaattaaacctctttcttgtatgaattacccagtcttgggtatttcttcatagcagtgtgaaaatggaataatacagatgaggttaacatttaaatcagtagactttgagtatggcctccataatgttggtaggcttcatctaatcaattgaaggcctcaatagaaaaagattgtattccactcaagaagagagaattctgcctccagcctgcctttgaacttgagactacagcaagtcttccttgcaccttcagcctgctagcctaccctgtaggttttggacttgctagccttcacaattgtgtgaaccaattctcaaaatcaatctgtccatgtatgtgtgtgtgtgtctgtgtgtgtgtcccctggtgggtttgtttctctggagaacccgggctctaattataaccatctttggtactggcataatgtgcgataacatgctgtacaattctattac

SEQ ID NO: 648204 - DNA, 853 bp, Homo sapiens
  misc_feature (28)..(28): n is a, c, g, or t
  misc_feature (74)..(74): n is a, c, g, or t
  misc_feature (105)..(105): n is a, c, g, or t
  misc_feature (123)..(123): n is a, c, g, or t
  misc_feature (182)..(182): n is a, c, g, or t
  misc_feature (243)..(243): n is a, c, g, or t
  misc_feature (245)..(245): n is a, c, g, or t
  misc_feature (275)..(275): n is a, c, g, or t
  misc_feature (293)..(293): n is a, c, g, or t
  misc_feature (306)..(309): n is a, c, g, or t
  misc_feature (314)..(314): n is a, c, g, or t
  misc_feature (317)..(317): n is a, c, g, or t
  misc_feature (333)..(333): n is a, c, g, or t
  misc_feature (336)..(336): n is a, c, g, or t
  misc_feature (338)..(338): n is a, c, g, or t
  misc_feature (340)..(340): n is a, c, g, or t
  misc_feature (348)..(348): n is a, c, g, or t
  misc_feature (353)..(353): n is a, c, g, or t
  misc_feature (414)..(414): n is a, c, g, or t
  misc_feature (522)..(522): n is a, c, g, or t
  misc_feature (668)..(668): n is a, c, g, or t
  misc_feature (681)..(681): n is a, c, g, or t
  misc_feature (778)..(778): n is a, c, g, or t
  misc_feature (804)..(804): n is a, c, g, or t
ttgtgcatggctttgcttgtggatcatntatatgccatccgcgaggcagccaccagcaacctgaagaagctagnggaaaagtttgggaaggagtgggcccatgcnacaatcatccccaaggtnttggccatgtccggagaccccaactacctgcaccgcatgactacgctcttctgcatcantgtgctgtctgaggtctgtgggcaggacatcaccaccaagcacatgctacccacggttctncncatggctggggacccggttgccaatgtccncttcaatgtggccaagtntctgcagaagatnnnncccanccnggacaacagcaccttncanantnaagtcaancccancctagagaagctgacccaggaccaggatgtggacgtcaaatactttgcccaggaggctctnactgttctttctctcgcctgatgctggaagaggagcaaacactggcctctggtgtccaccctccaacccccacaagtccctctttggggagacactggggggcctttnggtgtcactccctgtgcatggtctgaccccaggccccttcccccagcacggttcctcctctccccagcctgggaagatttctcactgtccacctcccaacgggctaggggagcacggggttggacaggacagtgaccttgggaggnaggggctactccncccacgtcagggagagatgtgagcatcccgggtcactggatcctgctgctgtaatgggaacccctcccccatttacttctccacctcccgtcctccncatcattggtttttttttgtgtgtcnactgtgccgtttttattttattccttttattttccccctttcacagaga

SEQ ID NO: 648205 - DNA, 676 bp, Homo sapiens
tgtctataggggaaaagggctaaggctatagaattcttaaaagtggatctcttcgatattcaaatataaactcatgttttatgtgatagtttactttttatagaattttgcattttgaaatactccattaacaaggttctaaaatatcttttaattttttctctttgtagtaacttgtattttgctttggtccttttttccttaaagagttattatttcagagttatgtaaacagtttatttttctaataccacattgatttctcagtcttcacatctacatttccatattggacatgtgattgttatcaaattaggcatacacttatatgatttcgtccagtgtgggtgaacattttttaaaaacgaagtgacaaaggacttttgcactaccagccctcatagcatttatgcatggtaaacagtagatggtgctataaccgtgaggcatagcaaactgaaagtagttgtaaattgctctttaagcttgtagtaaactaaatatttgccctttgccgtctttgtccgcttttccctttgttctttgtggttcattcatttaacgggattacaaagacctactagaattggaccctggttcctgtgggttgcgcttgaccctttcggcgagttccccaggggtccccagagttattggacctttctcaaccgagggg

SEQ ID NO: 648206 - DNA, 857 bp, Homo sapiens
gcagcattcagtaccagttcctgcgcagatacaagttggcggatcaggtgacataccgcgtagtccatgtgactgatggtcagcttgacggtcagggcgaacagctggtgccgtaagcgtcgtgtcaccgctgcctctgtgcccccaggtcctgcgcgcccttccctgtgagacatgtgatccaaaatcccttcagcactggtggcagtccgcgcggtcgaggtctgtcaggatggggaggcaacgagtttgcgctatatgaccgcagacgttccaggtggtgggagatactaccagctgtgtcctgtactagaccacagagccagagtcttgcaggctggaggccagttctacgtcatgatgagcgccccaggatgatgctacagaacaggaacacatatcgacgactcgccccccggacgacacccttactctccaatgaggtgatggaaccacgaagaccccgagatgagaggagaagagcccagcagacacgagtctggagcggagagcggaggggacaggatcgagcgactggcatcgtccagctttcgaaaactcatccatactgtaaggcaggacgacgagcagactgggagcccactagaggggagggagacctggtgcaaggcctgcgaagaacatccagacgagttgacacagaacagagcagcgcagtcatcgaagaccgttcaaaaagcccgcgtagaaccagaatggccaaagacctctgaaagagcaaacgaagaagctgaggacagcaaacgcacggaccaaccagaggaaaaggtaaccaggacatgtgcaagacacccgcacagaacacccccaagcaagatcatccacgcaaaaaccct

SEQ ID NO: 648207 - DNA, 341 bp, Homo sapiens
gctggagttggagactgagaccagtggaccaaaacggcctccggaaaaaccccggaaacatgacagcggtgcggcggacttggagcgggtccccgactatgcaaaggagaaggagatccaaagttcccatctggagacgggagaaaaaactggcaaaagtccccttcaagaagggaagatctggagctaataatgactgagatggagatatctcgagcaccagcagaacccagtttgcgggaacccatgggcaacgtggtaaaggcgcttattgccctaacccactgatgcgggctttttcaaatatacccactggattaatttatggccataaaattttt

SEQ ID NO: 648208 - DNA, 375 bp, Homo sapiens
caggcccgaacaatccccgaacaatcgtggtcctgtggagtgacttggttctggccaggactaaagccgccaggctggcctccagcctgaatgctcgctccttgcatgcctgctccctgcatgactgggacctatgtgtacagagagagataaggagagatttttccatacttctcatttaggtaaccagaaacgagtaattacagcaatgtgaacaaatgtgacctggttatggacttgagtaaaaaatgcaaattaatgattctgaacatcatttcctactgttagcaacagcagaaggcagggtttagccagagatcaactagcaagtcagatgcatttgcctaattgttcggggcctggggtaccgagctc

SEQ ID NO: 648209 - DNA, 298 bp, Homo sapiens
gagaactagtccgagtttttttattttttagtctcccaggctagaggtctaagatgctaatgagacatgcaaaatatgaataagcatgtacagctactgcacatgtgcacccagaagaccactcagaacaggcttactagcagctcctcttcccccctccttactaataataatgtaaaactcccataagggggtttctccagcgacaatccacgctgtctcactcttatgagcagcccgccctggaatatctctctcacggcgtactgtattctgcacttaactttcaaaaattttt

SEQ ID NO: 648210 - DNA, 299 bp, Homo sapiens
tcattttgttgagatggagtcttactcactctgtcccctagggtggagtgcaatggtgcaatctcagctgcaacctcaacttctgggttcaagcaattctcctgcttcagcctccctgggattacaggctcccgggttcacgccattctcctgcctcagcctcccgaggcatgacaccacacccggctaatttttgtaggacagggtttcaccatgttggccaggctggtctcgaaatcctgagctcaagtgatccgcacacctcggcctcccaaagtactgggattacaggtgtgagg

SEQ ID NO: 648211 - DNA, 194 bp, Homo sapiens
ctggtcgcgtacctcgaacctcgtcacgcaatcgtcgtccacccccagttcaccgagcccgaagctgctctgagagcggccgggattagcgtcggtcggcacatccttaacgtgtccagatgggttcgccctcgacccggatctcgtccccgacgatgccgacctcgtcgtcgtcgggaacccgacgaatccca

SEQ ID NO: 648212 - DNA, 280 bp, Homo sapiens
gaggatccccccggtagactgtcatcatttcaaactattaaaaataaggttagccaccataccttttcttttggtaataggggtgttattatttatattaagcagaaaaaaccaaacattttgcccagactctagagtttcccaactatcaattctgttttactagctgtgcaacttccccaccttcacgctagtatccccaagtcccgccaccaaattctaggctaggcaggaggcagagcaagctttcattctggtcatcaagatgacagtctaccgg

SEQ ID NO: 648213 - DNA, 227 bp, Homo sapiens
cgatattctgggatgcagcagctactgcccacagaaaagccatttccccgtggccttgatactcccttttaagaagtggtaaactggccgggtgcaatggctcatgcctgtaatcccaaaactttgggagtcccaggcgggcggatcacctgaggtcgggagttcaagaccagcctgaccaacatggagaaaccccatctctactaaaaatacaaaactagccaggc

SEQ ID NO: 648214 - DNA, 1436 bp, Homo sapiens
tctcatttttctctctcaaaacattattttttccccctctctctctctctcagatactctctttgtgacccctctttccccacaaatctctctcagagaagtgtgttttaacaccccccggcccacacaatttcttaaaccccccccataggccttgtgggagaagagagggcccctctccacagggttgtgtgtgacaaggtggattctccctgtgtgtgagatatccacaaaaatattcttctccgcgaacagtgtctctagcgcgcgcgtgtgtctcacacattttgtgtgtgtggcacgcgcgggtgtgacacactgcgcgcgcgaggtgtggtgtgtgagacacagagttgagagtgcgcgcgagagtgctcttcgcgccaccccaacctcactgtgcgcgcgtgtgagagacaacacacacgcgctctctcaaccaacaagtagcgcgcccctctctctctactatatatatataggtgcgctctctctcacagcgaggagagagagagatctctctcgcgcagcctgtgtgtgtggagcgaacagagaccgcgcgtggcgagagagagaaaagagctgagagagtatctgcgtgtgtctcgcgaggagggcgcgctgagagagtgtggagagagagagtggtctctcaagacaccgcgcgcgagaagagtgtgtgagacactctcttattctcttctattcttctcgaagagagaagtgtctagtagagagaagagcagagagacccacaagagagaccccctgcgagaagaagagaggagtggtctccaaccccccccaacaagcaccccccgcagagaataaaaagcgaagacaacacaccacgatgtggagctccactacatacgactgatgatgaagacatcaatatcatgaagaagaagagacaaccaacacccccaccactgtggtggagggccgatggtggctacccccgaggaaaccaccgtggtgagggaaaaaaaagtctctcaccccaacaaatagtaggtggacggcgacgtgtactaatagaaaaagaactacggtcagcagaagggagcgaggaagcctaacttctaccacgagaggggggagacgcgaagcaggagaagataggcagaccccacccggtgcggataatatttgcaagaaacaccaacgacaaagaatcaatccacccccccccctgatgagtgaagagagaacaatgaaggagggaggaggagggcggactaaaagaaacaaagtcccccccacccacggaagggggcgcaccccaacaaccaccaacttgttgagagagcgagtgagacaaaacaaaaaaaacggccaccaccaaacacaaaccaaacaggctggggggggggggacgaaaaaacaacaacgaaaacaacacaaagagagaataaacaacactagagcatgag

SEQ ID NO: 648215 - DNA, 854 bp, Homo sapiens
tttttattatgagttaatatagtttagcagtaaaaaaaaaaaaaaaaccacacctaaaataaaccactggggaaaccataaagcggatgctttcatgccccctttactggcactttctggaccagggagctacttggagttgggtggtcactaaggatcaggggtcagtcttgggcttatcaataaatttaatctctggtgaatcttacctggctttaaaaaacaagttctggtggttggtcgtatctttatttatcccctagtttggcagaactggtctgaataaagggatacaagggattatttccaatggttactggcctgaaaaacgtgtttgtatagggtggctagattattagcagaatattcacaagtttcgggtggacctgtgtggattgagcatgactactacattttttgtatctaaaaagctgtgtcataacagtcttatgaagtagtctcgaatatagaaagttctataattaagccatgaaaggataggtttcaatttccagaaatgggtgttgtgaatgggatcccttgtttatattgtgaactatgggctttacgccataaccagaggatactggctaatttatgggaaagtttaagatacctgatgggttttttaacctttctggacgtggggtgttatttctatggcactggagcacgaatgccgtaattggtcaataaagactccaacgggttgggcaaaatccgaaatattaggtctttacatcggagaataattgaatttccgagggtaagcaataccaaaaaaaaactgtggccggcaaataacatggggccaaaaagtatcagaggcatggtcaaaggggtaaatggtagaa

SEQ ID NO: 648216 - DNA, 366 bp, Homo sapiens
  misc_feature (349)..(349): n is a, c, g, or t
ttcaaagccatttaacaagtttctaggaagttccagactttcccacattttcctgtcttctgggccctccaaattgttctaacctctgcctgttatccagttccaaagttactttcacattttcgtgtatttgtacagcagtgccccactctactggtaccaatttactgtattagtctgttttcacactgctaatagagacataactgagactgggtaatttataaggaaaaagaggtttactggactcacagttccatatggctgaggaggcctcacagtcatggtgggaaggcaaaaggcgcttcttatatgggcggccaaggaggaggaatgaggggaaccaagncaaaaggggtttcccct

SEQ ID NO: 648217 - DNA, 143 bp, Homo sapiens
aaaatgacgaacacaaagggaaagaggagaggcacccgagtagtagtgtgtcgtcgtaggcacgtgtgtgtagaaaacagtggaggttgttcactgtgtggcacacagtagtagtgacgaagtgtagtaaggaaagggtgagt

SEQ ID NO: 648218 - DNA, 364 bp, Homo sapiens
  misc_feature (323)..(323): n is a, c, g, or t
  misc_feature (336)..(336): n is a, c, g, or t
ggttagatatgattgcttatcgtccagagtgccgttgctgcgcggagctagagacaacttcgatgaagtagatgaaccggtcatcctagggcgtcggtgaccgctgtgcatcactctgcaggtattcggaacgaccatgaatcgaattcgacctcatacgttaaaggatatcctgtgacaacgagtatgactagaaccaaagagaccaagacagtgacccgagcattcatgcatgcgtcatagcttcgtgatgttgtgacgtggcactgtcgtaagtctctcttgctttggaagactgtaggagacagaagcaagacgggcgnatactgcgaaggnactcgcttgctatcatcgaaatagatca

SEQ ID NO: 648219 - DNA, 167 bp, Homo sapiens
ttttgtctagaaaggcaacaagcaaacacggagaagaggaaggactagcccgtcaacacagcctctgacttcatcaccaagatagagtaccccaagcagactcagagatctcaggtccttcctgcagggcgagatgagaccaccacgtgttcaagacagattcttca

SEQ ID NO: 648220 - DNA, 171 bp, Homo sapiens
actgtgtcaggtctaaaactatgagaacagtaccagcaccaaccactcaaggagctgagacggctgacccactctctgcctctggctagcgactggcacccaggcagcccccagatgtggatggccgcatatgatcccacgctgccaaggtgcccagtgaacactatgcaa

SEQ ID NO: 648221 - DNA, 339 bp, Homo sapiens
  misc_feature (67)..(67): n is a, c, g, or t
  misc_feature (230)..(230): n is a, c, g, or t
  misc_feature (327)..(327): n is a, c, g, or t
  misc_feature (330)..(330): n is a, c, g, or t
gaggctggacccggccaagggcagggagaggagctgggcctcccacagggggcccgggcagtgccancctggtgggggagggcagccttcaaacgtgtggggtcaacagtcctcaggtctaggcagggcagccggttcaccacctccccagccgccccaggcccccagcctgggcctgccatgcaccccctctgcatgggccacggtgtctccgcattgccagccttttngccttcacctcttttctaaccccgccccctgcacattcggggtctcagcccccaggctgtgagctccttgggggcaggcccccaataaatgtgaacngcngcggccaaa

SEQ ID NO: 648222 - DNA, 356 bp, Homo sapiens
ccattttgtggtaaaaaaaaggttttaggccaggcgccgtggctcacgccttgtaatccaacactttgagaggctgaggcgggcggatcacctgagtcaggagttcgagaccagcctggccaacatggtgaaacctccgtctctattaaaaatacaaaaattagccgagagtggtggcatgcacctgtcatcccagctactcgggaggctgaggcaggagaatcgcttgaacccgggaggcagaggttgcagtgagccgagatcgcgccactgcactccaacctgggtgacagactctgtctccaaaacaaaacaaacaaacaaaaagattttattaaagatattttgttaactca

SEQ ID NO: 648223 - DNA, 146 bp, Homo sapiens
ggaccaacttcgacacatcaggctactttgggacagtggtatgaagcattaccacttaaagaggaacagagcttctgcccaactgtcaaccttgaaaactgtggacttggtcagtgaacagacacgggtgaatgcgtccgtcgaag

SEQ ID NO: 648224 - DNA, 382 bp, Homo sapiens
atcccctcagcacctggaggatgttgtagtcagacagcgctgcgccccctcttccagctgctttgccggcaagcatcaacctctgctggtctaggacgaatgccttccttgtcctgcatctttgctttgacgttctcgattgtgtccctcggctcgacctccagggtgatggtcttgccagtcagtgtcttcacgacgatttgcatcccagctctcagatggagcaccaggtgcacggtggactctttctggatgttgtagtcagaccgggtgcgcccatcttccagctgttttccagctcagatcagcctctgctgttcaggagggatgccttccttatcttggatctgtgccttaactttctctatggtctccctgggct

SEQ ID NO: 648225 - DNA, 419 bp, Homo sapiens
atggacgtatcacatcctgactgtgtatatctagccgcataagctcccaaagtgccggattacaggcaggacgcaccgcaccggcctgtttgtttgtttttgagcctgagtcttgctctgttgcaatgggctagagtacaatggcatgttctcggctcaccgcaacctctggctcctgggttccagcgattcttctgcctcagtatcccaagtagctgagattgcaggcatgtgccaccatgctcggctaatttagtattttcagtggagacagtttccccatgttggtcaggctggtctcgaactcctgacctcaggtgatctactcactttggcccctcagggtgctgggattacggacgtaaggcagcaaacccaggcaggccttccttcttaatacattgcaacacggtctctca

SEQ ID NO: 648226 - DNA, 155 bp, Homo sapiens
tggagtccaggatccacagctcgtaaaccaggtcaatgaatgtatttctttataagctagctgtactctagaaatagcttctgaaaactggttaccccataatttataaatattctaatcatgttagcagattttataggttctttgagcttgtg

SEQ ID NO: 648227 - DNA, 418 bp, Homo sapiens
  misc_feature (418)..(418): n is a, c, g, or t
agaagtcctgtcacacggcactaggccggggctttgcttgggacatactgataggctaactttactgagacttacctgagccacgtaaacctcttgagaaagcaggggccaatttctgctcgggcagctgtgccccttgtgcggatgggaacggactatactgcagctgtgtgaactgtgttcagagtgaggctgattcacccttaaccaatacttcggctactagggagcctacaagtgtctgcaggatgatgctgtggatgaggcctatggcaagcactagactatatttgagaacttggccaaggctgacagggaccagtatgagctgctctgcttggacaacaccctgaagccggtagatgaatacaaggactggcacttgtgccaggtcccttctcataccgtcgtggccggn

SEQ ID NO: 648228 - DNA, 595 bp, Homo sapiens
  misc_feature (329)..(329): n is a, c, g, or t
  misc_feature (343)..(343): n is a, c, g, or t
  misc_feature (355)..(355): n is a, c, g, or t
  misc_feature (371)..(371): n is a, c, g, or t
  misc_feature (404)..(404): n is a, c, g, or t
acgatggctggaatggctgggcagtgtgagaatatcctagtgagtgagtcgtgactgaatacctgggttcgtggagtaatctgctactgacgtgagcatgcttaagtgatggctagcgtgtgatgtataaaggcagggtgagcgataatggctcctgagcataatccactgagaaacctcccacctccccaaagtaacaatttgctgtaccccaagggacagacaaggacgaaccgacattctgctctaggcgtgccggacacctgtgattaccacgcaggaggccgacaacagttgcatctatgtcagcaagatcacgcacgaagtgnacgaactgacccanattatcgccgangtgtccaggaccccangttgccgcggaccgaggaccacccgtgccaaangtgcggccacaaggaggctgtgtcttccagtcacacagtgcgcgcgccggaggacggccatgcgcctttactacgtgtgcacaagcccaacaatgcggcaccgtggaccgagtgacctctctatcccccgagtgttacttaaacaccaagatttccacgaaaaacaacctacgcaaacgtccaacaacaac

SEQ ID NO: 648229 - DNA, 140 bp, Homo sapiens
caagtgagcgaaatcaggtagacacttgagtaggggcaggtggcagcaccaggtctctgatagccttcccttggcccatcaggctgaaacacggccttcccaggcagctgctggcagggaaggccgtgtttcagccctga

SEQ ID NO: 648230 - DNA, 545 bp, Homo sapiens
ccactcagtcctcctaagtagctatgactacggtctgtgcaacatgtctggctaatctttttattattggtccaggcgaggttgccctgtgtcgcccaggtcggtcttgaacctcttggctcctgtcatatctctgcctatggcctgcgcacggtgctcgaattcatgccgctcaccatccacacggctgagctcatacatcaagccgttagcgtgtggcccaagatccccaccataaatcacatcattagcatgaaccagtcgcagtagtgatcccagactcccagatcagctaccaggcaggatattccaagggcttatatattaatgcccaggagccgaggataacgggcccgatctttctttgggcgccggttaagcctttactgcatagccagaccacacagaatggtgtgggccaccagagaattctggtaaaaatatggcctctggcctttagcttctaaatctctgtatccgtcagatctctgtggttaccagaaacagccatctgaccctggtcaccagaggctgcaattcaggcc

SEQ ID NO: 648231 - DNA, 252 bp, Homo sapiens
gaggaaagcctctctgcagttgagatggaggatggccactatctcctgcttgcccctgggaactgaatgtctcggtgtaaacccgattgtacatttgttcaagtctgagctaggagagaagctgtcctgtggcgggaggcgagacatgttgcagtaacgctgccttgccattctttactccactgagatgtttgggtggagagaatcataaatccttggcgcctacgtgcaagtccagtcatagtaccttcc

SEQ ID NO: 648232 - DNA, 180 bp, Homo sapiens
acgagggatgcggacaacaatcttctgactgagaaggagaagctgtgtgtgaagaagatccatgagaatgagaatgcgcctggaggcaggagacctaccccgtgaagctgctggtccagctgagcgaacttgcagtgtacagggaagatgtacatgtaatagttcttctcgaagtcccgg

SEQ ID NO: 648233 - DNA, 373 bp, Homo sapiens
aaagattttcaaaaacaaccccagattgtttgccgggttcccccagaaaaattgcggcttctctaacacactaaaaaggcttgtagttgcttgttagcaaaatggataacacacatctctgatacttttttcattatggggggggcggaacaaaaaaaaaacttggtcttctttttttctttgaaaaaggagccggccccctgggggaggtaacacaacctctcccagcgggggacaccgggtgccccttcatgtacacccggggggggcgggctaaaaatgtaattattcttgtaaatatacccctagtaatttaagattttgtttttaaactggaaaaaaaagattgtatagtgcatgttttttaaagtca

SEQ ID NO: 648234 - DNA, 188 bp, Homo sapiens
tgcggcaccggttcgaactgacggccgagcgcgctcatcggtttcccgctctggaccatgacagccagcacctgcagggcggcgatcaggccgtcgccggtggtcgagaagtccgacaggatcaggtggcccgactgttcgccgccgacattgaagccgccctcgcgcatgcgctgcatgacgtagcg

SEQ ID NO: 648235 - DNA, 399 bp, Homo sapiens
tgctctgagcacactgtggtctctataggaccctttgcagtcccttgggcatgagattccaaccacggatttccgaatgttatctctggctctcccaatgtcacggaggcccacgctggtaccgagttcctaacggtcggcactactgacagggccgtacaagtgccagcaagtgtccttattgcgcagtgcatatatgaaccttgtccaccgatctcgtatcatgtgctataacgtttgtagcccttctgaactccataccaaaataggtatagtcagcctgttatgacaagagggccctggcaacataccagtccagcagtctcatagtgctgtgagcatagcaagatccacatgcaccatctgatatggtcactcacacatgtagccccaaagccc

SEQ ID NO: 648236 - DNA, 429 bp, Homo sapiens
  misc_feature (103)..(103): n is a, c, g, or t
  misc_feature (112)..(112): n is a, c, g, or t
  misc_feature (289)..(289): n is a, c, g, or t
  misc_feature (299)..(299): n is a, c, g, or t
  misc_feature (337)..(337): n is a, c, g, or t
  misc_feature (346)..(346): n is a, c, g, or t
agagactgcgcccagccagtattgattggctgctggatgggctcgggcgcacgtacatgcgcaggtcggcgtagtgctcactcatggtcgcctctcaggcaancgggtgcangggactgtcgatggccttgaggccgtgacggctgatcaactggccgtagccatgcaccaggaaaccaccgctgcgcgccagccactgctcgcgccgggcacggtacaccctgggcagcaggtatcacggcaactttggcagatcgtggtgcaccaggtgccagattgttgttgaganacagccaggnccagggccaggatgcttcgttgagcactgtgcgctgtnccggccgangatgggggcggtgctcatagtaggaacggatcgaggccaggcacaaggctggcacgttgaccagcagcaggtagtgccacacc

SEQ ID NO: 648237 - DNA, 105 bp, Homo sapiens
  misc_feature (13)..(13): n is a, c, g, or t
aatgttaacactncggtcgaaggttcacccagcccacgacggaaaaacctcctctactggctggggctctgagagcgcccacccgcataaaccctgggtaccttt

SEQ ID NO: 648238 - DNA, 842 bp, Homo sapiens
acacgcgcgcacgggattctgctccgctccgcggctcccccgccccgtagagctccgcgatcagcacccgggacagcgccaccgcccacgtgcagggggtggggtccgggtcggggctggcgcctcggcgtctcccgtggagtgtcccgtccgacgccgcgtagcatgggtgcttgagtgtctctgcagaaaagactctaggaccccgccaccatgttcccggagcccctaatccccggggccttcctatctgcccgacgactgcgtcccgactccagtcgcatcagccacggtccagtgcccaccgctgggccctgtgcacagcaatctgtgctaggtcttcaagagctctcgctctatcattcaagtctgcgtgtgtcgtgtctcataccggaagagctgtcaggaggctggacaggtcaagaagaagccgagggcccaatgcccaggtccaccttcaggacagtgaacggggctgggccatgagttagcataggacctaacggtgctacgctcagaacgtatgatggaacgctggaggcctacgtcactcactcacggcgcccagggcacgcatgtgttggcaagacaacgcatgaagctagggacgacgtgcagtagtcccgtggacttatgacgttccatgagtggccgagctgctggtgggcattctggctaatgctaattgggattggcagccttggatcttggtggctcctcggaccccatatgtgcgggtctacctgctgccggatcaaacggaggcggtactgagaccaacgtgcatcggtagtaagcttgaagcctcactttggggagaccttcgccttcaaggtacccta

SEQ ID NO: 648239 - DNA, 691 bp, Homo sapiens
  misc_feature (456)..(456): n is a, c, g, or t
tctctctttctttcacggcagcgacacacgctctcgccgccgccatgactgagcagatgacccttcggggcaccctcaagggccacaagggtggggtaacccagaatcgctactaccccgagttcccggacatgatcctctcgcgcctctgcgagataagaccatcatcagtggtggaaacgtgaccagggtatgagacgcaactatgtggaatttcccacaggcgtgtgttcgtggcggggttcacctccccacttgtgttaggtgagtggtggttatctcctcagagtggccagttggccctctcaggctccgtgggagtggaacccgtgcgcctcgtgggatctcacaaggggcaccaccacgaggcgattgggtgggccaataccagggagtgtgctgaggtggggccttctcctcgacaaccggaaggtccgggatctcgagataaaccancaagctagggaaaaccgggggggggtgcaatacccggccaggatgagagccactcagagggggggtctggggtccggttctcgcccaaaaggagaaccctataatcgtctccgggggcggggacaagcgggtcaaggttatggaaccgtggtaacggcaagctgaagaccaaccacttgtggcacacaggctatctgaacacggggactgtcctctccagatggatcctctgggc

SEQ ID NO: 648240 - DNA, 137 bp, Homo sapiens
ctctagaggcatcccctcgtttatcatcggcacctcgctattcatcggcaccattagctctagaggtccatgcatacttaatattaaacttgaatacaatacgggtgccgataaatagcgaggtgccgatcaatgga

SEQ ID NO: 648241 - DNA, 699 bp, Homo sapiens
taaaggttggagggggaatgctggaaatggtaatgggtatggagacatatcatataagtaatgctagggtgagtggtaggaagttttttcataggaggtgtatgagtgggtcgtagcggaatcgggggtatgctgttcgaattcataaaaacagggaggttaaaagtagggtctgggtgacaaaatattgttggtgtaagagttcagggtgaagagtgcgtcatatgttggtccctaggaagattggtagtgggtgagggtgtttattataataatgtaggtgtatctacggctatgaaaaatagggcagaaggggcctgcgaggtatccagatgttgaacgcctgagactagttcggaccccccttcggcaaggtcagaagggggtccggtgggtctcggctagcgggggagataaatcatataatgggccaagggtcatagagggcaggagtaatcaggaggtgtcctggtggctggtgacaaaggcgtgcgacagaggtcaactggagccacttattcagcacatggttgggatcacgcaaaaagcgagggctaagggggactcccatcatgaaatggtcggggcaactcgctcgcagtggcgccgatcaggcccgacagttggagttcggaggcccacccggatccagcaggctccggagctaaccacggctaggccaaaaggggggtcagaata

SEQ ID NO: 648242 - DNA, 228 bp, Homo sapiens
ataagaaaaaagaaaaaaaaaaaatcactgattgcaggtcaccctaacagatataataatgaaaaagtctgagatgttgcgagaattaccaaaatgtgatgcagacacgaaatgagcatgtgctgttggaaaagtggaacagatagacttgctggagacagggttgccacaaagtttcaatttgtaaaaaatgtgatatctatgaaatgcaataaagtgaagtccaat

SEQ ID NO: 648243 - DNA, 90 bp, Homo sapiens
atagagaaagaaaactcaccttgcagagcgccaagtcccgagtggccttctttgaagagctctagcaggtgacccagccaccccaggacc

SEQ ID NO: 648244 - DNA, 339 bp, Homo sapiens
tttttaaaaaggggttttttgggcccacccccccggtggccggcaaacccggtggggtttttccttgtttaaaaagccccccggaaaaagggccgtatttagggttttttttttgcctcccccaaaaatgggtggtttggattaagcacgtttgggccctggggtataccccctgggtatttaaacccccgggggttttggggagggtaacccccctttttatgggccggggtttccccgggtgtaaggggggccgccccccccccccccccccccccccctttttttggggggggtaaaccggttttgggtggccataaacccctgggaaatttttta

SEQ ID NO: 648245 - DNA, 108 bp, Homo sapiens
caaaagcacctttttgaggtgaggtttagggggagcctccaaaaaagagccattggggccttttaggtataaccccattttttccctcccactcagggaggcctatca

SEQ ID NO: 648246 - DNA, 740 bp, Homo sapiens
  misc_feature (260)..(261): n is a, c, g, or t
  misc_feature (267)..(268): n is a, c, g, or t
  misc_feature (352)..(352): n is a, c, g, or t
  misc_feature (357)..(357): n is a, c, g, or t
  misc_feature (603)..(603): n is a, c, g, or t
gttggccaggctggtcttgaactcttgacctcatgtgatccacctgtctcggcctcccaaggtgttgggattataggtgcctagcccatggtgcctagccctaacctacatttataaactatcacttgctgctgtgtggagactatattgtgagattaacagcagggatacctgctaggaagcaattgctgcagattgcctgagacaaaatagttatcatggactatggggatggtgttggtggtggtgtaggtggtttnnaattannatatattttgaagataggtaaatggtgcaagattatgggtcagttttaaatgctgaagtaaatattttttgtaagacattttangatgncatgttgagaatatctttataactgtattttaaaaaaaaccacatattttctaagcataaattcccatagtaacatcactatgtcaaaggctatgaacatttgaatgactctagataaatactgtaattgctctcccaaaatatgtgcttataatgtcaccgaaaggtgtgatcctgttacattcaggctggccagatagtcatttattttgaaaaatttttacttgtagatggaaaaatatattntaaccgggagtggggggccatggggaaaacctccctcattaatatttattgggaggtgttaagatacctttttatcggagttcctaggcccaatagaaccctggacccttgtcctattgttacttttgaggtgtctt

SEQ ID NO: 648247 - DNA, 401 bp, Homo sapiens
ctccaggagtctctatgagcaagttgtcgcggcttccattctgggacatttcatcaactggcgagcgatgagcaggcagtgagtaatgaaggaggccaggacgattatagccaaagacagagatgcgatttcgggacatcaaaagggaccagcgtatactgaagacacagcagttggtgatggctggaacttttcgagggcagaacagtacccctctcttcttatgatcttcttcctgcctcattcagcccccatgcacgtagacttggtccgttcagaaggacacctgcatcctcagggcttggatggacttgaacatgtctttttctcagaacttcatctccaagcccgtaattaatgagtgaggctgttaacctgtacacttacctatttcacaatcg

SEQ ID NO: 648248 - DNA, 159 bp, Homo sapiens
  misc_feature (153)..(156): n is a, c, g, or t
gcggccgcctactactactactgctcgaattcaagcttctaacgatgtacggggacatgcgctggttccagcagaagtatgatgggatcatccttcctggcaaataaattcccgtttctatccaaaagagcaataaaaagttttcagtgaagnnnnaaa

SEQ ID NO: 648249 - DNA, 429 bp, Homo sapiens
  misc_feature (208)..(208): n is a, c, g, or t
  misc_feature (237)..(237): n is a, c, g, or t
  misc_feature (244)..(244): n is a, c, g, or t
  misc_feature (271)..(271): n is a, c, g, or t
  misc_feature (289)..(289): n is a, c, g, or t
  misc_feature (299)..(300): n is a, c, g, or t
  misc_feature (307)..(307): n is a, c, g, or t
  misc_feature (318)..(318): n is a, c, g, or t
  misc_feature (423)..(426): n is a, c, g, or t
tccaaaggtagatacacggtcagatcctgtggcatccggagaaatagaagaattgctgtcccctgcgcagttcgaggggccaaggcagaagaaatcttgtagaagggtctaaaggtgcgggagtatgagttaagaaaaaacaacttttcagatactgggaactttggttttgggatccaggaacacatcgatttggggatcaaatatnacccaagcattggtattacggctggattnttgtggngctggtaggccaggttcagcatcgagncagaagcgcaggacaggngcattgggcnnaacacanaatcagcaaanaggaggccatgcgctggttccagcagaagtatgatgggatcatccttcctggcaaataaattcccgtttctatccaaaagagcaataaaaagttttcagtgaagnnnnaaa

SEQ ID NO: 648250 - DNA, 141 bp, Homo sapiens
gctcgactctaacaggatcccccatcacgcagcgtaaaaggctcccccgaaacacacgcaggttcagattccacataacacatagtctttaaggaaccaccatttgttgagttttagtgtagtatcaaagaagactatact

SEQ ID NO: 648251 - DNA, 356 bp, Homo sapiens
aaaatatccccccagaaacaatccaaaaattaccaaaagtttcccccagagccttatataccctcctaagcctatatgtcctatgtgtaccgtgtgcattccatcctaaagacataagtaaagtgattaacttcttcctaatcctataactaagatcctgaagtccctgaaggccttcccttggagccttcgtaaattcatttaatctaaatgggtgaaggtgctggggtgattacccttatcttgtgtcctgctaaatcacagggttttggggagttcctttagtccccagtaaagcttgtttgtgaaggtctggggagttccttaagatccacaataaaacttgtttaatccta

SEQ ID NO: 648252 - DNA, 612 bp, Homo sapiens
  misc_feature (612)..(612): n is a, c, g, or t
ctatgcttattacctgtgtgatgaaataatctgtatatctttcccccttgagagggcagtccactctacatttcaaatatgtacacataccccgtacctaatctaaacgtttttttttacattttaattgcacctttttcccaaggggcaaaatcctttgagaggcgcttctttagctgctaattgacaatgcacttggaaaagctccctaatgtgggccccgggggggggcgatttatatcccaaatttggaaatttctttcggcttaaacaaaaagccccccccaagggcttgattttggtgaaacttgacttcacggcaacaaaaggtttgagatttctatttaagcttaaatgacgacacctcttgggggtcaaaaaatggagatacaccggggggttcatttcctgaataaaatatttgaccttttacaagaaaggcgcccaggaaggggggaggcccttttgagacgggccaaatgtaaaaataccccgggggggggccctcccacttttattggccttaaaaaaaaaacctgggggggaaaacactttcgtgtaaaggcccaaaataaacttgggtgtggggcccaccctgttagcggctgcaan

SEQ ID NO: 648253 - DNA, 1027 bp, Homo sapiens
ggatacgggagttcctccttgctctcgcccctactctttctggtgttagatcgagcaacccgtcgtaaaagcagtttagagtggtaaaaacaaaaaaagaaagacacaccaaaaggctcggagccaacaaaggggttgaaatttcttcgggacaatccttcctgggttcttccgggtaacgggtcggctggcgtcccgtagagtccttcggggaaggcttttatattcctaaggagggcggaaaatcaggtcaccgggcggaaatcggggctggataacagggagctggggcattgggaattggggaagactggacttggcgctatggaattgggctaaagtcttaaagagcaagctgggttctctggggatataaataaggcttgggatctgggagggaaacaagttggccaaatggcaaggggatctggggtggccaagggttgcatacctttgggggtagactggcagaacccggagaaagaatatttacacgagctcgtgcgaaagcacagggtgcagggccaggaaaatgggcagaagtgctgagactactattacagtaaaagtaagggccggggtggaaaggtcttatacattccagcagttgggttgggctaacaacagagaagtccttgaagaatgttggacaagagaagcctttttgagagagggttaaagtggggcgattgttgggacccaatttttcgtggggagcattaaccagaaagggggcatttggattttcgcctgggaggaatggggacagaaaagaaaataaaacccaatggggtcccacataatttgcgtccaccacctgtggtggggacatatacggaggaaaggtcttgggacacattgtgtcctccgggggtccctcgctttttcttaaacctgggggcttaaccgggtgtaacaaacgcacaaagtgttatggggtggaggtagtggggaactttccattgaacaagttcttggcaccggagttggacattggggctgggctcattaaacacaatatattgga

SEQ ID NO: 648254 - DNA, 251 bp, Homo sapiens
  misc_feature (14)..(14): n is a, c, g, or t
  misc_feature (44)..(44): n is a, c, g, or t
  misc_feature (68)..(68): n is a, c, g, or t
  misc_feature (153)..(153): n is a, c, g, or t
  misc_feature (185)..(185): n is a, c, g, or t
  misc_feature (208)..(208): n is a, c, g, or t
  misc_feature (237)..(237): n is a, c, g, or t
ccgagatgcgggtnacggcgccccgaaccgtcctcctgctgctntcgggagccctggccctgaccganacctgggccggtaagtgcggggtcggcagggaaatggcctctttggggaggagcgaggggaccgcagcgggggcgcaggacccgnggagccgcgccgggaggagggtcgggcgggtntaagcccctcctcgcccccaggntcccactccatgaggtatttttacaccgncatgtcccggtccg

SEQ ID NO: 648255 - DNA, 948 bp, Homo sapiens
attctctcatagttatagatgcctggaaatctacaactcaagggtgctagatcgtattagggttccttctgcaggactctgaggatctgttctatgccttaattcctaacctctgttaacagcgtggcagtccttggcattccatggcttttacatacaccattccaatctctgcctccatcttcacattgcaattctcgcgtgtgtatctctgtgctatgtcattacatcagggacaccagtcaggtcacgcatgggggatacccttggttgacctcatcttacacttgactgatattctggccatgacccctgtggtcccaaagtaaggtcacatttaccggtaccatgggggttcacgtgcactttcagcatatcttattcaggggcatacagttcaagcccataataccctgtacacactgactctggtctacttatcatcggcaattgccctttgtatactttaagtgggccagttcacaatgcgactgtaatctaactattacatttcgggacgatcagagttctgccgctcctagatagagccacaggctatccacgtcgcacttgtttagtgatctccaggctacacttggcagatccttccgatgtccttttgacggttacactgaccgcgaagtatacttgtgttgccccttcatagtgcgttcgtagaaagggcaacgattcgggggcaattatcactggggctctattgtttgcgtccctacccacatgtggtctccgggggcaaaacacattgattatgttttatgtattgttatagtgtgagaggtgcatatgttcataatcgtatctcataccgcctacgcggggtcctttctaaaacactatgtcttggtagtgctacccccgagatgaggttggggacgcttagttgagaaaccacctgcattgagtactattaacaacagatgatacaca

SEQ ID NO: 648256 - DNA, 454 bp, Homo sapiens
  misc_feature (23)..(23): n is a, c, g, or t
  misc_feature (29)..(29): n is a, c, g, or t
  misc_feature (52)..(52): n is a, c, g, or t
  misc_feature (259)..(259): n is a, c, g, or t
  misc_feature (348)..(348): n is a, c, g, or t
  misc_feature (371)..(371): n is a, c, g, or t
  misc_feature (424)..(424): n is a, c, g, or t
  misc_feature (439)..(439): n is a, c, g, or t
actctacaagggcaaaccagggnaagacnggatactcaaaggaaggttgacngatgagttttgggaggcttatcatcttggaggctgtattagtccattttcacactgctggtaaacacatacccaagactgggtaatttataaagaaaaagaggtttagtggactcacagttccacgtggctgggcagacctcacaatcatggaagaaggcaaggaggagcgaaggcatgtcttacatgacatcaggcaaaaggattngtgcaggggtacttccatttataaaaccatcaaatctcatgcgacttattcattaccacgagaacagtatggggggaaactgcccccgngattcaatgatctccaccctggncccaccctgggattcatggggggttattacaattcaagggtggagatttgggntggggaacagtcaanccatttcagggggcc

SEQ ID NO: 648257 - DNA, 556 bp, Homo sapiens
gcaggattaaaggggagccaagtgctactatccaagacaatagggaaaaagccttgaaagcatttcaaagaacttcagagtggcttctcccatcacaggcccagaagcttaggaggagagaatagattcatggactgggcccagggccatggtaccttgcacagccttgggacactgctcaccacatcctagctgctcctgttcccactcttgccatggctcaaaggggcctacatacagcttggactgccactttggagaatgcaaacagtaaaccttggtagctttcatgtggtgttaagcctgcaggcacacaaagtgcaagaatcgtggattcttggcagcctctgcctagatttcagaggacatatggaaaagtctgtttgtccaggcagaagcctgttacaggggtggagcccttacaaagaacctctactagggcagtatagaggggaaatgtggggttggggcttcaacaagggcaccgcttgggcactgactaatgaactatacgaagtgggcactggcctccaaacctaaggatgatagaactacc

SEQ ID NO: 648258 - DNA, 1183 bp, Homo sapiens
  misc_feature (927)..(927): n is a, c, g, or t
ctttatggggcacacaatagtaaacaagaggttgtcacaaaatagaatgggtgttgttacaccgttccgggaatatttcccggagagattttcggtcgtaatcaacagggttgtcgggagctaaaactatactaaagggggggcttttcttctatataaggggggcacaaagtcggagagcctttaggagggatattctcttctagaattaaagtcgtgtggttgtcgtgccttctgcacaatgggtatgggaggtttttgagtcccggcgttgtagcggtgtgagagaaaagtagtaggggccaaattaagggtgtatcgtagagggagtattgttgggctgtacgcccgtgtaaagttgtggtgagaaaacgggggaaatgtcttagaatataggccttaaagaggtgtgttgaaaagaggagagaaattattggggagaatctttatgaaagaaggttaggcaatggagagtaaagaggaataaggaatttagaagagtgttttctttgaaaagcatgtgcacggggagagtttggaagaatttgataagactttctttttcactgtggaaatctaataccaaaaggtgatattttagaaaagaggaaattttgtagagagatacaaagggtcttaccagaagccccccggaatattaatatcccagatatagaaaggcgccacaaggtggttatgagagagtatgcacagaatagtgatagagtggcacttttcacacacagcgcgttgaaaagattgtcgtagcttctctgcaagagattgttaagagtggtatttaaataatttgaaggagcgcggatcttttttataaagagagagatttaaccggaagagtggacttatataagagacccttgtgataatccgatgtgacgccagagggagaacattggggctctcatnttgaagaccttagagttaacagcattttacttaaccccagaacgcaaaatggtgtatagaattgtaattggggagatggttagagtatcgcacacacccaacttggtagaaagaattagagaagattttgaagagggttataactgggaagcaccaggaagattacgggtcaggcgcaagaaaaggattgaggagataggggaattaaaaaataaaaacatacttttagaagaaaaaagataaaatttaaacatga

SEQ ID NO: 648259 - DNA, 497 bp, Homo sapiens
cgcggtggctcacgcctgtaatcccagctctcagggaggctaagaggcgggaggatagcttgagcccaggagttcgagacctgcctgggcaatatagcagagacccgttctcataaaaaaaaaaaaaaaaaaaaaaaaaaaaaatttggttgggcgggccttgggcccttgagaaaaagtttttataaacacaatttggttgtgggggggggggcccaaaggatagagtataagtgaaaagattgggctcatatacggctgggttctccagagaaaagaagctcgggggcgccatgggaaaaagaggggcgtggaattctcttcaaccaaatataaaaaaaaggccgcgggggggcagaacggagaagggttttgtaacaacaaatctccaggaagtgggagcttaggggagggccaacaaagggggagattctatttccaacggggtgattctcaaagggaagcttggaatatatcaatttagcgccgccccgtga

SEQ ID NO: 648260 - DNA, 1816 bp, Homo sapiens
  misc_feature (523)..(523): n is a, c, g, or t
  misc_feature (629)..(629): n is a, c, g, or t
  misc_feature (1213)..(1213): n is a, c, g, or t
  misc_feature (1367)..(1367): n is a, c, g, or t
ttatgatctgccgatctagcactgctgctgttcggtgtgctgctgaacgaccactttcttgtcttctagcacctgccagtttgtgtgctagtttgttaggagcgcgtcccgccgacgctagcctgttgtttgcgccccccgcgtgtgggccgcccccctctttgactaccctcacccttttgttttttctgttgcgggccgccccggcgtttgtatttagtttggttgcactcaccgcgcgtggttcggcgatatttgctctcccgcccggttgtggggtcgctcgttgtgtttgtcccccgcggggttatatgttgcccccctcttgtgtggaaatacatcatcagcgtgctgtgctccgttgccattcatagatgtctgtcccagcgtgggcggcttcctcacacgggcggttttctattatctcggtgtgggcggcccccaccgccgcccaaatgtttgtgtttctccacgcctgtggggacaatttttgctccctgttgtgtgcctccatacccgggcncgatacgattttgttgtgctagcccactgtcgctggcggtgtccgagccaagcatgtgttcctgtgtcggcgccgaatggttcctctccctcactccccgggggcnggtttcctaatatgcgtgtattttttctatgcgctgtggatcgctgctgcgcccacagcgccactttcgcccagccgggtgaagccccctaattacgttgggagaagttggggtgtttctctgcccttgaccacagtgtggcccttctttgtggaaggcccccccctttgggggaggtctgccagatggctgtgtttgcctctgtgtgtgcccccagcccgcttattagtggttgggtcccctgagtgacctcggggggccattctggtgtaatgttttacgccgcgccatgaaccttggcacgtccacccgtgttgggagacacacttccgggtgtacctattacagcccggagaccacagccgctgatcattattaccgctctggtgtattgccccacaccaccggtttccccccccgtatgttggttgcccgctttttccccaccttatgggaggtctcttgtgtattttttggccgcacctcccacttattgtgagggagcctcttcacgatgtccacaccgtggaggtgtcttctgcgcccctatgtgttgtttacagcaggggcgttattcaccccgnccttattgagcgcgctctagtagacgctttattctggccgcccacaaggagtccgcacctctgtccaacactatatgcagatagatgtttcactccggcggccgctataatttctaacactctttgcgttttcccacacgcacaacacactctntttctttcgcggcctatttttccgcgagtaaatgtccccccggatacgcttatatctccgcgagactataccccccgagattgcactataccacccacacatgtgaaccactccgctatctaatcttgttaaggcctccactctcccatttcttctgtataccacgccacgttaatattataataaattttccaatgagatttgtaagaaagccacttctccattctcgaaagccgagtaaaagtctcctataatatgtatgagagaaaccctccactataaacctggaggtgagactaataatggagtgccccccacccctatccaccaccacattcgaagaaacccggagtaacatataaattctatgaccaaaaaaggaaaggaaatcgaaacccccccaaagctggtttcataaccaaccccatggcctccatgacatttttcca

SEQ ID NO: 648261 - DNA, 464 bp, Homo sapiens
gcataggcgcgtacggtggtggtgacacctgtagttccacggaggcaggagaatcccttgaacccagggtggcagcctcagttttcccgtttccttgacgcaggcctagcttctctaaagattttgaaaaggctcctttattttttattttttgagacagggtctcactctgttacccagactagagtgcaatggcacgatcttggctcactgcaacctccacctcccaggctcaagtgattcttaatctgcttcagccttccgagtagctgggactacaggcgcccaccaccacgcctggctaatttttttttaaatatttttagtagagacggggtttcaccgtgttaaccaggatggtctcgatctcctgacctcgtgatccacccgcctcagcttcccaaagtgctgggattacaggcgtgagccaccgcgcccggccagaactttcacatcgaatggtc

SEQ ID NO: 648262 - DNA, 266 bp, Homo sapiens
gacttgaggacccctatcacttctgctgcgtgcgtcgggcgcgtacggtctgctccaccatccagacgatgtcgctggtcagagtggcgcattctgctacttcgtgtgagcgctggtgcccactggcagtgcgaactggttggcgaagtcggcgccggggtaagcagcgccttgtactgcgtttcgttgtcggtgtagtcgccgacaaaacgctggccgggtgccaggttgacctgctcggccaccagcttctgctcgtagaaagc

SEQ ID NO: 648263 - DNA, 831 bp, Homo sapiens
ggctcagcccccctgcacgcagccggagctagcagtctaaaggcctgaggcttcgtggtgtcctggtgacggggcgggtatgaacccgggggtcgtccatgcgagtccggctcacactcgtagtagggtccctcgagtcaagcgccctgttgaggtgggtcgcattgcgggtagacattgcgacgacgacaagcaccgaacacgaggccaaagttgtcacaagtggttgggaacccaacaattgggcctggaaattccaaagagcggctttcggagggcacccctagaatgacctgcaccattcgtcaggacagccacccacccagtgttatattctgtctcgccggagtgggtgttcccgggggcactgtgccgacagtcccttgctgtccccaggtttgcagctctcccctgggccactaacgcagtccgtggcgccgggctgccttgtcatgacgtccgtgccgtagtcgtggctctccatcttgtctcctccccgtgtccgcgaatgtcttcaggtggggggcccctcttgggtccccgtccggtctgccgatcacctgaagaccccacgcgaaacacatgaatgtcgaccgtgtggcttgcacgatctcggtccaccttggcggcccgtgttggactcagatcagacgtccttttagcagctaatatttccgggaaaatccccatgggttgaggtgtagtcttgtaacctttgtcaacggcttgacggatccccaattagaggcattaaacagtcacacagaacaacaaggcaaaaaagctccgggggacattatgtcgggggcgggaaacaaggcgcatggcagg

SEQ ID NO: 648264 - DNA, 320 bp, Homo sapiens
  misc_feature (14)..(15): n is a, c, g, or t
  misc_feature (45)..(45): n is a, c, g, or t
  misc_feature (49)..(49): n is a, c, g, or t
  misc_feature (75)..(75): n is a, c, g, or t
  misc_feature (83)..(83): n is a, c, g, or t
  misc_feature (89)..(89): n is a, c, g, or t
  misc_feature (97)..(97): n is a, c, g, or t
  misc_feature (137)..(137): n is a, c, g, or t
  misc_feature (145)..(146): n is a, c, g, or t
  misc_feature (150)..(150): n is a, c, g, or t
  misc_feature (161)..(163): n is a, c, g, or t
  misc_feature (177)..(177): n is a, c, g, or t
  misc_feature (187)..(187): n is a, c, g, or t
  misc_feature (209)..(209): n is a, c, g, or t
  misc_feature (216)..(216): n is a, c, g, or t
  misc_feature (238)..(238): n is a, c, g, or t
  misc_feature (245)..(245): n is a, c, g, or t
  misc_feature (252)..(252): n is a, c, g, or t
  misc_feature (255)..(255): n is a, c, g, or t
  misc_feature (263)..(263): n is a, c, g, or t
  misc_feature (268)..(268): n is a, c, g, or t
  misc_feature (282)..(282): n is a, c, g, or t
  misc_feature (290)..(291): n is a, c, g, or t
  misc_feature (294)..(294): n is a, c, g, or t
  misc_feature (312)..(312): n is a, c, g, or t
gattagccgtgtanntcctgcaatgaatgtttatgtgattgaagnaaangtgaagcgtattattttaaaaagtgncagagtgncttaantgagcatncatgagccctcatccctgaaagtgagtttatgtagtcagnttacttannttantcattagctannnttgtctatgtatanttctagatantgattagtgtaagcgattatanaggatanttatcaaggccagggattgcantttcaangtataantantttctttnctgangtattcatttaaancatacaannaancatagtttaaacagtcantttaccac

SEQ ID NO: 648265 - DNA, 232 bp, Homo sapiens
gatacaatacacgtgagatttggatggggacacagagccaaaacataacagcagcaatagtaaactcatacatcatatctatacatctctcctgaaccatccctgctagactcagtaggacctgtagagaccatctttccctgtattccttcaacatcctgcttccttatcatatgtttctaaggttgtatagttccatgagagattacagctactcgggaggcagaggcag

SEQ ID NO: 648266 - DNA, 136 bp, Homo sapiens
gcagagagaggctttctccttatggtcaacgaggctaaggacctcaggctgcttctcattcctctgactcctggaatacttcgttactagagcggtctcactatccagaactcctggcaagaatggcagaagctct

SEQ ID NO: 648267 - DNA, 1182 bp, Homo sapiens
tgttaatctagcgtgaacaacacgattgcttatagaatattagtaagtatcatatggtggatagatttagatgaagctttaaaagctattagagacatccagctatgctaagataaatgtcttaggaggttcctttgctgatcagaagatctgccaaggatgcccacataggtacgaatgtgaagaatcttttacgaccctaaacgtagacattagaaatcaccaaaatcttcttgattcttcggcaacagctatgtcaaaggagatttactaccacagtgtgcaaatgcatatcatagtgacccacatgcaataacaccggttgactaccgtaaagcgcttgctgattacaaaaattacctcctgtccttgcctcactaccaacctaaacagccgatccgacctatgactgggcacatcagaatgtgcaatcaaagatatcaacgatcacatactgaaataccctcgagaagctggccaatggacaaccatatacacaacatgaccaggtgcttacacacatgcctgcgctactgggatcatgtcacaacccacgatagctcagatcgatacacaaagcgctgagtcactcctgacaactgcacgacaagcagtgaaagccataaaacactatccgaactcgatgatagtgctacgtccataacaaaaagagtaatcacacgacaacactaacgctcaacacattaatacatcctcatatctccatcccacaagagaaatgatatgaaaatggtcgcgacgcaacttgacttgacaaataccactaaacacgacctcacaataacacacaccgacacgacggacaccagctgcagcgacggcgactgataaaaaacctcgtacacccaagtactcaagaaagtactagcaaaccagacccaaagcagagagacaacacacagcaaaaaaaccaaaacgccaacccaagagaaacataagatgagcgctagggagcacggcagaagtggtcgcagaaaaagcaaagagaatgtgacatgaggggcgcgccggggaggaagaccgtgtcgcagacccgaacatggaggagagagtgtatgaatagaggcgaagaaaagaggcacggagagagtgcgagacagagacggccgtcggaccccgagaacccagcctcaagtgcacactggggcgcatcacggggaa

SEQ ID NO: 648268 - DNA, 1070 bp, Homo sapiens
ggccatgcatggtgtgtctgaagctccctggaggctccagcttggcagcgttgacagtgacactgatggtgctgagctcccgactggctttcgctggggacacccagaccacgtttcttggacgctgcattaagtcatgagtgatcattatcttcaatgggacggagcgggtgcaggttcctggagagatacttccagtaaccaggaggagttcgtgcgcttcgacagcgacgtgggggaagtaccgggacggtgacaggcgctggggcggactgtcgccgagtcctggaacagaccagaaggacctccatggagcagaagcggggccaggtggacaattactgcagacacaaactacggggttgtggcgagcttcacagtgcagcggcgagtccatcctcaggtgactgtgtatcctgcaaagaaccagaccctgcagcaccacaacctccatggtctgttctgtgagctggtatctatccaggcagcacttgaagatcagagtgcgttccgaacatggccaggacagagaagactgcagtgagagtccacaagggcctgaatccataattggagaactggaccttacagaacctggtgatgctagaaaacagtacctcggagtggaagaggtcacacttgcacaagtgggcgcaccagacgtcaaagccctcatcaccagaggaactgggcgaggcacggtctgacatcttgccccgaagcagacatgctcactggcactccgaaggacaatgagctgggcctgatcatccttggagccggacgtgtatcaacgtgaaggaatagcaccggcccctctggaactacgagccagagggattcctgcgggttgaagtgtcccaggacaacggtaggcgaagcacgctgtgccacacgattgggcggcacacacgggaacccgaccggaaggacgcaacccacaaaagggcgcacaccgaacgagctggcactgtacagcgggcagaactacccggggtgacacgggaggcaggggagcaaccaataggggcggaaccacagggccgagacaccggcggcgatgacccgca

SEQ ID NO: 648269 - DNA, 103 bp, Homo sapiens
cccccccccccccccccccgggggggggggccaattttttttaatttttttgggggggttttcttttccccccggggtttaaacccccgggtttttttgttca

SEQ ID NO: 648270 - DNA, 342 bp, Homo sapiens
ttaaggatccagaagaatctgggcgacagacacggagtttatgtggcaggcgtggtctattgtggctcttcatctctctattcttgtcagtgcatgacgtgagccagtggagctggtgtctgtgggtgccaagggcagccaggctcttccctgcctggtgttttgggctccagaggacttacctacaaaatactccttggcaatgataattgtgggtcaggaatcttcttcctgtgtggcaggaggctgcggttgcctgtgacctgatgagctcatgttggctggtcccgtgtgtgaaagggactctctcggggaaaccaaggcccagcccctcccccctcc

SEQ ID NO: 648271 - DNA, 959 bp, Homo sapiens
  misc_feature (457)..(457): n is a, c, g, or t
  misc_feature (480)..(480): n is a, c, g, or t
agcggagttacgtccggagactggctgctggctgcggcggtggcggccggagctcgacccccagacggctgagggcgggcgggcgggcgcgggggcaagggagggggtgccaggtccagagacgacatccaccgaacggacgtattctccctaccgatgcgtggcagccgcggttacggcttggagggggtgcggggggtacaaggcgcaatcgcagtgatacactgtgggctggactagagaagagcgccgaaccaggaccagacagcaatgacatcttctagattccgtgccgagctccgacgaacgggtctattgaggagtagttcgctgtcattgctacttcaggaaacaggtgcgtgaccaagcgctttgtagaatgccatgcagtctggcccatttgtgatcggagaaggcgagacatctcgccatgagaaatcctgcagggatacagaantacgtacgaagacttgcgatggngcacaaacaagaagttgggtatcgaaaccatgtttttgcacgatctcacaacacgatgctccgcatagatgagaagtgaggaatggtttggaggacaatgttgaagaagccaggaacaaaacgtagataactcgtgcagaaagagagagaatgtgaaattaaggttctctcacagtgggtattacccgcgatgtaagaacattagctcaagtcccaacacggacacacacaacccactaacgtcaaccaaaagttctttggatcaactcagctgcgataagcggaatccccttcgcttgaccgttagaattgcgcagaaactcgaacgacacttagccccgttctttgggcgacaataattagccttatggggatccggaaaacgaaacccatggggggaaaacgcaaattccagtcagccccttctaaatggctcctaccgcgggtgagagacaatcacgctgttggagaccatgggc

SEQ ID NO: 648272 - DNA, 353 bp, Homo sapiens
aggtgacagaactctgcattgggggacataggaaatgagaatgagattcagctgtcagagtccgacgtggatcctggcattcaccttagaggacaactgtatttactgcttatgacatcagctaccgagagactggggacagagaagatgaaaaatagatcgtcataatggaagtgcaatggcctgaaatgtcagtttgctcccaatctgacttgtttactgtacaattggaacatgttggcaggagaaaaagttcaggcagaccaggccgaagtctcaaggtcacaatggggggactcaaggagatttcaccaccatccatcctcggcctgtggtcaaagtgaaactcttca

SEQ ID NO: 648273 - DNA, 814 bp, Homo sapiens
ataatggctatagcaataaaactaggaatagccccctgttcacttctgagtcccagaggttacccaaggcagccctctgagccatccggcctgcttcttctcacatgacaaaaaactagcccccatctcaatcatataccaaatctctccctcactaaacgtaagccttctcctcactgctctccgaatcttatccatcatagtcaggcagttgaggtggattaaaccaaagcccagctacgctaaatcttagcatagtcctcaattacccgacgataggatgaataatagcagttcgtaccgtgacaaccgctaacataaccattcttaatttaactatggatattatcctaactactaccgcatgcctactactcgacttaaactccagcaccactgaccgctactactatctcgcacctgaaacgaaggcctaaccatgactaacagcccttgaagttctcatccagcctcctctccctaggagagcctgcccccgataaccgagttaattgcccaaatgggccatctatcgaagaagtcacggaaaggacaatagcctcatcatccccaccatcataggccaccagtcaaccctccattaagcgtctaactttctaacctcacgcctaagtctaactcgacgcatcaatccgcactacttccgccatagtctgaacaacgtaagacaaataacatgaacaggtttgagaaccataggaaaaactcacccaatacttccccacagtcatcggcctttaccagagctaacttgctacctatttcccctttaatactaattatctgctcgcac

SEQ ID NO: 648274 - DNA, 261 bp, Homo sapiens
acttcgctaggggagtggggacgcccaccttggcgagcggctcagtgctcagcccctccagttcttggagggcctggcctcctcgctccccgctcagcccctcacgctcccctacgttgtggttgcattgtgtttgcggatttctgtatactcatatctggcttcctgttatgacaagtattgcaagtcagtaggtatgcgcaggagctgaaaatcgctcacgaaatgtacgacccttcctggggagagaatggggttcag

SEQ ID NO: 648275 - DNA, 289 bp, Homo sapiens
agaaggctttatcgatgttatataagagatgcaagttgctctgagtgaagcgtactatgccatcaatggagcccagagtcaactcgtcctagaattttaagaaggctcgatggaaaaatttctcaatcctgaaatcgcctaggtaccggggtccggatacggtgccatggtcgatattgaagacctccacagctcttaaataataagcacttatccctaacatgcaatactgcagatgcgagttaaacttatctgttaacagctgcctgctgttttctgctcccagatg

SEQ ID NO: 648276 - DNA, 370 bp, Homo sapiens
cgatgagtaaaacttggcacctgaatcgggaggtcgagaccaggctgaccaactatggtgaacacctgtctctactaaaattacaaaaattagctggatgtggtggcgcacgctggtagtcccagccacatgggaggctgaggcaggagaattgcttgaactcggggggtggaggctgcagtcagccaagatcttggcactgcactccagccaggacaacagagcaagactctgtctcaaaaaaaaaaaaaaaaaaaaaaaaaaaaaaattttccccgggtttttgggtccccacaatgttttcccaaggttccccgggacattgggggggaaaattggttggggcgggggaattggaggtggaggtgag

SEQ ID NO: 648277 - DNA, 295 bp, Homo sapiens
ttcaggagcagaagcaggaaggagtcccacacccagggcatagcctgccagacaggggaccgcctctgtggatgctccaaggccgcgcaaacagctgggaaacccatgtaattagcagaaggaatggcagagaaccggacccaactcaagtgtcctgatgcggactacagaggaaacgcagtgtaggcaccgaaagacacgctgtgtagcgacaaatggaaacgcacgcagacaacgaagatgttccccatcgcctgcatcatggcaggacaacgcagactgctcaactaaatat

SEQ ID NO: 648278 - DNA, 291 bp, Homo sapiens
  misc_feature (290)..(290): n is a, c, g, or t
cgaccgtgagggcggagccagagaagggcctgctgattctgtatgttcttgatccggctcgtgcgggcgccaggataggggcagattgggagcggccgaagaaccttgcaggcgccccacccgtcttggcatttgccgtgagtttccctggaagcagctccgatatcaaggttccctacaaggtgaacaacgtcggttgggagagcgagtattccgacattcccgagtacgtcatcaacggcatcggctgggaggatatgaatgctcagctccagcagtgacacagcgcng

SEQ ID NO: 648279 - DNA, 149 bp, Homo sapiens
  misc_feature (121)..(121): n is a, c, g, or t
caaagttgctagagtcaggagacctgagcatgaactccatcaaagtcgatggcattagtatgtctttccagaatcttctggcaaagatctgcttctaccaccatttttccgttgtggagcngagtagactcctgtgcctccatgtacag

SEQ ID NO: 648280 - DNA, 877 bp, Homo sapiens
agcgggtaatttctaaagtatctgatgcaggaacgtatcagtgaaactccctcccactgtctcttgtattagcatcaaggaagcgagaaaaaataagcagcctgaggaataggagacatctgtttgaagagcatcgcggatgaagaaacgcacaggaggagtgacactcttcgaagagaagaaatagtccttggccagagacatccatctaagctttccttttatgcattgatcttctcaactgttctctactgtggtgaggttgccttaggttgatacatgtttgagatttatcgaaagagctaatgacagcattctggatgtcatttaccatctagcttgtattattgtgggggcaattgtggatccaaattatcctgatgtttatcaattaaagacttgaggagaagataatggctgtcgattacttggttcggcacattcttcttttaggacctatggtgaggtgtatgcacaccattagaaatgaccacaaatggtttgaacaatcttgaaaccaggagaaggacacgagactcaagttagcatcaccaaagagcaaacacgatgctggacaggggaacattgcattctcaatccggggataacttttcatgcaagcagaaggcttcaagatacatgtcaagtgcattcaggcttttctcgagtcttgtccacaattaattttgccagatgtataatccaggacgtcactaatacgaaaaaattggcttttgaaatagcagccttggctgactgaacatttgcccctgttattcacgtactttattgggggccaaccgttggcatattcttggccatccaaaatcaagaatgatgattataacaataagctaaccgccgatacaatctccgg

SEQ ID NO: 648281 - DNA, 148 bp, Homo sapiens
gagcaccacagcaacactatcatcatatcactatcaccaccatcatcaccatcacctcaacaccaacaccaccaccaccaccgtcatcatccatcatcaccatcaccatcgcctatttgacaccaacccctgttcggttgagcggaga

SEQ ID NO: 648282 - DNA, 315 bp, Homo sapiens
cttcctgtcttcgcctattctacttttgcccctcttcagtccagttctcttctgcaggcagaaagatcccagtaaagacacaggtcaggatcaggtgtggtgtctcacacctgtaatcctagcaccctggaaggctaagacaggaggattgcttgaggccagaaattcgagaccagtctggactgcatagtgagagccgatctctacgaatctaaaaatgaaaataaaagtatctgggtgtcatggtgcacacctgtattcccagctacccgggaggctgaagtgggatgatcactagagggcagaagcaggaag

SEQ ID NO: 648283 - DNA, 237 bp, Homo sapiens
gaggactgttgtctacctgctcacgatgatctgtgcagacgggtactcgcgggtaggcaggtacactgagggccgtcggttcgaggctttgcacacggagtccgcgatgaaatcgactaaaattgctttatgttagtaaacaggcagatcctttcaaaaatactctgccatcattctagatttcctccgatcgccagcctcgagccgccagcctcagacctccaccggccgccacgc

SEQ ID NO: 648284 - DNA, 156 bp, Homo sapiens
gaaacaaaaaccccaaaccgtctctacacaaattcacgacaccggtcttcgcccccctcccccccaaaccacctttaaaaaacaatactacagacacacctttcgccgacacgtctgtaagttaacaataataatacaggatgttcgtaattaatt

SEQ ID NO: 648285 - DNA, 823 bp, Homo sapiens
cccacgcgtcgctggaagtataaacaagaaaggaggctgacggctctagaagtccccaagcctgttgtgatcttcagtagacaaacactcctggtgtgtcacaggattcaggccactaaacctcggcggctgtctcctggaatgaagaaagcaaaggaagcctagagtggagacaaagaagcccgaggcactctgagagctgccatcttttccttgtttgccgcctgacacttctcagcaggatccacataccctaagcagggagtggagagaggcctgggctgggccaggttttctgggctttttcctgtgctccgagtaggtgggttgtattttacccagtaggagtggaagactccttggcgcttggtgcttcaaccggactgacttcctgggcctggagttggcgattagaggtctgacatggctcacctgatgactgtgcagttgttgctcctggtgatgtggatggccgaatgtgctcagtccagagctactcgggccaggactgaacttctcaatgtctgcatggatgccaaacaccacaaagaaaaaccgggccctgaggacaatttacacgacagtgcagccctggaagacgaattcctgctgttccacgaacacaaagccaggaagcacataaggacatttctcacctgtacggttcaactggaaccactgggaactatgacatcggaatgcaaagggactttatccaaagacacctggctctattgagtgtccggaaatggggacctggttcacgcaggggcagaagtgggcaagaggggtcttggagtccctgtgcagagctgccatgggg

SEQ ID NO: 648286 - DNA, 130 bp, Homo sapiens
gttatagagatacccactgaagctggtctggctcttctaaacacggcaggacctcccccacagccacccccacaggttctctgtttcccaagtcctgatggattcaggcaatgaccttcacacagttcac

SEQ ID NO: 648287 - DNA, 266 bp, Homo sapiens
tgtatacctgcatgctctctctgatggaggactaataaaaaaagccactctagactgggcgcagtggtcatgctataatcccagcactttgggaggccaaggcaggcagatcacttgaggccaggagtttgagactagactggcaaacatggcaaaaccccatctctagtaaaaataaaaattagctgggcgtagtggcgtgcacctgtagtcccagctgctcaggaggattgcttgaacccagaagacagaggttgcaccaccgc

SEQ ID NO: 648288 - DNA, 172 bp, Homo sapiens
ctgatcgcttttcattgtcttacctcagaatcatgatgtacacagaactatgggcaaggtccctcaattccggtcaatcaggtatcattcaatttgagtaaaactgattgtgctcacaaactgtgcatgggtccagacaggtgcagcgtagacatattctacgctgcacctt

SEQ ID NO: 648289 - DNA, 419 bp, Homo sapiens
ccctcgaggaacgtgttatccggcaacggtagcttagaggagattccacgtctaggacagctgcgcttcttctattcagctagttacgttacacggctatgccctgcaactgcaccagtatacaggtaacccgcggggtgcatcgcgtcctggggactgggacgtgggccccggacaccgacgacggctacgacggtgacgacagaccgttggacacgacacgtgaccggctgacaggaacctcacgctggggaccccacctgacggactactggtacactaaacctggaacactcacgtagggacgacatgggcaaacgtgcagacccgacgccgctttgacgctagcgactaacccaggaccgaggacacgggcttaaactacacggaccggaacccacgtaacgggggcggactct

SEQ ID NO: 648290 - DNA, 117 bp, Homo sapiens
ttaactgtgccggaaccgacacggagaccaacggtaattgtcatcacattaccactgacactgacgatcaccgcaggggagctgctggttcgcagtgtatcgaagtgtacgcctccg

SEQ ID NO: 648291 - DNA, 145 bp, Homo sapiens
tgaattaaaggctgagttggaacgtaagaagcagcgactggctcaaatcagagaggaaaagaagagaaaagaagaagaaaggaaaaaaaaagaaacagaccagaagaaggaagctgttgctcctgtgcaagaagaatcagatctt

SEQ ID NO: 648292 - DNA, 1069 bp, Homo sapiens
  misc_feature (126)..(126): n is a, c, g, or t
gatcgtgggccccgtctgggcttcttggtacctagagagtgtagctggtcagatagcatgattgtgaatggtgagcgatagctaggtgccggatagctagtgagtacgggttagtgttgaaacagncgtgatgtgtagtgactgtaattgaagctatataaccaagaaagagttaaagacatatttcatggcgaaaatattttcattttcttccgccaagtctgagctgggattagcgctctaaattcgctagacatttttgtgatcaacccattgaggcctcaatgaacggtggagttcttttcccatatatccctacgcgctagagcaatgtgtacggtcatactttcttaggttggggaatctacgcgtggtttggttctatgatcacacacaaacgtcgcaaatatgggacagttacattgtcaggaggtctaactaatttaaccgtgatgtaagtggttgcctggtacatacatattggtttggtgtataggcatgtgagactccttctcagagaaattaatttattagctttctttcagaaggacctggattgtttgcactcctggtactgcaataacgttaattgaggaaagtctcctatctggtgagctcatcccaacagggtacttcgaagaaagcgctatacacataagcttgtgtgccaccgagaaggaactcagcacgtgaagcaggtccttaaatggacggtacgattccaatccctttcgggccgttggtgagctatctttggcgatttctatgaccgaagattggaggaacatgtcacttgggcgtacaaacttcacaaacactctttgtgagctttgcaaaggttttcattaggtctgcgagcactcttatgattccaaggtggtgacaagggaaccattgaaggtttctggagcgcactgtggccacatccactaaatggttggcgctcgcacacttttccgcgggagtatcacgtgcgggccaaccctggtttttcttgcaaaacaacacattacatcaagtgggggaaaaaccacggggccttttggacagagaggcccgtattaccaca

SEQ ID NO: 648293 - DNA, 1028 bp, Homo sapiens
ggaagaggaggaagacgaggattacattgcatttatctggaaaatgttgtatgagttcttgaataaatacttgtggaaccaagaatggtggtttatccttgtagtctctgccgtggtggattgaaccagaaaaatggaacatccatgagtccaaagggcttcccattgcgtgtcgccgacgtcgattgtatccagtaacgttgcacgttctgttgtttatccacctgctctagaaacattgccaattcgtcgtgggtcaatacccagcagtgagaacggagcagggtgcacgtataacgcgacactgacagccattggggcaggcccgataccgggatgctggacggtgtggaggcatgacacgtgtaccctgacctcgtctcgactctcttcactcaacggtcgtcgagcatcgctgcaacatcccgtcctacccgacctcgctcttcgcttcaaatgaccttcaccggcactagcaacactgaggacatctcctcctcatttcgctcacccactgcaacgagccggcgcagccatactttgcccctcccgggactatactaccaagatggccgcacacatatggcactctcgctccacacacgaaaacacagtgtcgcgggctactcctagagagagccgattatccgctactttggaccttttccactccacaacatctgcacttaaacccaccaactctctccactctcgtggtaaaccgcgtctaccaaccatacgtgataagtaggttacctaggccattacccagtccccctatccctattacgatttcccattaacgcaacggacggatgacccaaccgtgggttgacttccccatttccacgaggtggatctgccattggcccaacttaaacaaagcggggtcataaggagggggaaaaatccagcaaaatatgaatacaacatacggtcccccgcacgggtcacctcaaacgacttacacatgcttacacatgtggatggtaagccaatacaacaagttgacaaccgggattgttaag

SEQ ID NO: 648294 - DNA, 559 bp, Homo sapiens
gaccagattccttctaaaagaaggaaggccatgtctgcctgaagcctattggccgggcctactctggacccgcccctcttttttttttcatgacacacaccacaggcgaagtctgtgcggaatcctaaaccagcccaatttacatccattcatgaatctgtgacgtcagcaagccttggggctcctttgcggtgggctggaggattgtgtgggtggaatccccctcccctttatttttccaattctgcaaggcttttaaaattcaccttacatcttttcaaagcaagaaaatggaacagcatgtgtaggaattcttcgttgtgtgagtattggcactctgtttttcctgtttcttcagtatttatttcacaaggacagacagagaatgtgtgatctggaggtgattagaaagctgatattattgagggcgacaccgtgagagagacagagagacagaggcggagagaaacccgaaaccccgttacagctaggagcctccgaaactgacagctggttttccttgtgcttgtctgcctgctagacgtggacatttttcatt

SEQ ID NO: 648295 - DNA, 146 bp, Homo sapiens
tacttttccacaggccaaggcaagagagaagaaacttcacctaggctgctgagcctactgatatgttacaaacgcttcctacttgacagaaccccccccccccccaccaagacacaactcatatcaccgtggttgcagtacccagc

SEQ ID NO: 648296 - DNA, 370 bp, Homo sapiens
cttgtcgtggcgtttggcatcccggtacacccatttaaactgctcgttcagctgctccagcaaggaggaggtgttgagcatcttccactgttagcgactttacccagctcgtttagtttttcctggctccatctctcagtgacctggatggcttcgtcgatctcctcgctcgtcgcttagcctgggaggggttgttggtgctcagtccactcgacagatctcccggtctttgtcacactggtccttcttccgctggcagcccgtggagttgtggcggatctcccggtgcacagtccggttcatcgtcgccttctcgtatgaattctgttgcgggtcgggtggccgggctgtggaagcgggtcgggtggcg

SEQ ID NO: 648297 - DNA, 229 bp, Homo sapiens
  misc_feature (2)..(2): n is a, c, g, or t
gngagacgggggtctcaccacatggtccaggctcagattttttggttgggtttgggtggtttccaggtccacggtcatctcagcggcaaaacaccaaagtcagaaggaaggtaatctcccaagttttttggttttggtttggtttggtttttggagacagtcttcactcggtcacccaggcgggagtgcaggggcacaattttcaacttcttggcaaccttcggccttc

SEQ ID NO: 648298 - DNA, 636 bp, Homo sapiens
  misc_feature (39)..(39): n is a, c, g, or t
  misc_feature (61)..(61): n is a, c, g, or t
  misc_feature (79)..(79): n is a, c, g, or t
  misc_feature (156)..(156): n is a, c, g, or t
taatagccggttccaatgcctaggggtattcctggggtnaccatgtctttggttttttttntttagcatatgaagcttnggtatgtacaaggtcagtagtaagatgccactagtctcagggcttgtgtaatatctgggaggtcattaaatgcaganatggtcaagcaattaacacagtatttatgactctgttaagcataccgtttgtctgtcacattagtagattctgagattaaaaaaaatttttaaagagtgatcatttaaataatttctaaaagggtcttttcaagctctaacaaagtcactaacacatcatcaattttcgacagcattagatgttagtagtgcagtgccgcatattcagggaaagagtgtgaggaattgcatttcagcatagttcgctcgtgtgtttgacctaagaatgatcgtcgcctgaagtgttggcctttacagtgtagcatatatggcccaacatgataggattccttaggatgtgtcccccccgtgggccccaaaccagcctgctgtctcaggaagctgtagaaggagtgtttgtcagtttctggccactgccttgcttccttacggaggattaaatgttgcctgtctctgttacttaaattatctgtttaatat

SEQ ID NO: 648299 - DNA, 615 bp, Homo sapiens
gaggaggatgagagtggcactcgagaaaagagagcttatgcatgtgtcttcaggggcatatgggattccattggtgaccagccagatgaactgtccttccaccggggtggcttcatccgtattttgagcaaggagtataacatgtatggctggtgggtgggagaactgaacagcctcgttgggattgttccaaaggagtatctcacccctgcctttgaagtggaagaaagatgaaacccaggaaatatattcttccctctctcctgcctttatgaggaaactgatcatcaaaagttccccctccctatttttgcccccccaccaacgccttggattcctttttttgctgaagagacccaagtttcttcccccctcaaagtggttgtaagcacccattaaaccagtgggaaaaggcccgtttttcaaacctgttattaaaccagcctagttatagctcatccccatctttaaatgtgtccccccaaccccatttgccttttccccaagctttttccaaaaaaggtgaaaaaaaaggaacccttgggaggaggccattcttggttgttttggttggttttaaaagcccaaataaacttgggatgtggttcctttcca

SEQ ID NO: 648300 - DNA, 1937 bp, Homo sapiens
tgtcgtgtccggcaccatgggtagtccgtctgcgcactcggacgagtaaaagagctgtgtgcatagatgacgcagaggagcctcgttcagctggagtcaccttcggggaagtttcgaacgactctgaggcagactcaaacagaagttctctgtgggcgacaatacagctcacgaaagacgagagctaatgctcgataggggcagcgttgagaccggggagcagacacgtgttcacgaccatcaatgcatgcgcgcgcacgcctggctggcaatccttctctccagtccagcgcgaggttgtgcccgcccaccgggagctacgaatgcaaaatcgtatgtgagcgttgtacatgtacatacacgctcgtgtgtaccaggggctgcgctctcgcaatggaactgcatatccacgagaacgcgaaagcaaaaggcacggtcaagctgcacgaggcgtcttatcgcacaggtgacccgtgtgcgtccccattcacatagccttcacccgttgggatagcccagggacccaccggggtcagcgactacctggaagagtgtcgccttctgcctgtccgacactctctccgtccccgaaataaggaacctaatagtgaagtaactggaattagcacagcacacagaatccacaaaaagcggggccgaggactcgtgcgcaaataagcacagaaacttacccgccccagcgttagagggccgtgcaaccgccccagtcaagaaaccacacaggcaaacccacaagtgggttggacccaccccttagccagccacaggcaattcaaggtgctccctgggcaaatgaaagaagattgaggtcgcagaataggataggcacagcgcaaaggacagccaacgcgctgcgccagcgagtgacccacccacacggacagtagacaagccggcgcatgcgagagcacaacctatacggtatcgtggaccacagacggggggccccaacgagccaagcgctcacaaggcaaccgaaggaagcaactgtgccgtgccacacaacaatggggaagcatacgcaacaacaccacgagaacgcccgacgccactgcgcgccgcacggcacgcatggaccacccgtagcgacccatatctcacagcaacaccacgtagtatcacaacccagggacataccagaggtgggctggtacacatcaacaggcacgcaaggacagcatgcacggcaaatggccggcacacaacaccaaaaacaccaactaacagggaccaacagcaagcccacccacaagccgagaccgcgtcacccagctcaacacgcaacatgaggcaccaccacaagtcaactacaagatcgatggtagagaagacgatctcacgggcctggacttgtgcagcgtggcaaaacgatgaacaccaacgagccggcacgcccaccacacaagagcccagcactatgtgacgacaaggcccacgatcaacagagccggcactacagcgcgagcaaacgcgcaagctgaacaacgagggccaagagcgacaacgctgcacaacacatcaacagatacggatgcacaaaccagtgggtgacgacggacagacatagtacacgacgcggcagctaacacacgcacagagagaaacaaacaccaaggcaaccgcatgaggacagatacacagacaacatacacgccgcgaccagccaccacgatgccacacaagccacaagcagcagagacgcacgaacgccgacacaagaccacaacagacgaaacatcacgagcacacacgacgaacacccacggcagcaacacgaagacagcacaccacagcaacggcaagccgcagcgcgccgaacacacacacagcacaaatagcacgggcagcacgaagacagatagtaagcactacgactaacacgtaccaacagaacaacgacgagcacacgcaacgac

SEQ ID NO: 648301 - DNA, 534 bp, Homo sapiens
ggggagtggacagcaatagctagtgagcctagcttcaccaaggctctcgcgcctctccaccaccaaaatatcaaagaggaaggaaggtcagctcagctgaagggatagtgaaggaagagcccaggtggagacccagcacagttctcagctaactctgctcctacaaaagtggacaggaaaccaaaaaaggcagcaggaaaggatacatcttcagacaaaacaaaagtgaaaaggaaagcagagaaaatacatcgcagtggcaaaccaagaaactaaagatttacctacctacagaaaacagagaaactaaactgagaaagccagaggaaaaaaaagccaagtgtgattaatatcacataccttgtcttatgagtcattcctgtttcccttcttgtactatccacaggaattttctggttttttcgttgttgtagttttgttttgtgttttttaaattggagtttcactcttgttgcctaggctggagtacaacggtatggtctaggctcactacaacctccactcccgtaccag

SEQ ID NO: 648302 - DNA, 1026 bp, Homo sapiens
  misc_feature (135)..(135): n is a, c, g, or t
acggggtttgccatcagcgtggtcgtcgttctcgggcccattaaccacagctaccgctgatcgcagctcaagtcgtgttggatgttcaagattgacagtacttagtggtgctgctcccagctgcctcgcgtgggnggcgttcttacatatttattaccccaccgtggcgcctttccccggttataagtggtggtgtacaccccgctccgcacggattttttcgccccccccgggggagatgaccccccactatcattgccaggcgcgcacggttttttttggagcccccctcgtcccgtatgtggagagtacaccccctcgcggggggctctggtatttcacaaaggcccttctccccggaggccatttttgtcgccccttttagtggtcgcccgctgggtggtcccgttgatatattatacacccacttggtctactacacacaccgggggggaaacacagcgtgatatgtaccccacccttaattgggggccccttatctttacggcggacacacaccatctagggcacacacacagttgtgtgagacacacatcaataagcacacgcgggcgtcggggacaacccgcgttctcctgcgagaatttctccccgcgggagatatttctctgtctggcacacccacgcgcgctcccgcgattgttttgtctctttcttatctagaaaaggaaaatgaggattaccacacgtcaataccttccaccacgagagggtaaactcctaaaatttcctactgattcttctgaaccctattttaaaccccttcctaaaaattaaaataatcattttggtgttttttatgtagaatttagacttctaaaggcgggctctgacataatgttgcttgggcattgatagctcaccactgattagccacaagcatataaagcatcccttacccaccataataaagaccttgctttatcggccttgccatcattttgaacccttaacctcatagatttagaacgaaacactgtataaaaaccaacagataaagggtta

SEQ ID NO: 648303 - DNA, 258 bp, Homo sapiens
gcttacatttgttctgcgatttactgtacggattgcctggagtacaggtggcgggaggattcgacagctgctcttccatttacggcttgcttcacatactggcacgagttccccaacagcacgaggctattaagtactttcagggatatcaacccaaaatagaagagtatgacacaggcatatgacaggagtccttgcactctaattgagcttgtgacaactctgatgagtaaaacagctagtgggagaggaataaag

SEQ ID NO: 648304 - DNA, 1319 bp, Homo sapiens
ccagatgggcctagacaagacgcgtggcaacggacgaccggcgcagaagtactccgcggcccccccgtatgcccaagggccccgccaagagaggggctggatggtagtttgggggggcgaagaacaagtccccacggccggggatcggcggtgtcgcgaaatagttcaagagtggcctgctgaggccaagcgctacccgggcccgggacacccaaaggggactggccccgaggcgcccagaggagaaccacacggggggagaccccgtggcgtcgccccggggagagatctttgttgtcgcccgccaccacgccaggaggtttcgcgccgaaaaggcgaggccccgtgccccaaaacgttgagggggaacccctggggggagggggcccgcgcccccggggtcgccagttctgctggccccacctggccctggcgctgaatcctgggagccccgtggccccgtggcaaatgcggggcacacacagcccccaacgtcgccctgggaggagaaaattcctggggaaagggcccttggagagggagtgggcccacccaccccccgtgtgggcccccctttccttggggaagacgtctgtccccctgtgtagtgggtggggcttgggcccccacgcactgtggctcggcacattgccgtcccccgtcgcgttctgtctcttagaccccccccttggggtgctttggccttaaaaagcgtttcccctttttcacgaacttgtcctggggaacctgagtctcccccacaggcctgggacgcctggtgccccccccttggtgtgtgccctttgggaattttggcaaccacacgtcccctctctctccttgtgggttgaaagggagcacagagagccccccccgctcgtgtgagcactgcacgcgctcgcgtgttctgttcccctctttgccggcttttcacctctgcttgggttttctcgtgttctctccctcgggggaagctccgtgggccacgcaccctctttgaggcctcttggcccaccacctgagggcttatggcctccttctgcctcgggaatgggctcccacccctccccctgagggagtggcctcggagttcaccgccccttcttgtttcctctttggggctccaaagcccttcctacctctggtgaatggtttccaccacggaacacacagcactctttcacccaagaatgggtggcacccaaccttgctgggaacttggagatcccacaggggcttaatctcttcaaagtgtggaagggggcacagggtccacgccttctgctgtagcttatgaaattaactaattggaaattcca

SEQ ID NO: 648305 - DNA, 1690 bp, Homo sapiens
  misc_feature (1120)..(1120): n is a, c, g, or t
  misc_feature (1219)..(1219): n is a, c, g, or t
taccttgtactttacctgaatgatcaagtgcgtaacgatacatcgcaaaattagtgtctgaggacatgactgatatgtctgatgtactatcatcgaaattgttcccaattgggcaccactagagcgacctaattatcaatagtcctgctatgcatgtatatgctcacgtattgcgatcaagtcttacacgcatactcaagtccctgttcgttgagctcaccataattgatcgacactattgtgtgctagtactaagctctatatagcccctgctatggacgatatcaccacccttggatgagtgttgcctcacgcacaagggacgaaatacatatctgccattaactacggtagactaacagtgagtcagggaccctgacgaaattgttaaacggattagacactaatatagccttagacacacacccgtatgattcacacagaggtatggcttaaactaaggatcagaagacttccgtacaccataatccctaggtacaattactttaaagcgaaattgggagattccgaaaataacttggacagcgtttaaaggccaaacaacagcacaagtgggccaggcggaaactcaatgggtgaggtagggaacactatcatgagaaacaaccccagattatgcccccatttaattatggaaggatagagtttccccatgacaaagtctcctcggcacaaaaggccggactcacacaacatacgtatcggacactttacaacggtgacacatcttacattggggagaggcgtaccgattatattcacaagagggccatggcacaatatggcaaaacatgtggtctatattacactcctgtggattaaccacagcggagaggccccccgattttatttaaactcacgtaccaacagttactggaacctacgcaacttaaacaagagaagtgttaacatatccgctatttccgaggacaaacagtaaaagtactaaccagtagttgatacaccagatagtttagcacagtactcatatcaacacgccaactggatatataggagtacagccagggagacacaaccattgaggaatggagagaaagtaaggacacgagaacggtatatcatagacgacacatgaganacacattaacagggtaactcgcaacaggcaggagcacctagtcagagtcacgacaagacagtgatagtagtccagacacagcgattgagctaagaccgngcacagacatgtcacagatatcgtggggtcgagctcacatagaagcattagtctattagttaagcagcgcatagacgtgtagacgatctggcagtgtcagacgtagtagaggcaacaagatcacgatacacccatgtaggtacggaacagggaggatacgcataacgtataacgccacaccgagagtatagcaggcacaaaggtagacgccacgcaatcggcacatagtaggataccgcgatcgaaacagtagaacgaaaaggtgcaatagaagacagggagaacacactatacacattatggacatattagcgcaagaacagaagcaccggacacaataggtattgacactgatctagcactacgcggaggagcactatcgagtgtgactatcaagagatagagcaccagcgaggcgtaagagaagagaatgaggtagagaagagagaccatagggacgaaaaccaccaa

SEQ ID NO: 648306 - DNA, 152 bp, Homo sapiens
cactactaagctacatgatggctacacagtaaattggcagctgggtctatatgtagcccagttagctgtagttcctacaggggcacggtcaacacggtatacgacaagttcgggatgacgctctaatggatacttaccttgatggatagctt

SEQ ID NO: 648307 - DNA, 341 bp, Homo sapiens
tcggtggccttgatgttccgcacacgctgcaggtccacgtgcagcacacagatgcggttcgagtgcctgcacggcctgcaccgccaccttgctcgtgccatacaggttccgcgagaactcggcatgctcgatgaagtcgccggcggctatgtcacgctgcatcacctccgtggttacgaagtagtaatctttgccgttctcctcgccgggcgtcgggttcctcgtggtatgggacaccgtgaagccaaagatggcggtgtgctcctggagcagcctcttcggcaggtgctcttcccagctcgcgaaggcccgctcagcaccatcagcctggggcccgacat

SEQ ID NO: 648308 - DNA, 933 bp, Homo sapiens
ggcacggagatctcgccggggtttacgtgcgaggcctcggtgtctgcagcaacccatcacggattcctctcctaggcgactgatgacccatgggctagaattgcaccatgtctattctcaagatccatgccagggagatctttgagtctcgcgggaatccccactcgttgaggtattgatctcttccaccgtcaaagaggtgctctctcagagctgctgtgcccagtggtgcttcatactggtatctatgaggccctagagctccgggacaatgataagactcgcgtagtatggggaacgggatgtcgtcagaaggcctgttgaggcgtccagttgaactaatacttttgcgccgtgcccgtggctatagaccgagaattcctcgataggctcctcagaatcaggagaacgatggaggaacagatgatcgagatggatggtaccagacgaatcatgtctagagtcccgtctagcgaaaaggtcgccccctccgtgaaggcggtgatccacattgtccggtcctgtgtgaatctgaggggactcgcttcgaacaaaggggaggatccaatattcatagactgcctaattcggctgtaccgttgggacttggtgatacttctggatgaattcgtggccgcacagctacacggatatacccagataggtcattgggaacgcgtggcacgagtgccttcaataggcctgtgccatagccgtttcctttgggcacgtagccacttgacggttccgattgaatcccttcacacatgtccaagttggaggtatgggacttcccacgaggacactgccagatgcgacagtccgtgggcagacgtgccgaccattgaaacctggatggaaattggtcggtgaaacggtgaacatcatgggaaagcgatgcgacccattgagggcagattgaaggacggacaa

SEQ ID NO: 648309 - DNA, 166 bp, Homo sapiens
cacctctgcctcctgggatcagccatcctcccacctcagactttcgaatagctgcaagcacgtccaccactccaggctaaattttaaaatatataaaaagtagagatggggctttgccatgttgcccaggctggtctcaaacttctgagctcaagcgatcggccca

SEQ ID NO: 648310 - DNA, 126 bp, Homo sapiens
acgtatgccaattaacgcggttatttggggggcttcttatattgcttcgatgaatggtttgatgggccatgattaagagggtttgatgaagggtttggatagggtttgatgacagggtttcgatga

SEQ ID NO: 648311 - DNA, 347 bp, Homo sapiens
gcctcgcagtgctgccgttacataggtatacatgtgccatggtggtttgctgaacccatcaacccgtcatcttcaaagataaggccttcagtatatcaagatcagtggatcaaagaaacatcctcaagaaactaagaaacaacacaagattctctctgatgaaatgcttaagtataaggaaaatgatggaagacacagaagagcagcagaattgggtagaagactactacagatgccagatcgccacttctgaaagaaagggtttacggacaactgggctctgtgttttaagcctcgcagagggaggatggcaaggaggaaggaagggttgccttacaaggcaggca

SEQ ID NO: 648312 - DNA, 588 bp, Homo sapiens
agcgggggtgcgaaggagaacgcagcaagcctcaggcggcgggtggaaaggctggaggacacctaccgtaatacatgtggaatcccaagtgccgggcagtccagggccaaatccatatccccccaatattagggtgcccgtggaggttcccaatcctggcacatcgcagacagtctatgaatcacacacctgtcacgacgagtgcgcgtgtctgtggtcgtcacacggagtgccgcgagtggggaggacatactagcgctacagagcgagctgagctcgatgctgtgcgtgaggctggcggacggtcgcacttgactgcaggaacctggtgccggagatcgccgaaacacagattactaggcaggtagaccgcagacattcaagggcacgcatgtcgtggacatggaactaaacgtcgtgtaattgcctccttcggggctttgaggtgcaaccagcgcggcgggtatccgcttgggaatgctcctggacggaacttaccgatcaactggacctacagataccctatactagcacgcaacgtcgaacatccaaccatccgaggcttccatcaaggctgccagcaatggc

SEQ ID NO: 648313 - DNA, 938 bp, Homo sapiens
cgcctgtccagtggacacatgacccatgtgaccttaccgtattattggagatggttcacattccattaccctgcccctttgtctctatatccaataacatatcagtgcagccgtggcactttggggcccacgtacatggtctccgtggtcttggtggtacgtggtccccgcaggacccaggatgtctgtttgcttttaacaaataaaatagacacaaaaaagaacacacatacatacagagaaaaaagaacaaaaaagaagacataaagaaaggaggagaggtggggcaaaagagtaagatccaccgaaagtgcgaggacctctgttctcaacctgtcagcatgtcttatatgcagcaagcgagtcgtacgcccgcagaatcgaaggcggatatatctttgggaaatcaagtccctcgtaccagggatatctataaacaggaacattgccgagaagggagatggcgaagacgtggacagctatcatctgacgttacacacgaagacatctggaagaccgtatatcccgagggctagggacacgcacagggccatacaagtcttgcatatgccctcgatcgtgttagagcttcaagatcaatcacgcagaggaaagccatgggagggaatgatcaaacaaaaggtcccctcaaagctttggtagaaatccaatattgaaagcagcacaggggtccggacagaactttaataagtctaagacagttatgtgtgggaaagccgagggccctgtgcttggaaattggcggtcggactttccgggacgaacagttctttggacgactttcggggctagccaaaattgcttaaggtggcccaaccaacataacagggaagccttcgtatcccatgaaaaacaggacacatggaagaagccctggttgaggaattccctaaccctttttgttacttgctagccca

SEQ ID NO: 648314 - DNA, 803 bp, Homo sapiens
cacgcgtcggacaaacattcggtggaggtcaccaatggcatgttcagtagccagacaatgagtcatgaagatgaagtgggtgttgacatggaatatgctaacaatatgtatgaactggtcataaaaaggtttcgccaacatgagctcatccctgtgcactggtacgctactggccatgacatcacagagcactctgtgctgttccatgagtactacacccgagaggcccccaacccattcagctcacgtgtggacacaagtctccattgaaggggcgcatgagcatcgaaagcctaccgtcagtgactttaagtgggagtccctggagaggaccatgggagtgatgttcgacgacctctgacagtgaaatactgcgtactacgacgagtgaacgcatacggagtagacctgatcaatgatgacctgctttatccccaacagagtgattggactctcaagtgacttgcagctaagtaggaggggcatcagtcgcatccaggatgccctgagtaacagtgtcgcggaatatgcagaggatgtactgtactggaacgtgtcgtcaagctgacagatactggtgggccgcttccgtgaatgagcctggttaaccgaagtaccgaacaatagtttccccgatgactttgatgaccagtgctcaaccagcaacatcaatgaccgttttgatggtgacctacctggcaggctcacacagtcacagattgcgtcatgaaaaactggtaactgtgaatggccccagaggaaaacatgtggctagggataacccagatccaattgagcaatgg

SEQ ID NO: 648315 - DNA, 430 bp, Homo sapiens
tattagtataaaaacgaaaacacaagagagtatcaatacatacatagtcccttctaggaaaaatattaagaaagaataaagtaaatgctaagtatctatccttgtgtttaatttttaaatttaccatttctcagtgtttctgattatttaatcaattccacagcagctctaatagcaattttatcccacatatatgcttcaaaaaatggaaaagtaatgaaattcaatttaagttctgctctcaaatcaacttgtgaatgaaaatctacatcacagaaaacctgagctatacatgagtgaaatgcctcaaaaaaagttctcagacactgtaaatgaaatattaaaccataacattatagtatataatttacttaactgaaaacctattatgtaaatggcataaggtctgaaactgtcccaagacagcaaa

SEQ ID NO: 648316 - DNA, 157 bp, Homo sapiens
ctatgctaggggtgagtggtatgaagttccgacactcggaggcgtatgagttggccttacctgttcctgtgttaaaatgttcgaattcataagaacagggaggttagaagtagggtcttggtgacaaaatatgttgtgtagagttcagggtcttggt

SEQ ID NO: 648317 - DNA, 115 bp, Homo sapiens
atccacttcagttccaagcatggttccaagtgcatggtccaagtgcatggtccaagtgcatggtccaagtgcatggtccaagtgcatggttccctggctggggatcacggcagct

SEQ ID NO: 648318 - DNA, 390 bp, Homo sapiens
acagtgtttccaatcagatcatcgcacgcccttcatctgctccaacgttgccgctactgccgccgctttcaaggccagaacgtgacaccgcgtccccgcaggaagagcaggctgccacacgggccaatggagacagcgaactggccatgcaatacgcgatcgccctgaacctggctggccgtcgcactcatgttgaagacttcgatcacattgctccccactccacctttggccaatggtggaggcacttgcatgatgccttccaattgcccgatgttcagcagtggatcaaggccttgggggttgataccacctcgataaaaatcgatccaaaatcaggtcagatttccttttaccgtgagcgctttcttgacccgctaaggtcgacgc

SEQ ID NO: 648319 - DNA, 453 bp, Homo sapiens
aactatctccgccttacacgcccccaaaacgcatatcactcaccatctgctgtctctgatccatgacagccaccctagaggtgctggtgccctgagtcttctaccctgcggcagactcacactgacctggcagcgggctgggtgcggaccagacccaggacacggagctcgtggacgaccaggcctgcaggggatggaaccttccagcaagtgggcggctgtggtggtgccttctggacaggagcagagatacacctgccatgtgcagcatgagggtttgcccaagccactcaacctgagatgggagccgtcttccctagtccaccatccccatcgagggcatcattgctggcctggttccctttggagctgtgatcactggagctgtggtcgctgctgtgatagtggaaggaggaagaggtacaaataaaaaaggagggagctacactcagg

SEQ ID NO: 648320 - DNA, 329 bp, Homo sapiens
  misc_feature (150)..(150): n is a, c, g, or t
ctgggggctggggagggagtattcaaaagtgtcccaattttttggcccagcgtgatggctcacccctatcatcccagcaatttgagaggctgaggcaggaggatccctttggttcaggagtttgagaccagcctgggcaacatagcgagnctacatctctacaaaaaagaaaaaacttagctgggcatggtggtggtgcattcctgtggccccagctactttggaagctacggcaggaggatcccttgagcctaggagttcgagactgcagtgacccatgattgtgccatggccctccagcctgggcaacagagcaagactttgtttca

SEQ ID NO: 648321 - DNA, 451 bp, Homo sapiens
cctcatttaccattctgaaaatcctagtgcccttaagaagtatgcaaaaatctactgtgtgctgatcattgaaacaggaaagcctgtatagtagcatatctgtttacagtatgttttactgaatattttaagcccactattgagatctacagctcagaaaaaaagatttctttcaaaatattactgctcattgagaatgtgcttagtcaccaaagaggtctcatggagatgagtaagattaatgttaacatctgttctgcagcccatggatcaaggagtaatttcaactctcaaatcttacttaagaaatgcatcttgaggctgagcacggtggctcatgcctgtactcgcagcacttcgggaggccaaagctggtggatcgcttgagctcaggagttagagaccagccggggcagcatagtgagaccaccccctccactgccagtctctt

SEQ ID NO: 648322 - DNA, 267 bp, Homo sapiens
atgacggcagatgtcaacagagaccaagcaatgacatgccaggatgtgatacattgcccacaggaaacaagtctcctggccagtgaacctcactcctgcccctcaggtgcccctgcaacatgctgacgcagtgaacatatacacgctcatagccgtcagcccctactagggcgccccagggtccgctctccctgcccgctgccccagccaggaagcatcacctagcgctatctctcatccccttccctgcccagccccagctgtcgg

SEQ ID NO: 648323 - DNA, 515 bp, Homo sapiens
attgtctatgatccattgatggctctgtgtggtacccctgtgatcagctacagaaacttcaaaggtagtccatgaaagcagacaggaggggggctataccctgacaaaaccacaggggtggagctgcccaaggctgtgggaccccacctcttgcatcagcaagaccaggttgtgagatatggagtcaaaggagatcatttgggaactttaaggtttaatgactgctctactgcatttcaaacttgcctggggcctgtaacccctttgttttggccaatttctctcatttggaatgcatatatttacctaatgcctgtacccccactgtatctaggaagtaactaacttgcttttgattttacaggctcataggcataagggacttgccttgtctcagatgagactttggacttgaactttagggttaatgctggaatgagttaagactttgggggaatgttggaaaggcatgactgcattttgaaatgtgaagacatgcgattttggaggggcca

SEQ ID NO: 648324 - DNA, 1223 bp, Homo sapiens
gttttttccctcttggggctgtcaagtggtcagttcagggtatttaatctgacgcaggcttatgcggaggagaatggttcatgtcacttatactacacatttagcttctctctactagcgggtgatagcatgtggctccaactggggctgtgcaggagatcagtccatagtgtcggcgcgcactcaccaaggctacctgccgctgctcgcagctagcaaccgcattccctatcactcggccgagcaggtgcattaccagcgcccacacctagtgcgcgatgctacaaccacttcacccacacctcctactccatacacaggccctcacacacccacacacggcacccaaacgcaagcgtgcctccacctccctcgccaccataaacacgccaaccccaccccaccacaggcgcgaacattccgcaagagcgctccctgccgggccccaactccacaacgcccgcaccaacacaactccccaccccccgcgccccaaccccagccctactccacccagcgcctcgccccccagccccgccccccccccacccccaacacacctcaccccacaccaaccacgcgcccaccctccaccgcgaccgccgccccctcaccacccagccccctcacggcatagccccgcacagcatacccggcgccccccccaccctccgcccccaccctgtacaacccccaacaccccaaaccacaacccccacatcccccacaccgcaacccggccgcccccccccacccacccccctccgccccgcccccccccccaccccccccccccccccccccccccccccccccaccgccccccggtccacacccccccccccacccccaactcgcgcccacagctccgccccacactgaccgcacaccacgccacaccgcccctccccacccctcccctcaacaccaccacaccgccccactcccccccaccccccccccagacacccccactccccaccccccccccacacgcccccccccacccctctcctcccccctccaccctctcccacaccatacaacccccccccccctccccccctctccctccccccccctcatctccatctttccatacccctcccctcctaactactaccactaccacttcaatcaacacactccacccctcctccactccatcttcacaacaactaactttctacgctccctctactcaccacacaccacctcacccc

SEQ ID NO: 648325 - DNA, 1121 bp, Homo sapiens
gcacagagccatgagctggaaagtccatgagatgctgaagaagtgggtgggatgctgaaggttctcccttccgaggccagccgattcagaccctgccatgttcaacatctccccgggggctgtgcagttttcatgacacagaaggaaaggaaaccctcgccggtggggaggcagagccttatcctcggctgcccattcttggatcccatgcattccagggaattgctcgactatgtaataaccctagccatcctttctttcaagggtgaaccagagccattccacaccatgaccattgacaatctccagcactgttccagcagaaggtgcggggccagacatgcatatgtgagatggccgctgtggactgacacatgagtgaaaggtgtacgaaatgcaggcagaggatatcgcagcaaattgggatcacatgcttatgtctccacagtgaacacaggcaactgcaggcagacatgtcattatactcccctgactctactagcttgctgaagtatgagaccgctattactgtcttgcatgtacttatgggtaagggatgtggacgtagaacagatggactcatacaggcggaagctagcaaagatcaaaagcaaagtgtcgatgaaaggcatctggctgacttgccaatcgaagtgcggcaagggcacagggaacatagcgcctgatgccatatggagggcgatgacatcactggggggagacacatcccttttgggcaccacatatgaggcccaccttagtgaggagaagccatatcaacgtatgaggtcataatcaattggcgcacaattagcaccgcattgtaacataaaaatctagattgacaatatacagaccgattagccaatcgagagccagtccacattgaggtcaaacgaaaagcaaggattagaagtagcaccatgagacaagcaccaaatggtataggcaaccaagtatacataaaggacatgcaataccgacgacgaaaaaaagacaccataagagatacaaaggaagacataaccatcgatccacaataacatagcaaacgcagaggagaaatacattagagaacaatcactagacgaacgacgtatgagaagaacaaattgcaatac

SEQ ID NO: 648326 - DNA, 177 bp, Homo sapiens
gcgttaccgcgccatgtctgcttggccctgctgcagggcggcctccagcgtcggacaacttggcgttagcgatccttaatggccagctctccacgctgctcggcatctgccatgtcggcctcgagggactgccctctaggccctttgaggctcctgaatcctcacgcctgtgagccg

SEQ ID NO: 648327 - DNA, 971 bp, Homo sapiens
tgcggcctggcgctgctgtgcgcgctcagcctgggtcatgctgccccaccgtggggtccgggtgcggccctgggctgcctcctgcttgtgtgacgggaacggacgcgcgctgctgccgggttcacactgaccgctgctgctgccgcgattaccctgggtaatgtaaaccgcgttcacttaactgctggaccgtgccaatggctgtccctgcgtgaagccagggatgggtgtggctgcccccacttccactgtgctcatgacctggagttgctagagtgtctaaaggagtggtggtgcaacaagagaccagatcacgacagctggtgacgccttccggagcgggaggcaggatcccgaacagcggcagagcaggacgagtgttgcccaacatccaggcccaagtaggacccggcaccgggcacagcacgggcttgacgcccatgtcggcgaagctggctcctccaaagaaaggagatcatcgggcgtctacggaggggtgtgcagcgatgcgactaggaacccgagagctaccactaaaattggagcgaaggcaaaccgactgtcaaccaccaacttggacccatatcagacaaacatagaacaaacaagtacgcatgaaccacaaaatatcaaggagacacccaaacttgacaaaacgtttacccggtgcaagatccatagtatagaatcttggaacatcatggaaaagtgaaagacccatacgcacagcacaagagacgaagattacaaatgcaatggaacacgccgagcactgggacacttgggaactaagtgacaagtatacacataccttaaaggtaaaacccacacgaagaagcgcatctaacatccatatgcaacgaggaccattgatattggattgggcaatccaagaatagccaatacgtcgacgcagcacacctcaacaaaattactatcacgttagatagtcaaactcatatacactcccg

SEQ ID NO: 648328 - DNA, 1318 bp, Homo sapiens
cctgtaactgcatcagctgcatcaaattatgctaggatgatcttatcctgtagcttcgtcttaggactaatgtgtcaccataccctagaactcgctaggaacggctgttctagggaatagagtgattacatatccgagagtctcgagattattgacttgaccaaaatccgcgatgagtcgtgcttcagatggaaggcaaggatgggtgaattatcatagctttgtcagaaagtgaccgtaattgctactcttacgattgaggcgttagtacttgaccgtgaacaccctgatgaataattcgcttcgctactacctatgtacatgcagatgcagcatcctatgttctcgtgtgatgcgtaaaagatgcgaattgtggctagtattaccgcattagtggcgccagtttatagggcatgtcgatagactcatatttctcacacatttcaacgggttgggtaatgatacgttgttgctcaccgtagagtccatgaaagctctaccagttgtggttccgtttgaagactgggtcggacacacatcgcgtttgatatggcgcacctctgagtgacgttagcgaagctgcggtctacatggcatagggagtttcaggtctgtaaagcatataccaatgtggttctcgcgagagagcgacttgtcagaaaaacgcaggtcctgggaggaagtaagttaggccctaggcattcaacacctaggtggactgcagatgaggtcatactgcggagttgtaagtgcccgttacatatgggtccccagttgcggtgagccttgaaagtaccttgtgtcacatagtagcaagattccctgggagaagggcttcctcatatgactcgcaaaagagggggatgcgttggatcgggcttttgtcaagtgaacccgtagtcactccttttcgcgtgttcacgctactagtgggcacgaaattcgcctggctgttcatttggtggaaggccttgggacgtcgagcgtttggtgtaggaccttcaaggataggggcgaaatcctgtggattgtaaacgctattacgttcacctaccgagcctttagtgcgagcccttgtaattggaacctcatggaaagtccagacttgcgcgtgtatatcggaatccccagtgataatagttacctggtgcgaattggaaatcactccaggaaggcataaaaatgctcgcatggggccacacattgtggcacacgcaggagacactttctgtggtctgaaagcgcaaggactccaacgccgtgagatcttcagaaccactggtcaccgtgagaacccagcaagcgctttctgcagacc

SEQ ID NO: 648329 - DNA, 460 bp, Homo sapiens
  misc_feature (246)..(246): n is a, c, g, or t
  misc_feature (255)..(255): n is a, c, g, or t
  misc_feature (285)..(285): n is a, c, g, or t
  misc_feature (294)..(294): n is a, c, g, or t
  misc_feature (312)..(312): n is a, c, g, or t
  misc_feature (322)..(322): n is a, c, g, or t
  misc_feature (401)..(401): n is a, c, g, or t
  misc_feature (420)..(420): n is a, c, g, or t
gagctggacctcagtacatggaggatggaactctagagaaggctggtcagtactactctggagcatttctcatcagtagttcacatacaaatcatccatccttgccaatagtgtcatcctcatgggtggtgaggtcatgcgcaaagactcaaaagatgatgttatcaatgggtacccagtgaaaaaggggacaaatattatcctgagatattggcataggatgcacagcactacgagtttttcccncaaacccanatgaatttactctatgaaaattttgcaaangaatgttcncttataggatactttcangccatttggnctattgggccccagatggctgtgcacggacaagtacatttcgccatggtgatgaaatgaaatgccatcctcgttacacnttctagagacgattccacngtgaagacattgcaaggacagtgtgttgagagcatacaga

SEQ ID NO: 648330 - DNA, 283 bp, Homo sapiens
ctctcagcagagaataaccacacaagccacagtataggacacagcagtcacacactaggcatcagacacaggactaatgtccagactccaaaggaactgaaagaaatcagcaagaagaaaaggtgacaattaccaccttcctgactcattggccagaaccaatgttagtggaattaacatatgccccaccccaagtgacttctaacgggctcactcaccacaaggagagtcagagcagatcttggaactgagacctacaggacacaggtactgcttctactct

SEQ ID NO: 648331 - DNA, 669 bp, Homo sapiens
  misc_feature (33)..(33): n is a, c, g, or t
  misc_feature (51)..(51): n is a, c, g, or t
tttccaaccattcgcacttgtaccaagatgccnttccccagtctgtcactnactatccctgtcaccttccgttcgtaggtcttgttgtccaagctgattttacatgatagtttctcatacagtacaggctcattagaaacgccaatacattccactcagttctcgaatgttctattcattgtagcattaccataggtacaggcagtctgtatgccaaatgttcatcagacagtgaccgctgtaggttacggggtcatgacaaagtcagcaatcctaagagcctagttaggcacaatgtttgccattatcattttaggctccccccacacaggcctccatatgtgcttttaaggcaggatcctctctgtaaattccctcataattcgatgctctttcaattcgctcatcattgtcattcacacgccgtctgtgacacacgtggatctattccagcagagcccatttaatctagtcataagagatccatatatatcgatatatgcccacatatattggactattatctaggttatttatagattacccgctcagctatagggcacacgtgcacagtgtgcaggcatgctccataggcactcatgtgccatgttggtgtgttgtacccagtgtatgctcgtctaccgtaggtatatctcgtgacgttggtcc

SEQ ID NO: 648332 - DNA, 170 bp, Homo sapiens
  misc_feature (50)..(51): n is a, c, g, or t
gttgccttcctttcagaaatggtggaagtcctgcaaatgcataactgagnnactggatttaacctatcctggaaacatctgtgaaacaaatattgttggcggagattggacttaggataaagtggatacatttttatttacacctctgtattgactaatatggctctcaa

SEQ ID NO: 648333 - DNA, 108 bp, Homo sapiens
agctcttgctctcacccatctgcatatttcacttcagatacctttccccgagctagttaccattgcacctctagctgtcacgcagctcacacagcatggaacaaaatt

SEQ ID NO: 648334 - DNA, 265 bp, Homo sapiens
cggatcctttgatggcaggacactggggagtgggcattgtaaccggggttgttgggaccactcttggggtcaggccctgggtgaggcacaggaggctgcacacatggcactgtggtgggttctagccgggtcaggctgggaaggcaggagtagtgtctgtggcaggatgggaagaagcttcagtacttccctctcttgcacctctgcccactccaccttgaggcgttggctccctccccgctcatcctctcaccacattgcctga

SEQ ID NO: 648335 - DNA, 543 bp, Homo sapiens
  misc_feature (56)..(56): n is a, c, g, or t
  misc_feature (80)..(80): n is a, c, g, or t
  misc_feature (87)..(87): n is a, c, g, or t
tgaagtccttgcttgactgattgctttctattagcagaaagaaaacaggtccatcntatgtatctgagaaacaacatcancaccctntcgtatgtggtttgtattccctgacgcggcggacatttttgcagcagaaatttctccatcactgtccagattctggccctggtgggcaggtctccatgacacctttagtccctctgttcaacattcttaaaccatggacctttttgtttgtttgtggccgggggaggtggtgagaaacgttacttgaagcttgatcattctttcaatttcatttgtttctttatttttaatctgttagatgcaaattgaaatgcaatgctttttgaaaatcagcaatagtgtctgtagtatatgatgctgtcacaaaatctcaataaattgatcctgctgccattccttccaaatacccatccatgcttttcttcccctcgtgttttgtttggtttgttttaaacttttcgtacatgtacctctctcccaggtttaacaagcatgacgagaccactctggcattct

SEQ ID NO: 648336 - DNA, 460 bp, Homo sapiens
aggaggttagaaagaggaaaacggggacgggcgcagtggctaacgcctgtaatcctaacacttaaggaggctgataagggtggagcacctgaggtcaggagttcgaggctagcctagccaacatggggaaaccccgtctctactaaaaatacaaaaattagccgggggaggtggtgagaaacgttacttgaagcttgatcattctttcaatttcatttgtttctttatttttaatctgttagatgcaaattgaaatgcaatgctttttgaaaatcagcaatagtgtctgtagtatatgatgctgtcacaaaatctcaataaattgatcctgctgccattccttccaaatacccatccatgcttttcttcccctcgtgttttgtttggtttgttttaaacttttcgtacatgtacctctctcccaggtttaacaagcatgacgagaccactctggcattct

SEQ ID NO: 648337 - DNA, 117 bp, Homo sapiens
tagagtggcgtggagtgcaagaacccggctactgccgagctgttggaggaggctgaagcggctggccaagtccgaccccatggttgcagtgcttcatcgagggagtcgggagagcac

SEQ ID NO: 648338 - DNA, 958 bp, Homo sapiens
  misc_feature (958)..(958): n is a, c, g, or t
ctacttgggaggctgaggcaggagaatcgcctggacctgggagactaaggcaggagaatcgcctgggctgggaggcggaggttgcagtgagcccagacggaccattgcactctagcctgggcaacaacacgaaactccgtcccaaaaaaaaaaaaaaaaaaaaccccaggggggttgaggttggcaaaaccgaattacccttcttatttataaccgccattacttccgtgtttaacagaggaggaatattaagaagagacaggtattcaaggcgagagagctctcaggggtgcacagacacctggtggaggggttggaccttacaagagcttctggcgcttacgaaaagttcttctttagacggggtgaattattcgccgagtatagagaacgtgtataggggtgcggcgttgggataagagagcacgtgggggggggtgtcgcacttttaggcggaggagaaggggagtatgatcaaggggaggtaattgctgtttataagcgacgacgccccaaaaagaggagggaagagattatccaaggggtgtggcgacaagggcgagatttgggcccttgagcgagggtggggggggatatttttggtgcgcggcgccaatagtgggacatttccttttacggcaaaaggtgttccgcaatatgaggtgggttcttttacaacccactgtggggggtgtggcagacagtgcgtgagatgagacaaaagttgtgttacaagacagagtgttaatgtgggagcgcgcactcacgtgggtggggtcttctgtgggagagggggtctctaaagggcgaggaataacggggggtgaaaacaacgggggggagaaggagaagaggagaggagaaaagcacagtataggatagaagcggcccttttgtggaggaatatttatgatgatatgacgactatgtgcggaacacacatttttttttgtttgtn

SEQ ID NO: 648339 - DNA, 311 bp, Homo sapiens
atgatgtgacggtggtagtggaggtgaaggagatataaagtcctctcttggtaaggattccaagggacacgtgtcaacctctataccagctctggctgcgtctgccctccacttaaggtaaatgaggaatatatcatcatgggctatgaagatgaggaacgtaccagatgactctgggtggaaggctctatagctgagaagtggaaggatcgactcggtaaaaaagttaagcgctgggatatgaagcttcgtcatcttggactcagtaaaagtgattctagcaatagtgattccactcagagtcagaagtc

SEQ ID NO: 648340 - DNA, 921 bp, Homo sapiens
agtcgtcggggtttccgtgcttcaacagtgcttggacggatgccggcgctcgttccccaccccggtgcggccgcccactagccggccctccgtcacctcttcaccgcaccctcggacggccccaaggcccccgctcccgctccagcgccgcgcaggcaccggcgcgtcgctgcgcctctccttagtcgctcggcatgacgcaccgcgtccacctcgcatggtgcccggagctaccatcaggactcagaggccggcatcaaccgtcagatcaaactggagctctactgcgctcctagcgttgtacctgtcctagtggtcttacatatcttgtgactcggctgattgatgtggcttgggacagaggttttgccgagtatactttgtctgacaccaatgctcatgaggagagggacccatgctgcagaagacctgatggaagctgcacgaaagccaacggagtgttgtgaccgaagtcttgcgctgtgagagatatgcaagaaagcaagagctgtgatgacctgggagagcggtgctgaaatgttcatggagtgtgcattgatgattgtggataaaaaaggtgtgaactcagtcagtactggaactgggacaagactggcgcccttgatcaagtaatgacgccatttgtgttgactttcatttgaagacacattataccttgaattgagccggtgaaaagccttcaaggaatggggtgacccccgtgaccaaacttgggcgagatgggagcgcgcgaatctgcttcgggggcatatctctttgaaaagcaccccctgggacaccgtgatactgaaagctacgcctcgggctaattcccattagccgtgggttgattcctcgttcacgccaggacatgatgttgtgggttcctaacctatctaacgtttgcaaatccctaagccg

SEQ ID NO: 648341 - DNA, 137 bp, Homo sapiens
aggaggttgagctctggcagtagggcacgactgctgctgggctgagctcttgccgaagctgaagcttccttcggcgctatgcaggagttggggttgagactggagctggccttgggatttaatggggaagaaggcct

SEQ ID NO: 648342 - DNA, 85 bp, Homo sapiens
ccatttccgtggtttctcatgagctgtgttcacagacctcaagcagggcatcgcatggaccgcaggagggcagattcggaccact

SEQ ID NO: 648343 - DNA, 182 bp, Homo sapiens
atcaactattcacctagtacaagcttcacattacaatttaatcaaaggtaataaacatgcacaaaagtcaatatctcatctatatgccagcagtttaaatgctattggttcagtctcagcacattttcaaacaatatgacagttatcacttaactaacacaatctttctattatttcactga

SEQ ID NO: 648344 - DNA, 332 bp, Homo sapiens
  misc_feature (304)..(304): n is a, c, g, or t
cacagtaacatgaccatccctctgctttctgtacctggaatgctgtttcaagagaccaaaagccattaaaaaataaaaacatccctgaaagatggatattaacactatttactaagaggaagcattactgagttttcaaatgcaacatgcacaataatcaaaaagcttaccttgatgacctgttggggcagaagcaaccagggtaaagagaaaccacaagttacatctattctactaagctggtaaagagacactccgttttacctcgttctctggggtgggagatggcgttgcgagaactaangtgacccgtttcctaaagaaccctggag

SEQ ID NO: 648345 - DNA, 111 bp, Homo sapiens
tgcagaagtggagctgctatagacatggcccctcaccaggagagtcatcagtcccggagaaacttgcaggtaaggccgactatcacgtgacaccagcttgctcctgggata

SEQ ID NO: 648346 - DNA, 311 bp, Homo sapiens
  misc_feature (142)..(142): n is a, c, g, or t
cttcccttcttaaaaccccccccctttttttttagggggaagggcccgtttttttcccaggtccccacggggggggtgaaagcattgtttttgggtaaattttggaaggcaaaattttttattttttcccccaaaaactttntattttggttttatttggaagggggggctttggggcccccccttcccctttttttttcccccaatttgaaaggtttgagggtttttgttttcctggggggggggggggggcggccggggtttcccggtcccttgtttttggcccgtttgaataaaggggccccctttta

SEQ ID NO: 648347 - DNA, 779 bp, Homo sapiens
  misc_feature (616)..(616): n is a, c, g, or t
tttttttttcagaacttgtcaggcatggctcagagcttgaagattaggagaaacactttcttattaattcttcacctgttatgtatgaaggaatcattccaggtgctagaaaatttagccctttaaacacgtcttagagccttttatctgcagaacatcgatttgtgtttttattcatttcatacagaattaattccagttattgcgtgattttaaaggcagagaagtttctcaaagtttaatttcaccctatgtgtttatttgggtgctccaacgttgtgttatgtgtttgaacattactttcaaaaattaatgtgtgccagtggtgggttgagtttaattttaccaagagttaactttactcgtggtgtttaaacaagtacgttaataactgttatggtaatctttcatccaaaatatttttcggcagttatattagtgaagatggtttcaactccagattggtcttgcaacttcagtttatattttggccagggcaaaaaaactcttaactcgtgtgtgtatatcgagaatcccttaaaattaccagacaacaacattttaaacttcacgttgttatccctaggggatgactgttgatgagtatccttttccncgtgtgtaacccgtagtggtatcctctgtatttctaggccaggttggtttgctaagacgccttaagaggattcctttgcttccaacatagggaaggtctggacttttaaacctaaaagggtctctctctatggtccatggtctgcaggtgcaggtaactaatt

SEQ ID NO: 648348 - DNA, 115 bp, Homo sapiens
aaaaaaaccgccaaaagccaaaatggggggcttttgatgtttccataaaagttttataacccggggaaccagttttttatgtaaaaaattaaaaaactatgatgatgccctttta

SEQ ID NO: 648349 - DNA, 1686 bp, Homo sapiens
  misc_feature (1360)..(1360): n is a, c, g, or t
  misc_feature (1430)..(1430): n is a, c, g, or t
cctgcctagattgtgttctgggtgtgcctcccccttgttattactccatccgccccctgtggtgtttttcctctcattagctcggccggtctgggaaattactatcttctatcagtgcactcctcttcggttgcgatcttgctattcacccgtttgctttcagtggggcattgtctgcttaatcacgtagtgtctttgctctcttttgtgtgggaggtagtttgtctcttcccctactgcctacacatcttatccagcttcgttttttgtttgggtctcctgcggctgtgttgttgtgtctccccttcccctcaccctgtggggcttctcctgctctgaagactggtccatggggcgctctcctccatcattaacattttacttgtcctccctcagttgcttccctgcttggttgttcaggtatgctggagctgcttctcctcatgtggttgtatcttcctcttctgtcctgggggacttgttcttatttgttatcagggtcgcctcacatgcgtgcctttgtgtggtgtgggggcgccctctcttctgtggtgtgtcgtattcttgtggcataccgtcttgttgtttttctctactctcctctctctgtcttctaacctcggtgtgtttgttgtccagcgtaccccaacgagctgttgttgtcccagccaccagcatggggggtatgtatgccttcgccgctgtgtttgtctcgtcttcgtcctgtgcgcttctctctccgttgtagtggcttttctccctgtggtttggtctccctctacctacttctttgcctccaacactctggtgcgccctgctcgcacaatgacagtcgccccttgcggtgccggtactgtgtgggtcgttcctaatctttcttttctggtctttcgccgtggtggcaactcggcgcctgcatctgttggtggccccaactctgtccgcggcgtcggacaagagctttttgggtgtccctcctctctgcaggatgatgcgttgcgccccgcgatgatgtatctttctgttgagtgcgcagagggtgtgcgcggccgtctctcactacacctctcagatcgtctcttgttcccggcgcgctctctttctctctctctcagtgttatgtcttcccagagtatctttgtgccactcgcgccaccctcctctctctctgtgcggcgtgtgtgtgcccagagtgagtgcgctctctctgtgcgcacgacgagctctctcccagagacaccactactgtgcgtgagctctgtgtggtgtgtgtgtttgtgtgtctgcgcgctcaccactggtgcgatcccctctctcccgccaccctctctccctactctccacaggagagcggttgtcnccccctcactcgtgcggcggtttcttacgcgagcgcgctcctctcggcctctcctccgccaccgcggcgnccctcttcttctggtttattgtgttggctcacagaggcctcgccccgccgcgggtgggtggacttttctcctgcgtggcgcttctctccctcgccctcggcgtctccgctggtgttctctctgacatttttgtttccctcttcgtaatatctctctctattcaaggacttttggggaacttgtgcccctgctttttctttttacaaataaagaaacccttttacccccaaaaaaaacacaaaaacaaaaaagaaaa

SEQ ID NO: 648350 - DNA, 491 bp, Homo sapiens
tgaatcgacggtttctcaatcacagttcatatttattggtagaaaagccaccatggattactgcagacaaaatgcattaggatgaaaacagacccaaaatatccctagaaaccaatttaaaaatgatcaactttctaataaatggttttaaaaaataaaaatccgtgagtgatttttaaacacccttatcatagatatatttgtgtttcaaaggattatttctctttaagacatgttaacaattaagaataaaaccatcaccgggtgcagtggctcatgcctgtaatcccagcactttgagaggttgaggcgggcaaagcacttgaggtcatgaattccagaccagcctggccaaaatggtgaaaccccgtctctaccaaaaacacaaaaatcagctgggcatggtggcacacgcctgtaatcccagctacttggaaggctgagattgcagtgagctgaaatcgtgccaccgaattccagcctgggcaaga

SEQ ID NO: 648351 - DNA, 471 bp, Homo sapiens
ctaatgcataagataataattcgcatttaggtcgcctctcccgccttacccccttttcgatcccgataagaggtaacttcacccctctcgccagcttggcccatgttctcggcgccatccagtcctatgcccacctcatccacgtccagcgactcatccgccgttagcacaccgttccggaaggcaaaagccttgtatgcctgcaaagctgaacgtgactcagaactttcgttcacaggaggcacggccttcgataatgcagagtgtccttcagctttcacagccatcttcactgccacaccggagctacaggcaccttcacctttaacctgggcacttccactggtcgtgtgacacaccttctcacatctcgtcttgctgccataaccccatctttacagagcagcgagagtgatttctgaaacacagaattggttttccagcccttgagtggactaccattgctttaat

SEQ ID NO: 648352 - DNA, 273 bp, Homo sapiens
gggcatgtgctcatttaaaaattaacttatagggaggcaaggcgggcggataacgaggtcaggagatcgagaccaccctcgctaacacaatggaaacttatttttaataaaaaattaaaaaaataaggcaggcgtggtggcaggcgccttaatcccagctacttgggaggcagaggcaggataatcttttgaacctgggaggtggaggttgcagcagtgaatcgagatcgagcatggcactctagcctgggggacaagagcgagacttctctc

SEQ ID NO: 648353 - DNA, 183 bp, Homo sapiens
  misc_feature (100)..(100): n is a, c, g, or t
gtcagcatcccctgtgtggacgagagctgcccgagcgtagacgtctgccctcctccccaggagaatcaccctcagcacctgcagacctgcagacacaccntaaaccagagtgcagggcctgtgcctcctggtgaacacttcattcattgcctgtgggccgtgaggtcatcaagttcaggggtc

SEQ ID NO: 648354 - DNA, 744 bp, Homo sapiens
gcagtccacaaggagaagagagtcttcattgaactctttcgaacgaaccttatgacgaactggaggtagaaaccatacacagagccatttgaacaaccttattatgaaagaaaccacgactgaacgaacctaatgaccgagattaacggtaagaacgctaaaaaagaagttcccgacggacactgggacagaagattttgaacgacagggccagacctactactgacacacgggaccgaacggctatgaccgacagggggacggacagagttgggacacgaaggcttacccaagaaacgggaacgtcacttcacagttccaaacacgggacggtctactgaacgacactcaccatgacgacgaaacacgttcccaggccacaagtaccctgacaaaggaaaaggcaccgaacacgcttccttaaaagtttactacaaggaacgcccagtacactttgaacaaacaacttggcacacaaggactttcgtcgacaggaattggacgggaccgaaagacaaggtttccaagttccaacgcaaaaagttacccttgcaaggttttccacaacgcaacaggattggttccccaccaaaaaaccttttccccgggaactccacagctcacacgggacagcaaaggtttatttggcacggtggacaaagtttaccaagcgtgtgtgcaatttacccaagcgacgactgggttcaatttccacggaaggcaaccaaatgttcctttgcttct

SEQ ID NO: 648355 - DNA, 1164 bp, Homo sapiens
  misc_feature (1)..(1): n is a, c, g, or t
ntcttttatttcgtttgtggctgtctcaccaaaccatctatagtcgctcataagcccgacatagtcccttgcttgttgtgtgatgaactcccctccacaagatgtgtttgtgcttgtcacacaggggtttctccattgctccagaaatgtcctcctgttgttggtgcgacaaatggttctttttggggatcgccaacatagttgaacctcaagggcttggcccctcaaaggggcgtcttgaacacaatggataccttgatccagaggtcggccgttctaacttttgttctcaagattgcgcccttgttgggtaacactcctcattctaatgtgtagttattttctttgtcactcttgggatacacccacttcatggtatcccataagccttttcccccgtataagtaatttgtgtcttccccctagaccaccctttctcaatcctcatctttgtacaacacaccaaaggagatttctacgggacccccctaatctttccgcaccccaagatgtatttttctccttggtaagattccactccctaccaccccaattttcgtttctaaccccacgtggcttctaatgttgaggttgtaaacccaactcccacgcctataccccccttagttaataataaggtatcatctaagcccccagtggcacacctgtagtgacacccacccctggattttacacagccagccttgtggagctctcttagccagtattacccaacctcggggccatagccaggaaacaccccagagaggctccaagaaggggccagccctcccgccattagaggtagtatatctgagcttcttgccgctccttcccagaggccccgagccaccgtcaagaggccgccaccagcggccagccccggaagcccccccggcacccaccatcactctctagaggaaagggagcccaccgcgaggctcacaggcagggccctggccccacgggcaagggcgagcctcggaaaccccctggaggacgtgctgtggctgcaggaggtctcccacacctgtcagagtggctgagtcccaacccatgggccctgaacccgggtcccccttcccgcaagcagcccccccgaatccggaggctgcgggcaaccgttatcccgctggtttaattaacctcccgcgcgctcaccca

SEQ ID NO: 648356 - DNA, 984 bp, Homo sapiens
  misc_feature (713)..(713): n is a, c, g, or t
gcgcctacaaagtggtgctgatcctggtgtggtgagagtgtctgggaacctggataagcgtttcagcgggtggtacgatgccgacctgagacccggtgggtgcacgaggaggcgaggggcggagtgcaggcgctgggagatgctggctatgagtttgactatccatgcttcacgctcagtgcatcaaggatgaagcgatctcgtgacgccgttctgggactacgtgctaggattgccgagttgcagtcagtagtgtgtgctgccgaggtgtgtgagggacgttgagtagcctcgaagtggagtcgggcacgtattgggggagtctataccaggatctcagataaggagcacgaagctgcatgctagagacagtggctgacgtggcccatggttgacgtatcatcggaggcggcgtccgtatgatgtcccgaccaacctcgcagagtgggaggcccacgacacactccctttctacacgtcgaacatcaggataggggggcctcgcaggtctagtgcgagatgctcacagtaaagattcaaggataacccttccgtgatgagtaggtcgtgatccggatacttagttgccatagagtggtcgtgccacttcctggcaatgaagaaggctagattcgcccagagtcacaggcagtggggagaattggtgtactgaatttaggatgaccatttgggagaacagaccgtcggggggntaatttgtccaatgctggtggtggaagggtctcttcatgtgagaggcgtatcaagtggaagcttgatagacatgccagataatgaggtatgacccattttgcttgtatgaattgggactcaggagggctttgaaagggctagtaaaaggccattcatgattgtggggggcatgaagaaagagaggtgagaagggccatgtgaaccttgttggttgcttggattggccatgaaatgtaaagtcggccaagagaataagttcgcagggaaacg

SEQ ID NO: 648357 - DNA, 153 bp, Homo sapiens
tgggtcatgcggagatttttccacagagggggaaaaagtttttttttaaaaaaagaacatattaataaatacattccaaaacagagcaaatgtgttggattttaacatgtcaaacaattctttttattttttttttttttttttttttttttt

SEQ ID NO: 648358 - DNA, 195 bp, Homo sapiens
caaagcgagacctgtcaaaaccgccactcggtgaagaggggtggcagcaccggggcgccacgcacaggcgggaacgcagggcaccccgggaggacgcaagagcgcggacgccaaccaatggaccgcgcagaaccaaaaaggccggcgccggcggaaccaggacgaacccccacccacccacggcccgagcgaccg

SEQ ID NO: 648359 - DNA, 139 bp, Homo sapiens
tgctccggttacattgcaatctagctttattttttaattataaagaaaatctttcatctacagagaacagaatgcgacataatatcaatggcgatgaatgctgggaaagaaaacataagccaagaaacagcgatgtcta

SEQ ID NO: 648360 - DNA, 825 bp, Homo sapiens
  misc_feature (419)..(419): n is a, c, g, or t
gccatgcatcatcgtcaccatgcccccagttgtggctggatcaacactgcccacaggcatgggtgtctgcgtgcttggggacttgcatcagctggagtggaatgaagggggaaggcatctgtgaagcctacctaggcgcgggggatgtagcagtctcgtaccaggcgagtgtggctggaccggtcgtggtccgagagtccatctccagctcttgtttcagtctctatgatgtgctggagctggatcgaagcgatgcggaggagacttcgcgtagagttcatggacgcaggcttgatgaggggataccatgtgccttcacctgttgccctgacgaggtacccggtcatccaacatcaagacatgtcaacacaggcacagtgtatcccaggggcgagtgcctgggtgctgtcgtgcggtantagactagccggtggtatgctaagagatggcgcaagcgtcatagaatggcatacgcactgtaaacctcaagcgcaggcatgcaaacagtggatcgttcatgttgcatgtccttgtcgcacggcctgttacttcaccgtaaccgtagtaaactgggccgggaaggagtccagcttgtgagacggactgcttggggtgcagggcttgggggaagccgccggcggctggaatgttgttagcgttggggccgtttggaattggttgataatgacttcgcaggggggaaccggtgggtcgggagggggcgccgattgtcgaacaacgaggacgcaaggtcggattgggaggcctggattccggaaaaggccattggcctatctaccgtgggctttggtaatggacccccgc

SEQ ID NO: 648361 - DNA, 229 bp, Homo sapiens
aactggaaatttaaaatcatgctacactctcccatccggagactgttggagcaatatagccaaggccgcgtctataaggaattgcacttgacttggcacacatttctatgctgctctgaaggtctcgattcatgttgccatatcccgctgaaaattgttccactatcaggagatttcgacgtgttttcctctctgaatctgttatgaacacgttggttggcttatcgag

SEQ ID NO: 648362 - DNA, 615 bp, Homo sapiens
  misc_feature (16)..(16): n is a, c, g, or t
ccttgggcctcggganccagacgacacaagatgttccccccgtccagtggcttctggcgaacggagcagctggtgcggagtggcgggggccccctgtctctcttctattcaggctcgcccacttcctacttcaccaagcgactgcaggctggcctcgagcagagccacctcagtaaggcaatcggtcttccccgctggggtccggagaagggctcctgggcctcagacccgggcctaatggtcacagccacctgctgaagaccccactgggcggcagaaacgcagctttgaccacactgctgccctcgcaccgagcccagcccagaaggcagctatgtgggccagcactcccaggcctcggacggccactacgcggactcctacctgaagcggaagaggacttcactaagtggctggcaccagagataactcaagggcctgcaccaaatcgcttagggtttactgatgtcaagtaaagagtaaaaataaaccatttactctcttacggtaatagaaaaatctctgaaagactttactgaccaatcagacggagcaccaggagaccaaggggtgtgggggagtctggaggcctcattatgtctctggtatgatccc

SEQ ID NO: 648363 - DNA, 85 bp, Homo sapiens
accctcgggcggtaccgcccaggcagccctaaatccagcctcccaggcccccagcagcgccctccgccccttctgtcgtcttctc

SEQ ID NO: 648364 - DNA, 361 bp, Homo sapiens
cgccatgctgagttccccggcccgcgtgggtcctgtgcggccgagccttcccgacgagcgccggcccttgctccacgatgcccagtcccatcgaccacccaagggctgaggagtgcgggctcacggttacaggattcccatttcagaactacgaccatttgaaaaatagaagatttaaagattgacgcaaagtgcatgtaccatgcatacaccagacggagtctcactctctcgcccaagcttgagtacagtggcgcaatctcggctcactgcaagctccgcctcccgggttcacaccattttcctgcctcagcctcccgatagctaggactacaggcggccgccaccacgccggctaatt

SEQ ID NO: 648365 - DNA, 187 bp, Homo sapiens
acagcaaggagtcgtcaacgagttaaagcagctcgggctggagacatagcattcattcctgttcagattgcgacctttggtggcctcctactccttgcccccaacccggccccgccctttcctttttgttccccagttctttgacctcaacaatattgaggcaattcttttgttaccttgtttcaac

SEQ ID NO: 648366 - DNA, 476 bp, Homo sapiens
tggttttggtcaatttatttagaaaaaaattaagcaggggcaaatgagatacctcagggttacaacagagtatagaaatgtctagcaatagtcaaataattggatctttaaatacaaaataaccacatgaacacctaatatacaggttcatctgaatacatatttattagataaattattagaggtggtcacattcatctaactacattacagccttggcaagactagaaatcacaatttagtttttggaccagtttaaagtatgaaagttgatggcttggtacatacgagtgtacaaagacgagtgagtggttccgtgggggagtaacttcaggcgtgcacgtggtggggtgtgtaatgtgtgtacgtgtgaatcaccggttgatcatgatatcaaagaattatacaaagtatgaattgggttacaatgttcttctgaaatcccggtttctttgtcattatttccatagcacccc

SEQ ID NO: 648367 - DNA, 233 bp, Homo sapiens
  misc_feature (64)..(65): n is a, c, g, or t
  misc_feature (67)..(68): n is a, c, g, or t
  misc_feature (184)..(184): n is a, c, g, or t
  misc_feature (203)..(203): n is a, c, g, or t
  misc_feature (216)..(216): n is a, c, g, or t
ggggctctaacagaaaaaggagttggaatacagaatgcccatcctttccaggagaaagaccacnntnnggtcagaagagcaggtctcaggacagcaggggcagctgctctctctcctgaagcatggctcaggtgtggagaagggtttcagaacacttctgggaatccggtcattaacagctgangagaagacggattacaganaagcaccttgganttgtgcccgtagaccca

SEQ ID NO: 648368 - DNA, 994 bp, Homo sapiens
ccagagtgactcaaagaagtgatggtgctgaacgcacagaatcatttgtatatgagcccaagagcagaagaaaatgtttcatgccacagtggcactgagaatgaagtcttccgagtgaaggtttttaatattgacctaaaggagaagttcacccccaagaagatcattggcctagcaattatgtttgccgcatgggttcctggaggtatattctttcacacttggtggctgatgtgaattggctggaccgaaacatgggagattcccaaaggattgacttagaagtggccgcgtaactcctaaaatcaatcagctttgctcacaaactaaaggcagttctcgtgaaatggggtggttcgagagtacctataaaaccacagtgagggtgaaaatcactctattatgacatacacagataatacacgggacatgggagtggtggtgcgctgggacgacctgagctacccatcaactgtgtagcgaacgcgatatactgtgaaatcacctgcttttgaatttggggccgcccaaaggtgggaatacccgcgagttgagatctgtaattctattagtcacactcacaggcatcaagaccaccgacaaaacacgaaagacatactccatcctgatttccagtatttgtaaacttcacccgacattttcttctaaaaatctggatgtcatttgacgaagcacatggttactggagactaacgacttagtgcttcaaaaatgtcattttccggctggaatcaaaatataataaacaccatattttaactgtatcccatggaagggatcgggaagcgctaactttccacgctttaaaaaggcgatttgctttcactctattgacaaaaaagggggctaaaaacacgaggggcatagacgccagtttgcaagggccataggttataacaagcgcggtacacgagcaaatgatgcacactggtgagaccaaacggaagatgctggagaaaacaaacgggggaac

SEQ ID NO: 648369 - DNA, 181 bp, Homo sapiens
agcgataacggtgcgctccaggtatggccataggtaccgggaagcaggatgagagccgggcggtggagctgcgctgaacctggattcgcgaccgacctggattcgcgaccgagcctggattcgcgaccgacctggattcgcgaccgaacctggattcgcgaccgacctggattcgcgaccg

SEQ ID NO: 648370 - DNA, 1398 bp, Homo sapiens
  misc_feature (550)..(550): n is a, c, g, or t
  misc_feature (689)..(689): n is a, c, g, or t
  misc_feature (889)..(889): n is a, c, g, or t
gcctcgcttattttaacctaggtgattcctcagtggaggagccaccgtctatcgggacacatgagggtgtcaaaccgttgaccgaagagagtaactcccatgttaatcatccctactagtgaacgatctgataatagtcaagaccactgaattgagagaatagccgtgcaaagccatcgacgtcgcattgtaccataggaaagatcccggcagaatcatgagctgtcacatacctacatctacctctaattgagtgcaactcacaatacttattttcagcctaagttatgatacgcagactaattgtgttcagtaatgtaggtaagcaatgagcaaacgttgtgcgtctccctaccggcaatgaattgccttcgcgttctacccagttaatagtaacccactttgcagaccgtggcaacaagagtcttagatccgaggtcgcctaggaatttagttgcgtcaacaagaatatcaaacccaatagcaataggctgccaatatggagtttcaactccccttgcaaggcgtgtgctaccacattcgcgcaaanaacaacaaaggggcccaattgtcttcctgttgaaaggagaccaccatgggttttgacacctatcaataatgttccccggcccgcgcggcagacccttcggttggcgagccacatttgcgtgtatagcttctcccaggcnctatgggtaatgtagcaccacattacaaagtgagtcgaactccttcgtgagatcaattcatcacgacgtagagtttcaaggatgagccgagcctaggcccatttgtctcgcaagtggttggcaccgaatcgactttgtgtttttagaccctagatgctgccagcccgcgaatatagcgctgcgattaatgagtccccggnttggggcatggagacgcaggttgagcaccaagttaaaaagattccactcgtgtggtctctccccttttaaccctctgtaggggaggaagcccctctgtataacttgtaaattggggcacgttgcacaaccggaaggcgcgttatttttccaagcccattgggttcattacatatttactctttctcatgttagaagacccaggcttggaagctagaatatggaagtccccgttggaacccctgtattgtacacatggcaacggggcccgttggggcctactatgaagcaaccctagggcacaaaacagccaaccggacgtgttaggagtgaaacgcctcattaagttgggagaaaggcccttatatagatctgtgtctaacttttacacacctgggtgcacatatccaaaggatataatattccttttaacaacccaaagttatccgctccacacgtagtgtggtgtccgcattataggagagtattaatcgcgaaaagagcacgtgtg

SEQ ID NO: 648371 - DNA, 441 bp, Homo sapiens
gtaaaacttcaacacggtctgcttcaggcagggcttacactcttcccagagggccatcatggtctcgttgcacacttccgggaatgccttcagctttgtctcggagtcccgggtctcatttagggcatcctccttattcttcttggcttcctctaagacactgagcagcgtcttgcgctcttcgttcgttttctctatcagagtcttgatctcctgcacgcccttgacggcattctgaatttccctatcgatgtacttactcccttgagtggacatttcctgcagctcattgtcggagaccagctggtctcccaggacctgcccacgctcccagctcagcagcagccccacacacagcagcagagtcttcatcttgcctcctcctcctcggatactggggcccaagaatgcctcggtctgcggcgccggcgctcgtgcgct

SEQ ID NO: 648372 - DNA, 401 bp, Homo sapiens
cataccgtggaccttctgtaattgtccgttcttttgtctattctttttattatctttttattgttgatctgtaggaagttcttcatgtactccatgcaaaaatcctttctcagatatatgtatttttccaattctgtggcctgtgtactccttctttattttttttttgagacagagtctcgctctgtcacccaagctggagtgcagtggtgtgatatcagttcactgcaacctctgcctcccagattcaagcgattctcctgcctcagcctctggagtagctgggattacaggcgtgtaccaccatgtccggctaatttgttgtatttttaccagagacggagccccaccatattggccaggctggtctcgaacccctgatctcaagtgagctgcccacc

SEQ ID NO: 648373 - DNA, 165 bp, Homo sapiens
ctttgctacaaattaaagaaatcctaaaagttttccttggtcataaagttggggaatgacagaatttttttttgttgtgaaatgtatgtacagagtagaccatctctagccctgtggtgaaaaaggtacactcgaatgtttgcataaagcaagtgccaaatgcca

SEQ ID NO: 648374 - DNA, 190 bp, Homo sapiens
tatagctgacgtgagagacgtgttgcatggggggcatgtggcttctggaagtctctccagtggctctgtagctggtcttggaaagaaatgttctagaccaagggttgtcaaacctacagctcatgggccaaatccagcctgctgttctgcttttgtaagtaaagttttattggaacaaagccatgttcat

SEQ ID NO: 648375 - DNA, 328 bp, Homo sapiens
aggctccagcttacgatatttggaggtcagcactgatgctcacgtgtcgacggaacttgtacagggaagtgcatgcaccgaagtggtaaatacacgtctgaccaggctccatataaacgatatttggaggtcagcacggttctcatgtattgacggaacttgtccaggaaggcatgcaccgcagtggtaaatacacgtcgagctggaggcatgctagcgtagctctggtactgaaaggatcctctaaaagtcgaccaggctccagcttaacgatatttggaggtcagcacggtgctcacgtagtcgacggaactaagtacagggaggc

SEQ ID NO: 648376 - DNA, 339 bp, Homo sapiens
ctcatagctgattctagaggatcccagtcaggtgcaacaatcaatgctcaaggaaataaaagaggatacaaacaaatggaagaatattccatgctcatggataggaagaatcaatatcatgaaaatggccatactgcccaaggtaatttatagattcaatgccatccccatcaagctaccaatgactttcttcacagaattggaaaaaactactttaacgttcatatggacccaaaaaagagcctgcattgtcaagtcaatactaagccaaaagaacaaagctggaggcatcatgctacctgacttcaaactatactacaaggctacagtaaccaaaac

SEQ ID NO: 648377 - DNA, 336 bp, Homo sapiens
taaagaagaaaaagaaatatgtgggttgtaataagctgctgtattgtgggagggcctcagaatggacagaggactcatggtgatacagctgatgtagcaaatggatttggggatgtaaaggtcgaaatggaattatttggtccttttaattaccgcttaacactttgaacaggatcctttgtcaaaatccctaccaactgcacagaatggtttttgactctccttttttggaaaggatcatttttaagagattactcttagactctggcaaaaggattgttagtatattagtccatttgtgagtgggaaaaaaatatctaaaaccactgttaattg

SEQ ID NO: 648378 - DNA, 898 bp, Homo sapiens
cttggaacatagactgtttcgctggggacaaatgcccctgtgggtccccccgagcactatttgtgtgccttcctaatgcggccccccggggtcgcccatattacggtgtgtttcggccagccacttcgttggaacgggcgtcgcctgccttgctgttctcttggccgtcctccgccctgaatgagccggggagctaactcaatctttactgcgctctcatcaggcggggcaaccgacacttcgtttgggcccttttatgccttgcattgcggaccgagtgttcgccgcctccggatttgtactcgacccgagggctgtcctccccgccgtggaccgttacgtgtctggctcccaccctctgttccttgggggctgttatgatcccagacaagtgggcccccccccgggggtgtgtctccaaaaggtgatctttcccatccctgggtcacctctcccaggtcgccgtggcagggtcagacggaccccgcctccttctcaagcgtgggcgtggccgaaggcccacccacataccggtctgccccccctagagtgtcccgcctcaagttaccgccgcccccaggacgtttatgtctgccgcggacaaccgcgcgtgcgcgtgtggttgcctccccaggaggtacgagtgtctcgtctctcaccagtgatgggcggccacccctgttgcaggacattggggcgccctctacatgtacatgtatcatgccgtgttctatcaatcacccctacgccctcccccccgggggaggattgagccctccgagtctctcccgggtggaggggtctgtttcttctccgccacccccagcgctccgccccattgtcgcgctgccctcccagacccccccaaaaaaattccccttctccacccccccataac

SEQ ID NO: 648379 - DNA, 257 bp, Homo sapiens
attgtgaggtaatgatctttcttacttctaatacaccatgcccggctcttttgtgtgtgtaaattttatttataagagatggagtcttgctctgtcgcccaggctggagtgcaatggtgcgatctcggctcactgcaacctcctcctcctgggttcaaacagctctcctgcctcagcctccggagtggctgggattacaggcgcccaccaccacgcccagcttatttttgtatttttaacagagacggagtttcact

SEQ ID NO: 648380 - DNA, 448 bp, Homo sapiens
cgctcccgctgagaggagacagacagagcgactccaccctctagctcgacggcagagcgccccgggcgacaggcccgagacgacaggccggcgcgtgccgggccccacacttcgaccaccgccagcgctctcaggccccggcgcttcccgcgtctgccggcaccgggcccttcgcttcggccgcagaggcaaccatgagcgccgccaggatgggccccgtccgcgtcgccttcgtgggcctcctcgccctcttggagacgggcgggcgtcggccacaactgtgaagggccgcgccggtgcccggacgagccggcgccgcgctgtccggcgggcgtgagcctcgtgctggacagctgcggctgctgtcgcgtgtgcgccaagcagctgggcgagctgtgcaccgagcgcgaaccctgcgaaccgcacgggcctcttctgtgacttggct

SEQ ID NO: 648381 - DNA, 203 bp, Homo sapiens
ccataatggaaacttcctgtcattcaagggccatgtatcccatcaatatggaatcagtaccttaacagaaaaaggcagctcttcaatggaattaaacgtgatataaaatgtttcgataataggcaagtacttattataaacacacggatacagctggaaatatgctcccgtgcatcacgttaactgacgggtaccgagactcg

SEQ ID NO: 648382 - DNA, 1263 bp, Homo sapiens
tttttaactgaaggaaccagttgtaacagtctcaattttaagctaaaacttgacagaactcaaaacaacaatgcagacacctttcagccatggttgtggccaagactggttaacaactgtcactgcaagcaaccaaatgcactgtgatgtggcaccaactcaattagcaagccatgcacatttttcacgccacagcagtgcaaaacacaaggcacacacatctcacgcatggccttgaaagtttaaacgagcagaaactccatgactaccaaattctcatgcacgtggcatcccaatagcagcacctcaatcaggttcaagagaaccgtccagacaggggccctgtgcataccacgcgactagtgacagcacagacatataacagtcgcctgcacgcattgtagcattaagccatctgggcaatttctatcccaacaacgatggctccacaagcgcatatcggctaaactcacccttgcaccagccccttacaatcttccttaaacgcacactcactactttataccttgggacttcgacgctgatcgatattccaagaggacagaagccccccaacggcacctctccggtaaagtgtccttcatcacaagggggcccccgaacagcattcttctatcctatacaccgcctatacatctatccagcttccacaacaataatacacaccagaccaccgaccaacaacgatctgcaaatacaacacacaccctagggaaccaaccacacaaccaacaaggaggagcacccacacaaccaccccatacacagcgcagcacgcaggaccacgacagaaccacataatacgcgggcggcaaacaacaccacagcacgttatggtgcactgcggacgcacaccaacaccaacccgtggtaacctacgcgcacacaccgagacacaaaccctaccgcgccgcgcaagacaaaccaatactatatcagcccacagccgacataaccacctacatgcccgatcagctgcacggcacgataccacctagcagcgagcacacaccaactctcaccaccaacaaggcggatcgctgacaacaacaccacaagagacaaggctgaccaacaccagcccaccacgcagagcggccccccccgcgactacagaatactacgatagccaagcatccaacagcagcgccacagcggtgagccaccaacacgcgggacagcgacccactatgcacacacaaccgaggggcgcactcacacagaccgcgccagacgatggtg

SEQ ID NO: 648383 - DNA, 136 bp, Homo sapiens
gaatgcatcaacgcgcatgtgactgcagtcacatgcggcgttggatgcagtcacatgcggcgttggatgcagtcacatgcggcgttggatgcagtcacatgcggcgttggatgcagtcagcggcgttggatgcagt

SEQ ID NO: 648384 - DNA, 155 bp, Homo sapiens
agctcatctgcaaactccaaatggtagcctcctgaatacacggcttcctgcacccacggcctgcgaacacagaacattggcagaacttcctccctcctagagcctctggcaaattcaatctgcagcgcatcacttcgaggcggtgctctctcctc

SEQ ID NO: 648385 - DNA, 588 bp, Homo sapiens
gcacgattgattttttgaagggtttttcatgtctctatctccttcagttctgcactgatcttgttatttcttgccttctgctagcttttgaatgtgtttgctcttgtttctctagttcttttaattgtgatgttagggtgtcaattttagatctttcctgctttctcctgtgggcatttagtgctataaatttccctctacacactgctttaaatatgtcccagagattctggtatgttgtgtctttgttctcattggtttcaaagagcatctttatttctgccttcatttcgttatgtacccagtagtcattcaggagtgggttgttcagtttccatgtagttgagtggttttgagtgagtttcttaatcctgagttctagtttgattgcactgtagtctgagagactgttggttcttatttctgttcttttacatttgccgaggagtgctttacttccaactatgtgcgacgtggtgctgagaagaaagtatattctgttgatttggggtggagagttctgtagatgtctattaggtctgcttggtgcacacctaataagtttggaataagtgcgacgtggtgctc

SEQ ID NO: 648386 - DNA, 1148 bp, Homo sapiens
ggtgtgaggacagcctgccatagtctggtctctggagcactatggtgacacacgacctcctcccagctctgctttcttgtcctcctggtattgggatttgaggtccatgggtgatccaatcagtcgctagcaatgatgagtatgctctatgacccgatcctttcctcaaccaggtgtaacggaattctcttctaccagttacgtgggagtcatgccaaacgtagcagcctgaccagaaaactgtacgagaacgacgatactctgctccgctgtcagaatgtagaacatcatctagggaacttgttctgcatacacgtcgacagcagccatgagcacttgctacaggcatttataatctgtaccaggtggtacttttccttgtgcttgaagggcagaggatgtaatcaggccagtaacccccactcaattctagtggaatcaatggggaagtagatccaccatatatctctctggatcaccgcagtgttcaggattgtatgcctccttggctttcccaggtaaggcatccattggccagttccgtcacattccactaattctccttacgtccgttgacaaattcctgtttgcagtgaaataaggacacccagaagccagaattgacacagacacgaagcgatggcctaagtgtccaacggtcaaaggtgcgcctactacgaaagcaccggcttattcggggcggactaactcgggctttttccagtgcccgtccgggcccattatacaggccactggaggttatgagttcgccgttaaccagtggttcgccaacaactcccagttggatgtaactcctctaaggaagacacactatgtggggcgccccttatccgataagaagcggggccttgcgggtcactatatatgcccagtccctaaatgatccctaacattaaaccttagggacccgtctgtttccccattaagtgcgcatgctcatgtgtctgtagtgaccaacaaatttctatcgccgcaccacgtgtgtgacagcggccttctgtttacgtggactgcccccctttgctgagcgtgtgcgaccctttttaattaccacacgctcgaggggaagtcggcccacgagagacataccgtatgtctacttactatatactaaattatattcccgc

SEQ ID NO: 648387 - DNA, 190 bp, Homo sapiens
ttgatgcgttctcctgtgtgttttctgtcttgcttcttccaggtcccatgcatgcccagctgcatgttgtccagtacacatgaaaccaaactggctgggatggaagcagattattctgccatttttccaggtctttgatttgcacgtcaaatctgaggctgatcaccccacacttgtttagcctgcctgt

SEQ ID NO: 648388 - DNA, 211 bp, Homo sapiens
catgtttccctatgggttgacctacaaatatggcattgcgccagtaaacgatgcgagttgcctcgcgaagatgattaaatataccgcactttaagaaaattgccaaatccgatatcagagtgggtttgttgcgaaaagttgatttttttctgtcaggcggagaatgggaatatgtttcctttgtacccgtcaggataccactcagtttaga

SEQ ID NO: 648389 - DNA, 493 bp, Homo sapiens
gaggcggcacgctgactgtcgtggggccaggacaggctcagcaccagcgatcagcgccatgggcttgtcccgaggagtcagggaggacacagagcccactctgcagggctcggaggacggggggccagccaggccagaaaggtcaggcacagatgccagtcagcagcgccgagagtctccgctcaatgcacagtttgcacttggtgacgttctcgatgtcgggctggtccgagagcaggtgctgcagcccctccaggagcagcagggccttgtggtagcgtgagacgcacccctcacggggctggaccatctcgtccagggcagccgactgcaccatctgcacagcgtggctgaagatgagcctctcggcagtgatgctgtgaatgcggtccaggagccgttgcttgtccaggaagaagcgctgcacgcgcatgctcaggccctggcaggccaccaggctgaccttgtacagctcattcagcctggggtccga

SEQ ID NO: 648390 - DNA, 637 bp, Homo sapiens
agcgggacggcttgggagagcaagccgcggagagaacttgaagccaccatggcagatgaagattgggaagcagaaatcaaccactcatatgtcttcctatgtacccatatttcgagaaggataggtattcatggagaaaatggagacaattctaactaggactcgagcttcatcgatcagtaaatggatgatggaccttctcgaagagatcatttgatgaaaagtggatttgccatctggtgtggaatttatggagacagagatgctggtgagtgtaataagcgagtataatacatccacaatgggtggtttcaggagtaggaaagagtatggaaacagaggtatatcatagagcagaaggtttgaagatggtgatagctctggttgcttggagagagtctagtaatgactgcgaaagataatcgcaaaagaggaatcagagggttggccaaagagagagcggctcatcgagatggaacatacattggcagaagcttctatggggctatacatgaagaggtggaagaggtagttaccgaagtttgcgtggaggataaggtctaggaacgtccaagataatgacttatagccttgacgacatgtgtgcagcgcacttggtgggcttgaggttctagaa

SEQ ID NO: 648391 - DNA, 534 bp, Homo sapiens
attacatagctagaatataatagaaatgggggtacgcattcccgacagaagcagtgtgttattagttttagaactctgaacagagatctgcgagatctttcaataaagaccatctaattcttcattggctgagaacgacgtttaataatagtcttaaataaggcttagtttgcattgtttgagttcaaggggccttattattgaatggaattgcacaagcctttctttgtgcaatctaaccattgttattggtagttctgtaaagggaaactgtggcaatcgatattggcatgtgtgagttcatagcttttttctggtgagtgtggcttccgagaaatgttgcaattcaaaatgcactaagtctgtgatttattggagatttggagattctaaataatatttttaaaaaacttccatgcaacttctggtttaatgtttggcaactccacatgataaaaaaataaaaacagcccaaccgagtctcggaattaagtattcttctagtaagtgattcaaacttgtaatatttgccac

SEQ ID NO: 648392 - DNA, 517 bp, Homo sapiens
cgcaaaagggcggggtggggggttttcccccccaatttttccctttgggcgcatccaaggaaaaaaacaacccccgataaccctggggatctgcccgggtccggggtcccccaagcttcccccggggcgccgtcccccaagaaggtgagaagctcctaagaaaaggggcgggcccatttgttccttttttgaagcgtgagcaccaaaaactgtgcggcccgggttttttgggccccgtttttatatattaagtcatggcaagtcgcccaccataatttttcccaaggtagattggttgggaaagcacacttccctttgtgtaaaggacttgggtgctgcagttctttttatggccaaagtgtctcctctccctagaaaaaaaaaaaaaaggccaggcccagtggctcacccttgtacttcaggcgctttgggagcctgacccaggcacttgagcctaggagttcgagacaagcctgggcaaaatggcaaacccccatctctcccaaaggtgccgggt

SEQ ID NO: 648393 - DNA, 816 bp, Homo sapiens
cagcatggcggttggcagtaacaagcgccttacgatgagtgcggtaatagggagccgagatagtaaatgtggtagatccattttctatgagagattggtatgatgtgaaagcaccgtgctatgcttcattataagaaactattgggaaagactgctcgtcagcagggacccaaggtagccaacaattgacatgctgatgcgtctcaaggcgttcgtgtgcttctcgagagtgagttcttgcctgattttcgcagaatgatgaaagtggcatttaggaaatattcagagctgattactcgaaggatgttcatgtgctacaaagactgacctgtagctaatcgttccatgggctatggcagtcttaacccgtgaacaaacatgtgttgccatgggtcaacaaaactgtgcagaacaaatgattgaacgctcacggttgattttctagaactacacgatggtgtacttgtcttcgatcgtgtgtctgtggtcggattttaactaataaaatggcagacacatcaggatacaggacagactctcttattgcctcagtgaccaagcaaggtaccgcccaaagtcgcggaacgaacgaatgatgcgaaatcatgatgccgagaggtgcagactgaatgcacttgcaacgaagtggtccatgaaattgagttaccagtacagcaattggaacaagacatacgaaagaggcttgtcagatctatttatcctctccatgatgtcttcgtcgagaacaagtactacttgctgcaagaagcgccaagtttgaactcggagagacgctcaatggagcttcatggtgaa

SEQ ID NO: 648394 - DNA, 663 bp, Homo sapiens
  misc_feature (594)..(594): n is a, c, g, or t
gttacactagagtaagagtattatagacccaaggacttcttgtgaggtcaagttcagatattgatatgaatatgagaataccaagggtcccataggtagttcagtagtaacgtggcaaagtctaaacagaaatgaacaaaactaatgctagcaggtaaaaatcaatcaaaatgttgaaaaattgattctgtcctcagcatgttatttcctcaggctctgataattgagtggtgcgtgggtatacagagaatttgatgttgaacgttataaagtcaaagaactgcttgtttagatgaggtttatttttatttctgatattattcattcttgtcacacatcaagaagaaaacactagagtgctgctggaattccaaatctgaagaattctaacgactgcattcttggttattaaaaagggcacaatccttcctttttatttggcagtttaatttcagtaggaagcatgtcacatgtgcactgtaggttagaattatgcatctgtcatgcctgactgctgaaccctacctaagcctttgggcgcagtataaaacctatactggtggactgtgaacctcaaaacaaatgggtattgtngggtttcgaggatagatgttactccttaaagttggtattgggggcatggaaaactactgaaagacgaaa

SEQ ID NO: 648395 - DNA, 228 bp, Homo sapiens
cacacccgtgccagcagactgatctgtctgggcctgaattaattcaatccaggaatagactcccagcttatccaaggtgcctcctgtgtgcccagaccacgtccggtgatcattggcaaccttgcagccacatgccggcagggcaggtgggaggaccaggctgaccttgtcaaccacacccccttgtgtatgcttgtccacaagctgctggcgccagtgatcagcggt

SEQ ID NO: 648396 - DNA, 422 bp, Homo sapiens
  misc_feature (157)..(157): n is a, c, g, or t
  misc_feature (176)..(176): n is a, c, g, or t
  misc_feature (326)..(326): n is a, c, g, or t
tgggtgcctttccatgtgcatgatgtggaaaggtctgatgcatctttcataaaatgaatatcaaatgggattgaggatctttggttcgagtgttgctttgcaagaaacattgtcagctgctgctttcttccttcagatatgaacatttcagcctggnctctacagtaccatgaaanctaaattacttacttctctccagcttaatcctaggtggaggaattctagctgtggtttgtgaatgtacacaggtcagagaggtttagcaccttttgggaggaggaggtcagaatgcggtggtgaaacctctcccactgtgaccaacaaancctcatacttaaaaagaagcatgcacctctggcttaaggatctggatgctactggaatttttgtctgtttcaattgtattcattagctttgaagag

SEQ ID NO: 648397 - DNA, 293 bp, Homo sapiens
  misc_feature (98)..(98): n is a, c, g, or t
  misc_feature (124)..(124): n is a, c, g, or t
  misc_feature (127)..(127): n is a, c, g, or t
  misc_feature (136)..(136): n is a, c, g, or t
  misc_feature (192)..(192): n is a, c, g, or t
  misc_feature (197)..(197): n is a, c, g, or t
  misc_feature (221)..(221): n is a, c, g, or t
  misc_feature (281)..(281): n is a, c, g, or t
  misc_feature (290)..(290): n is a, c, g, or t
gaagatccgcgaccaggacaggaacacgaggcggatgaggcgtcttgcaacacggccccggctgggtaaccagcccatcagcacacggctcccacggnattctcagaagattgggccgcctctnctncatcttctngcaaggacagaggcgaggggacagcccagcgccatcctgaggatcgggtgggagtngagtnggggcttccaggtggcccttcccngcacacattccatttgttgagccccagtcctgccccccaccccaccctccctaacccctncccagtctnttg

SEQ ID NO: 648398 - DNA, 223 bp, Homo sapiens
gagctcgaattcgtcgagccctcggcatagtggctgtgggagccctgatggccctgagccaggggtgacccctccccagatccccagagctgattccccacacctccttatttggccagtctgcctcaaagggtgtcaggaccatgggctccatgttccgtttttttttggcggccctggtccagctctttctgcccacagcggctgcctacacctgcgtgag

SEQ ID NO: 648399 - DNA, 253 bp, Homo sapiens
  misc_feature (46)..(46): n is a, c, g, or t
  misc_feature (83)..(83): n is a, c, g, or t
aggagggagttaatccaaaccacacaatgaagtcttcaaaccaccncccgaacagggctgctgattgttcctttcacttttgnggtgaccttgagctcccttaaaaaaaaaacttggagaatcacaactggcaatgcaccgcagttctcgaactacacaagcatagtctgactaagtcacatgtgtttccatatcaacttgtttgacagggcgacctactgcaaagcaggctcagttaccccaccagtcaacc

SEQ ID NO: 648400 - DNA, 177 bp, Homo sapiens
  misc_feature (161)..(161): n is a, c, g, or t
cggctccctcccccgcgtccctgcgaccgccgcggcgaagatggcctcaggagtgcaagtagctgatgaagtatgtcgcatttttgtatgacatgaaagttcggtaaatgctccagcaccagaagaagatcaagacaaagaaagaagtgctgtcatttttntgtatcaagtgcagag

SEQ ID NO: 648401 - DNA, 269 bp, Homo sapiens
gttagaggtacactctcagcacttgggatgccgaggcgggtggctcacaaggtcaggagatcgagaccatcctggctaacacggtgaaaccccgtctctactaaaaatacaaaaaaattagctgggcgtagtggcgggtgcctatagtcccagctactcgggaggctgaggcaggagaattccttgaatccacggacgggggaggtggccgggcaccgagatggtgccacggcactccagcctacgcaacagagtgagaccggtctcac

SEQ ID NO: 648402 - DNA, 195 bp, Homo sapiens
  misc_feature (18)..(18): n is a, c, g, or t
  misc_feature (65)..(65): n is a, c, g, or t
  misc_feature (68)..(68): n is a, c, g, or t
acgggggcgcaggacagnagtgcgcgaggaggggggggggaggggggaggcgggggagggaaggnggnggagagggcagaggacgaagagggccggggagaggcggagaggagccagccggcgccaaggggccggagcggagggggggcggggagcatcggcggcgcctctcagagagggagagcgcactctcgg

SEQ ID NO: 648403 - DNA, 686 bp, Homo sapiens
taaactctaagtggttagccagtaaagaccaaagataagagctagaataactacagaaatgactaaaaagagcattatacataagtatagactcagacacataatcattgaataacgtaacccactatgtaagtaaatgtagtaaataaaaataacatacaacaagtatacagtctaacaaagtatgccgtaaaatagtatctagatgataaaaattgaggtataattcatcctaaattccaaacttgtaaagtgcagaaaatataatagaggaaaaaaatacataaacctaagagagtataagcttcatatataactactactttttataaggccaatatatatatatagtaaaggatctatctatatataaatatatagtaatcaataagcatattaaaactgaagtgggtgcatactattctctgttcatgagaacagagaaattagtgtcctgaatatttgaaagtgtagcttatatcatgagctattcccccatgtagtagatatctagaggctagttttaaaaacgagaggcattggggtgcatctctctgacaatctgtataggatccaagtaaagcccttttgatgtcctcaggggctggtggtcaaaaagatttcgagtggacgagttgtatttctggcaactaggctctctcaggttattttgtgccttcatggtc

SEQ ID NO: 648404 - DNA, 480 bp, Homo sapiens
  misc_feature (29)..(29): n is a, c, g, or t
  misc_feature (41)..(41): n is a, c, g, or t
  misc_feature (74)..(74): n is a, c, g, or t
aaaaaacttcctctgcctaattccccaantcctgtgaactnttaggccaaagttaacttcctctgtgcctacantttccctcctaataaaattaaggacagtaagcaccctgccctcaggggggtcctccttaaaataagttaaatagatgccaacatgtttaagaacattgcccatgggctcggcgctgtggctcatgccctgtaatctcccacaatttgtgaaggccaaggcgggtggatcacctgaggtcccggagttcgagacccatccctgacccaacatggcgaaaccccgtctctactgaaaatacaaaaattagcccaagtgtggtggcatgcacctgtaatcccagctactcaggaggctgagacaggagaattgcttgaacctgggaggtggaggttgcagtgagccaaggtcacaccattgcactccagcttgggtaacaagagtgaaactccatctctagaaaaaaaa

SEQ ID NO: 648405 - DNA, 825 bp, Homo sapiens
acggccggggtaagtgtacattgtacccaatatgtggttttttataccttgcccccctcttaccctccccacttgagtctctagtgtccaattatgtcactctgtataccttttgtacccataagttagctctcacttataagtgagaacacacagtattgggttttccattcctgagttgcttcacttagaataatatcctccagctccatccaaaatgctgcaaaaaaaaaaaaaaaccacaaacttcaatttgggtgcttttttatgggcgtaagtcatatcccaatgggtggtacgagataccaaatttaattaatccactcactgggtcggatgcggtgggtcccacatcttggcattggtgactggtccgtggccatcacggttgtcttcggggtataaggactctttcctgtggggtagatacccaggagcgggcatcggctcaaatcaatggggttctcaacatttttctctggggatctcattcctggaaatttaaaggcaccagtatagggtgcgtcggtcggtaaactcaaaatgcatcggatggtattggctcatccactttttacacttaatgcttaaattccggtatagtgcgggttagaaaattcttgtaggcacgaatttctctttgtgggactcaattacaatggagtgggtaatttaagtttaatcttggatgacggagaaacgtggttccttaaatgggactaagtgggtaaaaagggcagctttcggttctagataaaattaggaataagaggatctatgtaagaaatcttcattaaaatattacggggtgataatttaggtatg

SEQ ID NO: 648406 - DNA, 315 bp, Homo sapiens
ggtgtaacagtgaaaacaaattccctactttgagaccagtgccaaggagcgccatcaacgtgagcaggcgtgcagacgattgcacggaatgcacttaaggcaggaaacggaggtggagctgtacaacgaatttcctgaacctatcaaactggacaagaatgaccgggccaaggcctcggcagaaagctgcagttgctgagggggcggtgagagttgagcacagagtccttcacaaaccaagaacacacgtaggccttcaacacaattcccctctcctcttccaagacaaaacatacattggatcatctcactatc

SEQ ID NO: 648407 - DNA, 650 bp, Homo sapiens
caacgatggtctcagctactgggggctgaggcaagaggattgcttgagcctgggaacttgaggctgcagtgagccgaggtcacacctctgtactccagcctgggtgacaaagtgaaaccctttaaaaaaaaagttttttgttttttttttagacagagtctcgctctgtagcccaggctggactgcagtggtgcaatctcgactcactgcaagctctgcctccgggattcatgccattctcctgcctcagcctcccgagcagctgggactataggcgcccgccaccatgcctggctaatgtttggtatttttagtagagacggggtttcaccatgttggtaaggctggtctccaactcctgaccttgggtgatcctcccgcctcggtctcccaaagcgctgggattacaggcatgagccagcgcctaccaccgctatgggtactttcacacggatgctaaagttatggtgctggccgtgttaagggtcaggcatcaaaatggccgctcaagagaatgaagctttctctttgtgcagatgcaacgggtgggatggggtgcacaattatcacagtgctggttgtggtgtacctcgacttctgccttaagctgaggaccatcgtggggtacgagctcgaatcgtatctgctag

SEQ ID NO: 648408 - DNA, 150 bp, Homo sapiens
gggagctccaggtctcgtcctcactactctgtgtcttcctgcttttaggggcgcactcttgttggccctgtgaccctgcccccctggaagcctagaaattggactgttgacatttagggatgtggccatagaattctctctgaggagttg

SEQ ID NO: 648409 - DNA, 165 bp, Homo sapiens
cactaaggatggctctcgagcatggaagtccaaagctaggcagaccaagggagtacccaatccaatgcaaacagcccagtgccttccagtccaaagctaccaagaactttccgtcagcccaccgtcaggacggctctatgtccgacacctttcggaggtcctcgc

SEQ ID NO: 648410 - DNA, 303 bp, Homo sapiens
acaatccatatggtcttagggaaccagggaggccttgaagagagcaacaagagatgggggaatgcccacttgctcaagcagtcagaatacacacaacattgataatttaagttagccatcttatatgagcatagttcatagcatcccaaaacaattacaatagtaacatcaaagatcactgaccacagaacaccgtaatagactgaaaagtttaaaatattgagagaattaataaaatgtgacacaaagtgagcaccacagacttgctcacccagggttgccacaaaccatcaatttgttaaa

SEQ ID NO: 648411 - DNA, 265 bp, Homo sapiens
  misc_feature (7)..(7): n is a, c, g, or t
tgtgtantgacgcatcaggcgggtcatgctagccgagggcatgtatcccatgcctgattgaagtacttgaaggctcaggagcttgcgcggctggagatctgcgggaggccgcatagtccgccatcttgaggagagtgtctttgttgggtccaattttgagttgcactccaccacggcatccactgcaggcgagctgtccccaaccaccaacagagcaggcactgcagggtttactgtgtgggttcccggcattggtcgctcaatc

SEQ ID NO: 648412 - DNA, 107 bp, Homo sapiens
ctcatttagctccatttatataatcatgataaaatgtaaatttcaggaaactcatttagctccatttatataatcatgataaagatatataaaatactcaatttcta

SEQ ID NO: 648413 - DNA, 1060 bp, Homo sapiens
  misc_feature (468)..(468): n is a, c, g, or t
  misc_feature (523)..(523): n is a, c, g, or t
  misc_feature (525)..(525): n is a, c, g, or t
  misc_feature (536)..(537): n is a, c, g, or t
  misc_feature (553)..(553): n is a, c, g, or t
  misc_feature (590)..(590): n is a, c, g, or t
gacatccaacaagtactctctgtatccagaaacactaacttatctaagagcagagaattcacaggaaccctataatcgtcagttaggttttgcatcaaaacagatgcagcaagaaaagccgcatctcaatgccgttgtgactttatgaaggtggacaatcctggttgagcagagatattgcagatgtctcccctgtcatggaggataacctgccttcccagcttgtcttacagatgctgaagaagctcccaaaatatagttgggattttagtaacaaatatcctatgagttgctgaattgaattcagtaatctcagaaaacccagcctggccctccaaactcaagcctctccactgggtctcacaccttgacagtatgctccatcacaccgccatttctacaccccacgcctgggcctggctgaaacttcaaggctccccttggaaggcagcccatctttgaggtcanaagaaaacatgtcattctgaaagttggccactcaccttcgaaatatcccatcccnanggtttttttgnngttgtttgttttgttnaaaggcaacaaaacggctagtctgtgacccataccanagctgttaaaacagaaggattaactctagacttggccccaagtgctggcaaatgtttttgagaacggagttggggatgtttgagaacactgagaactcacgcttgtaacgtgaagatgtggcgaacctggagtgagttcagagaagtgacaaagatgatgaaagggctaaagaatggtttctgagggaaggctaaagggattctttttgcctttatcccaagaaatgagaaaataatgattattaacttcaaagccagtttgctcttcatgtctgcaacaaacccaatgaatggaaataggctcgaattaaaagcaggagagaattgggtgaggtaaaaggaagactttcttgtgcttcagaggaagaaatatggcaatctgaggtcatggagtacagatgtgtatacagattttaatagagggatagaccacacattttttataattaaacttgacttctcatttttta

SEQ ID NO: 648414 - DNA, 457 bp, Homo sapiens
agcggagtggttgccaggcatcaggccaatggagagggaagaaggtggttggcactggaaggacaatgggaggcatccttgtgcagaggaaagggtctgtatgttgagtgcgccgaggtactacagctgtccaagatgccaccggtgggggaaataggttgacctgagtattctgccaacagactgacctagcaggtcagtccccaggccgggctctacccctgggaatggcacccctcctccagaggaagcatttcccaaatgccccaggataggagttggcgcggaaggagagccaagccggcgatgaagacattctccgctggacacaggaacgccaagagccaacgctaagaagcggcctccacactggacggcggcctccattagccagctgctgctggtaaaacaaagagaaggccgtgggcaggcggcgctgagtgcagataaccgtccg

SEQ ID NO: 648415 - DNA, 371 bp, Homo sapiens
tgatgtagaagacagcagtcactccagagatgtatcttatcttagtcaggcccttcgtcttcatgggccacatgtatctgcgtgagcttaggcccattgaggactaaggatcgtgaccctttctttaccccctacccgttgtggctctcaccctgtctcggacaggtttacagtgtcctggttcacacccaggacttatctttgcaagctgaacctgttagaagcccaagtcttaactactggtctcgtaaggttccactgagacgagatgtctgagaacaaccaaagaaggcctgctctttgctgcttttcaaaaatgacacttaaatgtgcagattccccaagcacccgatgacctataacagcagccg

SEQ ID NO: 648416 - DNA, 168 bp, Homo sapiens
agcatctcatagatagtatagcatatgtataaagcctcaatggcagctctccattcttgatgtcaaaacgtagcatacctgagaggtaagcagtgtaagcctgagcctctaatttggtcttggcatccacgcgatcgctctcacacaagcgttccaattcctctgcat

SEQ ID NO: 648417 - DNA, 796 bp, Homo sapiens
  misc_feature (27)..(27): n is a, c, g, or t
  misc_feature (184)..(185): n is a, c, g, or t
  misc_feature (337)..(337): n is a, c, g, or t
  misc_feature (643)..(643): n is a, c, g, or t
  misc_feature (651)..(651): n is a, c, g, or t
  misc_feature (654)..(654): n is a, c, g, or t
  misc_feature (660)..(660): n is a, c, g, or t
ggacatggtggtgcgagcggcggcggnggcggaggctgccatggacgacgaggaggagacgtacctggctctggaaaatccgcaagaccatcatgcagctgtgccacgacctgtggctatctggtgacccaggacgagcttgaccatgaccctgtgaggagttcaaagcccaatttggggacanngccgatgtgaggggcgtgccgcggcgcacggacctcaccgtgctggtggcccacaacgatgaccccaccgaccagatgtttgtgttctttccagaggagcccaatggtgggcatcaatgaccatcaatggtgtactgccatgcgcatgcagngaggagaacatcacacgggctctcatcgtggtgcagcagggcatgacaccctccgccaagcagtccctgggtcgacatggcccccaaagtacatcctggagcagtttctgcagacaggagctgctcatcaacatcacggagcacgagctagtccctgagcacgtcgtcatgaccaaggaggaggtgacagagctgctggcccgatataagctccgagagaaccagctgccaggatccaggcgggggaccctgtggcgcgctactttgggataaagcgtgggcaggtggggaagatcatccggccantgagaggntgnaggacntcaactaccggtgtgcagtattaccgcctgaaagccctagaagcggacacagggaacccaactggcggaaagcccttctcaaatcggccccagtttacgggggggctctgaccagaggggccaccgcccgccggga

SEQ ID NO: 648418 - DNA, 259 bp, Homo sapiens
accgcagtgtgaacatgtctccctcatcccactgtatctgctgattcagattagatcatcaacgtttcatcggcatctcatcaatctgagtggaatagtactgctcgatagtctctgaggatgcggatgtagtcatactttacaaaggttagtgtacacacccttccggccgtatcgaccatgttctcccaagttctgtgatatgtacaattcttcgtgttattaaaggagcatcgatagtttaatgcatcgagggaca

SEQ ID NO: 648419 - DNA, 333 bp, Homo sapiens
tgtcactgtgtaaccaggaggaaagttagtctgaagatatcagagcagaaagatggaaggaacttgacatcatggttgagccatttaataagcaagcctggagccactccacctccagatgtccagttaggtaaggttgtaacatgtctttgttgtttaaattagaagagtgagggccttctgttacttgcagacaagagcatcctaaccaaacaacatggtacacagagtccatcgtggcctgccttgtggcacactctccagtctcatctctcagtattgctttctccagtcccaaacttcagacccactgcattgcaacacggtctctca

SEQ ID NO: 648420 - DNA, 394 bp, Homo sapiens
actacatacttccgcacaagaacctgcatgtgtatatatataggtgaagatgactgatatggtttggctttggccccacccaaatctcatgttgaattcccacatgttgggggagggacccagtgggaggtaactgaatcatggcggcaggtctttcccatggcgttctcatgatagtgaataaatctcacgtgaataagtctcatgagactgatggctttataaggcagagtttccctgcccaatctctctctttgcctgctgccatccatgtaagacatgactttctcctccttgccttctgccacgattgtgaggcctccctagtcatatggaaatgtaagtccattaaacctctttcttttgtaaattgccccggaagtagggtaccgag

SEQ ID NO: 648421 - DNA, 721 bp, Homo sapiens
ccatgattatgtcactgtactctggcctggtgtgacagagcaaggccctctgtcttaaaaaaaaaaaaaaagaaaaaaatggagtttcaggtgggagtgtggattgatgttggcacccgttttgagactgaaaagaataatggggcaggctacttttgggagcatctggcttttcaatgggaacagagaatcggcctggcggttgccctgtgagaaggaggtggagtagcatgtggggcccatcttaatgcctacatgcacccggtgagctacacgagcttactacatcaaggcgctgtccaaggatctgccgaaaggctgggggagctcctgggtgacacttgtgcagaactgtagtctgggaagactcacatgattgacgaaggaacgtgatgtgatcctgcggtgagatgcaggagaatgatcgcatctatgcgagatgtggtctttaacgtacctgcgattgccgacagcgattccagggtgcacaccttcttagcgccaggcatgtggacggggcccagtctgagacatgtcgggacagcgtgtctcgttgcagtactttgagccgagatacctctaggaacactttacaagtgccgctcgaatggtgctggcatgtagctggacggagtggatgctaccatgcaaagttgttagacctcgcccagaagcacctcgggtggcatcccatggacatatgcctaggacgctgtgccca

SEQ ID NO: 648422 - DNA, 251 bp, Homo sapiens
gctctagactatagaggatcccgacgaaacaacttgaatccattactggaatcatttggaacctttacattatgccgtggcctaatgctgctacgctatactttctccggagaacaccttagctagcgcagggtagctcaacacttgcccggtaattaacgacgctgaactggccaatgactaaaccatatgatgcgagaggagcgacactgaccatcggcattggacctatagcgggaaggagagccgct

SEQ ID NO: 648423 - DNA, 550 bp, Homo sapiens
  misc_feature (172)..(172): n is a, c, g, or t
  misc_feature (179)..(179): n is a, c, g, or t
  misc_feature (183)..(183): n is a, c, g, or t
  misc_feature (187)..(187): n is a, c, g, or t
  misc_feature (189)..(189): n is a, c, g, or t
  misc_feature (218)..(218): n is a, c, g, or t
  misc_feature (241)..(241): n is a, c, g, or t
  misc_feature (283)..(283): n is a, c, g, or t
  misc_feature (428)..(428): n is a, c, g, or t
  misc_feature (460)..(460): n is a, c, g, or t
  misc_feature (529)..(529): n is a, c, g, or t
  misc_feature (540)..(540): n is a, c, g, or t
tatcaggtcactgattgcctaactagacattgtgggacgaaaagatcagtaaaactgaatttaactacaacttgtagagactgtgcctatactgtttagtgactgttgacttagttttgtatacatgttaaataatttgcataattgactgtatttgggtaatgtttactgnttttttnaggntttngnttttttttccagaacattaataatatggntgtaaattccgattttctgtatntcttatttactatttcagactttggctgagcaaaacactaanaatcctaaaagcactactggtagaaggttccaaatctaaagaggtaaaaaatagatcacagaccctaacccttctttttcatctccatagcacaagttcatctatcttataacttgtgcctgccttaacaatgttagagactaanagtttagagcaagggataggaatgagatggtntggttttaacttatctctaatcctaccatttttactttttgaccttgagctagtctcaccttggggttncttgaggcggnggggcgggct

SEQ ID NO: 648424 - DNA, 2367 bp, Homo sapiens
ggcgtgtcacattgccatctggggtcctttggggtttccaggttgtcaccatgctgtcccatttgggaatcccatacctgcctgtccccactgcgctggctgacccttgctgcctgctgcctcttgggagggctttgtccctgcctctgagctggtgggcaggatggctgggtggcccccagagaagcacagacctgagatggggtctccatgcccggtttgctgttggaatgatctgaacaggaccccaaatgcctcttccctctggtcatgcctcactatctctaggagctccatcctgtggcttccagagtgtgcacttccagcccacccgggcagtgctgagagggaggaggagaacaaggatggccagcctcccctccctcccctagaccacggggcaggcagctcgggttcctggagggctgtttcccccacgctgtccctacatctgctctgatctaaaatgtctttccttttatgctgcgcccagtcttggggctcaaagatttgcccaaacctcattggccctcgtgactaggctcatctagatggtgctcacgctggtgtttgaggcatttccactgtgatctccacgaggggatgttttccgggacacatctctggctctgggaactgcctgactcactgaagaaactacttttcaggcactgtagggtcacccatatgcctccagctcagttgacgcttaaaaacaggtgcagaaaagctcgcgatggaaggtcttaatgagagtgtctgtctatgccaatcatgtaaaatgacgtttcttgaaaaagattcagtggttcagctttgtcagcatcatctcaacacaagcctgctggctctttttagcatctcatccaaccatgtcatcgtccagatgagaaatcttagcccaggtgaggggagtaacttgcttgaggtcacacagctggctgttggcaaagctgggattagaaccctcaacccagggtcccttcctctgcagcgcctacatggttggttgaataagtggctgcgtttcctggggccctgggttttggggaagccagttagctgctgctttggcactggcatggaggtgagcagtcaaggatgctggtgaggctgcagtttctgctctttttcatcaggggggatagtctctaggatttttcagtgaggacccttgggctttggatgcagcttgaaccaagaaaacgaggagggaaagggattcagtgaactattcctcagtgggatcggttcttcagctcctgatgggggctgtgtaatgggggcagaggccagggaaaaagatgctgttcacccaccctcagcttcccttttcctaaattaagaggaaaagtggtcaaagaaaaactcttcatttctccctgattcttaaacgaaggtggttaatagaaactcaggctcccgtgacaaggcaggacaagagcctgtttcgctttcctccctgaccctgccaggtgccaactcaaacactacctttctcattggtttctaagtcagtagagacagatctgttttaagcagttgggggttcgagtagatctcatgggtacaggaggccagcagggaccaggccagtcagccatgctcaggacccctcggctcctcccccagcctctagctaccctgtatcgaggcaaggggaggccagtaaagtttgccaagcctgatcctgcagcctggtggggctggctggggtattcttttaccaaactctgttttaccgccagccccttgtacaccccaatcccatgtctccctcccttcagctggaccgtgtgcccctttgggaggaagaagacaagccccactagggccaagggcagcagagccctgccgagtgagaggctgtggggcagcggctctgtcctgtgccttaccagccctggggagggggacatttggctggaagactggaatttaattgccatcgtctttgattttgtgacatttctgcttggaagtgtgaactaccccccccccccgcttcctgctccttagcatgcgtgcagctctctcctgttttgggtgttccccttggacactccagctcggggactgctggcgtgtgagtgtgcagattcccctgtgtggtcgaacctaagaactgtggcttggaagtgatgctccatgtgacgacgactttgctttctttcctcttagtgaggaggtgattcgtagatcccaactgcctatgtaatgtaaataatgtacatttaatttattgctatggtagcacattgtatttgttaatgtacaaaacaaattctaaaaggttgacaaatgtatattttgttgcttaaatgtgtctttgcagaaattgacaataaataacatattttgtgtcca

SEQ ID NO: 648425 - DNA, 177 bp, Homo sapiens
ctaaccagtgaaatgactggcgtgaagaggcgggcataacacagcaagacgagaagagcctatggaggctgtaatgtctattaatggcaaacgagtagctaacaaacccagcaggtcctagagtaccaaacctgcattaaaaatttcggtgggggcgacctcggagcagaacccaac

SEQ ID NO: 648426 - DNA, 1381 bp, Homo sapiens
  misc_feature (1374)..(1374): n is a, c, g, or t
  misc_feature (1378)..(1378): n is a, c, g, or t
  misc_feature (1380)..(1380): n is a, c, g, or t
ggcgtgtcacattgccatctggggtcctttggggtttccaggttgtcaccatgctgtcccatttgggaatcccatacctgcctgtccccactgcgctggctgacccttgctgcctgctgcctcttgggagggctttgtccctgcctctgagctggtgggcaggatggctgggtggcccccagagaagcacagacctgagatggggtctccatgcccggtttgctgttggaatgatctgaacaggaccccaaatgcctcttccctctggtcatgcctcactatctctaggagctccatcctgtggcttccagagtgtgcacttccagcccacccgggcagtgctgagagggaggaggagaacaaggatggccagcctcccctccctcccctagaccacggggcaggcagctcgggttcctggagggctgtttcccccacgctgtccctacatctgctctgatctaaaatgtctttccttttatgctgcgcccagtcttggggctcaaagatttgcccaaacctcattggccctcgtgactaggctcatctagatggtgctcacgctggtgtttgaggcatttccactgtgatctccacgaggggatgttttccgggacacatctctggctctgggaactgcctgactcactgaagaaactacttttcaggcactgtagggtcacccatatgcctccagctcagttgacgcttaaaaacaggtgcagaaaagctcgcgatggaaggtcttaatgagagtgtctgtctatgccaatcatgtaaaatgacgtttcttgaaaaagattcagtggttcagctttgtcagcatcatctcaacacaagcctgctggctctttttagcatctcatccaaccatgtcatcgtccagatgagaaatcttagcccaggtgaggggagtaacttgcttgaggtcacacagctggctgttggcaaagctgggattagaaccctcaacccagggtcccttcctctgcagcgcctacatggttggttgaataagtggctgcgtttcctggggccctgggttttggggaagccagttagctgctgctttggcactggcatggaggtgagcagtcaaggatgctggtgaggctgcagtttctgctctttttcatcaggggggatagtctctaggatttttcagtgaggacccttgggctttggatgcagcttgaaccaagaaaacgaggagggaaagggattcagtgaactattcctcagtgggatcggttcttcagctcctgatgggggctgtgtaatgggggcagaggccagggaaaaagatgctgttcacccaccctcatccgcttatccaatgggggatcctggagattcccaatacaggcaagcttncctnang

SEQ ID NO: 648427 - DNA, 2634 bp, Homo sapiens
ggcgtgtcacattgccatctggggtcctttggggtttccaggttgtcaccatgctgtcccatttgggaatcccatacctgcctgtccccactgcgctggctgacccttgctgcctgctgcctcttgggagggctttgtccctgcctctgagctggtgggcaggatggctgggtggcccccagagaagcacagacctgagatggggtctccatgcccggtttgctgttggaatgatctgaacaggaccccaaatgcctcttccctctggtcatgcctcactatctctaggagctccatcctgtggcttccagagtgtgcacttccagcccacccgggcagtgctgagagggaggaggagaacaaggatggccagcctcccctccctcccctagaccacggggcaggcagctcgggttcctggagggctgtttcccccacgctgtccctacatctgctctgatctaaaatgtctttccttttatgctgcgcccagtcttggggctcaaagatttgcccaaacctcattggccctcgtgactaggctcatctagatggtgctcacgctggtgtttgaggcatttccactgtgatctccacgaggggatgttttccgggacacatctctggctctgggaactgcctgactcactgaagaaactacttttcaggcactgtagggtcacccatatgcctccagctcagttgacgcttaaaaacaggtgcagaaaagctcgcgatggaaggtcttaatgagagtgtctgtctatgccaatcatgtaaaatgacgtttcttgaaaaagattcagtggttcagctttgtcagcatcatctcaacacaagcctgctggctctttttagcatctcatccaaccatgtcatcgtccagatgagaaatcttagcccaggtgaggggagtaacttgcttgaggtcacacagctggctgttggcaaagctgggattagaaccctcaacccagggtcccttcctctgcagcgcctacatggttggttgaataagtggctgcgtttcctggggccctgggttttggggaagccagttagctgctgctttggcactggcatggaggtgagcagtcaaggatgctggtgaggctgcagtttctgctctttttcatcaggggggatagtctctaggatttttcagtgaggacccttgggctttggatgcagcttgaaccaagaaaacgaggagggaaagggattcagtgaactattcctcagtgggatcggttcttcagctcctgatgggggctgtgtaatgggggcagaggccagggaaaaagatgctgttcacccaccctcagcttcccttttcctaaattaagaggaaaagtggtcaaagaaaaactcttcatttctccctgattcttaaacgaaggtggttaatagaaactcaggctcccgtgacaaggcaggacaagagcctgtttcgctttcctccctgaccctgccaggtgccaactcaaacactacctttctcattggtttctaagtcagtagagacagatctgttttaagcagttgggggttcgagtagatctcatgggtacaggaggccagcagggaccaggccagtcagccatgctcaggacccctcggctcctcccccagcctctagctaccctgtatcgaggcaaggggaggccagtaaagtttgccaagcctgatcctgcagcctggtggggctggctggggtattcttttaccaaactctgttttaccgccagccccttgtacaccccaatcccatgtctccctcccttcagctggaccgtgtgcccctttgggaggaagaagacaagccccactagggccaagggcagcagagccctgccgagtgagaggctgtggggcagcggctctgtcctgtgccttaccagccctggggagggggacatttggctggaagactggaatttaattgccatcgtctttgattttgtgacatttctgcttggaagtgtgaactaccccccccccccgcttcctgctccttagcatgcgtgcagctctctcctgttttgggtgttccccttggacactccagctcggggactgctggcgtgtgagtgtgcagattcccctgtgtggtcgaacctaagaactgtggcttggaagtgatgctccatgtgacgacgactttgctttctttcctcttagtgaggaggtgattcgtagatcccaactgcctatgtaatgtaaataatgtacatttaatttattgctatggtagcacattgtatttgttaatgtacaaaacaaattctaaaaggttgacaaatgtatattttgttgcttaaatgtgtctttgcagaaattgacaataaataacatattttgtgtccaaaaaaaaaaaaaaaaaaaaaaaaaaaaaaagaaaaaaaaaaaaaaaaaaaaaaaaaaaaaaaaaaaaaaaaaaaaaaaaaaaaaaaagcaccccaccgggggaggtggtcccgaaaaggacgggtaacacaacccaggggggggggcgacgtgaaacagatatggttctccacagaggggggagtcaacacgacggtggacaactcacgcgaacatacgacagctcgcgtgggagaaaggtgatgccgcggatcccacgaggggagg

SEQ ID NO: 648428 - DNA, 208 bp, Homo sapiens
gagagcggccgtggatagaaaggaatatcaaattcacattccatggcctcctaggattgacccaccagttaccatgaggcagggggaagagaaacctgatgccacatacagtgatgttgccgcctgaaaggaccagattgagaaccggcgagaggaagttgaaaccccattactcaatccagagagttttgtgaacctgggcatggag

SEQ ID NO: 648429 - DNA, 1177 bp, Homo sapiens
tagggctagaccagatcattgttataccctcaaacattaagtcagttaagaactagattggttctgcagctcctgatgggggctgtgtaatgggggcagaggccagggaaaaagatgctgttcacccaccctcagcttcccttttcctaaattaagaggaaaagtggtcaaagaaaaactcttcatttctccctgattcttaaacgaaggtggttaatagaaactcaggctcccgtgacaaggcaggacaagagcctgtttcgctttcctccctgaccctgccaggtgccaactcaaacactacctttctcattggtttctaagtcagtagagacagatctgttttaagcagttgggggttcgagtagatctcatgggtacaggaggccagcagggaccaggccagtcagccatgctcaggacccctcggctcctcccccagcctctagctaccctgtatcgaggcaaggggaggccagtaaagtttgccaagcctgatcctgcagcctggtggggctggctggggtattcttttaccaaactctgttttaccgccagccccttgtacaccccaatcccatgtctccctcccttcagctggaccgtgtgcccctttgggaggaagaagacaagccccactagggccaagggcagcagagccctgccgagtgagaggctgtggggcagcggctctgtcctgtgccttaccagccctggggagggggacatttggctggaagactggaatttaattgccatcgtctttgattttgtgacatttctgcttggaagtgtgaactaccccccccccccgcttcctgctccttagcatgcgtgcagctctctcctgttttgggtgttccccttggacactccagctcggggactgctggcgtgtgagtgtgcagattcccctgtgtggtcgaacctaagaactgtggcttggaagtgatgctccatgtgacgacgactttgctttctttcctcttagtgaggaggtgattcgtagatcccaactgcctatgtaatgtaaataatgtacatttaatttattgctatggtagcacattgtatttgttaatgtacaaaacaaattctaaaaggttgacaaatgtatattttgttgcttaaatgtgtctttgcagaaattgacaataaataacatattttgtgtcca

SEQ ID NO: 648430 - DNA, 226 bp, Homo sapiens
agaaaggcactgtgaaaatccctgtcctgttttgttcttaattgaaagggcatgcagcccccagtcacacacctgctgcttgctcaatcgatcacgaccctctcatgcgcacccccttagagatgtgagcccttaaaagggacaggaattgctcacttgaggagcttcgctcttgagacaggagtcttgctgatgcccccagccgaataaaccccttccttcttta

SEQ ID NO: 648431 - DNA, 706 bp, Homo sapiens
  misc_feature (5)..(5): n is a, c, g, or t
  misc_feature (37)..(37): n is a, c, g, or t
  misc_feature (92)..(92): n is a, c, g, or t
  misc_feature (97)..(97): n is a, c, g, or t
  misc_feature (108)..(108): n is a, c, g, or t
  misc_feature (137)..(137): n is a, c, g, or t
  misc_feature (236)..(236): n is a, c, g, or t
  misc_feature (243)..(243): n is a, c, g, or t
  misc_feature (278)..(278): n is a, c, g, or t
  misc_feature (283)..(283): n is a, c, g, or t
  misc_feature (287)..(287): n is a, c, g, or t
  misc_feature (301)..(301): n is a, c, g, or t
  misc_feature (305)..(305): n is a, c, g, or t
  misc_feature (309)..(309): n is a, c, g, or t
  misc_feature (313)..(313): n is a, c, g, or t
  misc_feature (316)..(316): n is a, c, g, or t
  misc_feature (320)..(320): n is a, c, g, or t
  misc_feature (325)..(325): n is a, c, g, or t
  misc_feature (337)..(337): n is a, c, g, or t
  misc_feature (367)..(367): n is a, c, g, or t
  misc_feature (404)..(404): n is a, c, g, or t
  misc_feature (413)..(413): n is a, c, g, or t
  misc_feature (421)..(422): n is a, c, g, or t
  misc_feature (427)..(427): n is a, c, g, or t
  misc_feature (429)..(429): n is a, c, g, or t
  misc_feature (432)..(432): n is a, c, g, or t
  misc_feature (436)..(436): n is a, c, g, or t
  misc_feature (458)..(458): n is a, c, g, or t
  misc_feature (502)..(502): n is a, c, g, or t
  misc_feature (514)..(514): n is a, c, g, or t
  misc_feature (522)..(522): n is a, c, g, or t
  misc_feature (536)..(536): n is a, c, g, or t
  misc_feature (684)..(684): n is a, c, g, or t
tggcncctgtaagtcattttactttgaatatataggnaacaaaatccacaaacaggaagctatgttctatggttatgtcttttaaacaatgntctgnatttacaaatngtttttttccctaagtaaaagcaccagcngaaaagttataggctgctaaaaccgttacaaatattacaaacccattaaaagacattatgccaaacgtacttattaaaaaccttaacaaaacgaagagncaactgncaacgcaaccaaccaattgggccaccatgctgggntgggnggcngtcccaatttcctngccngggnttcnganaaanggggntgggggtgcttntcccagggggagggtcctcgcccaccgggngggactacagggacagagctggggagaggcagctgtntttcaaggnaacatggnngcctnanttnctgntgttggtggcctcctggtcagnccccctcaacccacagggcaagggggggggctttcaggggggtntggccagctttnggttgttnatttgttaatagantgtttttctgcgaccttgtcctcatccactgaagggtttggagtttttgttttttcctagacacttagctacaggacactgtgtgatgtgtcctcagggacttgctgtctgccttccattgttttttttttttttttttttttgaganaaagtctcaccgtcacccaggc

SEQ ID NO: 648432 - DNA, 193 bp, Homo sapiens
taatcagtcggtcctgcttctgggcgtatggcaaacctcatctctacaaaaaaatacaaaaagtagctgggcgtggtggcgggcgcctgtggttccagctactctggaggctgagacaggagaatcacttgaacccaggagggagaggttgcagtgagctgagatcacaccaccgcatacgcccaggtatgca

SEQ ID NO: 648433 - DNA, 886 bp, Homo sapiens
  misc_feature (23)..(23): n is a, c, g, or t
  misc_feature (886)..(886): n is a, c, g, or t
tttctagaaaaaacgaccgtccntaggcctggccaattgggcccatctgaacaacagggagagcggggggtggacgacgtcaattggtcgacgtgacgacggcggcggacacgaccagcaaggcggaatgcgaaccgaggtgtcacaagttgaccatcgacatctgtggacgggtgaggtcggtactggtcccggtccgggttctgtttcctcaaccctgtcgtctcgaggatgggggatggtagctccgggaggtccggtgacagttgcccctcaccctctttgacgacctccgcgaccggtggaaccaggcgaagctccttttgtgagggtatcccctccggtgcctcttccggatcgtggacgtcagaagaccaccacaaagggacgacgacattgaacgacgtatcccattgaacattcatcagaacccgatccgggggcgggtggccgatgtctagaaccacgtgatccccggatccaagaaccatcacatgacgaggagacagcgcatgttgctggacgcccatgtcaacgtcctggacccgttgatcggggagttgttgaccgtcttggccacgagcctgaacgaactccagttttgacacctccacacacggacattgatgatgaatcagtccctcaacagagagagaaaacctatcatgacgaagttcgttcccaaaccacggctccaggacgtcagagccgtcctcgtcctcaatcgggtgtagttgaagccggactccaacagtgggttggggcagtggacgagggaggcggcggtgttggagaaatgacagccgacgtgtctgtgtctcgggatcatccgtgacaggaagaacttgaagtatagtcacttgaggagcgggcatccggattagtn

SEQ ID NO: 648434 - DNA, 171 bp, Homo sapiens
  misc_feature (148)..(148): n is a, c, g, or t
gcggggatctagagatccagtctggaaagggactgtcaggatgtagctgcactgtcactacagcagctctgtggagatcagcccactgcagaagtgcagtctcacgatggtgggtggcagcagtggtgacagggctgtcgctcgagtngcctccttctgcatttggctgtg

SEQ ID NO: 648435 - DNA, 1280 bp, Homo sapiens
ccacgcgtccgaacaacaattaagtgttccatatttataaattttaaattctgattacttgaggtaaatatttctaacgagaaattttctaaaatgtattatatattttaaatttatattcagtagaaatactacaaacattaattactgtcgtataattatatttccaagcacgactagaattttaaaaccataaagaacaccagctgttgtgtttttaattcctgtttgctctgtgtgtgtgtgtgtgtgtgtgtgtgtgtgtgtgtgtacattatgacatggttgcagagagtgtgtagtgacgtcaacaccagatataggcggccctcctatatatattatagaaaaaatcctccaagaatgtcgcggggactaacagcggcgacgagccacgccgcgccgcgcacacaaataccctaacgagacgaacactaatccacctcaccaagcgtcatcacacatatagcacaaccatcatgcacccaagcagccgcaccacgactgcaccagacgtgagaacacgcgaagcaaaccgtgacacaaaaccagagcacacgtagccacaacacacaacaatactaaccaaaacactccagccggcgcaaccaatacaaaccactctgagacgcatgaaccacacataaaacgactgtacaaacaaacaaaaactggcagcagaaaacgcaacctcgcacccccaaaaaaaatacgacacgacaattggacgaacacttctacatcacaaaacacaccccacacacaaaaaggagaataacaaccggtggcaccaatcacgaaagcgagacacaaaccaaccagccaggacgccgagggaccaatcccagaatagcaacaaacacccttacgcagcaaagacacacaggggagaacaagaacgcaacccgcacagctatcaccacacaacccgaaactacaaggagacgaccaacaacactcaacaacaccaacaacgaaaaccaaaaacacaaaaacacacaagaccaacacaaaaaacacaacaaacaaagacacaacaaaacaccacacgccagcaacacgtacgtcacgcgacacgcacacagccacgccctgaatacaaacacggccacgacactgcaaccagcgcagaagagagcgcaagcacccacaaccaacacacgcacaggacagacgacccagtggcacaaataaacaaccaaagaaacatcagtgacataaggagcgactgcatgcaaacaaacacccgaatccaataacgggccacaagccacgagcac

SEQ ID NO: 648436 - DNA, 142 bp, Homo sapiens
acaggacctatcagggtggcgtgtccttcagcgaggtctcttctgcgaccaggctgaaatcctatttgagcaacactacacagttccgagatcagggtctttggtgcccggagttctggagaacttggaggtgaaatccggg

SEQ ID NO: 648437 - DNA, 554 bp, Homo sapiens
gagtgttggaaaaatgttttaatattttggtttgggtgattttaatatttgcttttatgcatttttgaagagaattttttaggaagacataaagcaacataatggaacaacttattgactaattgtttttaacaattacttttgttgataatctgtgacattgccaaaatgaaaacagataccattcgtgcagcatatataatattaatatgcaagttaaaatgttaggacattttaactacatcatgtatcaagttccagatgcatatatttaattgactattagacctttttacttggaagttcgaaacacatttaaaatttaggatgtcccaaaaataaactttgttttctttttctttgctttcttgctttttttcttgcttactttctttttttttttggacaggatttcactttgtgccaaaggctagaaagaggtgaggggtgtaattacaggttaatggattcttaaacatttcagggctaaagaattctttcaacttaaggcttttggtgtggcgggaccacaagaattttgtggcgaatttttg

SEQ ID NO: 648438 - DNA, 450 bp, Homo sapiens
  misc_feature (1)..(1): n is a, c, g, or t
  misc_feature (14)..(14): n is a, c, g, or t
  misc_feature (56)..(56): n is a, c, g, or t
  misc_feature (98)..(98): n is a, c, g, or t
nacattcgacttcnaacagccccagggaagaaccaaagccccccaaaaattcctcnaagtttttggattaattgtgggttcactgattccagtccaanttggagcttcagagaagaggctccctcctgtgtcatagaatccttgctttgggtctccctgcagagttcaataggtttagtaaggctaatcgattgtttcaagagatgcttatcaaaagcatatggtgtcactgaaggagtattctaaaccaggacacagccacttcatgccagtctagagatgctgggggtaaatgctttgtgagtcctggcaggaatcttcttgcaagtcaagggccgagctggagggggcactcaggagtcacacagcataggttctagccccggatcaggtgcaccggaggcttgggaggaggtttcctctcagagtctaggtcttcctttatcagga

SEQ ID NO: 648439 - DNA, 211 bp, Homo sapiens
tttaacaactaatccaccccctttcccaggcccgtcgataagcactaatctacttactgtctctctgaatggaactgttctgggtagtactcatgttagtggaatcatttactatagtgtactatattcgctgtctaggcttattatcatcatagcatgctttatgcgggttcatcccatattgtatcatgtcatcatgaattttagtttc

SEQ ID NO: 648440 - DNA, 415 bp, Homo sapiens
  misc_feature (49)..(49): n is a, c, g, or t
  misc_feature (61)..(61): n is a, c, g, or t
  misc_feature (82)..(82): n is a, c, g, or t
  misc_feature (84)..(84): n is a, c, g, or t
  misc_feature (141)..(141): n is a, c, g, or t
  misc_feature (341)..(341): n is a, c, g, or t
  misc_feature (389)..(389): n is a, c, g, or t
tgaagcttgaagagtgccctgcagtgccaggcctggagagcgccaggangcaccaagtgtngctgcaggagctgccaggcanangcacatcgagatgctggccaacgccaccaccctggcctatctgaaacgtgtgctccntgggccctgactcctgtgccacaggactcctgtggttcggccgtggacctgctgttggcctctggggctgtcatggcccacgcgttttgcaaagtttgtgactcaccattcaaggccccgagtcttggactgtgaagcatctgccatggggaagtgctgtttgttatcctttctctgtggcagtgaagaaggaagaaatnagagtctagactcaagggacaattggatggcaagaatgctgcttgatngtggaacttgctttgaccttagggac

SEQ ID NO: 648441 - DNA, 117 bp, Homo sapiens
gtacgccagcgagtattgtaactctctaaatgaagtttactttgatcctttaattcactgaagtgtacataatccatgtggtgcttcccttatacaggcaaacacctacaggtattg

SEQ ID NO: 648442 - DNA, 608 bp, Homo sapiens
tcctttcgccgggcgcgatggagccggggcgccggtggggccgcgtgcgctagtagcgctgctgtgcgtgggctgcgcgcttggcgcctgggagcgcccagtaaagagcgcctaacatggtttcgccggcagacttcccctactggggagcgatgctgatggccgctcgaaggtcggcctacgcggcacgctgcgtggacccatgtacgagcgtgcgaagtcaacatggggccggagaagcgttggggccaacctggggagatcagcctaacggggttgcaccggtttggccttgcgcagacagggaaggcgcccttttctttggccccaagctccggggaaactccttgtgggcaacatgagtctcagaaccacgaggaacagcgccctcattggaagagtagccccaccagggaatggccaccccgggctcgggccgagtgccccttctgcaagcctaattccacggaaggttagacacccttacttccgggggcgagactgtttggccaccccgagcgcgaagttggcctacaaaggcgggttagcaacggcataggggcccctgtggctcaggaactttccgggcaaaagtcccaaagacacag

SEQ ID NO: 648443 - DNA, 625 bp, Homo sapiens
tgatgtagaatatatggacatctgcttatgggccatctatatattctgttttcttgccattttatgattattttaattgaagcgctttgacacatttatgtattggggatttgagacctctttgggtatatgctttgcaaacatttactgttagttacaaactggacgttggatattctttacaagaactttatatcacaatcttgaagtaatccaaattatcaatttttccttggattgacagtattcttatggcaagtctaaaaactctttgactaatcctacagctgaagattttctccagttttatttttctaacattttcacattttacgtgttaatctataatctattttaaggaacttttggcataaggtaaaaaattaaggttgaagtttatttctatggatgtccaacagctctcgtatcatttgttgaaaagtctatcattcctccactgcaatgcttttgtgcttttgtcaaaaattagtcgtgcatatttgcgtaggtctatttctgggttgcctattctgttccatcaatatgtctatccctccactgataccacacagtcttgattactataactatataagagtaaaaattggggagactgattgctccc

SEQ ID NO: 648444 - DNA, 403 bp, Homo sapiens
aagtatttctagacttcttaggatctaggcaggatggctcatgcctgtaatctcagcactttgggagactgaggcaggaggatcactcgtggtcagttcagggctacagtgaattatgactgcaccactgcgctccagcctgcgtgacagagtgagtccctgtctctaaataaataaataaataacagagttttgctcattgcccaggctggagtgcaatggtgccatcccggctcactgcaacctccacctgccaggttcaagccattctcctgcctcagcctcacaagtagctgggattataagcacctgctgctacaaccagctaattttttgtattttttagagacggcgttttaccatgttggccaggctggtctcctcctgacctcaggtgtccgcg

SEQ ID NO: 648445 - DNA, 163 bp, Homo sapiens
gataaatgagactgggtaactggattggcggatggacacgatgatggatagatagatggataggtggatggactgatagatggataggatggaagggtggctagatcaattgatgggtggatggatgcatggacagatggatgagtgcacggatggatggtag

SEQ ID NO: 648446 - DNA, 446 bp, Homo sapiens
aacgagggtccgatggacatcatagctacaatcagactatctaagcaatagggaatagtagatatacatataaccataagaaaccctatcatacacctacctagaggggcagtgaatatctaaatattataagtaagcaagagtacactactaaagccaactagactaagagaatagcagaatgaaccggggaggacggcgctagataggcacagccttagaacagtaaccagaacacacccccataaagtagtacacctaccaggaaggcgccccatccccaatacctaccgtatactagggctcataatataggtaaagctactaagactacctagagccaactaaaatagtaactaggctatacctaaggctggggcttgacactaagtacaagaagccaaggagtatcagatactagatagcagagaagtaagtctacatat

SEQ ID NO: 648447 - DNA, 125 bp, Homo sapiens
aagtgtgtatactacttaaacgacttaccccaggctaatactactccgctgctaaagtttctaagaggtgggggtagagcctctgtgcccccaccccgccccccggttacggttcacctaaaccc

SEQ ID NO: 648448 - DNA, 416 bp, Homo sapiens
ccatttggcgaggcagtgagggtctttggggagtgtgcccccttattgggattggttgtggctaccaaggaaatcagatgatcataatgcaaaacttcctccatcccatttctatatgatcttttttttttttttttggagggggagcctgcctctgtgccccagccggggggccagggccagaatctaagctaactgcagccttggtccccaaaataaaagctattattccccggcccaagcctccaaaaaagcggggacaacaggcgggcccaaaatgccgggtaaattttggtattttaagaaaaaacgccccccccaaaggggccccgggcccaaatccgaaacaagggccaaggctgttcccgggggaaaattgtattccgctcccccggaagaagggggtaaaaaacccc

SEQ ID NO: 648449 - DNA, 202 bp, Homo sapiens
ggaacttacggaatgaggtctagaatcagaaggcacttgtagtcagttctagaccagagaacagcagatcacagatcttgatcaggccctggaggtggcacttctagagttgtgtgtctggactagtgagtgtacaggtcatgaggtcagaatctagagactagagcatcgctgtctgagactgtattatagtagcaggtcc

SEQ ID NO: 648450 - DNA, 443 bp, Homo sapiens
ggcagtgcacctgtatcttgtggtcgactctagcaggacccccacaccacctgtagtcactgtgcatgctacaagtgctgcagcctgtctgggtcgccgctctgggtgtcgtgtcacttttaacgtatttggggtgggatgagggcagatgagagcagctccacagacgaggcagactgccccaatttctccatcgaggctgggggacagctgctgcccccactgtagacagcggactgtccttcaataaaatacaggttgtctgcatcgcccagcggcggcgcagtatagaatatcatgacaaagcacacgagatcccactgctcttcagcagggagcagtgccagagtgcgagtttataagacgaaggatcaggaatcctagtattaggaagaatttcctctggacgctctgattttgagaacaccagttaaatggattta

SEQ ID NO: 648451 - DNA, 181 bp, Homo sapiens
gatcccacgagtcatgacagccctactgacgatgccaaatatatgataaagggaacttttgctgaggataaactcatgagagatataattaagatgctttataggaaactattatataaaaaaagccatttcccacccaaggacacagtggatgtgttttccctgactccagcagggcaag

SEQ ID NO: 648452 - DNA, 157 bp, Homo sapiens
gcggtcctctcgcgctcctgcggctggctggtctctgtaggtcgcaagtgcctctcctctgtatcctcccagcatctgtctgtccggaattgggcccgtcctctctgtggaggatcccgagagtaaccaggtaccgcagctcaagttcgtcttcatg

SEQ ID NO: 648453 - DNA, 145 bp, Homo sapiens
gacggctagagatatgtcgcccgtgctcagtaaaaagatcctctcaggctgcagagacagcgttctccgatatatcgtgcatctcgataacaaagaatgggcctgccctgaggaggattatcatgatagtcctaagtctgcccgg

SEQ ID NO: 648454 - DNA, 170 bp, Homo sapiens
tacacgcacttgtgtaacgaactagtatggaagcccaagctgctgagcaagtgggaagaagaaaagaaaacatagtccaaacagatcacacaagggaaccccggacaaatgctgactttggccttatctaggtaacccctattttttgtcataggtgactctaataatag

SEQ ID NO: 648455 - DNA, 446 bp, Homo sapiens
  misc_feature (355)..(355): n is a, c, g, or t
  misc_feature (440)..(440): n is a, c, g, or t
ggggcagccagcagccacctccccagtgcaagtaccctgtaatctctggaggggaggggctcggctgagcaggaaaagcaggggggccaagtgcccagggctatagcggggagtcagcagctttcctctcgtggtggggggcttaactgggacatagtcacatgtagggcagtgatggacccagaacccctcctccctactctcctgtgctccagggtctcggcggcgggggaaggggtccgggggtatgaagtaaatgaagaaaagcacaaccaaaggggattaggaaatgatccagttctaccactctcccgtagaagcttaagattcaaagctaccgagaagagagggagtnccggctgaaagatggcccagtcggaggaggctggaacaaaaaaggaccaggagagagacacagtcttgtctccagagaattggtncctagg

SEQ ID NO: 648456 - DNA, 437 bp, Homo sapiens
  misc_feature (64)..(64): n is a, c, g, or t
aaataaaacctccaataacctcctaaaccttcctaatggaaattgaaacagtaatttaaaatcnccccagaaagaaaatcctagactgtttttactgttacattcctaccaaacatttagggaagaaataattttcacctaatcttacacaaactctttcagatagctatgcacccatgatgcatgcctgtagtcccagtaactcaggaggctgatgcagaaggatctcttgagcccaggagttcaaggctgcagtgagccatgattgtgccactgcactccagccaaggcaacagagcaaaaccctgtctcttaaaaagtaaaaaaagactgggtacggtggctcaaacctgtaatcccagcactttgggaggccgaggcgggcagatcacgaggtcaggagatcgagaccagcccagccaacatggtgaaaccct

SEQ ID NO: 648457 - DNA, 413 bp, Homo sapiens
catgctggtttcagcttttggaaagagtaaaacgaaaccaggatgcaaataaaatgcacaaaaatttgcatttcaaatgtttttctctggtaattttgagatgatatcattcaaaacacacgtaagcaggttcagttgagttctccacatgcaaaaaatgattttaaatagcttgtaaagttaaattgtgcttcgagtagtgaaacacccagcccgtgctgtcagtgtgtgttattataaggatgatcaacattaatatctccctctgctgctgcaggactgactgtgctgttgctgttgttttggtttaaatgtgttttgtttttgttcgtggcaaaaggaaaccctttgtgattcccaaacggcgaagtgagaaaataatcaataaacaattattcatttatattaaccca

SEQ ID NO: 648458 - DNA, 303 bp, Homo sapiens
actagcaggatcctagaccactgtcgccggctccatcaaatcaagcaagactccaggttcctgaagtgctgctgcagcaggggttctcaaagctgtcacttctgtatgtgaagcgaagcttctcaacgatagccttcatcttggcccaacttggttctggagtttgccattgattttcttcaggtaaaggggcatccttcctttttattcattcaggcaacagggtaaaaaaagacccagctggaaagcctgggaggagtccacctgaattttctggtcatccaacttcttcttccctgtggc

SEQ ID NO: 648459 - DNA, 154 bp, Homo sapiens
cgatgctgaattggataaagaactcctgcagtgattttggcaggaagacaaaaagagagtgcttggagctcgtctgactaccagtcacgatcttgtaaggccagatgtcgtcctagaaactgcatggaggcacaatatcatggatttagccatg

SEQ ID NO: 648460 - DNA, 835 bp, Homo sapiens
  misc_feature (162)..(162): n is a, c, g, or t
  misc_feature (170)..(170): n is a, c, g, or t
  misc_feature (174)..(174): n is a, c, g, or t
  misc_feature (192)..(192): n is a, c, g, or t
  misc_feature (210)..(210): n is a, c, g, or t
  misc_feature (261)..(261): n is a, c, g, or t
  misc_feature (271)..(271): n is a, c, g, or t
  misc_feature (287)..(287): n is a, c, g, or t
  misc_feature (293)..(293): n is a, c, g, or t
  misc_feature (310)..(310): n is a, c, g, or t
  misc_feature (327)..(327): n is a, c, g, or t
  misc_feature (388)..(388): n is a, c, g, or t
  misc_feature (392)..(392): n is a, c, g, or t
  misc_feature (404)..(405): n is a, c, g, or t
  misc_feature (412)..(413): n is a, c, g, or t
  misc_feature (426)..(426): n is a, c, g, or t
  misc_feature (428)..(428): n is a, c, g, or t
  misc_feature (432)..(433): n is a, c, g, or t
  misc_feature (440)..(441): n is a, c, g, or t
  misc_feature (448)..(448): n is a, c, g, or t
  misc_feature (459)..(459): n is a, c, g, or t
  misc_feature (461)..(461): n is a, c, g, or t
  misc_feature (466)..(466): n is a, c, g, or t
  misc_feature (472)..(472): n is a, c, g, or t
  misc_feature (474)..(474): n is a, c, g, or t
  misc_feature (485)..(485): n is a, c, g, or t
  misc_feature (524)..(524): n is a, c, g, or t
agcggtctcaggtttcctttcaaatctgctgggaggccattaatctaggaatcagcttgcaacagagcacaaaaaacaccaaaaaaatttcaaacaagaaaaaaaaaaaaaaaagggaaaagaaaaaaatggaactggtaagctttaatgattactttaganttggtttnattntccctcctgcagtgaatnaatgggatatatatcagntgacactgatagatggatatttctgatcgtaattttggtgtaataagcatnggaaatgacntttatacacaccactngtgttngtcagagataacatatnaggggtggttttaaaangcaaaaagaaaaaaacaaaaaccaaactattaaaatcctcctataaatattcttttccttnacangttttccaagcnntgcaaanncagtttattggtnancttnnctggaannaattttnaaccaattaantnggtgnactacntngctggttaccnagcttccttattcctaatacctgggaacaattttttttncaagggatagatttggatgtaaaaaagaccgaaatttatcaaggtatctatagttgaagggactggggaaatacctatcaaaattaactttcttaggaaaaactttcaaccgtatttttaagtactcgggatacgacctgaaacggtttccagtgtttatttctggcgagttgtagacttaagggcttattggtaacagaagcattgctccatttgatgtggcatcctctagtcttgacaggtgggggtgggaattaaacccattagagaagcacgccagtttgtgtttcaccttagacaagcgttaatgg

SEQ ID NO: 648461 - DNA, 1062 bp, Homo sapiens
  misc_feature (669)..(669): n is a, c, g, or t
gtgttgttcacgcaccctgtggggggtttgtccgcacgagagggagcgcttttcttttcttgtgcagcgtcacgaggatgtctccggatggtgagagaggcacgtggtcctcgttggtctttgcgacccttctcccgacgtgcgcatcactcacactggctgtaatgaggacacgcaccacttcttggtagtgaccccctggttgcgcacacacatgacttcgccttctcgcaaaataggagagcagctgatactcttttttctcttccctctctcaataactcatcacctcactgtagtgtagtattttgtgtagacgcccccccccccccaccctcttcttgcacacaagaggcgcccccccacgccccacccacgcgtttgagggggacgacaacagataggtggtgtcggccggatactctcccaccccccccactggtgttcagcgcgccgcaggtgaaaagcccctccgcttttttcttcagcgcggctcgtttgagaagagttcccccacacggctcttttcttcgagagtgtccccccgctttaatacctgttgaggacacccactcttttcttctggcgagaattttggcgcctgtggtgaataaatgttatacacacacgcggcggagagcgtcgttttctcgtggagaacgccgcaancttttgcacttgtagatgtgtgcactagactagggtgtttgtaaacgcgcgttttctcgtatgaggcactcctctctgtaatattaatttccccaggggggaagaactcttatcgaaggagacctgggttgtaatcctcgccacgagttgaagtggggctcaacaacgactaagggtgaagatgtcacagaaaagccgcttgtgattttttaacacagcccaaaaaagagagattgtaaagggtggctttctgcccaggcttgcaactgccgtttccttcgggggtgttcattttcgggaaaagtggtggcggggggtccaataggtttcctgtcccccggtgctccttccgtaaaaaaatgaaatattttatgcccttattaataataaata

SEQ ID NO: 648462 - DNA, 440 bp, Homo sapiens
attttgaaggccggaaccccccgggggtttcaaaaatgtagaacgcagggtgggcccacgctcaacaggtgtgccgtccttccccctggtggggccccctttttagtatacaaagggggccttacccccatctcgcatggatggcagcattgttttgaaggggtttgcaaaaaaaaaagattttctttacataaagtgaatcaaatttgccctttttttagatcccaaagaaatcaggggtgattagttttccaggcatgaatgcatcgtccctttatctgtaagaacccttagtgtcctgtagggggacagaatgggggggccagggggggatttttttttggccaatgcatagtttggcagaaaaatcacccgttcctttaaaagaattttagcaaagattgggatgccttacccaataaaggtaagatggctatgca

SEQ ID NO: 648463 - DNA, 276 bp, Homo sapiens
gtacccgagcttcctgcggctgctgctgtaacgaggcactaatttctagctgagccagtgtttgcccgctgatgaaaccgacgtgtatactgctacattcctaaggctttagacctgtccctgtacatctctgcatatttatctacctacataaacaacttcaaaagccaaatattctactgtttacctcacattctcagctctttcctttccttcaccattccttcttatttatagcttggtttcagcaaggaaagctgctctcatgaatagcaa

SEQ ID NO: 648464 - DNA, 457 bp, Homo sapiens
agggagtagtagaggcagcagcaggtggagcgtcataactatgaatgagcttactagaactatatacttttgagccagacttattagatagaccctaatacagaaaagacgaagatagagggatactcccatgcggccaaaggataccatactggcagcgctccttcaaatacataaagaacaacatagtaggataccatgaacatgattctctttgggaccacaaagcagaagcaagagttgattgaggaagaaagaaaagcagctagggcagagtatgaagcagagaagaagggactgaccatgcgtatcaacataccaactgggaccaatttaccccctgtcagtttcaactctcaaactcctaatatacctttcaataggggagccctgtcagcaatgagtaatcaacagctggaggacctcattaatcaaggaagagaaaaagtggtagaag

SEQ ID NO: 648465 - DNA, 1006 bp, Homo sapiens
ggctgcaacgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgactgaatgtctgaccaacggtgaagtcaggccaccaaacgggcacggcacagacctctctgtgacccactatggagactctctggaacagctcatcggcgtatcgagagaagatctggccttatgcccaggcctgggccctcaagaaagcccggaggctggaatgatgtcctgcaggagcccttcttgacaagtaccctgatgacccagcttgcaaggaaaccccgagtgtaatcataaatcggtcctcgccaggccagcggtccgtggtgtgctggcctggtgcaggctctaggaaagggacacaggaagagggcccacgagcagcatggaccagaatggccaactacagctaagtataaaccatccacagagacaccagaaggacaaacacagcagaaaggaagcggaacagaaacaggggaacccgggcccagaggccgagaaccacagaaaagcccagaaatacgggaagaacccggaaaatacaccgggggccccgtgagagggaacacatggggcaaacacatccggcagcacccggcgaaggaaagaaaccacgatacgaacggaaacagggagagaaccgagaaaaagagcccacaccaagagaaacagacccaaaagcacgaaccgaagcaaactcc

SEQ ID NO: 648466 - DNA, 224 bp, Homo sapiens
  misc_feature (29)..(29): n is a, c, g, or t
  misc_feature (103)..(103): n is a, c, g, or t
  misc_feature (197)..(197): n is a, c, g, or t
agacgtgcgcctgggggtgaggggaggcncccgggagggcctcacaggaagttgggtcccgcaccacccaggctagggggtcccgccgccgccgccaccaacncacgtccaggggccggtagacaaagtggaagtcgcgcttgggctcgtcgcagcaggtagcccttgatgcagtgcggcagcgcgtcgtccgccantggaagcagcgcccgtccaccagcacg

SEQ ID NO: 648467 - DNA, 151 bp, Homo sapiens
gagcagccagttaggttaaagtgtaaataccgctgcagtcaccctgcccaggaattctctccaaaacactgccactgcccagtgcaatattcattatctatctccagactggattacctgaataacttcttaaatggtctccaggtctcca

SEQ ID NO: 648468 - DNA, 753 bp, Homo sapiens
  misc_feature (8)..(8): n is a, c, g, or t
  misc_feature (48)..(48): n is a, c, g, or t
  misc_feature (203)..(203): n is a, c, g, or t
  misc_feature (205)..(206): n is a, c, g, or t
  misc_feature (208)..(208): n is a, c, g, or t
  misc_feature (226)..(226): n is a, c, g, or t
  misc_feature (311)..(311): n is a, c, g, or t
  misc_feature (378)..(378): n is a, c, g, or t
  misc_feature (431)..(431): n is a, c, g, or t
  misc_feature (493)..(493): n is a, c, g, or t
  misc_feature (498)..(498): n is a, c, g, or t
  misc_feature (572)..(572): n is a, c, g, or t
  misc_feature (574)..(574): n is a, c, g, or t
  misc_feature (578)..(578): n is a, c, g, or t
  misc_feature (658)..(658): n is a, c, g, or t
  misc_feature (697)..(697): n is a, c, g, or t
ttaagacncacaaaatggggggggggggggtgtgttttttataaaacnaaaaaaaacaatatatacaccccccggggaaagatgttttgtgggggcgcccccaaaaaaaaaacactttggggtggggggcccccccctctctttttgggggaaagggggggggggaaaaaaaaagggagggggtcttttaaaaaaaaaaaaantnngngggggggggggaggaggngggagagagcctccttctttttaaaggggggggggccccccccttttttttggggggtgcccccacaaagaaaggggggggccgncgcgccaacaaacaaataatataatttatttttttggggggggcgggacaaaagaaaaacaacaatnttggggggggggggggacacccacttttcttttaaaataaaaataatttttgncccccccccctcttttctaaaaaaaaacaacaaaaggatgggagggagatgatatatttatntgagnggagggcgcccctgcccccccccgccgccccggcgcgatttttttattttttttttttcctccccccccccgcnancttnccccacccaccaccacccacaccaatacactcttttttgtgtttttgtttgggctgaagaaacaacacaccccccctctnctagggtggcgcgcgccctccctctcctattaataaaanagaaagaagaggagaagagaggcccgcgcgcgccctctttttcttttatttatctt

SEQ ID NO: 648469 - DNA, 304 bp, Homo sapiens
agctaggatgagcattaattcattcaatcaggatttgagtgcttccaggcactattctaggcactaaggatacatcggggaaacaagtatttatggagagacagagtcttgctctgcctcctagctgtctgcaacctcgaactcctgggctcaaagaatcccctgcctcagccttctgagtagctacgactgcaggcacatgccaccaggcctggctgatttttatgttttttttgtagagataagagtcttgctgtgttgaccaggctggtctcaaactcctggcctcaagtgatcctcctgc

SEQ ID NO: 648470 - DNA, 120 bp, Homo sapiens
cggatcttaacgtcagcactacttgtgcaggagttagacttttctattagagaagtcaggtgcatgtaatggggaacagtgagggaaaagttgttggtgctcagtgctgggctgtgtctg

SEQ ID NO: 648471 - DNA, 459 bp, Homo sapiens
cttgattatccccgtagcagcgcagccacatcaatagcagctctaaccttaggtgagaggcgtaggagggggcgggagtggaccgggaatctagaaggaaagtgtagtccggggatacgggaattaatcttaccggggggaagatggatgagggggtactttcgtcgtggtagggcggaatatggaagtggtattagtaaggtgcgggggggatctgaggaacaggacctgatagcggtcggggtgcggtgggagtgagtagtctgaaatgggaagtatgattggtggaggtggaaatcgttcccggtgtggccgccctgtgtggggccgtggggtggcggagattaggtgcgctatcggggtagaggaggtaggccggtccgcgcgtgaatcctgttggggggagacgctggtggttggaggctgtgcgtaggtattgatgtggctgcgctgctacgg

SEQ ID NO: 648472 - DNA, 174 bp, Homo sapiens
taaaaatacagacggggtctgggtaaatggcccaggcgggtgtcaaactccgggattccagtgaccctcccatttgggcctcccaaagggcggggataacgggtgtgagtaataataagctggtttcttaagctttatgagtgttgagacgcagggccctgggactaataatgg

SEQ ID NO: 648473 - DNA, 707 bp, Homo sapiens
ccatgtttaagaactgtaacactcaccatgagggttggcggcttcattctggacgtcagcgagaccaagaacccaccaattcctgacacagtatgaaatggttcctttgggagaggaaaggtcctgtgagggtacagtgagaagatggccatctaccagccaggaggaaaggcctaacaagaaaccaactctgctggcaccttgatcgtgaactcccgccctctagaactgtgagaaaataaacgtctgtttaagccaaaaaaaaaaaaaaaaaaaaaaaaaaaaaaaaaaaaaaaaaaaaaaaaaaaaaaaaaaaaaaaaaaaaaaaaaagggggggggggcggaaaaattttcccccgggggggggcattggcgcccttttttttaaaaaaagggggggtccaattagagggggagttatttattaaaagaagagaggggggaggggtattaaaaaagagtggcgtggggggggggaaaaacaagtgttatttctgggatttctttgggagaggaggaagaccaccatttagtgggggggagagcgaaaatatgtggtggggaacactatccacaacaggagatattatcacccttgaggggaaaattaataaaaattggagagggttatgtggggtaaacaaacgagtatatatgtgcggggtaaaaaaaattggtataatggatatattggaaaatttttcag

SEQ ID NO: 648474 - DNA, 793 bp, Homo sapiens
caggctttttaaagtttttaatgacatataatgtacgtatttacagggtaaataatgatgtttgatacatatataatgatcagatcagaacaattagcatatccatcacattgaacatttatcatttattggtgttgagcctttagttctttttttttttggggatagagtctcgctctggtcacccaggctggagtgcagcggtgtgatctgggctcacggcaacctccacccaccggcttcaaccaattctccggcctcagcctccctagtgactgggattacaggcacctgccaccacacccaattttggtatcattaagtagagacggggtttcaccatctgggccaggccaggcgggtctggatctcgtgacctgtgtgatccacccacctcagcttcccagacggcgtggggattacaggcatgagccagggaccccagcagagacagtctctgctatggtcgccaggcatggagatgtggtggcgccatctgggctcactgaacctccaactcccgtggtacacagcggacttccgtgacctcagactcccgagtagcggggattaggggcacgcaccaacatgcccagtggatataggatttcaagtggagacagggtttcaccattgtgggcacggatggactagacactcctggaccatccgagaactgcccacgtgggggagaaccaaggaggagtggtccattgagaccaggcagtatggagaccagcgggcaacctggcgacgacttgaccacgaaccaataacagtcgccaaggcgagg

SEQ ID NO: 648475 - DNA, 118 bp, Homo sapiens
atgtggccgtcgatgttaaacgttgggattggagaacaccgtgtgatgctctatgtggctgatataatatgaactcctttcacacagatggattatttcctttgggatgcatctggaa

SEQ ID NO: 648476 - DNA, 106 bp, Homo sapiens
tgtgtggtgatctacgatccttagtggtgtgggtaggatcctctcagtaaggagtgagacttcattctcctttcagagaggtgagggagcaggttgagcactggtg

SEQ ID NO: 648477 - DNA, 193 bp, Homo sapiens
aattctcctcctcctgtgacaccgtggagcagtctgagcctgcagtggtctcttgtgccccaggtgcctgctggcacgaggacacaccttatgcccctcagatgactgaggtcctaacaagtgtgtgtaaaaacctctgggcccccctggccactcccccctgccttgggactcatgaaggaaacagctcaag

SEQ ID NO: 648478 - DNA, 836 bp, Homo sapiens
gacttaacatgtctttcttcgtgtctcttgtatggactcgtcattctagtcctctgacctgtccaaggtaggggccctctactctggcacctctggggacctggcctcgtggcaagggcgtttcatcagacgaatggagatgccggagcgcccagtatcaggtggtatacgtgctatgtttcgctcctctagcgctcaccctaagcaagtgcagtaggtagaggtgctatcttcctccccaattccagggcaaactcccgcgagttgtgcactagtggttgtgaagctcatgcgatattcggggcctcgccgcctaactcccattgttcctccagctctccctagtccataaccctcctctgctgacctcacagatcaaccgtattaagcaagactatatccatgaatggatggactgctaccagtccctcccacctgcacaaaacctttgggaggccccctcagagctggcctcggacaacgggctgatgttaattagcaccttagtggcctcaagccttagtcctcccacaccacttgcccaagtacagatcgactctcttcgctttgaaacaagcagtgttacccgtcatgccgctgtccaccagcatagtgactggtcactcctggaggagagactcccacgcacatgccagcaagagccccaggtctgcacgtgctgcccctcagggtgagtggcgcagggccgggggtggtccagcacctgcgcctcggcccccaccccagctgcccttggtattgtctgtgcttttgaagagtgttaaatatggaagcccctcaggttcctcctgtctaacggacgggtatttatagta

SEQ ID NO: 648479 - DNA, 269 bp, Homo sapiens
tgcgcatgctggagcatgtgatgatgactgtggacaccaatctggaccgcctcgtgaccctggaggagttgctcgcattcactcagaggaaggagttcggggacaccgttgacgcctgggagacagtggccatgcctcttgccgtcaccgtggaaaagctgaatcactcgcaggaggaccgggctgctcactatgactatcttaatgccaacgcctgcctcctcatctaatagacgacgcgcatgagtggatgaacgagactcccgctg

SEQ ID NO: 648480 - DNA, 170 bp, Homo sapiens
ttttttggttcttttttaaaaaaatccgaaatttttcccctttaggtatgtttaattccaactattcctgctattcctgttttgtcaaaaaattatttttttccaaatatgtttttttgtttgatggggccccgggaacccttattaaaacccccgaggcccgcctggga

SEQ ID NO: 648481 - DNA, 375 bp, Homo sapiens
tcactgcactgctgtgtctgaccttcactcaggcatctgcgatagacatgtagtgtcaaggccgcgcttgggtctcggtgcctccatcaggccgtcatggctctcttgcctcctggtatgccccggctcatcctgcattctctctcctcttccacgttacctgcagatcctaacagcctgctttgggtcattcgccacatggtggcaatgacgtaagcaatgccattgggcctctggttgctattatatttggtttatgacacaggagatgtatcttcaaaagtggcaacaccaatatggcttctactctatggtggtctagggtggtatagactgggcttgaataggcgggatgagtatcagggagtaccgagc

SEQ ID NO: 648482 - DNA, 584 bp, Homo sapiens
ctgcaaaaaaaaaaaaaaaaaaaaaaaaaaaaaaaaaaaaaaaaaaaaaaaaaaaaaaaaaggggggggggttaaaatttttcttgggggggaaattttgggaacatttttttggaaaaggggggcttaggggggttctttattaaaagaatgagacagaggggtcgactgtttataaacagaagatgtgtgagctgtgggaaaagtgctgcacatgtggggatttcttttggtgaagaagagacctcatttattgtgggggggggtggacactaatttggggggaccaaaactcatcctcatcgagtgtttttttgaagagttctgtatgaggtgtaacattttaacaatttttgatgggagtatttagtgggggtaaaacaccaagatgatggattaattgtgatgggggttggcgtggaaaagaatctttgcggtacacgaggagtatttgtattcttagggccaatttattttatagcggaggatctttgtgatcatcttgtgatcaacagaagatatatgtgagcatcagagatatgatacatcaacaaatctaaacagatagagattaagattacagt

SEQ ID NO: 648483 - DNA, 392 bp, Homo sapiens
caaataacaaatacagcatctgctctcttggagcccttacgaactctggatctaatctatagtcccttatgcttggttccatactgcttaaatcagatcctcgagcatcacatctcactgggaggaatttggtagaacgagacgggattcatgctcaaggatggaaattttactcaataaaactcagattaaccacaccgcgtattctttaaatgacgttggacctgtggaataatgctgatggagaaagcaatgactaacctgacagaatcaatgcaacaaaggctcatacccactgtcaagacactactctggcattccccttttgttttcagacaaccaaaatacacaagtgttcaagagtacttgtcttaatagatgaaacactgctc

SEQ ID NO: 648484 - DNA, 380 bp, Homo sapiens
  misc_feature (12)..(12): n is a, c, g, or t
  misc_feature (43)..(43): n is a, c, g, or t
  misc_feature (159)..(159): n is a, c, g, or t
  misc_feature (171)..(171): n is a, c, g, or t
  misc_feature (198)..(198): n is a, c, g, or t
  misc_feature (243)..(243): n is a, c, g, or t
  misc_feature (259)..(259): n is a, c, g, or t
ggcatccccaanttcccatgggaaatgcttaagcttgctgccntgcgaggatggggccctaggactattgggtgttctgagttctaagaaaatgccagaccttggcttggcgcggtggctcacgcctgtatcccagccgctttgggagaccgagttggntggatcacgagnttgaggtcgagatcatcctggccaatntggtgaaaccccatctctgctaaaaatacaaaaattagctgggcntggtggcacgtgcctntagtcccagctacttgggaggctgaggcaggagaattacttgaacctgggaggcagaggttgcagtgagctgagatcgtgccactgcactctagcctggtgacagagtgaggctgtgtctc

SEQ ID NO: 648485 - DNA, 148 bp, Homo sapiens
actgaaggtaagacgtgtattcaccactgcgtgtgcatgcctccgctgtaacaagttaccgtcgacacgtgagcaccgtgctgacctccaaatatcgttaagctggagcctggtcagactctaagtaggatcctcgcagtacccgtag

SEQ ID NO: 648486 - DNA, 105 bp, Homo sapiens
cgatgaatgtgggaaacaatgggcgaagggaaaggaaggattgttttgagcaatgaaatgctgctgcatgtgaaatgtgggcatccagaccctgcccagcattgt

SEQ ID NO: 648487 - DNA, 223 bp, Homo sapiens
  misc_feature (81)..(81): n is a, c, g, or t
  misc_feature (89)..(89): n is a, c, g, or t
ttatcagttagctactcttgggtaaaaaaccactcccaaaccttgagttttcttaccgagataaacaacaatgtattgttnctccagantcggagaggagctgggtggcttgtattatataagtgactgcagtcagctggcaccgcggctggggctggatggcccaagatggactcactcacctgttgtctgctatcctagctctgattgactagggttgtgt

SEQ ID NO: 648488 - DNA, 389 bp, Homo sapiens
  misc_feature (6)..(6): n is a, c, g, or t
  misc_feature (21)..(21): n is a, c, g, or t
  misc_feature (102)..(102): n is a, c, g, or t
  misc_feature (268)..(268): n is a, c, g, or t
  misc_feature (321)..(321): n is a, c, g, or t
  misc_feature (360)..(360): n is a, c, g, or t
  misc_feature (368)..(368): n is a, c, g, or t
ctgggntgcagggaattcacnccaccaaacagtgaggcaggaccgtggaacatctggctaccgtcgatagatcccgcctgtttgtagctgttatcgcgatanaatatttatcactggctgaacagagcggatttttcacattaccgctggtgcccaaatacccccagcccaggccgagcgtaaaatcgaacggcccccaggctttgctggcaacaagatattccgcatcaaacagccccgtaccgccgatatcccgcgcaccaaccgncacttgcggcagccagtaactctcttcccacaaacgcagtttgaggatcgaanggctttatctttatacgtttgatcgccagagaacgcttnggacgctngcttgtaacttgccgggtgcg

SEQ ID NO: 648489 - DNA, 1613 bp, Homo sapiens
  misc_feature (1613)..(1613): n is a, c, g, or t
tgggtccccgggggggggggggggggggggcccaggtggaggagatgggcccaaagtgtccaggggtcggggggggagagggagggagaggttaaattacaagtgtggggtgtaagtggagtgtaagaaaggtttcttgggtggcaaaggggagatgtgtgggaaaattcttttaaaaagtgtgagaaaatatacacctctcgtggcgcattttatacaacacccaagaaatatttttttatagaggggcgctgggggacgcctctctctttaaacaaaacacctctcgagggggatatagagggccgtgtggtcctccgcggtgtctctctaagaaaagccttaaaagcgcgggggccccccgggggctctcacatactcttgtgtgtgaacggcgccccgtgctttaagccatatagaatatcccctttacagagcctgtgtgggagaatattccaccctcttaaataaagagagttaagcgctcttattttgtcggggccccccagagctctcgtgaaaaaaacacctcgtgggccagatatctctaagagaggctcgcgtgagaacatgtgggggcggaaaataccccgcggggggagagagaggtgtacagtgcgggtcagggggcccataaaggtccctcttatccctctgggaagaagacaaaaaaggcccctctaccacaaaaccatccggttggacaaaaaagaggcacctctattatccacaaaacttgcgtctccgacgtggcgagagaggactcatcttacgcgcgtgaagcataatgtctccccctaaaatatcaaaatcctccctaatactgtgggcacccacggcggcggttccgtgggcacacaaaaatctttggccaccattctcgtgggacaacacttgggggtggcgacccaccgttttccccaaagaggttcaagcttaagttgcgtgtcttacacacccccgcgctggcatcacacacacgcgccctcgcggcgggggcaccgccccaaaaagaaaacgccgaggggggaccaaccccccacgcgggggaaggagggggcccctctacccccagcaggaggaagaccctcggacaaagaggaaacaggcgctctcgagaaaaacaaccacagggcccaaatattatcacaaaagagagagcaccctccaacaagggcggtccaccaaaacacccgggccaaccgtgagcgcatataggttatttttcttcgggagaccccggggcaaagaggaaatatcgcttataagagggaagatgtgggggcggagaaagaacagttagtcttctcttcttgggcgccgcaaaaatttagtggaagcaattaatggggtctgttctaagccaaaaacaatgggggcgaggcgaggtacttaggggaatgaaaaaaaaacttggcgttggtcggacaacagccacaccgtgtctctgcgggggagcgagaaaagaagagatggcgtttatagtggctaagcgagtaaatataagttagatgcagtatgaatagagtagcgacatcagaaaataattataattgatcgatgtatcaatcgtggaataatcaatcagtaatgtcataaatatacactgaggn

SEQ ID NO: 648490 - DNA, 415 bp, Homo sapiens
tacaggatcctcggaattgtgtggtgttatggtccgatcctcttcggatatctaaatggtccgatataccgaggagtaagtttccttttctttccgaagcgacgaatgcccttcatgggtgagaccttcaataaaacgaagtctccaaccataaattccaggggtctgcgcctctggtcagcatagctcttcttcctgttttgagctgtcctgatacgatctcggatcaaagccaccttctctgtggtctctctcacgagctctggtcctaacaaaatcctgtcctcaggctctgcccaacatataggagatctgcaaggtcttccatacagggcctcatacggtgccatgtcgatggtggactgatagctgttgttgtatgcaaactcaatcagtggcataaaaccacacaatt

SEQ ID NO: 648491 - DNA, 336 bp, Homo sapiens
ggtgatgatgattattattatagatgttctttattattataattacttcatcttttaagtggagatgcccaacccattatcattattctctgacagaagctcataaaaaattttactaatgcattattaatacattttaaaatcttgtgataaactcaatttcatgtaggaagagatgatgctaaagtagatagcacaggaattttgggaccatatatacatatgaaataaacaccaactcaatcttttagtgtatatgacatgttggcaaatcaataaatatctctgtccctatgtgtttgttaatacaaataaaagaaaaaatacacacccaga

SEQ ID NO: 648492 - DNA, 173 bp, Homo sapiens
cctagtagttatggttcgcgttagcctcagcgcatcagaagagcgccaggctcacctcactacccagtatatgcaaagaatggctagtgtacgagctgtacctcagtcctgtaatcagacccctaccagccaggcaccgtccgttcagggttagcttcagtgggtagactaat

SEQ ID NO: 648493 - DNA, 205 bp, Homo sapiens
  misc_feature (2)..(3): n is a, c, g, or t
  misc_feature (5)..(6): n is a, c, g, or t
  misc_feature (16)..(16): n is a, c, g, or t
  misc_feature (36)..(36): n is a, c, g, or t
  misc_feature (45)..(45): n is a, c, g, or t
  misc_feature (51)..(53): n is a, c, g, or t
  misc_feature (55)..(55): n is a, c, g, or t
  misc_feature (65)..(66): n is a, c, g, or t
  misc_feature (76)..(76): n is a, c, g, or t
  misc_feature (83)..(83): n is a, c, g, or t
  misc_feature (104)..(104): n is a, c, g, or t
  misc_feature (106)..(106): n is a, c, g, or t
  misc_feature (115)..(115): n is a, c, g, or t
  misc_feature (124)..(125): n is a, c, g, or t
  misc_feature (143)..(143): n is a, c, g, or t
  misc_feature (150)..(150): n is a, c, g, or t
  misc_feature (175)..(176): n is a, c, g, or t
cnncnntgggaacatnaacggtggaaatcacttggnatgagactnatcatnnnanaattacaatnntcaacaggangtttaanaaggcagagcttttggacatngnttttcaagnctacttagnnatcctctagtgaagatgnaagaggnagatagaagaggagctacaaggtgnntgaatggagtccatgtagaagaagatggg

SEQ ID NO: 648494 - DNA, 318 bp, Homo sapiens
ttcaggtccacaggttgcgttccggggagtcaaacttccaggagatggttatgcccccgatatctgagtcactaaagcgcaacaagaaggtcccgtcgttcttgtggatgagcaggtcgtggtcctgttgcttattcacaaaacctaggatggccccatcattccatgtgggggcttgtggtgcttcttcaacacctccatcaccccgttcaaactatgccagaaggtgtagttccagcccgtaaagttctccctgttgaaccgggaacaggacacggacaggccactgtagtcctccaggttggcttgatactgctg

SEQ ID NO: 648495 - DNA, 324 bp, Homo sapiens
ctcggaccccaccagaaaggtcagtcagggtaaaacactggtgcaacagcgtcaaattaggaaaaaaaaaaaaactatattattatcaatggacaggtaccacaacggtgcccttgatagataagtattcactcctaaaaatcttcagttgggcaccaggattggtgtgtttaaaaccaccctaaggatgttttggaatctaggctggatttggataagttggagatatacagggagaattttaaaggggttgagaggatactgggggctcaggggaagtaaaagggacaagtgggaaaagtggacccagagaaaaaactctgt

SEQ ID NO: 648496 - DNA, 188 bp, Homo sapiens
gcggccgcctactaccactaaattcgcggccgcgtcgaccgacaccattctatatactttcggcccatccttggacactggctatctaacctccaaacgagcttcaatgccatacaacactccttccgtggcctccaactgctcttaaatgctagtaaaaccaaatgcatgcttttcaactgtcgacg

SEQ ID NO: 648497 - DNA, 165 bp, Homo sapiens
ccagagacatcacggaggcagcgtcacaccgagacgagggtctgcctgggagcccaactctcgacctgccatcattctgcgccactgcgacgcctcactggcccgggctgggaagaggctgcgaacccgctctagctgaccttgggaagacagcctggaaggtgc

SEQ ID NO: 648498 - DNA, 501 bp, Homo sapiens
ttggcacgcgggggctgcaccaaaaccctgcaaccacctgcaccttggcatgtctttgggtggcggctgtgcccagaccccgccccctctcatgccctctgggttctcgggagggtccggagactccagtgatataggctgggacaacgagagcaaggaccctgacaaggtagcaccattaaaaaccatgtctttctaccactctcatatcttccaattactgatgtgtgtgtgtggaaaggaatatagtcttctgactatcagtacagtactgcatagtgttggcacaataccagaacgtagacttcattacagatactaggttttgtatcccgatgttcaataccaaaacgataccgaggcacaaaaaaaaggcatattagccaaagttacagaatggcacatgatccagacagatatgctcagcgtggccagaaggatccttctggccacgcctgggacgacatggagaaaatctggcaccacaccttctacaatgag

SEQ ID NO: 648499 - DNA, 106 bp, Homo sapiens
cctcctgacgaatccgtgataccagagatgagcatccatataccaggatcacatctccattactgctcttctggtcagcaaagcgtgacattgcctgagctactag

SEQ ID NO: 648500 - DNA, 1056 bp, Homo sapiens
ggacggaatggagagtttgagacagagcccactgcactctctcgacttagaattgtggaagtgcgacttccaaccccgggtcctgcctaccgcagtccctaactcgcagctggacgcttcccggagcccagatacttccgtgcgagcttgttcccgcaagccgacttatgctctgctgtcacgtagccacttactggaactgctgagctttgcttaaataacttccctacatgactgccctagtgagcttatgccaccactggggagaagactggtggctagctagtccatgcgccttgtccgtggaatcgcaagttgctcaagaaaagtaagccagttcatggcatgcactcgggtccaatagcgttggagcctgtttactgcgcagcaatctcttgagtttctaccaggggacctcctacgtggtcttcgatctctgcagatatcaggaacgcttcaacaaaccaatttgcaccctgaataaccctttcgcatggggcacgcatccaccggtcagtgcccgtgccgttgccataggggtacctaacgcaagccggagtaggaacctactttatgacggtcgccttgtgggaaacctatgcaggccgagttcgaaacgtccggggcccccttgcatggccctgttgacgttgcttttcttcaatttcgccgacggcggttgcttttcccttttgccagatcggaagcggcgacacttgccagaccttcccacgttgcgcggtcgttacactcccgcggggcactcgctcggggggctcggccacatggaagcgcactggcaccggcggacttccccacttccttctcgggcggttaagccaatacttgttctaccgacggttatgacactttcggcataaggcgatttgtgcggaaggctagagggggggcccaccattgggggtcccggcgggtttgccgtgtcgggttcggggacctgtcgcgcgcgcctcggaatcgcgagaggcgcatccccccgcgttacgccgcccctaggcgattacccgccgtttcgcgcgctttggttccgccccg

SEQ ID NO: 648501 - DNA, 1223 bp, Homo sapiens
gtctccgtatttgtgcttctgttgtcgcttcgtcagcactctgtttgttacgttgtgctgcccgttgttcggtcgtctttgtgttctcctgtgtggtgtgttgtgtttccatatctcttttttatttttttcccccttctttcgctgccctttcttagcttctctggttttgcttcatcattcttcttgcaagttccctcgctgtgggcgccgtttgattttctgtgcccatcttgatcgtctgtgtctgccctctattccctggtctcccgtcgtttctctctcggtgctttctattttctcttcttgcttttctttgttttttctttttttctcctcttcctctgttttgctgtatgcttggttgatttcccctttattgtatctttgtcttctgtctcttggttgtttgcctccatcgttgtacccctgcggtatgttctaccatgtatggtctttctgcactgcttgctgattctggtcgcctgttctggttgtcgctgtgttggtcttctgacgtcttccttcctctttcgtgtcgctcttctgttgtccggtttttcttttacatgtctcgtcattcctttttttgcatatggttatgtcatggtagtatataatttacacattttctatgttcatgtttatatgtactagacctctagatcttatgcattttatgtacaattgttactttctatatttttcgttaaatgtaaagtaagtacagtattcatagtttttatattctttattattgttgtactatagtaagtgttctggtgtaaactatgtagtagttttatgctgtatatgtatctgtttacatgtatgtgtttaaggatatgctatttaaatatgtgtatataacttcctctgcctgttgggataatggagagttttgttactttattgtcttatttttaaatacatgttctgtcagataatgaatagtattgctgtgttggtcaatttatgataataacttaatagttatgtttgtaaatctttagttaactgatatagagatgggtattctggttaactgactcaattctcatgtaggaatatacatataatacataatgtctatttgataaatcgagaatacagaagcattacttagaaatctgagttacctcttaaataatgacgtggcatgttgaagttgaggatgggtcttgagttccatgtgattttaagctcttggatatcgagggtta

SEQ ID NO: 648502 - DNA, 1188 bp, Homo sapiens
gatgtgaaagctttggggttttggaacagttacttacaggtctgttgaagatggtaatatctacgaactaacaatgggaagacattcttatttttgcaactggttgcagattccattcctccaggctggatttaaacccactcgcttcaacttgagtgtctgcatgtgggattttcctgttggaatcaagtgtaataactgtttagtcaattcccatcaccaattacatataaagagtttcaagaacaatatggaccttcaccatagagaagacactctaacgactagaaagaggaaggaaagttctcattacattggacattagaatgtttccttgagacaaagagaagcttctttaagaagctagctattgataactctctttgattatcactaaccttttcatcatcactttgaacaaactagttagcttcttgacctaataaaatttatgatcatgcaatatacacggacatattcatagccacttaggctaaaaagaaggtttctccagtataaagcatactagtcaacaatcggtgataagtttctcattttcttgatatagatacttcataaacctcaataaatagtctcagactggttgtatggatcggatttagcgtatggtagcatggttcataacacagtaaaaactgtgttacctcacagttctttcgccacatttcaggattacctattagcaatgccaccagttccctagggtaattcacgttccacattattccccatttacttcaaaagcgctaactcaacacggccaacttggggtcaactcgggggattatacaaccacgggcgaattaatcggcagagcatctgtccatcaaactaacaacccttcacggtagcaccacaaggtcggaacgacgcttgcgagctctgcctttactatagtcagtctacgcagggatgactacattacacctggacggagtactattataataatagagaaaagtccacgaaggtgtgattcaacaaaaagtaggggggcgagcaacacataatccctacgtaggaagactacctaaaacaataacagacgtaagttaactacggatccgagaagtaagctagatagtaagaatagttgtccgttccttttttttctttgttattttttttttcttggtatcttcctagggaaggaggaggggggaggga

SEQ ID NO: 648503 - DNA, 270 bp, Homo sapiens
caaaggccggatgagtagcatcgtggtgtttaacgacaaaagtactttaccgaaaaaggcgcaatgaattgtattcctcgaaacgaagatagagctcctaagtaagataatgtcaagtgaactgtagtacaaggaggttggaattgaagtagagaggccaaagggatcgttgtaaataagcacttagattgtaagcttaagcgctttaatgaaattaagtggaccaactgacagattgaagaaatggataacgtattcactgactgtgtc

SEQ ID NO: 648504 - DNA, 359 bp, Homo sapiens
tcccgtcggagcgtgactaaacaattctcatataaattcaccctagccatcattctactatcatcattactaataattggctcctttaatctctccacccttatcgcaacacaataacacctcttatttactcctgccatcatgacccttggacacttatatgattcatctccacactagctcatacctaatcgaaccccctttcgacctcttagctgtcgtgtatggttttcatttgttttgaggcttcgtctgattagtcattgttgggtgtgtgcctcgtccgttgttgatccgatctttggaggtggggtactcaatagaggcggaagttcactgctcagttctgcggcgggtat

SEQ ID NO: 648505 - DNA, 277 bp, Homo sapiens
tacaggcctaccaggtacagttatactactattgctctgaagtccatcttcaataagtaatggccattcttcccaaatgtatgcaagatcaatttttccattctttgacgtggcagattctccatctgttactctgcatctccagaatcttactttctcatctgaacatgaagttgccaataaataaggagcactgcatgcaggatatatagaagatgaactcagatgtcctgctgatggcttaatacttattatctcaactccttctggtaaatgc

SEQ ID NO: 648506 - DNA, 744 bp, Homo sapiens
ggcccttcgggacgatctggatgcagaacgttcagtacaaagtgattcgtgctcgagatgctctccagtaccccctccgtactccgccggtgcatacctcagcgcctctcctctcttcgccccggacttcgtctaccacaggtactcttcggtgtacggttttcgcgtatggtccaggcgctccgtccttaggcgtctgggccctcctctgcgaccttaatatggcccggtgcgcgcgcgctctgtttgttgagttgtcgtcttccttccccttacgcctctattccgcttcccgaggtggcccggtgtgtcccgctttcggcgcagtttgttacgagtcggctgcacgcggcctctgtccggttgactttgcggagccatggagggcggcgttctggctccgtatttcgggggctcctggcagcgtggaagctgtgacccatgggctcataatggagcaggtgaaatgtgcagatcgccgtggccaacgcgcaggagctgctgcagaggatgacggacaagtgtttccggaagtgtatagggaaacctgggggctccctggacaatcgtccgagcatgaagtgcatcgccatgtgcatggaccgctacatggacgcctggaacaccgtgtctcgcgcctacaattcgcggtctgcagcgggaacgagccaacatgtgaccggcgagcgcgggtcaccccgacctgttcatttccagtaaacgtgctttgagaggcggggtccg

SEQ ID NO: 648507 - DNA, 81 bp, Homo sapiens
ctagaagattcagcaaagtacttttgtgctcttggggacggccttcctagggatgggggatacgcctccgataaactcact

SEQ ID NO: 648508 - DNA, 227 bp, Homo sapiens
  misc_feature (222)..(222): n is a, c, g, or t
ggcagaaagtcaacgggctcggagtggttaaagtaggacgaatattcattggttgagtagttggaatttgaactggaccttgaaagttgggtagaatttaaatgagtgaagaagagctaggaaataatttcattaaggaaataaatatagctaagatgggacaagcatagcatttctaatgccataccattgtttttataattaatgtagcataaaggcacnaacgc

SEQ ID NO: 648509 - DNA, 401 bp, Homo sapiens
tggggagctgcaaagagtgttgaatgggcaattctacttgggagggatggaaatgttttgaaactaggtagaagtggtggtatcactgaattattcgatttacaaggattaattatatgttatgtgaatttgaactcaataaattattaaatgaaaaacaaatgataggattggaaacgctgcaaccactttggacaagagcttggcccttctccatgcaggtgaagacacgcacgccatgaccagaccccctactctgactgtcggtccctagagggattcaggcacatgtcccttgcaggcagggacacgagtgtgtcgtaacccataagtgaacacagtcaccgtgatcagggttgggaggccgaggtaggcggatcatgaggtcaagaggtcgagct

SEQ ID NO: 648510 - DNA, 643 bp, Homo sapiens
tcctgcttatagtgatctcttgcatgtttacttctcttgctctgaatcccttaaactgctgaggtcttgctcgaacgtttcatccctcagtcctattttctcattctatatgcacactcattatttcagttgaacgagacgttcacatggcttcagagcgaccagtttgagttgttgattaatagcgatatctttgaacccccatatctctctaggtgctgtagacctgatagtttgcatacgttaactaggtatattcacctaaacatcccattagatagtgccgaaatgtcacatgtcgtcctaaatactgataacttgtgcctctactctctccgctggcttcaacatctattctgtcttctcataactgcgtataacttactcgtcccctcaatgttcagtcatcaatcacttcttctgggtctacttgtgagatagccttcgagtgactaacctttgctcaacgtgtcacatcgtatgctggttcctcgtacaatgttcaagaatgatcgtggctggcttttgccagggttgaccatgttaaacctagctttatagagcacacattattgtgaatagattgaggctttaaccgccggagacactatacctagggaaacactcagactaacctctacaa

SEQ ID NO: 648511 - DNA, 557 bp, Homo sapiens
tcgaattcgacggtttctcggtacgagaaacatcaatcagacccatattaacaaaaaaaaaaaaaaagggtcccagggaaaagcctgctgtctctaagctaaaggaccaaaaaaaggacagccaacaaaacaaaaacttttggattatacttgcctgccccgggaaaatagctatgaaaagagatagactctttcccctccccagggagcacggcagctacccagatggggagcagaggtctgtccaccaaccacagcctgaaaaacaaagcagcaacctctccatacctgtgggatttggtgggtaacgagccctataatctttgcctctgcatagtgagagaggcccgtgtcccagatgaaggctctcagcaaaaactatatggcttccttgcccttcagtattgagatagtccccttttgcccctaccctgcacctgactcactggggtgctgtagccaacagatttggggatacacctctcctccatccccatgatgcattattgagccagaataccatatcttctcagttagagagttgacggaggataact

SEQ ID NO: 648512 - DNA, 334 bp, Homo sapiens
tctaggacttttatactttcaggtcttacttttatgtctttaattcatcttgagttaattttggtataagaggtggggtgtggtaggtagctcacacctaaagtcccaactcttgggaagaccaaggggggaggatggcttgagtccaggagttggagaccagctggggcaacaaagtgagaacccgtctctaaaacaataaaaaattgcgctggggggtgatgtgcacctgtaatccctgctacacagaaggctcaggcaggagaatcccttgagtccagggggtcaaggctgtagtgagccatgttcataccatggcacgggcagcctccag

SEQ ID NO: 648513 - DNA, 166 bp, Homo sapiens
cgaggagtattggtgcgggagcttagtatgatgatgggcgtagataagtagtggttactggttgaccatggttgtaggtgtatatacttgtaattgagattgctcgggggaataggttatgtgattaggagtagggttaggatgagtgggaagaagaaagagagga

SEQ ID NO: 648514 - DNA, 479 bp, Homo sapiens
gctgaggtgatctagaggatccagtgtactccacaacagcagcacgggctgaccatgtactggaatcatctgcactcctcacatggaactggcaagctcataaacgaacagcagtgggtgctgaaagcagcaccaaaatggagatttggattccagccccccagtgacagcccagtgcgaagaagcaaactccagatgggcagaaggcagggtgcacaggtggctccagtctcaggaggatgcgcctcctctcccccatcccagccctcagcattgtgccagagtgatacccttaagtgtttgggtttatgtttttcagtttggtttgggaaacagcagttgcacagagagttgggggtactgctgctgccttttcaccgaggcactgccaccaccagctctagcagggatgctcctgagcttggcggacatacttagatcctaacgtgccagtgagacctgtttgtggaggtagcact

SEQ ID NO: 648515 - DNA, 1295 bp, Homo sapiens
  misc_feature (156)..(156): n is a, c, g, or t
  misc_feature (340)..(340): n is a, c, g, or t
  misc_feature (443)..(443): n is a, c, g, or t
  misc_feature (497)..(497): n is a, c, g, or t
  misc_feature (523)..(523): n is a, c, g, or t
  misc_feature (606)..(606): n is a, c, g, or t
  misc_feature (634)..(634): n is a, c, g, or t
  misc_feature (684)..(684): n is a, c, g, or t
  misc_feature (736)..(736): n is a, c, g, or t
  misc_feature (803)..(803): n is a, c, g, or t
  misc_feature (860)..(860): n is a, c, g, or t
  misc_feature (915)..(915): n is a, c, g, or t
  misc_feature (958)..(958): n is a, c, g, or t
  misc_feature (1022)..(1022): n is a, c, g, or t
  misc_feature (1170)..(1170): n is a, c, g, or t
ctcccccccagcggccgccccttgggcgtgcggccccgccggggaattccttggtcctatctatcggtccttgggcgggagcatgctcggttatgttcacagaggtctgtagaggtgtgacgtcgcgtgaccatcctcccattgtgtagtaagagncctcgccgccatatattcatagcgcttatatcccacgtaattgaccagcccgcatacctcgcgctaagtcgtacttgtcaagaccaacggtagccgagtgagtggtatgttgatagtgtgtggctcttgtgtatgagccaacaagcagcaccccgcgtgtagatgtgagacgccgcgtttttgntcgtttatcttataagaataagtggttcgggagcctgacggggccggcgctatgattggcgcatctgctactcctataagcacgacgtcatcccaatgacttntccgactcatcctgctgccacgacagcaagggtttggacgtagttggtggtgtntctctttataagcgaggaaataggangagacagagcggatattgtctcgacggcgcgctaagcgacgcagccaacgcgagactccgccgcgaggcgcacggccgccgangcgaggatcaccgctacagagaagcagnatgagatgtacgggtatacatctagcgtgagatttgttgttgatgatatngctatcgttctgcgttggggcgtcgcctggccgctgacagcgtttcctcgtngcaactcgcgcgagcgagtgcgtattcgctcgagcgtcccggtgacttcgagccgacgtcataacantctatatcactcctctctctccacaactaccccgtcacacgagacgcgctccatgcngcactctctcgctcacacgtggtgagtagtatagttacaggcgagtaggcacatnttcgcatcgccgcggtactatagctcacgtttatctagctgantgcaatccctagtgattattcgtatgtctttcgcttgttcttcgtgtgatagcagtgcgtcgcncacccgccgcacccctctctctactccccgcgcgtccgccctctatctgctcacgaagacgtgtatcagcggatcgtgccgcgcgtgcgcaacgtgtggcctgaagatactatagttgtgctttggactcgatcgggctgtcgagatncgacatacaaatgagaacaacatcgcgtgtcgaggacgcagcgatgactgtgtgcccggcgcgactcgtctctgtattcttcctcgctgtctcttcgcggtatcttgtatcctcgtcgtcgcgag

SEQ ID NO: 648516 - DNA, 502 bp, Homo sapiens
  misc_feature (497)..(497): n is a, c, g, or t
gttatgcagtatctatcatctatatatctatccataactattctcaagatcagtctagtacactatcgatctatcgctgtccatctatctatctatcctaactttgtgcctatacatccacgtatgaatatctattaataactatatccatgagatctatgttcttgctactcaactgtgtccgtgcactgttatctatatcgatcaaggaatcgtctctccttgtctctgtggggttctctatcagtccgtgttttgttatttacgtatctctgcctataatgtatctatgtccatttaatccatgtattgctatgtatctctacatttcatatacgttagcactttcgttagtatatgctatgtctcaaacacgtgcccactcacatttgcatgtgtgtctgaatgtatacacacatacacacacatttagtgaaggggcaccctgacttgatttgtacatatctcagtggtgacagtcatcagcaagaagcagncccag

SEQ ID NO: 648517 - DNA, 282 bp, Homo sapiens
ggacccaggaggtgtctcttgtgccagacggagtgcaaggcacaatctcagtttactggcaacctgtgcctcctgagttcaagcgattctcctgcctcagtctcccaagtagctgggattacagtcatgtgccaccgtgcctgtctaatttggtatttttagtagagacggggtttcaccatgttggtcaggctggtcttaaactcctgacctcaagtgatccacccgcctcggcctcccaaagtgctgggattacaggtgtgagccagtacaacctgccgg

SEQ ID NO: 648518 - DNA, 456 bp, Homo sapiens
  misc_feature (455)..(455): n is a, c, g, or t
ttccggtattactctgctacacgtagcctttttacttttggggttttgtttttgttctgactttcctgttacttttcagggctgacgtcacatgtaggtggcgtgtatgagtggaaacgggcctgggtcttggggactggagggcgggggtccttctgcccctggggtcccagggtgctttgcctggtcagccaggcctttcctgggagccactcgcccaaaaaatcagcttggccaacctggggggctgtgtccacccagcccgcccgtcctgtggggtgcacagctcaccttgttccctcctgccccggtttgaaaaccgagtttgtgggcactttttgccttcatgcacctgtcctttttaacatgtcaccttcaactgtaatcccaacatcctgactccgtcattttataaaaaaggaacatcaggcatgctaccaggcctgtgccgtccna

SEQ ID NO: 648519 - DNA, 1067 bp, Homo sapiens
  misc_feature (1)..(1): n is a, c, g, or t
ngaaaaaaaatgaaaagcgaaagataatatacatcgtctttcccatatacttgtgtgcgtcgctctgtatccaattgtggaggagactgtcaatcgttttaactggattatatatgtctgctttcgacgtagcttggtccccacttccgtatggcgcccctgcagttatccttcctcctgacagctttactgctccaatggtagttctgcaatttacctcttgtccgttgttcctttcgtcagtgctagcgttcccctctgcagtagcccttcgggcttgtactatcagaagtgaatgccccttcctgtcacatgacgtgttattcagtcagaccagccccactaccattgctgtgccctgtcaggccctccgggaggacctgcgtgcctagccaagtcatttcacttccactccatagcgctctttcatatctatgggcctagcttaccaacacactatctctagtgatcgatttgtatggcgcgatgtgacatgaagaaagcacatgccaaggtccaccacacaccacctgtcccataggccttcgatacgggataatcctagttattacctcagaagtttttttcttcgcagagatttttctgagccttttaccactccagcctagccccgttaccccccaattaggagggcactggcccccaacaggcatcaccccgctaaatcccctagaagtcccactcctaaacacatccgtattactcgcatcaggagtatcaatcaccatgagctcacacatagtctaatagaaaacaaccgagaatccaagataattcaagcacgtgcttactacaatatctactagggtctgctatttgtacccttacagtagcaagcctcagagtagcttcgagtctcccttcaccatttccgacggcatcctacggctcaacattttttgtagccacaggcttcgcaatcggacttcacgtcactttaatggctctacgtttcctcactatctgcttcatcacgccaactaatatttcagctttacatccaaacatccactttggcttcgaagcaaattgcctgatactggcat

SEQ ID NO: 648520 - DNA, 758 bp, Homo sapiens
caggctgggtgtaaatcggccgaggccggaggtgcggcgccgaccaagatggagactgccgagctgccttgagccgttgagcagctgaactgaggccgtgccggggcgctccgaggcctgagtactgaccacgcctgtgccggtgaggaccttcatcagggctccgtccacttggcccgcttggctgtcccgtcacactccagtgtcaagccactgtgtcacccaggcagccaagagaggtgtggcgtggccctggtggacgcattgagctgagtgctaggaacaggtgagccgtcccccagtcgtgtgagggccgaacacgggactggagtattggacacgctgccttccgacacagtctccctcagtgactcggactctgacctcacgtcttgcccggtggtgctgatagtggaatgcactgtctcccgattggggctgcctggggatgtgaggattcaggtcctgatgagccgccctcatcccccgtcaggcctcctcccagccagcggtgcagccattccatctgagaggcatgagctccgaccgttctcccagcgcagccgtgacatctttgactgcctggagtggggcgtgcagacggtgctccatcctctgtggcccacaccagcatgagtgacaacggaggcttcaagcggccctagcgccctcaggccggtctccactggaaggctgggcaggccatcggaggcctgctcacaaggtgctccgggccgatacgtggaaacccgacgctg

SEQ ID NO: 648521 - DNA, 345 bp, Homo sapiens
tttacccccaatttaaaacgtttttttttattgcaggttgtttgtttgatatggtttggctgtgtccccacccaaatcttatctagaattgtaatcagaattataatccccatgtgttgggggagggacctggtgggaggtgataggatcatgggggtggttcccccatgctgttctgatagtgagtgagttatcacgagatctgatggttttgtaagtggtggtttcccctgctcttctctcttgcctgccaccatgtaagatgtgcctggttccccttccgccatgattgtaagtttcctgaggcctcccccgccatgtggaactgtgagtcaattacacctc

SEQ ID NO: 648522 - DNA, 479 bp, Homo sapiens
tgtcctatgtgttttccaaaagcccgcggtgttacaccgacggcgttcttcctcccgcgcgcataaagggatgttagcaggtcttttccgatctctcaacaaaagtgcgcccaagtaccagcctggcggggtgacaccaccatgaagtggatcctgcacaaagagaaccggattgtcctaatgggtgaggctcttatcgagtgccggcttgagctagatagtatccggtagatgatctctccacgggggcttgttaacctgggtcgctctctaggcttgtctggattccacacatggacctcggagaccaccacacgtatgtttggttcgatagttctgtctcagacaagaggaggaatttgtgggggggacacgcgtctgatacacagctacagtgtcggggtaagaacagacgtcacactggcgtgcgtttttggccccaaaaacaggataactgctgttgtcggtcccacaaaaca

SEQ ID NO: 648523 - DNA, 417 bp, Homo sapiens
ttcggcacgaggaaaatacaaaaaagttagccaggcgtgatggcacacgcccgtaatcccagctactcgggaggctgaagcaggagaattggttgaacccttgagcagatatcgtgccactacactccagcttgggtgaccaagtgagactaaaaaaaaaaaaatattaaagtgagtctcaaaaaaaaaattaaaaggaaaagataaaatgagcatatcaggattatttaggcctgaaaacaaactgaataatcagaatgatggttacatggttaattaaattacctatgtcatatttattccccaggatattgtgactttgttaaaactgacaaatagaaagtctaagttggggaaagacgggactttttaatatgtaaaggtggaaaacaaaacagctacccatataaaaaaaaa

SEQ ID NO: 648524 - DNA, 710 bp, Homo sapiens
  misc_feature (350)..(350): n is a, c, g, or t
catggggctggggctgctggcgaaggaggtcgggcgctgcagaggagctcatagaccctacagcgcagccaggtcggggaggccgctgattctcccgcttcagggcgttcaactgcaggacgaagcgtccccaacgcgcacacccgactctggagacccgagtgtgtgcgggaggccagccccgccgaagcgccgtccaggatctgccgaagcgccgtccaggatctgccgaagcgccatccaggatctgccgaagcgccgcccgggatctgccgccgcacgcaagagcccaaccatagaggacagcgggggcacctagtacccgtggagatccaaactcctctcacccnagccccaaagcacttctcccaatgctgctgccgtgcctgaatcccgcccacgcgtgagaatcaccccattattacagaagacccctgtcaaatgcacacgcgttaaccacgtgttacccaaggacgactcagtcatcctttaggactcggtgatacattagcacagatgaacctggcactgaggtgggatgaggtggggagatcttttggccgcaggtcatttaggatattgttattactgcaaagaccacagaacagccatggtttagtcacttattccttgccaggagcttcgtctcattgtctcttttaataaacaatattttgagatcaaaaacacacgagagaaatcaaaaaggg

SEQ ID NO: 648525 - DNA, 283 bp, Homo sapiens
ccagcccagactgggcagagaaaggaaatggcacatcactcacagatgacagtctgcagatcgtacagtgttatatcagacgaggctgcttctcgttttatactgattgaactgtgtctccacggtcgtggagcgttgatggtaccttctcggaaggtccacattcaattgtaccaccagagatcctggcctgaacttcatattgtagaggacccacaaaacctcccttttttataggaatctgctacatacacatttctaaaatgtctctctcgcagctctt

SEQ ID NO: 648526 - DNA, 480 bp, Homo sapiens
tggcacaaaccggccttaaaaacaaaatttgtgactttttaaacaaaaagggaggcccttaaaaaggggttggccaatttgtacaaaaaggtcctatttttgtgaaaaggggcataaaaaaaaaagatgttataccccaaaagggaaaaagggatttttaaaaaaacttgggaaaaactgcccaaacatttttgccaagcgggatccccgcctttgtttaaatttttttaacggggaaaatccccccaggcccattaactgttgcccttttgaaggtccaaaatttatattttagaaaaaataaaaaaaaaaatattttcatgttcccaaaaaaatggtggggggaatgggtgaaaaaaaataaattgatagggtttcccaaaacaaaatgttttacgaaagcccccgttcaggtttttgttttaaaacggggaaaaaaaaatttttttatttcaaaaaatgaaaaaaaatttaaagtta

SEQ ID NO: 648527 - DNA, 195 bp, Homo sapiens
gcctcagaaaaatgagaagatgagaatcagcagtggatcagcttcaggctccagtctgtcaactcaatgagaaagaaatggtagtaagcttgttcagggagatcaagatatgacagagcagttagagcagcttgaccgaggataatgaccatcctctttctcagtttaactgaacagaggaaggaccagatgaag

SEQ ID NO: 648528 - DNA, 189 bp, Homo sapiens
ggcagagagaagtgaggtataacagtgcaagagcagattccagcaggaccccagctgctaagggcaaggaccctttgatgtcacaatgtggaggttttgatggagcccaagtctaggagcttccctgtgggcatgaagtaataggctagagcaggttccctggtgtggtgagtatgagtgttggcactt

SEQ ID NO: 648529 - DNA, 221 bp, Homo sapiens
ctactgcagttacaacatgtaataggtaatgctagactgcttcaagtaggtgatcaggttaactcaatatgtaaaacctacaaatgttaaaatattgtacaattagtacctgtatttttatttctatagctacttattctaccattataaacattatcaattagagcagtgattcctacacatagctattatatgcataacagggaataccaaaagtctta

SEQ ID NO: 648530 - DNA, 437 bp, Homo sapiens
  misc_feature (245)..(245): n is a, c, g, or t
  misc_feature (369)..(369): n is a, c, g, or t
  misc_feature (375)..(375): n is a, c, g, or t
  misc_feature (396)..(396): n is a, c, g, or t
  misc_feature (403)..(403): n is a, c, g, or t
  misc_feature (431)..(431): n is a, c, g, or t
ggcaagcacaagaagtggcgttattgaaattaacatttcccccaagttttacaatgtctaggcatgcatatttaagtgtctgcctcaaaagctcatgctaataaggagatggtgcatttaatttcctttttttgttctctgagcaacatgcagcttcctgcacagccctccttgcaggcaactgcactgaggtgacagtcctcctgactgccagcacagatccccagggcctctgagggcctgtnattctgggggcagtctttcactttctattcggccccagctggaagggagcagtttaaccacagcccagcacaggtctcccgccttagcttctcttaagggagtctgggttccctcttgacaatntggganctcaccagtttgagggttcgngagcccnggggcagggagccaggggccaggggggnatttgg

SEQ ID NO: 648531 - DNA, 512 bp, Homo sapiens
gggcgctctagaggacttagctagtggtctcagctgtagaaataacctcccactagaaaaaccaatgggcaataatgacttcttgacgatggggtggtcaaaacgaaatatagccttcctctttatatactcacatcaaggccctgtgactggttaagcaaacaaggtttcccatggtccatggtgtcccttcccttgacagagaatcttgaactcatcaaactagattcgatatagtactagggtggaattaatgccctctctatataggctggttatcagaaatcaagaacactatgctgaagtccttcctaatgatctcccaaagtaaacatattctacaggaaggattcccagtgtcataaaattgcagtagatatgcatcaatcaagtacctctcaggagcattttaaatttttctgagaatagcccttatacttatcagatgcttactgtaggctgggaacttcctcatgtgtaaaggcgagcctccttgacatgttttgtctagt

SEQ ID NO: 648532 - DNA, 132 bp, Homo sapiens
gctctcactggcttcactccttccctgtgtactatgctcagagacagaatagtttgaaaatacgtctttttcctctttagctggatgtcccacagagaaaatggaataaagtgtcatttggactgcgaatat

SEQ ID NO: 648533 - DNA, 178 bp, Homo sapiens
cgagctcttacccctaattgcttcttcgatgacggctttgtttcatatatgaaactctgatctttatttaatacggtcaatatatacgcggtgcaatctttcgtcaagcggtaatgtgaaggatttgttaaccgatcgtgatttacttatctaagtgcgtcatcgaagaaccaattag

SEQ ID NO: 648534 - DNA, 734 bp, Homo sapiens
ttccaacagtagttttatagtatgtgatcttgggtttttgctgatgtgctttgttttccttaggacttttgtgggtatgatatccattgtctaagctcatgacgcatgtgaggagatatgctatcagagtgcctcgtctgttcccgcatgtatgctggagttcctgtccgtcttgcttcttcgtgccagttcatggttcatcttgccttatctgctctggtgggtgtctacctatgtccacttgcctagttgtgatatgatcgttattgtatactctgtctgtgtgtgattgttgatcaatcttgtgttccgttccctggactctccagtatggattctggtctttctacgtgttggtggactctaattctctgtaatattcgtttattgtgcttaattttacttgttatttaaatataatgtatatgtatactataattacaaaacatatatacccttctcgcgaggtttcttgctgtgtcgtgttgaaatatgtctccatcatagtggtcattcatcgaacatataatgtccattccgtcatatctcatatatatggatcatgctctcttgaccttctgagtgggcatggatgtgcttctctggtgtgtgtattatgaatcccttctctgccttgtttcatggcatgtgtaatgcctcttggtccccgtccaagtgtatctattactgatttctgaatcatgtttctagttgcttgtcctgccacagggcta

SEQ ID NO: 648535 - DNA, 205 bp, Homo sapiens
agtgcctctagctggctcatctcaacgggcccgggacactgaacagtgtaggtgtggcatgagcccagctgtgcccaatgctgtgctgagtgggccctcaggcagggcaggtttccaatgggagggcccgggaggacggcctggtgtggggtaggggctcagcccagcggcggctgttagggccggggaggggactcccttgagt

SEQ ID NO: 648536 - DNA, 778 bp, Homo sapiens
agctgggctcctgagtctggtggggacgtggagagtctttatatctagctcagggattgtaaacacaccaatcagcaccctgtgtctagctcaaggtttgtgagtgcaccaatcaacactctgtatctagctgctctggtggggccttggagaacttttatgtctagctcagggattgtaaataccccaaccagcaccctgtgtttagctcaaggtttgtgagtgcaccaatcgacactctgtatctagctgctctgatgaggacgtggaggacctttatgtctagctcaaggattgttaatacatcaatcggcactctgtatctagctcaaggtttgtaaatacaccaatcagcaccctctgtttagctcaaggtttgtgagtgcaccaatcgacactgtgtatctagctgctctggtggggccttggtgaacctttatgtctagctcaggcattgtaaataccccaatcagcaccctgtgtttagctcaaggtttgtgacgtgcaccaatcgacactctgtatctagctgctctggtggggccctggagaacctgctgtgtcacaacactctgcaatctaactaatctgatggggcaccctgcagaaccctttgccatctacctccagggatcgtacccgcaccactcagcgccctgacaaaacaggcactcccctcaccatcaccacgagacgtggcgccaaacgcacaccaaaccagtgccagccacatggcactctcggtcctcaccgggacctgcatcgccctccaacttca

SEQ ID NO: 648537 - DNA, 282 bp, Homo sapiens
cctagcatgcataagcacctagggctagacaacaaagaatgagtgttgccatccattgtcaaaagagtactcaagagtgtggtggccaagttcaatgcctcatagctgattacccagtgggcccaggtatccctgttgattcattgggagctgccagagagggccaaggacttcagtcttatcttggatgatgtagccatcacagagctgagctttagctgagagtacacagctactgtagaggccaaacaagtggtccagcaggagcccagcaggcccagt

SEQ ID NO: 648538 - DNA, 245 bp, Homo sapiens
cacgaggggacaaatgacaatgacacaaacgtacgcctattgcctggagactccgtgacctcaaacaaggagctatgagcatcagttactggtgccattccggtatcacgaaactgagagatgcttctgactgctgtggcctcggctgaaccagataccacaaatctggtgtctgggcagtgttgctcagagctgagtgcctcacgttacctgctgttacctgacgatttctatggcagtgccgg

SEQ ID NO: 648539 - DNA, 209 bp, Homo sapiens
acacagtcctggtccctttcaggagctgccaccacggtgacggtgctgcaggaagagatcttggagggagcgcctgtgcagacgggtgtgtccccagtgccagcaggccatcaccaccaagatctcctaggagatttggcttgatagaattccggggctgggttcctccgtgtggggctagccgggggggtaacagaggctcagaatcg

SEQ ID NO: 648540 - DNA, 93 bp, Homo sapiens
gttttgctccaccaaacacttcagatatggaagctggtgtggaaagaggcaaaacctgatgaattaatggattccaaattgagatacgtattt

SEQ ID NO: 648541 - DNA, 584 bp, Homo sapiens
agttcaagaccagcctggccggcgcgacgaagccctgactctgctggaagtacaaaaattggctgggcgtggtggcacacacctgtggtcccagcagtctcgggaggctggggcaggagaattgtcccgagcctgagaggtggaggttgcagtgagctgagatcacaacactgcactcaaaaagtagttcatcaatttagtctacttaagacaaagaatatccgagtgtcaggcaatctgggatagaacccattgtgtgtctacaggatacaatctgctgtgtgctctagcggaacttccggatcaccttcaccgtatgactctagacaatccctgtccactcttcagttctagattgccccattcatagaatgaaagaattgtcctagatgatccttgagggtcttccaggctgatgacaagggggacctggcccctctgctgtgtggccaacagaggactccacttccccattccgggtggtttgaaccaagaaattgggctggggcttccatttcctgccttgtgggcctttccctaccatgtgaccttggcgcccctctttggccttccaggaattccat

SEQ ID NO: 648542 - DNA, 154 bp, Homo sapiens
  misc_feature (53)..(53): n is a, c, g, or t
gaccggatggcgtcattcaaggggcttaccggaaatcaacaagaaccccaagntataagaaactcaaagatgccatggaagaaaagatcaccatggctgaagtcgtgaacaaaattaaccgtgctaagtgggaagagtacatctcaggattttc

SEQ ID NO: 648543 - DNA, 489 bp, Homo sapiens
gggggggccagttttttccacccctgccagccccataagattccggatggcccagttccctcctcggtggtggaggaggtgtttaaacccccggcccccggtgagaaaggagcccctcaaaaacctgaaaaaggtgcctccaacagttcaagcaggagatggacagcctgcagggccaaatggaggagcacgccctacgggtgcaaaagtttttgtccttgtggaagccgttggagccagccaatgccagccctgtgcccccggggggttacgccggcccacggggggacccacaaaaacacagttaaagcagggtttccaaaaaagggccgggaaagtgactgctgtggattcgcctccgggggccgctgccccaaaaggtttttatcaaggttatttatttgattgggtgggcgatgtttttttaaaacatgaaatttaagttttgttttgcctttaacaaaaagtaaaaaaaaaagcagaatgaga

SEQ ID NO: 648544 - DNA, 257 bp, Homo sapiens
ccacgtgtgtatctgggtgtctcgactctcaggaggtgcatctgagtggtcccgcactctgtgcatagatcatggtagtcccacctcttgggaggtgaatgctggtgatctcgtcatctcaggaggtgcatcctgtgtggtcctgtcccccgtggtatagcatcctgggtaatcctcgtcctcttgggagtagcatcccgggtgttcccgtcctccccggcagtagcatcctgggtggcttcccatcctccttaagc

SEQ ID NO: 648545 - DNA, 320 bp, Homo sapiens
tgatgtaacggtgcggtggaaagaggtactgagatggtaaagaaaagttaacttctggcactatgatcgccacttccgtcaggctggtcctgactctctccctcgcgttctgatcgtttcatatcctgtactatctgatcatatctgaattactccaccgcttagcctcttcctatagttcccacttccttaacaaagccctaataaatatttcctctagtctcgcctattactctcctactcttctctaacatctgcagccacactctccattcactccatgctgacaaggcagcggcaaacacttatctctgctgaca

SEQ ID NO: 648546 - DNA, 129 bp, Homo sapiens
aggagatggggacaggtctggagtctaaacacttgtaatttagtatctcgatgtctttgttaagactgctgaataattattttttttcttttataataaggaatataccccacctttattccttcattt

SEQ ID NO: 648547 - DNA, 354 bp, Homo sapiens
  misc_feature (14)..(14): n is a, c, g, or t
  misc_feature (113)..(113): n is a, c, g, or t
  misc_feature (314)..(314): n is a, c, g, or t
ccctgtcccccccncccccggtggtggaaatactcattgattcctaaggaaacaaaattttcctctgtgttctggtgatggttagtgaaaataatttaaacaagatgtacagnataatcaagatggactcataacaaataatagtcagtgacccactacagagaaataagattagggatgtgacaaacacagttcagcatttaccttctaaacttcaacagtagtaaggtaggtaaattcccattacaatgctttcttaaaaccaacttccatcaatgtgtactccagaaaaaaaaaaaatccatctttgaaanaaaaatattgcaaattaagtaacaaatagatcctgctttt

SEQ ID NO: 648548 - DNA, 865 bp, Homo sapiens
  misc_feature (379)..(379): n is a, c, g, or t
cacaatgttccttggggtcgagaaagagaacatgccggcctagatcaaaaaaaaaaaaatggggtgagcgggaacaacagcacgcgtttccctagactgagctgctgattatctggcagagaagttgaatctagatccactaattactcatactctgaatcttgataaaatcaatgaagcagttgaattaatgaaaactggaaaatgtatccgctgtatcctgttactttaagtacaatgtaatacatgccagacccaaaggatatttcaccaactcaatggcatttgatgtttttttcatgatttagaagaattattcacccaatcccatttctatattctgacttctgattcactccgcagaggacctatatctggnttctgacctaaccatttcatcaaaattgctcttacgtaacctagcgtgaccaaggatcagcctacttcccacagctagattaatactggcttgtatcactcacctctccatcctctctacataataggtcaacgccaatacgttgccattatcatgagttcgtctacctgcagaccttaatgtggaatggccccttttacattgtttcgctcgcctgttatctccaatcttgttcattttctcataattaaacgtctcctcctttcttatccttcatttttcagaagtggttcaaattcctcgtccttcatatctaatttcaagaattaatttattcgtattttcccgtctactatctctcccgccagcaacataagtatacaaatcccgcgtccttgttgtatttttctcttttctaccttttctgtttttctttgccccgctgccttcccccgtgtcgtatacactataggtagcgccaacccc

SEQ ID NO: 648549 - DNA, 188 bp, Homo sapiens
aggctgacttgaggatcccctaaatggctgttacctaaatggctgtcatcaataaatttcgcacactgagcattcaccagctcctttcggaagtgtcatattggagcactattcccggaagcggatgcgcttcagcatgccttggcagagcagcaacagcatacagccatttaggtaacagccattgt

SEQ ID NO: 648550 - DNA, 317 bp, Homo sapiens
tatttttgaagtacgtaagagtatttttttagctagattttttttgttaaagccacactaactactgtatttttacctttttatatgtaaagctcggcggtagctctccatgtataatttatttggatttttttataaaacaaagtgcaccctcttgcttctgtttcacagtagtgatgtatgaacggctttgggcactgcactgcgatccttacagaaactgtacacgggaacgagaagtgtgatttgttgtccacaacccgatctcgaaatgtttatgctgtagttgtgtctgaaatacaccacgtctgtgcaaa

SEQ ID NO: 648551 - DNA, 948 bp, Homo sapiens
tctgctgcgctgcgtgccccgtgtgctgggctcctccgtcgccggctcgcgctgcggcccgctcgcctttccggcagctcctgcagccggcaccccgtgtgtgcacccggccttcgggctgctcagcgtgcgcgcaggttccgagcggggcgggctcctgcggctcgggaccctgcgctgtggtgtggtgcggtcgtgcacaccgaggagacaaagcttggttgatttcctgagtgatgaaattagggaggaacagaaaaattcagaagcataaaacctccctaagatgtctggaggttgggagctggaactgaatgggacagaagcgaaattagtgcggaaagttgccggggaaaaaatcagggtcagtttcaacattaacaaagatcccacaacattgtgatggtgaggaggaaccctcgcaagggcagaaggttgaagaacaggagcctgaagtgatatcaatcccaattcgtgggttgaagttataaagaatgatgatggcaagaaggcccttgtgtggacgtgtcattatccagaggatgaggttggacaagaagacgaggtgagagtgacatcttctctatcagggaagttagctttacagtccactgggcggaagtctgaatggaaggatactaattatacactcaacacaagattccttgggactgggcctttatatgaccacctagtgattttccttgccgacccgaggggtggccaccacttttgcagatgaactggtggagctcagcaagccctggagcaccaggcgtaacttacttttttgaagacctcagaagtttggtacgagccagtagagcagacagatgttgaccctagttatggcgggttgggcccgtgaacactctatttgagcgaactggtgttggaaggataccccatatatggggacacacccattttttatacacaaaacagaag

SEQ ID NO: 648552 - DNA, 571 bp, Homo sapiens
atgagccaccaatcacatgcctatcatatagtaaaagccggacccatgacccctagcaggtgccctctcagcccgtcctaagtgacctccgtgccctagaccatgtgcattattaactttccaggtcgcactaagcgctccgtcgataactaggacctactgacgcgaaacaacactaacctattatacctaatgatggcgcggatgtatacacgagcaaagaaccacaattaccaaggccaccagaaaccacctgtccagaaagaggacttcgatacgggataatcctatttattacctcagaaattgggtttctgtccgcagggattgtgtcgagagcctttttacctatctccaggtcctgagtccccctgacccgcgccaaaagttaggaagggcactaggtctcgccccaagacaagggcatacacccacggactaacatcactcgcgtagacagtccacatcgtccgaatcaccaacatgctgtgatcatttcgcattcgatggacgtatcaatcaccctgagtctcaaccatagtctaatagagaacaatcgaaagcatataat

SEQ ID NO: 648553 - DNA, 421 bp, Homo sapiens
  misc_feature (24)..(24): n is a, c, g, or t
  misc_feature (41)..(41): n is a, c, g, or t
  misc_feature (49)..(49): n is a, c, g, or t
  misc_feature (174)..(174): n is a, c, g, or t
  misc_feature (202)..(202): n is a, c, g, or t
  misc_feature (222)..(222): n is a, c, g, or t
cctccccccccggttcacgcccantcctcccgcctcagccntcccccantaccgggacctacaggcgcccgcccactacgccccggcctaattttttgtatttttaagtagagaccggggtttccacccgttttagcccgggatggtcctcgatcctccctgaccctcgtgatnccgccccgcctcggcctccccaaagtgnctgggattacaggcgtattncatgaacttttacatgaatgagtaaggacattgaaagatgcatgagatgatgcatacatctttgtggttgacttatcattgcatgatgcatgacgtacatgttcagagtaatattcttctgcattatagtgagagaaaaatcttgaattttagtaataaattgcttttaccagttgcacatttatgtaataaaatacag

SEQ ID NO: 648554 - DNA, 762 bp, Homo sapiens
  misc_feature (16)..(16): n is a, c, g, or t
  misc_feature (116)..(116): n is a, c, g, or t
  misc_feature (144)..(144): n is a, c, g, or t
  misc_feature (274)..(275): n is a, c, g, or t
  misc_feature (296)..(296): n is a, c, g, or t
  misc_feature (302)..(302): n is a, c, g, or t
  misc_feature (315)..(315): n is a, c, g, or t
  misc_feature (399)..(399): n is a, c, g, or t
  misc_feature (608)..(608): n is a, c, g, or t
  misc_feature (676)..(676): n is a, c, g, or t
  misc_feature (713)..(713): n is a, c, g, or t
tcgggggttgggtgtngggggggaacgccttccaaactgcggtaggtacttatggtgggtatctggtggttcttagttggcacaaatgccctgcctagcccccttaactgcgtccnttcccaggtggggtgttttgttgttggngttgttagtaggcagggttgccttaccctggggggggcagccccgcttgggtgaaagtccgccgtgtttttgattttgtttgtatgtgtgttttaatgcaacaaccagctcccagtttcccagtgggaanntattccgtagcctcatgtacntgtacnatagggaagagcntaacatgaacatcctccatcatggcctccccaaatcagccccccgcccccttaattaattccttccaccaaaagaacttaaacnaggggcttaagcccaccttatggagagcgcatttcacggcgcgcctgaccccttcgcatttggatttgtgttcagcactttaaaaggttcaactttttgcttctacccagattggtctcaggtctgtcttctcatccatccctttctaaagccaaagcacatttgtagcacataatccaggagaagcagaagtaaatgctatgactggnggtatttcttagcctggttttgtagtttttaggcagtaagtagattatgagcgaacaaatgtgaaggntcatgtggagtcataatacctgtgatctaggtatggncggagtcaagctcagagacaacaaagccttctaggtcattaggcaatgg

SEQ ID NO: 648555 - DNA, 105 bp, Homo sapiens
agccggtaccgcgtggcaatgaacacgatgaaattgtacttagactatagaatttacgggtagtcggtacgatcagccaatagcgatgataaaatccaataaagg

SEQ ID NO: 648556 - DNA, 795 bp, Homo sapiens
tgaaatggggcttggcactcaagtcaaagatgaacatcggaataacaaacatgtcctctccagaaagtcctttctttctccatactgtagtcctatgagaagacatttcgtctctgagaaaaaaggatggaactatgggttctcttcgcaaagccaaaggatagtgtttaacaagccagctggcttatgctggttctcagctgtttaaaaaaaaaaaaatggggggagagaccagatggtcctattccccctgttccattcccctcttcttccttctatctccttccccggaaaaaccaaaaaatgggagacaggccaggatgtatgtgctgcttgagaggggttctttacttcaaaatctttcttcagggggcaagacatgactgactaatggctctcccttacttggtacaggttacataaactggaggtgggctgaatttttaaccccgtttttataaactttccattagggtccctaaacccaggacacttttctcacattggactcggtcactttcgacgttggtctcacttcttggaacgctggttcagctggggggagagggaccgggcttcccgggccagccggggttgttaccttggtcacccacttttctctcgtgggtgccacaactggctcactctgtgtttctcccccacgtgcctcacttcgggccaaggatatcaccggtgggaccagacggggcgctcgaaattttccggccaagtttaccgggtgttgaaagatacacccggcgggcggttgctggggccgtggtgtgggccgtggat

SEQ ID NO: 648557 - DNA, 259 bp, Homo sapiens
aggtgactctacgagctctacgtggtgtacgtgagttaaaccagttggtaccggtagtatcactagttcttctggtgtcttctctgatctagtctaggaaatgctgcaaacatggactatttaggtcctaggtatatcctggtgtggaatctaagtctatctagaatacgtgtctttggttgttacttgacctgttagttatgcttctccagtggcagcagtagtggtaactccttgtggaccaaactatattttaggg

SEQ ID NO: 648558 - DNA, 389 bp, Homo sapiens
catggtggcttacacccataatcccagcactttgtgaggctgaggcaggtggatcacttgaggcgaggagttggagaccagcctggccaacatggcaaaaccctgtctaccccgtctctactaaaaatacaaaaagtagccagacatggtggtacaaacctgtagtcccagctactcaggaggctgaggcacgagaatcgcttgaacctgggaggtggagggctactgcactccagcctgggcaagagtgagactcagtctctaaaaaaataaaaataaaaaagctgaggttccagacctgatcctggaggcccagttcaccctgatttaggagaagccaggaatttcccaggaccctgaaggggccatgatggcaacagatctggaac

SEQ ID NO: 648559 - DNA, 189 bp, Homo sapiens
ggtccagagtagtgaggggctcattcttgatgaggtgtctcaacctgcccaacctttccctgccagctgcctcagggcatggctgtaaggagaaaaggctgctgaagttgcaggctgggcacctggctctccgagagccctgagggtggatggtgctcctgagtagccagctgatgttggagcggccgc

SEQ ID NO: 648560 - DNA, 906 bp, Homo sapiens
gctttgatggcagatgcctatgtatgagacgcttgctgaatttctagagccctgcacgttagtaggattccattttccgatcagctgagtgagctgggaggcacactagagagggaagatttctttgcttgtgctctgtgctttatgtctctgtttggacgatgaggtctcagctctgtcagccacagggtggagtgtacgtggctcaggtcctcatcctacactggcaagcgcgtcgtggctgtcgctggggttcaacggtgattcgtccgtgctcgtcagcctgtccgcgagttagctgggatttactagggtgtcgttgctcatcgcacatccgtgggtgtaagttgtgttggtagtgctttatgctaggacgacgaggggtctttgcaccgagtggttagccagggcgtgtgtttctagaacttgcctgacccttcaggtagatactgactcaccattgcgccctccacaaagtgcatgggtatgacagtgcactgatgtgcgcaccgaccatcccgagacgcatgagcggcgacacttttccgaacgtgcatcttcgtgacagggccgtggatggatggctgacacgagcaattaataggagagctggcacgcgagccccgagtagcaccagtgacgcattgaggcgtcccagagggccaccacaagaagagaatggaaagtgacgagcgtgagttgcctcgattgtgttaccagcgcattaggcaagtatagcttttaaggacatcccttggccaggggtatccccagcgggtgttcttcctcaacgagcctcatcttcccccttctgttgcaccaacgggtcgtcccggtaaccgccccggaactataataggggcccaccactattggccgtcaccattgaatcctcggcccggtatg

SEQ ID NO: 648561 - DNA, 431 bp, Homo sapiens
  misc_feature (15)..(15): n is a, c, g, or t
  misc_feature (82)..(82): n is a, c, g, or t
  misc_feature (152)..(153): n is a, c, g, or t
  misc_feature (156)..(156): n is a, c, g, or t
  misc_feature (172)..(172): n is a, c, g, or t
  misc_feature (179)..(179): n is a, c, g, or t
  misc_feature (186)..(186): n is a, c, g, or t
  misc_feature (194)..(195): n is a, c, g, or t
  misc_feature (218)..(219): n is a, c, g, or t
  misc_feature (228)..(228): n is a, c, g, or t
  misc_feature (248)..(248): n is a, c, g, or t
  misc_feature (260)..(260): n is a, c, g, or t
  misc_feature (290)..(292): n is a, c, g, or t
  misc_feature (295)..(295): n is a, c, g, or t
  misc_feature (320)..(320): n is a, c, g, or t
  misc_feature (334)..(334): n is a, c, g, or t
  misc_feature (338)..(339): n is a, c, g, or t
  misc_feature (355)..(355): n is a, c, g, or t
  misc_feature (358)..(358): n is a, c, g, or t
  misc_feature (362)..(362): n is a, c, g, or t
  misc_feature (404)..(404): n is a, c, g, or t
ccttgttttgctgtngcttccttggggtttttggctctctttttctccccggccttctccctctttccttgttgcctctccngcttctccggccccgggggggccccttttcgctcttcctccggtgtcgtggcttcgtggtgggccctggnnttnttttgcccgtgcggcngtgtcgnttttgcntctttgcnncccttctgtgcttcctgggtttnntgtcttgcnctctttgggcgggtttgcgncgtcttgttgcngctgataccttacatggattgtcttacaannntcngtacagatttatactgattgataantgttcacatatttnaganntagtttgttgactggngcnttcngtttcccttgtttgttttcatcttctagtaatacaatatgcntttctcaaatgccctattccgtttttg

SEQ ID NO: 648562 - DNA, 241 bp, Homo sapiens
tattttgagacgatcttgctcctatcatacaagctggagtacagtagcacaatcgtagctcactgcagcctcaaactactgggctcaatcctcctgcctcagcctcctgagaagttagggactacatacaggtgctcgccactgtgcctggctaattttttttttttttttttttttggaaaaattggagtccccgctatgtgttcacagggacgtgctctcaaactcttgcccccagggt

SEQ ID NO: 648563 - DNA, 932 bp, Homo sapiens
gcttcctaggggttcatcgtgtgagcacaccatatatttacggtagtgaatagacgtacgacacacgagcgtatttcacactccggtacgcatgaatcatcgctagtccccaccgggtcaaagtattgtagctgaatcgccaactccacggaagccatatgagaatgatctgctgcagtgctctgagcccgtaggattcatcgtttcgtttttcaccgtaggtggcctgacgtggcatgtattagcaaactcatcactagacatcgtactaacacgacacgtactacgttgtagcccacttccactatgtcctatcaataggagctgtagtttgccatcataggaggcttcattcactgatttcccctatctcaggctacagcctagaccagaccttacgccaaaatccatttcactatccatattcatcggcgtatatctaactttcttcccacagggaggttgctcggcctatccggaatgccccgacgttactcggacctaccccgatgcatacagcacatgaaacatcctatcatctgtaggctcattcatttctctaacagcagtaatattaataatttcatgatggagaagccttcgcttcgaggcgaaaaagtcctaatagtagaagaaccctcataaactggagtgactatatggtgcgccagctacacaattcgagagcggatacataacatccagacggagaggacggatcgacccgcaaaggtggttaagcaacccatggctcatgattttcagaacacaaaaaggggggggaaagatcgcgcggccagaaaggccagtttgagggccaaggggggaaacaagggggacgccgcggacggaagactggggctcgggatgggcaccgggccgaaataggggctcgggtgaaatacgacgcgatgttggccctcttacaagaa

SEQ ID NO: 648564 - DNA, 1125 bp, Homo sapiens
  misc_feature (1124)..(1124): n is a, c, g, or t
cccatgctgtccgtcggacgcgtgggaatgaaaaagagacctcaatcaagaaatgaaagagagacagcatctcaaacaaagaaaacaagagtcaacaaaggatgatcacatgaccgccagaatgtcctgattcacctaaggatgtcctaaccttaccggcccctctgctggatacccctcattggacctgtagccacctgcaccatggagctggacctgccgttccttacctgggagcaattagtgccaacacacctttgctgtattaacatccctccccagacatccatcctgctactcaccctctgttaatctcctgttacactcagcttcttggcatgtacatattcatttgtgagtagtaatgtgctgcgtgtaaacacagtcacattatggtggtcttcagtaatacaagtattatcggattcgtttctgaagatggagtcttactctgtcgcccaggctggacgttgcaagtgggtacgatcttggctcactgcaacctccgcctccatgggttcaaagtaattctcctgcctcagctttccaagtagctgggattacaggcacccatcaccaacccagctaatcttcgtctttttaatagagagggggtttccatgttggccaggctggtcttgaactccctgacctcaggtgatccgcttgcctcagcttcgcaaaagtgcttgagcattcggcttgagctacacgctgggccgtgtgctgtttaacgtgctgcatgtcccccaatattattttttgagaatggagcccgctcatgtagccagggctgaagtgacagagatgagaactaggtcacatggaggcccaggcaccaagaataaacaaatctctgcccaacctcacaaccagagcaatcaaggcgacccacaccacctgagacaatatgggtcttagtacagcggggcggtcacgagtacaaggggactaatgacactgttatcacaaccttcctccaaaagtatgattagtggctcagatcgagcaccactatattacacggtaataagaaagaattcaccactataatccgcactaatacgcatatagtcgaagagcacagtcgttatatcaaccagcagcagtaaaatagattttcnc

SEQ ID NO: 648565 - DNA, 292 bp, Homo sapiens
gcaaaatcgaacatcctcctcatcaagtcaaacagctgcacgtgcgccagggagtattgatgcatgtaactcttcagaggtttgcagctctccttcacaataccgggcctcagctctgtcctcagaccaaactaggcccccttagtaaaaatatttctgcttcctggtacggtggatcatgtgtgatgggatgggccctaggatcttctccatcatcaccaggtgctctcggtattcgtgggtctggaagagtggggagccccggtagtactcaaagaggatgcagccaatg

SEQ ID NO: 648566 - DNA, 724 bp, Homo sapiens
ctcctgatctcaggtgatccacctgctcatcggccgtcccacagtgttggtgattacaggcctgagtccaccgtgcctggcccctaatcgtgtcgtgaagatagagaatgatatagagagaaaatcaaccgtgagtagaagcagcacctgtgtttcgagttctatctagagctacagggatcttcattagatgacgcttctggatagatagcattaaggatggtgggggttaggataatgccattcagacagacaataggggggctcagctcgttaaatagtaagaaagctgaatgaatagaaatacgacagtaacagaaagggcacatgttgtgtggacggctcactcctgtacacactaatattattcgacaagcgccgaaaactttgggcgacctccgtgtgagcgtacctgtctaataaaagggccaaggtagtgcttgggcaactgaattggcaggagcaagcactggtgagtaagacactctagcgggaatacgaacaccagtaaaatgaccacccgtgcgcggaaagcctactccgtccttgctgcaggcgcccattgaggagaattccgggcgggaaaaaccgggaacacacacaccagggggtcctcacacaagaccggaggcatccgaagtgcccccggggcgttgcccgttggcgggctctctcttgcgtacagggaaggacgcctcgcagactcagctgcgcgcagcccaac

SEQ ID NO: 648567 - DNA, 136 bp, Homo sapiens
cagagcgccgcccgtgccctatcctgtgtctgagttgcagaggcaatgcccgggcaccgaggtagaacatgcaacctaacaaggaagtaccgtccagctccgccggaccgacgggtggcccatcaagaagaaactt

SEQ ID NO: 648568 - DNA, 185 bp, Homo sapiens
  misc_feature (41)..(41): n is a, c, g, or t
  misc_feature (136)..(136): n is a, c, g, or t
gagccggaccaacatcgaacggactgatccctggtgtattngccgtgtggcgtcaggcagataaacagaaacctccaggccctcccgcggggggctgagagcagagccgggcctggggggtgctctgcgggccctnccgtggttctgattctgagcacagggatggatcagtccgttcgcatgtt

SEQ ID NO: 648569 - DNA, 183 bp, Homo sapiens
tagaagtcaagaattgatggtttggcaaacattctcctatgatttcatgaggatctgatagagaatgcctgtgttgtccatggcaatgagtttgcgtacagggagtggtgcgctctctatgtgatgaatctgctgactaggctagggtgtggagtggaacatgtgtggatcgagagccccacc

SEQ ID NO: 648570 - DNA, 905 bp, Homo sapiens
gatgactggcttcgctacggcaacccctgggagaaggcccggcccgagttcacgctacctgtgcacttctacggccatgtggagcacaccagccaggtgccaagtgggtggacacacaggtggtactggccatgccctacgatacgcccgtgcctggctatcgcaacaatgttgtcagtgaagcgcatcaacatggcacacctgtgcatcgcggggtcgcacgccgtcaacggcgtggcgcgcatccactccgagatcctcaagaagaccatcttcaaagacttctatgagctggagcctcataagttccagaataagaccaacggcatcacccctcgggctggctggttctgtgtaaccccgggctggcagaggtcattgctgagcgcatcggggaggacttcatctctgacctggaccagctgcgcaaactgctctcctttgtggatgatgaagctttcattcgggatgtggccaaagtgaagcaggaaaacaagttgaagttgctgcctacctagagagggaatacaaagtccacatcaaccccaatcactcttcgacatccaggtgaaagcggattcacgaattttaacgacagtcctccaacagctcatgtcattcaacctgttccaccgcatcaagaggagccaatagttttgtgctcggactgtgttgattgggggaaggttgcgctggtcccacatggcacgatggtcctcaggatcgtccaggcatcgggtgtgtacatgacctgcggggtggcgcccggcttctcgggaccccggttctggcggaaagcgccggggaccttccgatcctgggcgagctccgccgaactattgccggggctcgcgggggcctgtaaaggggacatcttctcggggcctgccactctcttcttcgac

SEQ ID NO: 648571 - DNA, 380 bp, Homo sapiens
gatacgaatcgagctctgtaccttatcgtttttgataatctggtatcctacggaaagtctagtgtcgcaggatcaacattcccttaaactgacagggatggagttctagaatctggcataaagatgaatacgaatgaatgcctccagtatcgtgtatataatcacggtgttctgggtcactacgggcatttagggtttaacatcaaaaacaaagacgggttatttaaaaatcatgctacgggatttcaagctcttcctctatgaccagttctacacggattctgcaagttgtttaaaagttttacattcacccaaatcaaagccaagttttaggggtgtggagatagcgtgtgctttaaaccacaacaataaacaattaa

SEQ ID NO: 648572 - DNA, 561 bp, Homo sapiens
ggcggagcacagagggccagtgtcaccatcataccagggccagaggcgatggtagcatcatgagaccgaacaccctctccttcctttgggggctttgtgtctaccctaagtgaggcatcgatgcgcaagctggaacccagacacttctgacatgcactccagagaaggaccttgcatcaatagcacttgtcccatgcaataataaatgcaacaggatgacaaggaagacaccaaggagaagacagaataggaatacaaccatgaagaagaaggcgaaacatcaagaagatagagacagacacgtagtgtgcaaaactagaagtgacacaaaagatagaacaggatgtgcatatcactatgaaaatgaacatactataagaagatggcgaatgtagacaacagaatatgggaacccagtgagataggaaaatatctaatatacaatttagacgacgaaaagacaagaaatacatgaaaagacaaattcggataaagtacaacccaattaagagaacaaaacaaggagaacacctacaataaagtaaaaattcaagacaaagt

SEQ ID NO: 648573 - DNA, 458 bp, Homo sapiens
gactgattattcgactcgatgtatcgctcgatttccgctatcaccaccgtatcgactacaccgcgcacctgctcggggtaagcccgctgcatcttgggctccaaaccctcgatctggcgcaggatgtctgtctgattcacacggtcaccacgaaaggcaatgggcaacgaaggatcatgatcgggccaaggatgctgttgatcatgccgatcaccggcttgttgggctggtcgtctccatcatctgggccgaagaactcggtttccagcggaccaaccttagcgcgcttgatggccatggacgcgatgtagtccggattcaggctcccaggcttgaccagctcacgcagcgccccctcataggtagcctgctcaatttcgcgcggcacctcgccatcggggatagggtcgccagaccgatctactgcgcctgtacgcggccattgcagggcttgcacc

SEQ ID NO: 648574 - DNA, 238 bp, Homo sapiens
ctgtaccgtctgagcatcagagacgatggataaactgcggctatttcagatgtgcagctttggagaggggcccagccagagacagctgggtttcacggaaacatcaccttcttcccacacaatcccctttccaactccccatcccactgagagccacttccattgcccagtaaaatcctccacatacactacccttcaatctgtttgtgtgacctgattcttcccagctagctcaaga

SEQ ID NO: 648575 - DNA, 308 bp, Homo sapiens
ctctggatcaagtgtctagctttgatgtctgtcccacagtatcctatcatggaaatgttcgtggatatctgctaggtattagccacgtgtagtcaggacggtcgtacctggaagatccctgccgcattagagtcactacactacgtatgtcccatatggagtatcataaacataggatgttctccacctgctacactcccttgatggatatccctttggtaagatagatcctgggaataactcctggacaggtcataaaggctgtggtcaactgaagcatataaggcacgatgagaggtggacagtcg

SEQ ID NO: 648576 - DNA, 471 bp, Homo sapiens
agctcagtcgccttccttccaaaatctgcaacatcaggtccctattctgagcaatgtgtgaagagacagatccacctgcatcatctaatagttcatctgatcaagttgtcctgtccagagatcagagcttcacacatgatgtccccaagtatgtaacatccatgtagcagaatacagactcatcccagcaaatgaaaacatctcatcatacggatcaaatgaaagtagctaaattataaatctctcttgatagctgagatctgtgcgtaatgtgtatcactatctgagcagttcaatcagactgtctgacagacataaatccactctaggaacctgatatctctagatatactactaagcattcgttacatacaagtcagcattctcttacctgggagcatattctgcatattgaccatgcgtagtggataaagcactgttaaccattctcgatcgagtaatttagctaac

SEQ ID NO: 648577 - DNA, 1962 bp, Homo sapiens
  misc_feature (1104)..(1104): n is a, c, g, or t
gggcgagggccgggtgcggggtcccgccccacgttaaccgcctctaggcagcgctggggtccctacatgcacctcggcgtgtaaggccattcgcgaccgcagcgttgctgacggtgggatcgcgcgcgggggcggcacaggttactcggcagccatcgcgcagtgagcgacgatctgtatgaaacgagtgggccgtggcagagagttgctgcctactccaccgcagagacgcgtagctcggtcctcacgatggatagggaacagcgtgaaggccggagagcacgaggattccgcacctctagatggcagcactctgactagtgagtgttaaggatggtcacggtgcgatcgaaggcatggatgccactcacgaggcaacactgtagaacggtggcacggtcgtgtcaagagacgagggtgcatgaggcacacgactgtgtgatggggacagtgacggcacgaggtgcagtccattgcagacggacaacactgctcgaagccctgtgcggactgcgcactaggtgcgcacaggtgtgtgaatgccctcttggggacatggcccgttacaattcagccacgtaattgggcacgcactgtggggggacaacgcaaggggggtggctcacacaggggaacttgcggcaacagaggatcataccgtggacacatttaggggcaatgggcaacaacggtgcacccatcaccaattggaacctattccaagatacgggtgactttcggccaacggccatatcccaattccggctattatgagattaaccattgggcacttggcgaaccttggaaccaccgatcgggtgccagagctgaccaagggaacactggcagacgaacaaaggggtgagcgtcaattggacgcaagagaccgcgcattgccgtggcagatgccaacattggcgccccacattagggtcatgtacactcggccgacatgtgggcccatacatctacacatgggcgttaaacgtccggcttgtacactgccaaaaacggcggtcgtctccacaatacaacgtgcatttgtacacccacaaaaggcgtaccaccgacaagagccacgcgccatctagagaggcatagcanacggtggaccaacgacaacagcgcgcgcgtttacgccacttggcaggaaggatcgtcaacaggcactggccctactagcgggacacacgccaaggggcgaccatacaaatgcgcgccagatagtacccagttcacgccggtcataaggcgcaaaagggtcgtatgctataaccaaaggcaggaagcgccaatgccagacacacatcggcgagagacacagtgcgatcatggggggtccacacgataaagtgcgcggcgacacgacccacacccggtaagcacattcgcggatacaccgtggcgatagcaccaacgtggacacatgagagacgagcacagtagcgtgagagaacctaacccatggaagcgagttgggcacagctttacccccatagagcaagcctccattcacacacagataagcgaaaccaggacggcatcagcaaaacacagaacggacgaccagtgcccagggacgagcctagttagcaatattcacacaagaggagaaaggaagaggagaatggcagaacgatgcggctgcaagagagcatccccaccagaagacaccagggggagacagcccaacagtagacaaccgccgtgacacaggaagcgacaccccagcacagagcggagtccgacagacggccccgggctacccccacacagcggcagatcagacagcagtagaccacgtcgagcaacgccaagactcacaggagggcggcaagcaggagacagcagcaaacactcaggagcaagacaaagcagaagccactaccaagacagcgagacacagacacacaagacaagacgagcgcatacgacaagtgagagggacagccgagaagcact

SEQ ID NO: 648578 - DNA, 103 bp, Homo sapiens
cgtataacagcagtaacatgctgtagatgagggtctcaagcagcagatagtggcagtcggacacacccaccctccccatacaaggatagaagctgctggaatc

SEQ ID NO: 648579 - DNA, 131 bp, Homo sapiens
tgaaataacagcactccgtgatgtttcaggttgactgaatttgggattttttaagttttgccaaaatgtggtttcaatccagcttgatgccatcgtgaattaaagtactagtccttatgtttgcgtaacca

SEQ ID NO: 648580 - DNA, 2479 bp, Homo sapiens
ctgggtcatcggttccctggaaggagaaaaagctgccaattgaacggggcctcccggtcccaggaatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaaaaaaaaaaaaatccttggcggcggttacaacgtcgtgcttgggaaacccttgcgtacccaattaattgcttgaagacatcccctttgccaggtgcggg

SEQ ID NO: 648581 - DNA, 2428 bp, Homo sapiens
ctgggtcatcggttccctggaaggagaaaaagctgccaattgaacggggcctcccggtcccaggaatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaaaaaaaaaaaaatccttggcggcggttacaacgtcgtgcttgggaaacccttgcgtacccaattaattgcttgaagacatcccctttgccaggtgcggg

SEQ ID NO: 648582 - DNA, 1916 bp, Homo sapiens
agcggggcttgcggcctcagcttccggcctgcggaccccagcttccggcggggcggggcgggggcctgggcgcggcgtgtggcccttgcgggcgagcctggcggggttgcgttcctgtccgctagcaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctg

SEQ ID NO: 648583 - DNA, 2373 bp, Homo sapiens
ctgggtcatcggttccctggaaggagaaaaagctgccaattgaacggggcctcccggtcccaggaatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctg

SEQ ID NO: 648584 - DNA, 412 bp, Homo sapiens
  misc_feature (33)..(33): n is a, c, g, or t
aatgataaattgagctctgtacctgtgtgtagnagtactagggatcagttgcatgtggtaagccatttaccatgattgttgtaggttaagaagggcagattattagagaaagttgtgaaacatatgttgcagtgggcagctcatcatagaaggggctacctgcaaggaggcaaggtgctggaggatagtcttatagggtcctgtgtaagggtgttatctgtgaaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaa

SEQ ID NO: 648585 - DNA, 138 bp, Homo sapiens
ttgtccgctcggtacctgtattgtctgacttgaaatacactaagtaatcctgcaatgcatgctggtgtcatgtgacaccagtgcctggaatcacacctctgtccagcaggcacttgtctcagtgtgagtgcagttagt

SEQ ID NO: 648586 - DNA, 2887 bp, Homo sapiens
ctgggtcatcggttccctggaaggagaaaaagctgccaattgaacggggcctcccggtcccaggaatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaaaaaatcacgataactggcaagaagacgtgcttagtgctcaggaagcgaacaagcgtcgggcgaagtgcggacgaagaccgaaggaaggggggagcccgtgaggcggaggggaatgactggtccgaagtgggcgaggaagtagaattcccgacaggagggggcgaggacgtggagggggggggccaggtagtatccataggagggctccgcggttacaacaaagccagactggccgggggagaggccaagcaaagaatggcacccgacatggagggcgggggaaagccgggggcgacaaggggacggcaaaacaaggggcttcaggcgggccaacagcgggaaataaacagccgcgcgcacgaccgcgggaaaatgccgggacaaaagcacgcggaggggaaacaccatggccacgggcgcaaggccccgcggaaaattacaagcctcaacaatagaggaaagaccacgggacagaactatcaggcacgacaataaagactacagcg

SEQ ID NO: 648587 - DNA, 1199 bp, Homo sapiens
  misc_feature (819)..(819): n is a, c, g, or t
agaggggcgttcccctttactatttgtctctcgggggtatcccggggccagaacacccgggtctttgtgggggcccggagggccatttgtacctgcccgggcctttgggggatatcccccgaggagtggtttgttgccccacctggggggccccccccgatgtacacttggcgccgctggacacggtgtgttgacgcgcgggggcgcccctcggtttttcttcggggggggccgggaactttccacgggacccagaccaccaccgcggggtgccctaaccattcggcccccaattcgagggtggagcttgacacccaggctggaccagcccctaggtttgctaccggcgcccgcccctttgtttttctcgccgtcgggttcgcgctcccacggggcttcacagcttgtgccttgagatatgccccccccgggcccaccgcttatgcgctcgaaattggctggtgtcacccctaaacccaccgggctctccgcgtgttttcccacacacgcgccctgtggagaaacttgagatttggagcccctccccacacggggtggccacccacacacgccacagtccacagcccctctctcttataaggagagaaatagggtgtagacccgaaatcacccgcggagaagaaccctcgagtaggggcgcggagatatcattcactttcccacaggtcttggggaaccctctcacaagaaaggaaggggccacaggtggtgaactccacggtgggcctctatatgggggggttatatgatatggggataaggcacagtgcctcttgccacattgtgagaggctcccgnggagagcgtctccaacactcttatatggcataatgtgtgaatggctaaccctataccggcgagaaggcactgagcccacaggagaagagagttgttttcgcacacattctaactgccacacatgctcttcgctttggcccatggaggcgggagtggctccacgtggagaggagagtgaatccccctggcacagcccattgcacgaagttccaggggtatgaagccgccaagtatacttttgggagagagaccccgagatataccccaaatttgcccttgccacacctttacccccccccctgtgatcctgggattttagtatgccataagagatgcccctgtactgatgcccaaattttataaagtttgtccccgagtga

SEQ ID NO: 648588 - DNA, 898 bp, Homo sapiens
gtgcctgggcagactgtgtcacagagctgctatctcaagtgcaggccctgtggccgtcgaaacatcaagtacccccatagcctccagcaccacgtccattgtgctcccggccatctgcagaggcagcagcattgtggtaccgtcacttctggctcatccgtctttgctcagcctcctgcatgccagttctagctcagctttcaaccaggtcaccaacaacacagcactgcccccatctgccacgccgtgttgggcgcaagtggcagcccagcaccgaaccaagtctgtttgggccagcagactggtagcacagccagcaagcagtgccacaccaacaggtcagcaacctcagggtttagcagcccagctttggtaccacagccccagggtcttctggacaagacaacctttcgtggcaggcctcagtcttgtgggcagtcggagaagcagtgctgcaagtgtcttttgcttcagttcagcctgggttcagttccgtgcctgctttcggtcaagcctgttcctccaattcccacatccaccagggcaagtgtctttggggccgctcaagtaccaggagcttccagtccctctcatggggcgacgcctctcccaacaacaggagacggctggtgggccacggaacggccctgcttggggcgagcaggtcggacaaggacgcccgctggtggacccagtgcaccaaagccagcaccttggtccggcttggcaagccacgtaggcagaaacggccgtgtggccacaccgatcgcggaagtgggccaacacctcagaacacggggccacacacagggtcccggcggacaccggcacaacccatcggggggggcaacacacaacaaaggcagtcgggggtcgacaccctgtggcacacctctcg

SEQ ID NO: 648589 - DNA, 2438 bp, Homo sapiens
ctgggtcatcggttccctggaaggagaaaaagctgccaattgaacggggcctcccggtcccaggaatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctgggcaaaaaacaaataaccacagtccaggatacagtcatcacacgacactcaaacacaccaccgcg

SEQ ID NO: 648590 - DNA, 357 bp, Homo sapiens
ctactaattccgttgcccgtcggactgtctgtggcgtgtaccgtgtgtggtgcttagtgtgtagtgtgtggtgtgtgtagtgtgtggtgtgtaccgtgtgtggtgtgtagtgtgtgtggtgtgtagtgtggtgcgtgtgtagtgtggtatgtgtgtagtgtgtgtggcgtgtagtgtgtagtgtggtgtgtgtgtagtgtgtggtgtgtactgtgtagtgtggtgtgtgtgtagtgtgtggtgtgtagtgtgtagtgtcgtatgtgtctagtgtgtggcgtgtagtatgtgtggtgtgtagtgtgtagtgtggtgtgtgtgtggagtgtgtggtgtgtggagtgtgtggagtgtgtg

SEQ ID NO: 648591 - DNA, 2562 bp, Homo sapiens
ctgggtcatcggttccctggaaggagaaaaagctgccaattgaacggggcctcccggtcccaggaatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgtacttaaaatcacccctccagaagaagtggatgaaacagtgctgaagattagggtgggtcgtgcagaaggaagggtttgaaaggggaccaggtaacatgggtgttgcaccagttttctttataacagggaggaaagcgggggcaaaagtaggaggttaaatatcgaagcggacagcgaagaaa

SEQ ID NO: 648592 - DNA, 2237 bp, Homo sapiens
taggtctcaaggcccttccatcatctcccgacccccacaggcgttacccgtttcctgcccgtggctgtctttgccctgccatccctcaagaccatagtggagctgctcctccttcctgtgcccccttaggtgtgggtcttactgagtgcagagggctaacctcttggcgtcctcctgcgagacagctctggatggttctgtgccaggaagggaggcctgcgcatccagacccctgcccaccatgctgcttaaaagtgtcttcaggagagaactgggacctgggctgggccagagcctgtggaaggcactggagctggggctgagttgtgggctggccaagcaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaaaaaaaaaaaaatccttggcggcggttacaacgtcgtgcttgggaaacccttgcgtacccaattaattgcttgaagacatcccctttgccaggtgcggg

SEQ ID NO: 648593 - DNA, 297 bp, Homo sapiens
aattgggtctgggtggttgaggctagcagtgagcatgatcctgtgactacgctcagcccaggggacagagtgagtctagtatctaccgaaaaaaagaaagaaaggccccttcaattctaactcatgacaaataaatactattaactacggctcctgtgtagagttgcctgtgaatatacagaactcccccaggtacaggggaaccactgtatggtctaggaaggcgtcacgcgtgcagaaatttcaagtcttccttattgccaactcagatttcaagcccagctttgaaaatgataa

SEQ ID NO: 648594 - DNA, 368 bp, Homo sapiens
ttttttgagatggagtgtcgctctgtcacccaggctgcagtgcgtggtgctatcttggctcactgcaacctccacctctggggttcaagcaattctcctgcttcagcctcacaagtacctgggattacaagcctgaaccaccacgcgtgctaatttttttgtatttttagtagagacggggtttcaccatgttggtcaggctggtctcgaactcctggcctcaggtgatccacctgcctgggcctcccaaagtgctaggattacaggcatgagccactgcgcccggctctacattttttgctgagtggtaacatattgtagtgggtaaaagaaattgagacaaagaagcgttcttgtcagtttgaagt

SEQ ID NO: 648595 - DNA, 2022 bp, Homo sapiens
agcggggcttgcggcctcagcttccggcctgcggaccccagcttccggcggggcggggcgggggcctgggcgcggcgtgtggcccttgcgggcgagcctggcggggttgcgttcctgtccgctagcaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaaaaaaaaaaaaatccttggcggcggttacaacgtcgtgcttgggaaacccttgcgtacccaattaattgcttgaagacatcccctttgccaggtgcggg

SEQ ID NO: 648596 - DNA, 786 bp, Homo sapiens
atgaccccaatacgcaaaattaaccccctaataaaattaattaactcactcattcatcgatactccccaaccgccatccaagcgatctccgcatgatgaaacttcggttcactccttggcgcctgtctgatcctccaaatcaccagaggactattcctagaccatgacactattcaccagacgcctcaaccgccttttccatcaatcgcccacatcactcgagacgtaaagtatatggctgaagtcatccgcgtagccttcatcgccaatggcgcctcagagtattctttatctgcctcttcctacacatcgggcgaggcctatattcacggatcatatctctactcagaatacctgaaagccatcggctattatcctctctgccttgcaagtatagcaaacatgccgttcatatggctatgtcctcccgtgaggccaaatatcgattctgaggggccacatggtaattgacacaatttactatccgccatcccatacaattgtggacagacctagttcccttgaatctgaggaggctactcagaagacagtcaccacgctcatacgattcttgtacctttcaccttcgtcttgcccttcattgattgcagtcctagcagaactccatccctcctatactgtgcatcgaaacgggatcgaactaatccccctaggaatcaccttcccattccgataaaaatcaccttccaaccttagtacagcaatcaaagaagcccttcgggttattctcttccttctctctttaatgacataaccactattctc

SEQ ID NO: 648597 - DNA, 132 bp, Homo sapiens
  misc_feature (43)..(43): n is a, c, g, or t
actgtctgattctagaggatcccaatgcagcggaatcgtgaanctggagttgcttacctgcccacaggtctgaccacagtgaaggggacggctgggcagagcactgaaggatggggagcaggcaggggcacc

SEQ ID NO: 648598 - DNA, 2392 bp, Homo sapiens
ctgggtcatcggttccctggaaggagaaaaagctgccaattgaacggggcctcccggtcccaggaatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctcggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaaaaaaaaaaaaatccttggcggcggttacaacgtcgtgcttgggaaacccttgcgtacccaattaattgcttgaagacatcccctttgccaggtgcggg

SEQ ID NO: 648599 - DNA, 126 bp, Homo sapiens
attctcctcattgcctgagtgactgtgatcagtcgactacggattgagctctgagtatcagattgacgacgaacatatgtgccatggccattaagtgttacacaaccatactagtatccttcttcc

SEQ ID NO: 648600 - DNA, 252 bp, Homo sapiens
agtgtcgtctctctcctaaaaatacaaaaattagaccgggcattgtagcgggtgcctgtaatctcagattgctccggaggctgaggcaggagaatcgcttgaacccaggaggcagagagtggcagtgaggcacgattgcgccatcgtactccagcctgggcgacagagcaagactccgtctcaaaaagaataggagacacagtgagacgaccatgagacgccagagagaaaacagccatcttgagcctgtgt

SEQ ID NO: 648601 - DNA, 158 bp, Homo sapiens
gctgtgaggcgtatggtgaatagtgcatggctaggaatagtcctgtggtgatattggaggatcaaacaacccccataggaatcacactcccattccgataaaatcaccttccacccttactacacaatccaagacgcccacggattactacgtacaca

SEQ ID NO: 648602 - DNA, 162 bp, Homo sapiens
  misc_feature (38)..(38): n is a, c, g, or t
  misc_feature (66)..(66): n is a, c, g, or t
  misc_feature (137)..(137): n is a, c, g, or t
ctccaatcagactagcatacaggatgaacaaccaagtnattcattccaaggacaggcagcccagtntggtgtttggaatgacgacagtatgttagggcctagtcaaaattttaaagctgagtcaattcaagataatncgcatatggcagagggcacaggttt

SEQ ID NO: 648603 - DNA, 100 bp, Homo sapiens
acccaggcgatacttggtttggtatatattggtgattctgtgtctacatgttatttggaagtatatctgagggaaaaatacatgaaaattttctttatgt

SEQ ID NO: 648604 - DNA, 127 bp, Homo sapiens
acgggagctcactggtcgttggcttccgtgttcccattgcccatgtgtcagtcgtggacctgacctgtcgtttagaaaagcctgcctcttatgatgacctcgggaaggttgtgatgcaggtctcgga

SEQ ID NO: 648605 - DNA, 270 bp, Homo sapiens
tgacctagagtgatcccggctatcacattatcagagcacttggattggacttactcttaaacctctggagttcaagacttttcaaagggctacatacacatctctacatgttaaagggcactgactcctacttcctctgtattagagcaactgtttgaaactcaggctgcctgtaggggcgtgattctccagtcccccagacctcagctttggaagatctttacaaatgcatgggaaatcagcgcagaacacttgacacgggagaattgc

SEQ ID NO: 648606 - DNA, 292 bp, Homo sapiens
gcaaaaagagactgatcatgcaggcatgatcctcatcctccgtcaggacccctgtccaggatggagggtgcaatcctaggtcagctttgttcctcagcacccgtagcatgaggttgtgggatggtggggttggtttccctggtattatgttcaaaggccttgtttcggctacagggggttttccagtgagcaggggtaggaagggtgtgccaggatgtttctctgcacccgtatcttatgtcagacattccatgatccctccaggtcaataataacagtatttccttcgatc

SEQ ID NO: 648607 - DNA, 177 bp, Homo sapiens
ccccttttttttttgaaaaaccaaaattttccggggggggggggcccccccctttgttccccgcttttcggggggttggggggggggattccttttttttcggggggggggggttgcggtggccccggtttttccccccgccttgccccctgggtgcccccgttagcttttttccca

SEQ ID NO: 648608 - DNA, 795 bp, Homo sapiens
gcaatgctgcaacgactctcttaatcctccaccgctacacaatgacgacctaaacgacccaagcaaatccttttttatctcacggggccgcagactctaatgatacaagtgattcagcaactacgaccttatatcttactcatgagagagatggtacgatgcatccatgtcagttggactactttctccaatcctcaagatttcattgactgacctgcgcgttctatattgggcctgcctactaaagaagatgccgcgttgaacccacatatggtgtaagctttaactcgatgaccaaccgtgaagactcacttggccactgagaggggatgtgcccaccgcggggaactgagagaagggttgccctctgtatgcgttaccaaaatgcatgaaatcggacgatgaaacggactacgacacagcagaatggggaactgctgcaaacaaccctgaacagcgaggcagcatagtaactgaattatcgaacaagggtgtaaaattttatggggctccaccaacacaagaagaccgggacttaccgacctccctatatagatcgtgcatgggaaatatccaatgccggggggaaaaggaaatacaggctaagacccgggctattaaatagacaaggggggcgccctggtactaggacatagtgcacatgcgatttaaaaaagcgcgggggcttacggggtttcccttagacagggggactccaaactacaatcactatgaaacccgaggggaactacgtcccaaagcaatttactgaggctgggtgcttttaggaccaca

SEQ ID NO: 648609 - DNA, 2281 bp, Homo sapiens
tgttatagttaggagtgatgtggattggatgttcgtagtgttgttgtcgtatgtgtgtttattggttatcggtgggattggatgtaggtgttgagttagtggttgaatggttgatgatggttggagtgtgatcgggtggtgagtgcatggtcggggtgtgagggtgtgtgacagttgtggtgtgctatgtggtgtggggtctgacattatgatcgtgtggtgaaaatacctacttagttgtggggacacattgaagttatcgtgggatggatcttcactatgtggtgtgtcgactaatgaaaggtgggtgtgtgtgtgttttgattcggccatcggtattagatgatagttcgttggatgttaattgtgtgtggacatgacagtgtgggggtgatactaatgtttgttatgatttagtggtgagtgatggctagcttatgtttgcttcagaagtggagggaggatttgggtgtgtgttcagtggtgtggtggtgtcttttgtaagtcagtaggtggatgatttgtagtaggaggggttgttgacgtgtaattgagtaggagtagaatgttggttggttggtatgagttgaggtgagagtgaagtctatgttggtgggagagtgagtgtgggagtggcttgaggtagtgtgtagtaataatacacttagtagagtgtgctggaggtgtaggtatggttgttgtgtggttgttgtcaacaaaccacgctggatctcgacactcgatagagtgtttgtgcttgagttggtagtgagtaatgaggctactgcggctcagtgagtgcttttgcgtagtgagacctatggtaggtctatgcgagtgttgtgagtgtttcgtcctaacttaaagtagtgttgtgttttgtggccggtcttggtctttcacactcaaatggtgagactcggaatcctggttgaggagcacggactgtgttagtctagttgccatgtgatgtgttagaggttgtgtgttgcggccgcaccatcacaactagaagggggggtggtggttagtgtggtgtaggtcagactaacttgagggtaacttctaagcaggaatgaagcgatgggtgtgtgttgttgtatgtgggggtagtgatcgagaacaagttgagtgctttctatgtggagtaggagagtagattttctatttatgtgtgtgatattgacgagtgtgagaggttagtacgatagtctctgtttagtagtggtggtgtggtttttgataggagtgggtgttgtgagtcatctaatagaggaggagaagagaggtgtggggggcgctacaacccatcagcttgctccgtgactcagaagaggcgttggtttgtgagtgggtgttgttatgtgaggcgagataaaattatcttccgcgtcgtggtgagattagcaacaacgtctgtggtgggtgttatatgtatatcatcactcagacgctaggtaggtggtggtggtggatgagtgagatatgctaccccgtccgtagggaggtgatgcacactacatcgctcggcggaggtattagaaacacatctcgtctgctttgattatttagagatcgtagtctctgggtttgcgatcactgctctttgtgtgtgcgcacaacacactatggtgtggtggtgtctccacacaacacacagaggaggtgtgtgttgtgtggacgcgctacacacacagagggggagatgatactcgacttcttgtggtctcactctgtgtggacgcctcccctctgtgtgagagagagatagtgtgcgcacctactcaagtgagagctccactctcccgctctcgtgcccaccttcggagtgagctctctctgttggtggtgacaactcacacaacaatgagagtagagagatatatcttcgctcactcacactcacaccacattcttctgtctcgggaccaatagaagagagtgtggtgggtaacactcaaaatcacacactcactcaccaccctagatcgcacacacactcaccactcgctctccacacctcacgcgatcatacacacgaggtgtgttttcttgtggcgccccggagtgtgtgttgtgagagagtgtgtgtggagacgagttgtgtgtgtgtgtgttgatagagacaccactttgtagagtgtaaaagtgtgtgtgaaactaaaacccacacaaataaatataataatatataaataaataaaattaaataaaaagatataaaataaaacgtcgaaggctagtcatattcgagggtcgagaaagagtattagtaccataa

SEQ ID NO: 648610 - DNA, 192 bp, Homo sapiens
acaggatttccgagctcacagtcagcctgacgagccattctggtgggctgacaccactcaactgtttctcagggaacaccctcagtcctctataatcagaataggtttacgtgtctggacacgttgcactcagtttatcctcatgggcgtcatcgccatcttctgtgggattccttcggttggcatggctgt

SEQ ID NO: 648611 - DNA, 379 bp, Homo sapiens
  misc_feature (41)..(41): n is a, c, g, or t
  misc_feature (128)..(128): n is a, c, g, or t
  misc_feature (374)..(374): n is a, c, g, or t
attttttaaaatgttttttgttagagacagggtctcactanctttccccaagctgttctcaaactcgtggcctccaaatgatcctctcaccttggcctcccaaagtgttgggattacagtggtatganccaccacatccagctacaggaagattttgtaacagatggcagtgtcttaggcaggaggcaccttcacctgtttgctccaaggaacccctatccagtggcagcctgctcctctccaactcttgtcttctatcctcctccctcctcttctgccccatttttcttcccttgaacccagccttgtcttttttctatttttttgagacagagtttcactgtgttgcccaggctggagtgagaccctatctntataa

SEQ ID NO: 648612 - DNA, 234 bp, Homo sapiens
taggctgttctgtcgggtcttcgctcacttattctttgcaactttctcccttatgtcccaatttatcacaaattcccttccaaataaaaagccatggccaggtgtggtggctcacacctacaatcccaacacttagggaggctgaggtcagaaaatgtcttgaggccaggagttccagacaagcctggtgcacaacagtgtgaacccatctctaccaaaaaaaatacacgggcc

SEQ ID NO: 648613 - DNA, 329 bp, Homo sapiens
tattacagcgccctgccctgacaatatgcactgtacattccacaagcattgccttcttattttacttcttttagctgtttaactttgtaagatgcaaaagagggttggaatccaggttttaaatggatggtgtgtggccctttcacactctcaagagactctcatgtgacaagcgaaggccgcgcctgcctttcccatctgtctatctatctggctggcagggaaggacaagaacttgcatgttggtgaaggaagaacgtggggtggaagaagtggggtgggacgacagtgaaatctagagtaaaaccaagctggcccaaggtgtcctg

SEQ ID NO: 648614 - DNA, 1104 bp, Homo sapiens
ggggctggacgcggcggacgtgggtgagtggcgcggccgtaagatgatgcgtggacgcggggtgcccggcgcgtggtgggggtccccgtgcgccgtgctccccacggcacccaagaagtgcctggccagggtaccctcctgcggagcccggtgggtggcggggcgcggatgccggcggccgcgatggtgcccggtgaccctccagctggcctggagcgtgcgtccgtccccgtcggccgctgtcccttggtgggcgcggcttgagctaccgccagtgggccacttcctcaatcgacgctgtgcgctgtccagtgtggttcaccgtacctgctgctcctaccttgcatctcgtgtgcgcgcctacagctcccgcggcgcggggctgctgctgctgcatggtgccaggtggaccgtacgggcatgttgcacaccgctcgtgggctacggaggcctgaccgcgcctgccagctgcttgtgcccgcatacggcccggcgcaaaggcctggcgaccttgtgtcggcgaccggtcattgcggtccctgctgtccattccccttcatcttcaggccccgtgcctgggcttgtgggagcgagcacggcccgagttgggcttgccctccttcttagcttactgggccgttcatctgtgatcttccaagtcatggctgggcctccagcacagatcctcccacttcaggcctcattccgcggagactcgtaaccaaaggaccaatggagcaaggtggagcttcaccgggactcaacggtattgcggtacacccggatggtgggccaagaatcaaccggcgtacgggcgccgccttgattcctggtgcacgctgagaaggggtcaggatcgaaggagctggaagcccaaccacgaagagcattcaaggccgctactgtagacaaaggattgagggcggcactaggagaagttccgccggtggttccccggaagacctgtatccgtagtcatagaaagtaggtggctacagagccggcggtccgcacctgggtatatacccccttgtgggaaccccaggggaaagtggcgccagagacacgaatatgcggaggacgccacggggcgacacacacccg

SEQ ID NO: 648615 - DNA, 234 bp, Homo sapiens
atcgaggattcggaatgtgtggtgtatgtatgttaactttctttatattaataaaacctctaattgacttgtcaaataaaattttcattaggcttatcaattaattctttaattgggcttaccagttaaccatttaattgggctttcaactaaaccaatccaaacatagatttagttaggcttatcaattacccaacctaatacttttgtgtacgaccataacaccacacaatt

SEQ ID NO: 648616 - DNA, 346 bp, Homo sapiens
ctccgtgtgttgggctgggaaacagacctggtcataaccggtgagttcacacaaatccttctcaagctctcggaaaagctgctgatatccttgagcttgatccagaggcacaagggggtggatgttggcaaatcctttccatgtgataggtgcgagttcagaggaacgtgtcaggtgtcagtggtgcaggagtcccagtggaatcatgctgtgaacaagggaaatgtctttattttccagttttcttcatgtaccggacaagggtggtttcagagtggtagctgttgaacactgtgatgggagaggagggcagaggtatgccagggtctggtgtcaagagaagggt

SEQ ID NO: 648617 - DNA, 1084 bp, Homo sapiens
ggttcctcatatgccccagtctgggaagatgtctaaatgtcgacatcccaatgggataagggagctcggggttggacagaacagtgaccttgggaggaaggggctaatccgcccacgtcagggaaagatgtgagcaaagcgggtcaatgggtcgggagggtgaaaagggaaccccttcccccatttacttctccacctcccgtcctccccatcattggttttttttgtgtgtcaactgtgccgtttttattttattccttttattttcccccttttcacagagaaataaaggtctagaagctaaaacaaaaaaaaaaaaaaaaaaaaaaaaaaaaaaaacaacaaaaacacacaaaaacacaaaaaaacaacaacacacacaccacaacacaacaaaaacaaaacaccaaacaaaaacacacacacaaaaacacaacacaacaaacaagagagagaagaagagagagagagagagagggaggcgaggagggcgaagtgggggagcagtagagagaggcggcgcacgcaaacgaatcggccacaagaatacacttaagcatgagcgacagacggagcgggcgcgagacaccacgaggccgcgcgcaccacactactcgtaagacgggggaggagacgcgcggacaaagaagacggaggaatcaagcaaggaagcgcgggaggaggcggctgagaggaagaacggaagcaagggaggcgggggcgagaagcgacgacactgcagagggacgccgatggggcggggaacaggatactcaaagaatgaagggattacgacacaaggtcgacggaaggcaagagagacaggagtgaaggtagacgtgggaaggagtaggagagggggaggcgcgttgctcattaagcaagaagaaggagggggattgccagaggtgagcgccgctgacccgcaggcagagcgaggagcgagaacagagcaactgagcataaagggcacccgcatcagagaagatcacaacaatgtgctcgagggacgcccaggcacggcagaccagtccagcaggacaaagccaataaaacgaacaacgcgcacacccaccatcactaa

SEQ ID NO: 648618 - DNA, 554 bp, Homo sapiens
  misc_feature (24)..(24): n is a, c, g, or t
  misc_feature (31)..(31): n is a, c, g, or t
  misc_feature (44)..(45): n is a, c, g, or t
  misc_feature (53)..(54): n is a, c, g, or t
aggctgtcggtcgaattctgggantttgttngcgcaacctccgnntggttgcnntggctgccgctgttcaggcggcgggaacgggcggggggagcgggcggagctggccaccatgtccccatcgtgcctcccttggccggcgcgcagtcggcgcgggcgcgccgcgcgcactgccctgagcgcttgctgaggcgagggagacgtcgggcctgcacctggagggagcctgcggctggccccgaggagggggcgttgccatggcgacagctctcccgtgctgacggtggggctggggggccggggggccctgggaaggagggcctggtctcctggccccccgcctccccttactctcccctggacttggatgggccgagttgggggcaacaccccggcattggggctttccagctctcacagaaccttcagcatccccagctgccggtcttggcatcttcgaagtaaggagagttttagatgcttctggatgttcaatgctagcacctttacaagactggagcagctcgattttcttcgtatttacttttcaagaa

SEQ ID NO: 648619 - DNA, 125 bp, Homo sapiens
ggcacatagtattttctgtataggtcccatgatacttatgaagtccggtaggcatggcagcattgagggatggcagacatggtgcagtgtctcatggaggtttacgctcataggtggagaagaac

SEQ ID NO: 648620 - DNA, 115 bp, Homo sapiens
gggagtggagagagaaaggacggggaaagagagaacatgaagggaggactggtcgaagggccagtggagcaggtgtctgggagggacaggccatgaacttgcaagggggctgagg

SEQ ID NO: 648621 - DNA, 104 bp, Homo sapiens
agatcggcgactatgcgttgctcagtctggaggctcggcgtgtgcagtatggcgttcggcgtgtgcagtttggatgttcggcgtgtgcaacgccgatcttcacg

SEQ ID NO: 648622 - DNA, 133 bp, Homo sapiens
ggtcatcaacctatagttccccacattagttattagcagactcattgtggacgagtgaatttcacaagacagctacaatagtcgagaagaaatcgagggcagaggcccacatgtttacttcgttgtgacgcat

SEQ ID NO: 648623 - DNA, 468 bp, Homo sapiens
ttaatgtagctaggggtttgttatttttgtttttatttccaaaaatacaactctagctttgttgatttttatattgttttttattttaaagttattttatttatattctaatctttattatttacttcattatgctaactttgggcttagttagttcttctttttctaactgtttatttgtaaagttaggttgttcaattgagatctttcttattttttaatgtaggtgtttatcactataacatttccctcttagcactttttttgctgcatcctgtaagttttgttgagttgtatgttcatttttgtttgtctcaagatacttttaaaattcccttttgatttctccttttacccaatggtttgtcaagagtgtgtgggttagttctgcatttttggaaatgtttctgtcttctttgttatcgattcctaattttattccattgtggtctgagaagatactttgct

SEQ ID NO: 648624 - DNA, 1326 bp, Homo sapiens
gcatactgcgcacagcacacgcacccggggggcaaaattacacggtttttattaagacgccgcggccgtctcccagacgacccagggtgaaacacccacagcccggctgtgggacacaagcttgtggaaaatcccagcgggggcaaagatctccccggtggacaacccccagcaaggttgtttcccccacgagtagggaggtctcacctgtgtggcacaactttgaagcggccccatgggagtaataaacctccacaaagtgtgtgcttgcagccctggtggggacacaaagagagttatccggggggaaaaaaagggagggacacccacgaggattgtaccctgaactccccgtgaaagtggacacagagggcccccggttttgggcgcccaagggagaagcaccacgttggaaaacacctaaatggggctcccccagggagaaaccttgaaagaaacgtcaacacaaaaaccttggaaagaatttgaggaaaccccacgaagggggaaacaaaaagggggtccaatatcccacaaggaattttcacctctgggacatgtcctcgataggccctcgtgccacaaacaatggagaaaacgccaacactctgtgtttgaaaaagatttgagggaaaacttttctcaaaaggggcccacagagttttaacccgaaatgagaggaccccacaccacgagaagaattttctgggacaacaacagtgggtataatgagaaaatttatttacaaatctggggctctgaaatataagaaaattcacgagcctcttctgtaagaaaggagaagaaaatctgtgagaacacattccaccacagagaaagaagtcttggaggagaaagtttggcacaccccactgtcacttcacccacacgctcgtgaaccacgagttgccacggaaggcataagccacggagaggaatatgctctgggggatatttcctctggtgtggtggagagctccttcccttctcgggtggtggctttcctccacgggcccacccacttgaaagagaggttgagttaaagccacaccccaagggtaagaatgtaagcacattttgtgccaccaccacatttataaaacactttgaaaggagcctaaaatttcgtagcacaaatttctcgtggcacagttttataaaaagttaaagctgctaataagtaaagttatctgggcacattttcacaataacttgaataatggaaacaataatgccccggggaaggaaataacattgcactttataaaccctgtattgtaagatgggaaaagccaagttttaaataaaactatttaaaattggcca

SEQ ID NO: 648625 - DNA, 172 bp, Homo sapiens
  misc_feature (53)..(53): n is a, c, g, or t
  misc_feature (98)..(98): n is a, c, g, or t
  misc_feature (131)..(131): n is a, c, g, or t
  misc_feature (157)..(157): n is a, c, g, or t
taattgtgggtataagatggtttcaagttgactggcttcatttttggaaaganttcaggggccagggctcaacccaaacactcctggactggtgtganttaatgctaagaaggctggtactgggccccaantctatcctggctccctggagggtaangaacctgttgacttg

SEQ ID NO: 648626 - DNA, 275 bp, Homo sapiens
acagaaaaccttatgacataaccaagaggagtatgcgagattctacaagagcctcactaattggctgggaagaacacttggcagtcaagcacttttctgtagaaggtcagttggaattcagggcattgctattattcctcgcgggctccctttgacctttttgggaacaagaaggaaaagaacaacattaaactctatgttcgccgggtgttcatcatggacagctgtgatgagttgataccagagtatctcaattttatccgtggtgtattccg

SEQ ID NO: 648627 - DNA, 401 bp, Homo sapiens
tccacaatttttttttgttcccaaactgtaatgtacaaggatatgtggtagataagtgcttgtgagactttgaagctaaacttaatttctttttgttgtttactactttttcccaagagggaacaaaaaacgttgggcttttgtgcgggaaattaatttgttttattaagggaaatttagaacttgttttaagaaaagcccaattttaacaaccttcttcctaaacgggggcaaactttaacaatgttttgggaaacttaaacttttttgggccctcttcccaaaaaattttccttttgggaaagcccccaaacccaaaactttttctttcataacggggggctttaccacacaacatttaacctgtgtcaaggaaatcttggcaaacaggagaacttgtg

SEQ ID NO: 648628 - DNA, 358 bp, Homo sapiens
ggtcgactactactactaaattcgcggccgcgtcgacgggtctcactttgtcacccagggtggagtgcagtggcacaaacacggctcactgcagcctctaccgcctgggctcaagtgatcttcctgccccagacccccaagagctgggacgacaggtgcactccaccacgccgggctaatttttgtatttttttgtagagatggggtctcgccatgttgcccaggctggtcttgacctcctgggctcaagtgatcctccagcctcagcctcccaaagtgctggaattacaggcgtgagccaccgtgctgggtccaaaatgctgcctgttttgaaaaggttcaccaatagtgggtcgac

SEQ ID NO: 648629 - DNA, 434 bp, Homo sapiens
  misc_feature (73)..(73): n is a, c, g, or t
  misc_feature (203)..(203): n is a, c, g, or t
  misc_feature (381)..(381): n is a, c, g, or t
  misc_feature (397)..(397): n is a, c, g, or t
  misc_feature (416)..(416): n is a, c, g, or t
tgaaagcagcacgatcggttcggtcgttccgcgctgccttgaggttgaagtgttcccccgatgacaggcgtgnaccctgagccgaagcttgcaagggctccggccgtgacgcgggactgatactcctttgaggcacactttgaagtatgtgtcacactcgtcgcgggtgcaatttgcggtcttccggggttccgggcgccgcngcagaagttcccgttctgcagcttccccgttcacgttctgcatggacaggatctccaactcgaactgacccgaggccccacacaccttggctcgcaggcacagagcaggcgagcaggagcttaggggcgccggaccggccgcgcgtccgtggggaacgcaatgctgcgcgcgccgcgngcactcgggacgccgncgctctgttcgcgctggtntgcgccggtgctgccgtc

SEQ ID NO: 648630 - DNA, 583 bp, Homo sapiens
tatagtaaaacgattggtacttcgtatcctgactgtcagaatactacgacagcactattcttgtcagaccgacagaagcaacaaaaggtattcttgtacggccggtgggtatcgacgacatgcttgagtacacatcataaactctgcacattcattctcaaaaacccagcttagaatagtgacagtggtacaggaaagacagaactagaaaagaaaaacagaaagggcaaatacaaggaaaatggctccgtatccagcagtgagacaccaccaacaccagcaccacctgatgaaattaatcctcctccacatacaatgaaagaagaggaggatgataactggggagaagatacaactgaggaagctcaaaggcgtcgaatggataaaatcagtgaccatgcaaaagttctgacactcagtgatgatttggaaagaacaattaaggagagggtccatatcctctttgattttgttacgaaaaagaaagaagagggtgtactagattcatctgacacagaaatcgttgctgaagcagaaagactggatgataaaaccatgggcccttctggtcctaactgaagtt

SEQ ID NO: 648631 - DNA, 182 bp, Homo sapiens
  misc_feature (32)..(32): n is a, c, g, or t
  misc_feature (53)..(53): n is a, c, g, or t
ttaagggaaaatgaaacctaaagcatctagtncttctcataatctaacaaagnaaaagtctctcaggtttaaatctttacatcactacagatggcaaaaaactacagcatctcagttacaagtttcaagtcttaaaaaaaaacgaacaaaaaaaactttcctccaggaaagcccatgagatc

SEQ ID NO: 648632 - DNA, 314 bp, Homo sapiens
ggatatgacagggggtggcatgttactacttctccctggtgagtgtgggccgtcccgtccatgaggcgtggaccggtccctggacttctacgagcggtcgagcatgaccttctggctgctggtgcgggacactccgggggagaatgtggaacccaggcacactgccatcggcagactagtgctgaacgtggtgcccgccgacctgcggcccccgtggttcctgccctgcaccttctcagatggctacgtctgcattcaagctcagtaccacggggctgtccccacggggcacatactgccatctcccctcgtcc

SEQ ID NO: 648633 - DNA, 529 bp, Homo sapiens
tcccctttttgggtttttttttttcctttgaatgggttgaaaacccctttggggggggggtgggggtttggggaaaaggccctgtgggggatggccaagggggctatgagttgtggtgggcagaaattaaagtttttgtggtgggttgggggaacccctctttaggcgtttgatgtggtgctcccgtggtgtgagaagcgccgaccaaataacgcgtgtgtttttttaaaaaaaaaaaaaaaataaaaaaaaaaacaaaaaaaaaaaaacaccaaacaacgacaacacatgaaccaccaacaaagaaacaaaacaaaaagaggggggggggggggccgaaaaaaaataaatatccaccagggagggggagagcaaccattggggaggaggcccagaagcagtcgggtgatgagaagagacggggcgggctcacctaaagggaggaggataaataaacaaagaagagcgacgaggacggggccgtacactaaagaggagggcggggggcgacagaagcacggacagacat

SEQ ID NO: 648634 - DNA, 137 bp, Homo sapiens
cctggctgagttcctgcgggatgcccggtcggttaagctcctgaacatggggagccctgtgtgtaggatgtcacagacacactcaaacgcttctttcgtgagctcgatgaccctgtgacctctggatggaacccacg

SEQ ID NO: 648635 - DNA, 286 bp, Homo sapiens
cgccggtccagccacccccccaggtctgaggttctgtcatgccctctgtgattagagcacatgccatcattagcttcggcttagctgtgcttacagcacgaggatctggcccagaagaggattccagccctggtggcgatagctcaaagtgtgtgcggacctggctgtccgggaagaacgtccatcattgtgatgtgcgatctctgcatatcggtacagcatcatgggtggccgcgtatgttcccaatgagctcgcgaatgtgtttgaaggacttcgacccatttc

SEQ ID NO: 648636 - DNA, 374 bp, Homo sapiens
acacggtttgtggtgggaggacctagaatttatggtcgtggatgtctgagctagtaagatggtgttgggaagttgggtggtctagtaaccttttttgtacgaacacttagagacgacagtcacttcctgcaggctgtaatctcaagccttgacgaacccaaaccaacattgactgaaggcacctataactcaagttatagccacagaaagggctttgcttgtatccacctcaattccaaataccttggttgcacaaggagaccacaaggactatttgaagacaccatccattccctgaaaatcctttaggttgattttggggtctttcataggttgtaggtcacctagcctaagctgactgcctcccaccacag

SEQ ID NO: 648637 - DNA, 327 bp, Homo sapiens
  misc_feature (6)..(6): n is a, c, g, or t
  misc_feature (24)..(24): n is a, c, g, or t
  misc_feature (239)..(239): n is a, c, g, or t
cgggcncgaagtgctgcgcggttntatcgaccgctctggccgcgtgctgcaactgatcgaaggcttcgtgccggatgccgcctggctcgatgacgtcgagaccttgacctatctgcattcctgcatctcgaccaaacggcaccgggtgcgcctccctgagattccgatgcacctcgacgcgttgctggttgatgagccgctggctggaggacttgagccccgattgggcgcgcagcacntgcgcaccttgagcgtggtcggatttccgacagcgacatttcccggcgtgctggatgagctgaatcaactcgcgtttccgtatcgctg

SEQ ID NO: 648638 - DNA, 218 bp, Homo sapiens
ggccccttcttgcttccctatctatcgtctgatttctgcagtctcctcgcacacctttgtcatagcagtagagcacaaaggatatgtctctgttcccggtgaccacattcaggacaaacgtctatgttgttataataactttcttaggattgtcaggctacatgaggtcatcatacaccatccagttccacctcactttaacaggaagacttaacttt

SEQ ID NO: 648639 - DNA, 511 bp, Homo sapiens
  misc_feature (461)..(461): n is a, c, g, or t
ctacaaacagttacagtgaactctatagattctgctggtatacagctacatccaggagagaatgctgacagtcctgcagatattaggatcaaggaagaagaacctgatcctgaagagtggcagctcagtggtgattctaccttgaataccaatgacctaacacacttaagagtacaggtggtagatgaagaaggggaccaacaacatccaggaaggaaaaagacttcggagggtagcttgcacctgtcccaactgtaaagaaggtggtggaagaggtaccaatcttgggaaaaagaagcaacacatttgtcatataccaggatgtggtaaagtctatgggaagacctcacatctgagagctcatctgcgttggcattctggagaacggccctttggttggtaactggatgtactgtggtaaaagatttactcgaagtgatgaattacagaggcacagaagnacacatacagggtgagaagaaatttgtttgtccagaatgttcaaacgctt

SEQ ID NO: 648640 - DNA, 676 bp, Homo sapiens
ggccaacaattagaaataagagcaagagccaccgcgcccggctctgctcttatttctaatgtgtggccacactttcagagcaagagccgggcgcggtggctcacgcctgtaatcccagcactttgggaggccgaggcgggcggatcacgaggtcaggagatcgagaccatcctggctaacacggtgaaaccccgtctctactaaaaaaatacaaaaaattagccgggcgtggtggtgggcgcctgtagtcccagctactcgggaggctgaggcaggagaatggcatgaacccaagaggcggagcttgcagtgagccgggatagcgccactgcagtccagcttgggcgaaagagtgagactccgtctcaaaaaaaaaaaaaaaaaaaaaaaaaaaaggagaaaaaaaaagggcgggggcggggggagccacacgccttggtaagcccacaggcacctttgggagaggcgccgaaggcgggggggagaccccagagggcgccagggaagattccagagaaccaagccggggggggaaaaccgggggggagaacccccggtgcgtgtatagtagaaaagattcgaaaagaattattaggccggggcgggtaagtggggggaggcccattggtgaggccccagagtactttgggaacgggcatggagcggagcaagacgg

SEQ ID NO: 648641 - DNA, 211 bp, Homo sapiens
ctcgatagatgtatagggacagtgggaatatcgtccatccatacatgcgcgtaaactaattagatagacgaggaatatggctaccttaagagagtcatagttactcccgccgtatacccgcgctacattgaatttcttcactattgacattcagagcacttgggcagaaatacacatacgcgtcaacacccgccgcgagactatcgagatg

SEQ ID NO: 648642 - DNA, 430 bp, Homo sapiens
  misc_feature (15)..(15): n is a, c, g, or t
  misc_feature (56)..(56): n is a, c, g, or t
  misc_feature (129)..(129): n is a, c, g, or t
  misc_feature (196)..(196): n is a, c, g, or t
  misc_feature (221)..(221): n is a, c, g, or t
  misc_feature (295)..(295): n is a, c, g, or t
  misc_feature (376)..(376): n is a, c, g, or t
  misc_feature (427)..(427): n is a, c, g, or t
gaatgtggtccaagngccctgaactcccttaaatctgtcgttcgctgggctgaaanaggtgcctaaaggactgccagccaagctcagagtgctcgatctcagctgcaacagactgaacaggcgcccgancctgacgagctgcccgaggtggataacctgacactggacgggaatcccttcctggtccctggaactncctcccccacgagggctcaatgaantccggcgtggtcccagcctgtgcacgttcgacctgtcggtgggggtgtcggaaccctggtgctcctccaagggnccgggtttgcctaagatccaagacagaataatgaatgactcaaactccttggcttcaggggagcccgtcaggacgttgagncttttcgaccaattcaaccctttgccccacctttattaaaatcttaaacgngcg

SEQ ID NO: 648643 - DNA, 1411 bp, Homo sapiens
  misc_feature (320)..(320): n is a, c, g, or t
taggaaatggagtcgggctcggtcgcccagggcgggagtgcaggggcgccatctcagctcacggcaagctcggcctcccgggtttcacgccattggccatttctctccgcggccctcgagcctctcccaagtatagcgtggggcatacggggcgcccgccaccagcgcccaggtataattttcgcgtggtatttttttatagtatagagaacgggggtttcaccagtgtgtgggccgagggcgtggtgttctcgaaacctcgctgtgagaccctcagagtgtgtacatcgcgcgcacacacgatgaggtgccctcccaanagaggtggggtggggaatttcacgagtgggtgtgagagtctcagcgtggcgcccggcgggccccgaggggacacaatatttatagtgagagaacacaaagagagaaccagagcggcgagtggcgcgtgaactctctctcgcgagtgtgtatcacgagcgcgtggagagaacagagagcggcgaaagaggggtgtgtgtgggggtgtggtcacaaagcgcgaggctctcgaggggggcgagagcgtggggtgcgcgtggcggggcgagtggccagtgtgtgcgcgagaccgcgagagagagcgccggtgtgggcactctgcggggtgctcatcacccgagagagtgggcctctacaggaggggacaagaggggcccagaaacaccctgtggcgcactgtggcgcagagcgtcacacagacgactcaccacctgtgggtgtgtgtgtgtgggtggggacaccccgagtgggggcggggcgagtgaaagagaaggcccctgtgggaaagcggggggctctttgtggcgcactccccccttggggtgtaagctcaccacctggggggggggcgtcctattaacacccaggggggggaggggcggcgcacctccatatatttgggggcacttgtgggtgcccccgtgggccccccttgtgtggcccccccaaacttttattccccaaggaggggcgctgaggtgcgctcgtggtgcccaatatgtggtaccctttgtgggccccttttaagagggggcacgcggagaagtgtcccccccccccagagggggcgtggtggtgccccccacatacaggtggtgagcacataacgggggggggccccatcgtggtgcgcccaaaacaggctccttggggcgcacaaagggggccgtcccccggggggggggcccccattaggaatcgggccctaagtaagggacacccccccggggagcatattccacctgaggcggttgtggcgccaacaaagtgccccccaagggggggcagcagcccgggagactgaaaagcattccacacgcccataaaaaagaagggggcgcccactccccttgggtgggggccgcaaaaaagg

SEQ ID NO: 648644 - DNA, 169 bp, Homo sapiens
ggaagaccgtttcatgggctgtaggagaaaatagcatggcgtgcgatctgtgccctagttggtgaagctgttttgcacagaaacctgggttagcaattatgagattactttgtgtgtgctccagacttgagcaagccagcatattgtgggtaattagagccaggtgtgt

SEQ ID NO: 648645 - DNA, 166 bp, Homo sapiens
  misc_feature (47)..(47): n is a, c, g, or t
  misc_feature (125)..(125): n is a, c, g, or t
ccatgctgagtgaaaccagcacaagctgctgcggaggcgctggagtngcagaccctgttggggccgctcgagctggtgggcagcctcttggagcccagtagccatgtggccagtctaccatgggncccaggagttggggaaacacaataaaggtggcatacgaagg

SEQ ID NO: 648646 - DNA, 295 bp, Homo sapiens
gtatgaataggatacagtccgctctggcacagtactctgcgtccagaaagagtaccgatgctatcataaggctctgtagtgagcatgatcactgagcatgcacgagttgcgagctatcagtgatattgccagtcagttggcaaggatctatctcagacgcatgaggactccccaacagccatacagctgacatacctgacctacagtcagaagagtataggtgcctagcactagcttggattgaatagctctaagcataactatagcacattgtagagtactctgtgacctgctg

SEQ ID NO: 648647 - DNA, 211 bp, Homo sapiens
tccttgcctcactcctgagtagctgggactataggcacgcaccaccacgtctgactgatttttggtatttttttggtaaagatgggggtttcggctgtgttggcacaggctgggtctgtgaactcctggggctcaatgcaatccaccttgcctgtggcctccacaaagtgctggggattacagggctgtgagccactggcacccaagcccc

SEQ ID NO: 648648 - DNA, 248 bp, Homo sapiens
caacccatcgatccgaaatgagccatctctgataggagatggggagtgcgtgctggtggagtgtcccggtctgcggacatcacttaaacaaagggccactcagcaacttcgcccagtcttgcctggaccatccacgtatgctctcagagtgagatggcaacgaaagcaccatgatcaatggtatccatttgtacaggccgttgccatcacaggtccagctctgcccgatggacgaagcccgagcccgg

SEQ ID NO: 648649 - DNA, 178 bp, Homo sapiens
aaaaaaaaaaaggacattattaaatttatccctaggatcctagattgtttttatttctaaacacaatggctgcccttggtccaaaagggggaagaacgaaccttttattagggctaggaaaaaggcaaacttcggggtatccgggaccggctagcgggtaccacttgctacgggagga

SEQ ID NO: 648650 - DNA, 200 bp, Homo sapiens
atgcacctgaatgcctgcagagtctgactctcagagtgatccccctaatgcttggcgggctttaggaatctcccacactctccctttccactcttttccctatgagtccccaaagtccactgtgtcattcttacgcttttgcatccttatagcttagctcccacttatgagtgagcaaaacgtggaaccaacccaaatgg

SEQ ID NO: 648651 - DNA, 239 bp, Homo sapiens
ctgccaatgaagtaactgacgaggtgcagtctgtaagagttgatacaggttgggaacagctcgtacactaaccattctctgcatctactggttagtgaggtgagcctggcgctctactatgcgctgagctacagctacatacaatggctttgtggccacgattctaccgatcatttctgtaactgctttactggcttcatctggggaggagacacatacgaaatcaaatcctttgctgc

SEQ ID NO: 648652 - DNA, 458 bp, Homo sapiens
agtaaaagaacagaaaagcgaaacttttctttcatttctgaaaaatgtgctcgttctatggatggatcataccttgctagctacgtggttaatgtccgtgggatgaaacctacagattaatgtgagaaagtgaaatttacttccccaggggaatctcggggtggagcttaggttctccagcctagtgtcagaatatatcggtagcagctggagaaagcatgtactttgacatcagattgccttcgttgggtggcacctctgccctcccgtggcagccgactccttaatgtgagttctgtgagttgggtgcagaaagtctctcttgctttttgtttttttaatttgctacatctgtgaaagtacttggaaaaattgcatctcagcttggagaagctgagaactgtaggttgctaacagaagtggaaattgtgattgcccccggcccgaattggttaccg

SEQ ID NO: 648653 - DNA, 508 bp, Homo sapiens
cttcctttgtctgatataatgagtgtcgctctgtcgcccatctggagtgcagttgcaacaatctcagctcactacaacctctgcctcccgggtccaagtgatcctcctgcctcagcctcctaagtagctgggactgcgggtgtataccaccacactggctaattttacgtatttatttatttatttatttttagggagtctcactctgttgcccaggctggagtgcagtggcaccatctcggctcactgcaacctccgcctccctggttcaagcaattctcctgccttagcctcctgagtggctgggattacaggcgcccgccaccacgccccactgattttattttgtatttttagtagagagactggtttcgccatgttggccaggctggtctcgaattcctgacctcaggtgatccacctacctcggcctcccaaagtgctgggattacaagcatgtgccaccgtgcctggctaattgggtatttacagtagacaaagggaaaca

SEQ ID NO: 648654 - DNA, 520 bp, Homo sapiens
tacaaatttctacactggctttgaattatgtctagtgtcctttcatttcaacctgaaggactcctttacatttctttcaggacaggtctattaatgaactcccttagcttttatttatctggaaatgtcttactttctctctcactttgaaggacagtttgccagtcatagaattcttggttgacagttttgttcctttagtactttgaatatattggcccactgccttctggcctccaaagtttctgatgagaaatcagctgattattgaagattccttgtatgtgatgagttgcttctctcctgctttcaaaattctctcttgggttttaggcagtttgataataatgtgtcttggcgtgattctctttgagttcatcctacttggagtttactaaacttcttagatgtttgtgtccatgtttttcatcaaattggggatgttttcaaccattatttcttcaaatattctctgccaaaatgcacatgctggtctgattgatggtgtgtagaaattgaa

SEQ ID NO: 648655 - DNA, 106 bp, Homo sapiens
gggtcatacggcgttgttctggattccgtcgtaacttaagggaattttcacaatgtccggagcccttgatgttctgcaaatgaagggggggggatgtccttaaggt

SEQ ID NO: 648656 - DNA, 248 bp, Homo sapiens
acacgagacagaggttcattggcacatagtgagccatactatgaccagtgaagtgagtaggggctaaggggctaggtttggtcccatggctacattaaatgcttggaatgactccagggactgctctaataagtggctccagacacggtatagagttaggtgagtaacgtgtaggagtgtggggacaaggaaaaagggaggaggggtccctagaggctgggtgccccttacctagactccaattcgtc

SEQ ID NO: 648657 - DNA, 837 bp, Homo sapiens
  misc_feature (673)..(673): n is a, c, g, or t
  misc_feature (685)..(685): n is a, c, g, or t
  misc_feature (799)..(799): n is a, c, g, or t
gctgcggttgcgtagcgctgtagggagcctgtgctgtgccgcgcagttaggcagcagcagccgcggagcaagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggcccctttttcatctacctgctcttctacttccggagtgcccttcatctatggccacaaatatgactttacgtccagtcggcatacagtggtgcacctcgcctgcatctgtcactcattccactacatcaagcgcctgctggagacgctcttcgtgcaccgtttctcccatggcactatgcctttgcgcaacatcttcaagaactggacctactactggggcttcgccgcgtggatgggctattacatcaatcaccctctctaagtccccctacctacggagctcagcanggtgaaactggngctcggcatctttgtgatctgcagctcggcaacttctccatccacatggcctgcgggactggggccgtgggtccaagaagcggaagatccataacccacaagaacccttcaggnggtctcctggtgtgcctgcccaaaactacaaggggggc

SEQ ID NO: 648658 - DNA, 976 bp, Homo sapiens
  misc_feature (436)..(436): n is a, c, g, or t
  misc_feature (551)..(551): n is a, c, g, or t
  misc_feature (827)..(827): n is a, c, g, or t
  misc_feature (892)..(892): n is a, c, g, or t
gctgcggttgcgtagcgctgtagggagcctgtgctgtgccgcgcagttaggcagcagcagccgcggagcaagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcattttggtgagggttttccttacagagaacagcggggcccctgtacatctaccgtgttaggtactttgcaagtgcccctagatctatngccatcaatattgacttagcggtccaagagtgctatactacgggttcgcaatcggactagacctggcgctgtcgatccagtaccgatagagtcgactcggtgggagacgcaattntaagctactcggtcagtcaggggatctatgccgtttgagcacacctcctcataaagcagcacgctgactagttggagctactgcgcgcgaagtgggatctataaatataatgtttcgctgtttcaactttgtgcctgtgccgaaggggaggtgggataggtgatgcttgccgcactagatatattgtggcgcaggacttgttcggcaccgcggtactgagaatgggcctatacgggaatagaggctccgatgtagacttctagagaaaatagtagncgtcgtaaagtcctgtcacaggtaataaatctactacactgctagctagttacagacataagccntacacgctacacggtacagtagagagacactatagtgctatggcacggatcacagagggataactctgttaggaagtgacggag

SEQ ID NO: 648659 - DNA, 297 bp, Homo sapiens
aaaaataaaaataaataaaaaataaaaaaataaaagagccccctttttcccaaacccataaaataacttccataaaagtaatataactgttttgtaagtaaaagccagccctggtttttttaatttaggggctattccttttatttaaaacaatgaaaatttactgtcattgtttattagtctgtaaaaattaaaaaatgaaatcattaatggccttccaaaaaagtatgtccctgtttttatgttcatttttaaaaacaaaacctgtattaaaaaaagtgaacatttgcttggtta

SEQ ID NO: 648660 - DNA, 247 bp, Homo sapiens
gctgcggttgcgtagcgctgtagggagcctgtgctgtgccgcgcagttaggcagcagcagccgcggagcaagtagccgccgtgggagggagccatgaagcattacgaggtggagattctggacgcaaagacaagggagaagctgtgtttcttggacaaggtggagccccacgccaccattctgtagatcgacgacctacttcactgagaccaagccgccagggtgactcgagagcaagcccgtccgc

SEQ ID NO: 648661 - DNA, 156 bp, Homo sapiens
gtacatattccatgacaatgcctgatgtcatgaaatcatgtgggtcaaaaaaaaaatctatttaaagtatgggcagaccttttggattttaacataattgactgaaaaatgcactggtacagtttcaggctccacattgcaactaacctctagaca

SEQ ID NO: 648662 - DNA, 657 bp, Homo sapiens
cgacctagcagtatacccgcttgcgtcttagcagcagatagtttaacatagcctttgcatacaattataaaaatatcatttcaacagtgacactttttgtgctgttaagctttaagggttggaatgtttaggtgcacatcagctccttaaagaacaaagcaagtgatctaggatatgtctccctaggcagagggaattaacatttacaattaacattgaaaaatcatgtattcagaacttctgcagggaggattcttcagttatacctttatcccaaaaaattacttcactggtcctaaatgttatcattttgacagagtccctggtaagtactttcttcccttggcagcctcaatcttcccacatcatggaagtacaggtttgcacatataacacaacaatgatgatagaacactatgatataggtaaaattagctttctaaatttcggttctaaagtctccttgtcgataccagtagataagtatgcaggcagtaatactactcaaagagatgcagacagcaaagaatatattcaacggttttggaggtagtagagggaaaacaaaagcacttatcagcgtcactagaatcactacggatgtcaagctgccaacaattaaattgatgattcgatccttggcggacgtctccccaa

SEQ ID NO: 648663 - DNA, 788 bp, Homo sapiens
gtactgccctcgtgattcatccagaatgatgactccgagtgctcatcttcgttccctcgagtcatgtctgccatgttgctattggtggagggcacctgtcgccaagaccagagtaatctataccagtttctactcacgaggtaggtacgccgatgaacagaatcattgtctatgatgccagcgatgacagaggattgacagatacttacgcatggcatgcgcggagcatgtgttgctcgccagaggatggcgatgggagacaagattctatcttggcctacatcatcagagacattgtgagacccaaatcaaaaacactactagaaagatagtatcgactcgcacgagtagtgtctcttgtgtagcgtggccaagtcttccagacaaacagtggcaggccgatcacgcatattagcgagcttgtaggatagtatcccaaatcatcgactcgaggtctctgtagcttggtcatacacctggggttttctcattcctgaatggcggctgaattctggccgaagatgcactgtgaggcaaggtaggaatggcagcaccggagcattcctgatactggtgcgtgcctcgatcatctggcaccatccaacgcaagtccgagtacgcgtacgtgttggcaagctacttcggtgtaaataagcgttcagctggacaacaattccctctatcgggacacagcagttctttgaatgttgtgccacaacatgcgatgtctggaaatgatacaattacctgcacgaccacatggaaattggactaaattaccagaatgc

SEQ ID NO: 648664 - DNA, 201 bp, Homo sapiens
tttagagtcagagtctctgtcgcccaggctggagtgcagtggtataatcacagcccactgcagccctgaacttgtgatcctctgcttcagccctcagttatgtcttggcacatagctaggacaacagctgtgtgccaccatgcccagctaatgttttttgtttgggacagtctcgctctgtcaaccgggctgaagtgcagt

SEQ ID NO: 648665 - DNA, 241 bp, Homo sapiens
aaaaaaaaaaaaaaaaaagaatagataaatgtaccaatggaacagaataaaaatgctggaaacagacacgtgcatagtcagacagttgtctagctacatctgtctgtaacagatgagggaaaatagatgctttaaatatatgattctgccacaatgagttatctatgtgggggaaaattggatccataactcacatcagatagaaaaaatcaattgtgagggtattaataacctaaatgta

SEQ ID NO: 648666 - DNA, 1419 bp, Homo sapiens
gccgctatagtcctgaattcaaggatcccttgccttgaccaggaatattatcgcaagccagtggaggagctaactgaggaggacgaaatatgttcgggagctcaagaagactcagctcatcaaagctgctcccagccagggcaaaaccaagttctgtgtttgcaagcaccccagtccatccagtcaagattcaaaccaaccatgcatgcatgcatcaggcaggcaaaaccaacagtcactggcccagcatccctcccatgcattccagcactcttggcacagcttgtgcaaacacaggcacagccagttctgcagcaagtcacccatgccagctctctgcacgcaggcaacaggcgaacacatacgacacgcaaaacccgtacaacgcatacttcccatcgacagcactacgacaacaactggtagcagccataatgcattagcggactggataccacgatcacatcaacgggcaggcctgtattcataaccagagtcaccttgtacaccccgtaacacgaacgagcgatcgaccggacttcacctaagacccactagacactgctgggattgcattcaccttgcagatggcccggggcacttaacacaacaagacacaccacgctggaaccaacttgtatcggcccggcagaaacagacttggtcgacaacacacgctggctggaccaggcctatactcacccaatacacaccccacgggcgccccagatgaatacgaaccgcagggcacacggcaatgcacctctcgccacacaaggcactgggccagacagaagacgaaaacctggcatcgcgccccttggcgcaccgaccaaacccgcatcgaactagggactcacgcaagatcctcccaagacgacgcagaaggacccgcaggggccacctccccttggcacgagccaacaggaaacatcccaggtgctcgcacagcctaccctatgggccaccccggcttcgacacacagcctacacccgctgggatggagcgcgcttccaccacggcggaactgggcacacgcttccccgtcttttggttaaccgcccgggttcgccacccacagcagcccccgcccgctcacaggccacacggcctgtggttccgccgctcccaccctaaatctccacgcccaaaatccaggagtcagcaaagctcgttactcatagagagcgctatccggacagcgcatacgagagccaacagcatcggaccgctcctcatctcctgtgcaccctgactatcagatccaccccatatggagctaaaccggataagggcaaagcaaaacgacgattcagaactatagtcgagccgaaacattagtcgatctatcgagaggcagctacacttaccacgcggcactgtcgcaccatcgcaatatcgaacacaccataaagggg

SEQ ID NO: 648667 - DNA, 379 bp, Homo sapiens
tttccccacgttggtcaggctggtctcgaactcctgacttcaggtgatccacctgcctgggcctcccaaagtgctgggattacaggagtgagcccccatgcccggcgccagatttgttttttgaagttcccatcaggtaattttggaactcccaacttgactgccagtggccctgaatttagaaattggaaatgtttgatgatcaagggttgccgatttaaaccttattgaattcattcagttttgcagtttttattggcaagtacctttgctttccattttacattagccagagggcaagatgaacttactttattatacttccaagccagccagtgatattcaaaaactagcccccttttcattcatatcccaaata

SEQ ID NO: 648668 - DNA, 143 bp, Homo sapiens
ccgtccttcaggtggctcggatcggcgtggcaactgggcgcatctcactctccttcctcacttccacattaatttcctttagttcttccacactggcaagattgctgttcaccatcctgtccttgtcgtaagcattatagggt

SEQ ID NO: 648669 - DNA, 106 bp, Homo sapiens
ctttcttctttggaggctcacgttctccgagcatatttttcggacaggcataacttaagtgtccactttccccacattcataacacttagatttatcaaagtagtt

SEQ ID NO: 648670 - DNA, 746 bp, Homo sapiens
agcgggggcggctctcgtaggcagctccagtcccggacgcaaccccggagccgtctcaggtccctggcggggaacggtgggttagacggggacgggaagggacacgcggccttcgaccgccccccgtagtaattgacccagcgacgtcattttcaggaagagcctgatcaatgagtacagaatagtgtaaatgaggaatttgaacgagttctcatctttggagtggggatcttctcgaggatgcaaagagtgattcatcccaatgccatgtggtatccctctaggaatttgaatgaaaatggagatgtttacactattttgtcgacgctgtattgggcatacccctcctaaagagggcacagctctacttcagccgtgtgaacccacattacgtgttcccacgatgtactgaaaagtggcctacagcgatgacgtcttccctaatctgatgggtcattatgaccagagtattgccgcggtggaaatggagcagtttgtcttcctctcgcaaaatctggaatgttcaccaatacattgtaaactttcctctgctcatcgcatttgtaccaatcctgcagtagaacaaattcagtgtggttccaatcttgtcgtaaactttgtgagaaagtatattctgattgcgacaacattagttgacacttttgggatccgatggcctgaggagcttgacttgtgatcagattacaatactgtgactgagactgtccgtgtaccttttgatccac

SEQ ID NO: 648671 - DNA, 846 bp, Homo sapiens
caatcaatactcatcattaataatcataatggctatagcaataaaactaggaatagccccctttgcacttctgagtcccagaggttacccaaggcacccctcgtgacatccgggcgtgcttcttctcacatgacaaaaactagcccccatcgtcaatcgatataccaaatctctcgcctcactaaacgtaagccttctccgtcactctctcaatcgttatccatcatagcaggcagttgaggtggattaaagccaaagccagctacgcaagaatcttagcatactcctcaagttacccagataggatgaataatagcagttctacacgtacagacctaacataacgcattgctgtgaatttgaactaattgcatattgatccataactactacgcggattcctactactgcaacttaaactccagaaccacaaccctactactatctcgcacctgaaacaagcgtaacatgacgtaacacccttgaattccatccatcctcctctccctaggaggccgtgcccccgctaaccggctttttgcccaaatgggccattatcgaagaagttcacaaaaaaccaatagcctcatcatccgcaccgatcatagccacgcatcaacctccttaacgtctacttctgacctacgcctaatcgtatgcgcactcaatcacactgactcccgatatctaacaaagtagaaagtaaaagtgacaggttggaacataacaaaaccgatagcgattcatggccgaaattcatgaccctttatcacggctatcctaactatttcccctttttatctaataatcttaggagaaagagaaaagaaaagaaagaaaagagag

SEQ ID NO: 648672 - DNA, 173 bp, Homo sapiens
tggtttaacctgtgttagcaggatggtcgcgatcttctgacctcatgatcctgcccacctcggcctcccaaagtgctgggattacaggtatgagccaccacaccctggccttttttttttttttttttgaaaagggatttacatttttgtgccccaggctgatgtgcaagggt

SEQ ID NO: 648673 - DNA, 312 bp, Homo sapiens
ttgcatcgtgtaagccatttaccaagcatagttgtaggataagcaagggcagatttattagagaaattgtgaaaatatgttgcagtgggcagctcagcagagcaaggggctacctgcaaagaggcaagggctggaggacagttttatagggtcctgctgaagggtgctcacgtgtggaatgaggtcattgtgcccgcaggttgtatgtgattagctgtctctaacaattgttcatacaataattgtacattattgttctcaacttggggctctccccaacctggggacccttccttattgttgctaaccaca

SEQ ID NO: 648674 - DNA, 650 bp, Homo sapiens
gagagctggtgcctacgtgcgcggccaaggctgggcggctccttcgacctgcggcgcttcctgacgcagccgcaggtggtggctgcgcgccgtgtgcttgtgtcttcgccttgatctgtgttctcctgcatctatgtgtgagtggctacagcaatgcccacgagtctaagcagatgtacttgcgtgttcaaccgcaacgaggatgcctgccgctatgtgcagtgccatcggggtgctggccttcctgtgcctcggctttcttcttggttggtcgacgcgtatttcccccagatcagcaacgccactgacctgcaagtacctggtcattggtgacctgctcttctcagtggttgtgcttggcctccctgtgcctaccagctgctacaatggctggctgtggacgaacttcatccagaattacgtttgaccccactccgggaccccaagacttgctactgcctcctacccagtgtgcatcttgtggacaactaccaacagccagcctatcaccgcagaactgcggagaccacctgagggctaccagcctggcccctgtgtacttgagcggctggttagctgtgggaatgggggacagagagggcctcccctctgcctggatttcccatgagcctcctggaaactgcagaccg

SEQ ID NO: 648675 - DNA, 772 bp, Homo sapiens
ggcaacgcggagccgggaagtcgtcgctactctggtggaactccgagttggttctggagtgcggtgtgacgcggaggtccctcaagaggatccagcgaggggcgccaacaagaggcgaagaggtggcaccagtggctgtgctgtgcagtgaatgacgtgatgctggtgatgcaggagcgcagtgagcggagctgtccctgaccctgcctgtgctgtactttctgggacgcggacaggtggcagcgggggaatcggcccctgcaggcgaagctgcccggatggctgagggtggttatgccaaagttccgagctgcttgagccgacattcccatcaggctatacgaacggaagaacgggaacacgtttttcgcttatatatacaaaagaaagagcatacgcagcacagagtctcagcaggcgcactcacgggaaggccacaaagaccatcaaccggtaagcacatttcaggaaagacggggtcagcgcagtcacctaaagaccctaagaatcctgtgtgtgaaacacagcatgattgccctgacggaatagccactttagggtgcgcgtgtaggcaacacacggagggtggctcacagcactaggaccaggagggagaccagaggtgcatgttcatcgcagcgacattgggcacgcgtaacttaagcaggccataggtgtaactccacgtagggatgcattaggagatagatcacatacgataacataccatcagccaccaccgtacaagttaagggagaagtcgacttagcag

SEQ ID NO: 648676 - DNA, 1055 bp, Homo sapiens
  misc_feature (631)..(631): n is a, c, g, or t
gctatcatatagtatagaaccttagcccatgacccctaacagggagccctctcagccctcctaactgacctcgcggccgtagccatgtgatttgccactttccactccataacgctcctcatactaggcctactaaccatatcacactaaccgagtagtaccaatggagtggcgcgatgtaagcacgagaaagcacataccaaggccaccacacggccatcctgtcgcaacacagaggcgcgttcgatacgggagtaatcctagtttattacctcagaagtttagatttcctgtcgcaggatttgttctcgagccttattacgcgagctccaggcctagcccctagccgcccaattaggagggcacgtggcccccaacgaggcatcacccccgctgtagatccacctagaagtcccactcctaaacacatccgtatgactcggactcaggagtatcaatcacctgagctcagcatagtctagtagacacaggcaatcgaaaccaaatagattgcaagcactgcttattacaactttgacgggtctctattttaccctcctacaagcctcagagtacttcgagtctcccttcgaccatttccgacggcctctacggctcaccattgtggtanagccccacggccttccacggactttccccgtccttattggctcaacttttcctcactatctggttcatccgcactaaatttcactttaactccaacatcacttggttcgaagcgcggtgatacggcttgagaatggggggaactgaggtccccctgtggcggcacaaaacaaaaaaaaccgcgttctggggaaaaagtatacttttatgctccggcggataggtcgtcaggaacgatattcaaagcaacactcacgaggcagtgtggggcgcacacaaaccacctaccgcagaagcgcgcgaacaacacacgtggacagcgagacaaaccaccgacgcagcaacccacagagtaacgacagaacacggcaccagccgacgcacatgacgcaaacgcacccagtacaccacacgcacaaacacac

SEQ ID NO: 648677 - DNA, 131 bp, Homo sapiens
tgatgttgaggcgatctagagatccgggagtgacgaagaacgtctggtcaccctgtatagagggataggactacaaacttctgactgtagaagcagaagctgcgggtaagaagatccatgagaatgagaag

SEQ ID NO: 648678 - DNA, 794 bp, Homo sapiens
  misc_feature (210)..(210): n is a, c, g, or t
  misc_feature (213)..(213): n is a, c, g, or t
  misc_feature (285)..(285): n is a, c, g, or t
  misc_feature (319)..(319): n is a, c, g, or t
  misc_feature (345)..(345): n is a, c, g, or t
caagcggcatttgggtttttttaaccctcttgggcagtatacccaacaaacaggcatttccccctcgccttccaagaatgcactcgggaacaagaattgcaccctccatttaaccagtaagccctttgttagaaaaagggcagggtccagaggggagtgttcctttttctaatcacagctcggatcaatcccttcttaacaagaagcttncanggctcccctcaataaggctcaaggtgttaccttaccttgcttgtcaggggcttttcaagcttgcttcctacntgctatctccactcctctccaaaccaccatatcntgaggcttctagaaagcaaactctgncggcatggggttaatgggtctgtgtacccaagacactgtacctgggtgctgtcatctgcctgactgaccttcctgtgtcctggtccgatggtgtctttgatcctatagctaagatcaagacactgaaaatctctagactcaagtctgtgcttttgctgggataaagtttgtgttgagtacatctaggctgggtgtggtagctcacgcctgtaatctcagcactttgggaggccaaggcaggtggatcatctgaggtcaggagttcgagaccagcctggacaacatggtgaaaccctgtctctgctaaaaatacaaaaattagccaggtgtggtggcaggcgcctgtaatcccagctactcaggaggctgaggcaggagaatcccttgagcctgggaggcagaggttgcagtgagccaagatcgtgccattgcactccagcctggggtat

SEQ ID NO: 648679 - DNA, 129 bp, Homo sapiens
cacgaggatgatgatgtttttaatccaaattatgtggaggttgaacggatctggggctttgcacgttacacagattaccggagagagcctgtgcctcactagctggtgaagtggtgttcacttccttat

SEQ ID NO: 648680 - DNA, 1160 bp, Homo sapiens
ggtgaacacacacgctccctggaagctggaagactgtgcagaagacgcccattctggactgtctgtgccgcgatgccacgatatcctcctcgtaagccatgtgctgcggtcactcaggcctcatgaagaagccaaggtgaagacaagtggttatgtggacgagagggctgtgagcatcctggcaggtgccccaggatgccacgccatgagaagggccggctatctgcctggggtgcatttcccccgacagatgcataccggaattgtcgacacggacctcgggctagtataaggtagtgcaaagatctctagagtttagtccattacgtgtctcacatcgtatcctggtgtacccaggactctgacaggaaacatacacctgagacctccaaatccaacatctggcgatacacatcatggaaaatacatgtctggagtccccatacctccagccgctggcaacaagcagcttcagatccatggggtaatccggttcatacgaacagtcgatgtacgctaacgaaggtgacccttatagccaggatgctaaagctggtctagcgaaagaaggctaggagttctgtagacagggagttggggcatggggaacagggctggctgcaattgcagtgtcactgctgatgaccttctgaaacagaacgttggaaaggcaacaagaagacaaagcaattacggtaggcaacagaagctcgggagcgacggctcgaagcactccgaaagaaggcccataaggagaacacgacagcacacccacgggcatccaagagccatgggcgaagacaccccgcggcactaaaatagcgcttgcacggcacagaaagcacactacatccgggggcaccaagaccgggacaagtgggacagggaccagcgtcggaccggcaagggcacacgaacgcccgggcgagaatattccgggccaccacgcaggggcacggcaacgaaacccagacccagcaggaagaaaccagcgcacgcagagaacagaacacgacgccacaaggcagatataccgcaatatcacagggacaggtacgacacacccacaaccagcggcacagccaagcaacaagagggaaccacgggcaacaaacccaagcgaaggcaccaaacacaacacaaagaaaaggtgagccaca

SEQ ID NO: 648681 - DNA, 458 bp, Homo sapiens
acccaggctgagcatggtagcttacactgcaatcccagcactttgggaggcgaaggcaggtggattgttgagtccagaagttcgagaccagcctgggcaacacgggaaaaccccgtctccacaaaaaaatacaaaaaatcagccgggcatggtggtgcctggctgcagtcccaactactcgggaagctgaggtgagaggatcacctgagcacgggaagttgaggctgcaatgagcagtgacctaatcactgcactccagcctgagtcactgtctcacaaaaaaaaaaaaaaaaaaggagagaccaaagattgttccctaaaaggaaaggcttcctagggactatataaggccctgggtttgggccttcctcatctgggggaatggtctctttccagttaccaagacttcaagggcctagtttaggaatggttggccagggatcaggagagaaattaaa

SEQ ID NO: 648682 - DNA, 461 bp, Homo sapiens
cctgcgtacacccctatacgcgatgatgtgccccatcaacaccccctttctgcgacactccccatggccacccgtgcagatgaccaggagcacacgcgtctccatatggctctcgtccaggctaacctgccagctgtgcaccggctggtcaacctcttccaccaggggggcccggccctcgacatctaccccaactacggcagacaccgctccacctcgctgcgatcaccacattaccgcctgtggtccggctcctggtgacacctggtcccagccccatgcgctggcacccgcgcagtgccagactggccgctgcacgctggcgtggcgcagccaccggcagccgcgacgctgcctgcgagccctgctggacagcgcagctccgggcacgttggacctggaggcccggcacattatcgggacgctcacccgccctgcacgtggcagtcaacaccgagtgc

SEQ ID NO: 648683 - DNA, 266 bp, Homo sapiens
aaacctgaatatctcacagtcagaaaaattttctcctatgttcgttccaaaaggtttacaagtttaactttcatatttaggcttatgatccattttgaggcaactcttctgacactgttgtaagaggttaagcgctcattcttttcactatggcatatataactatttcacgaaccgttaattaacaaagatcattccgttccccacttggccatctcgcttgaacaatcaactagaccacacgctagctgtgggctctattctgt

SEQ ID NO: 648684 - DNA, 264 bp, Homo sapiens
ccgcgcccagataccgcgcgatgcagcgctttcacctggcgcctgcaggtcctccggccgcccatcgttgaccaccacgtcatcggccagtgccagccgctgtgtgcggctggcctgggcggcgatcatccggtcggccagcgcggcgtcgatgccgtcgcgctgcatcagccgggcgtgctgcactgcttccggtgcatccaccagcagcacccggtccagccaaggataggcgtcacgcccaccgacctcggtcagcagcgg

SEQ ID NO: 648685 - DNA, 538 bp, Homo sapiens
  misc_feature (43)..(43): n is a, c, g, or t
  misc_feature (81)..(81): n is a, c, g, or t
  misc_feature (98)..(98): n is a, c, g, or t
  misc_feature (117)..(117): n is a, c, g, or t
  misc_feature (124)..(124): n is a, c, g, or t
  misc_feature (315)..(316): n is a, c, g, or t
  misc_feature (341)..(341): n is a, c, g, or t
  misc_feature (364)..(364): n is a, c, g, or t
  misc_feature (405)..(405): n is a, c, g, or t
  misc_feature (407)..(407): n is a, c, g, or t
  misc_feature (413)..(413): n is a, c, g, or t
  misc_feature (430)..(430): n is a, c, g, or t
  misc_feature (482)..(482): n is a, c, g, or t
  misc_feature (527)..(527): n is a, c, g, or t
aattcgcggccgcgtcgactacggctgcgaaagacgacagaangggaggggcgtggcttttgttggtgagctgattgtgtncctgtgggtgggacgtnggttggtgattggcaggantctggtnatccgctaacaaggtccaaaatgcagtcttcgttgaaaaccctttaccgggcaagacccatcaaccttgaaggtggagccccagtgacacccatcgaaaaatgtgaaaggccaagattccaggataaaggaaaggcattccccccgacccagccagagggctcatctttgcaggcaagcagctggaaagannggccgtactcttctgactacacatncagaaaggagttcgaccctgcantggtcctgcgtctgaaaagtggtatgcagatcttcgtgaanancctgancgggcaaagaccatcancctggaaatggagcccagtgacaccatcgaaaatgtgaaggccaagatccangattaaagaaaggcatcctcccgaccagcaggctcatcttttcangcacgctgttg

SEQ ID NO: 648686 - DNA, 1248 bp, Homo sapiens
  misc_feature (524)..(524): n is a, c, g, or t
gctgaggcaggaggctctcttgagaataggagttcaagaccagcctgggcaacatagcaagatcctgtctctccaaaaaaaaaaaaaaaaaaaaaaaaaaattttctttttgggatcccaaaggcccctttttttactctttgatttcaccttcttccagagatgtacgttaaaaaattaattttcagaatataattatatttgttttaacaacccaggctgtgatcgggttccacagacaaaggtgggaccaaaacaaaaatttctctcattattattcccctgtgccctcacacattgcattaggcctccccaccacttattcagtattctcccagcacccaagaagtgtggtctacccttttgtgtgtcgaacaaacctcaatataaactcctccccatttgtgcacaccattctatttatctcaccaccaaagagtcctccatatagtctctacaccgttgtgaaaggtattctccctttcgtgcgttgtgttgtgctaccacttgtgcatctgtcggcncttttagaaaccacagtctgtttttcgatctggattctctctctagccaaattctatttagagacatctctattataccgagagaagataatagtgtctctacactgttggcgccctataagaaaagctttctctctctaatatgtggcatctccaccaccttgtggtcaccatcctcccccttatttttcttctccaccatataagattctccctcgcgtgtgtggcaaaacccacactctttttctacagcacgacagacaaacaaactttctagcagctgtcccacgggggggggcgtacaccttctgtttgcccgggtgtataaacacgttctggtgttgacagccaagggtggggcggcgctgtgtggtgtatctactcacccacgatttatatttttatgatgtgttgcaccccccggcggtgtgggtatacctcattgaaacggcccctgttagtgtctaccccccccaaaatatgagtctttagcccctttggtcagtgggggctccgcattgtgtgtctccccgttttttgtttccgccccaaccctctctgccaagccgctcgttgactgttgtttgtggccgccgccaaagtgtttagtgtgtgttacattcccgctttttgggtgtggtctccccgagtgtgttttcattatgtttggcgaccttcgccgccatgtttgtgtgttgaagcgacacaccgcttggcggacaac

SEQ ID NO: 648687 - DNA, 208 bp, Homo sapiens
aaggagcagagctaagctgggcctcacggatgagttggtttgatgagaggacaaaagaaagggggcattgggaggaaagcatcactgaaggcccagaggaagtcataggctcagtgaggaggaacgcaagcctctcatgggagcagaaatatgaacagatttatttacttactttattattattgaatggagtctactctgcacccag

SEQ ID NO: 648688 - DNA, 224 bp, Homo sapiens
  misc_feature (32)..(32): n is a, c, g, or t
  misc_feature (120)..(120): n is a, c, g, or t
  misc_feature (136)..(137): n is a, c, g, or t
aggatcttatgcaccattccgactaaagaggncatcacttgtctcttagctgtctagctttttcaactattcgagagtctttcattatcatcatctggaatagtcacctgaatgatgttnaggtcttcaacacctnnatgcagtagcattaacacttgggtgatgaatttatttattcagggagggctcttatgaggaggtgctctcctttaatacgccggtct

SEQ ID NO: 648689 - DNA, 649 bp, Homo sapiens
gagagagagagagagagagagagagagagagagagagagagagagagacttactatgaggactaactatagtgctggaagcggttcgtgatttacagctcttggttactcccagacatgttgctggcagagattgtggtttttaaggggttgttagatggagtaaatactcttttccacgcgtgtgatcttaactaaaaaggggttacagaatttcagcagttatctgaggtctatattaaattgctcatcctatccaatccctgtcttttgagtgcacatggtaagtacattgtctttaacgttgatgctgcttttcttactacatgtggctgtacctttgggctactgtacactgtttgcagtgctgtccccggcataggaccatgattgcagaagccatttcacgagtacctgaaggctcaacggtagaagcttcaccacaaaagcgaaatgtgcacactacagggagaaaactggttgtactggatgtttgaaaagttgagcgatgttatggtgtgttactttatcctatgtatcattaactacatggcacatagttatgccaaacgaatccagtaacggctgaactcagaggagacaactgtacgttgaggctatagactggattgtagtcgtgggttctgcct

SEQ ID NO: 648690 - DNA, 885 bp, Homo sapiens
  misc_feature (404)..(404): n is a, c, g, or t
  misc_feature (658)..(658): n is a, c, g, or t
tatcgatccatacatctgcggcggtgagggagaagtatcggctcagatcgcttgtgagcccgcctggtgcctccatgagtcacacacgagggatgtactatcctatgtccgagtgcacataagtgcatcctaggattgtcctctcatccggactttgtctatactagagtcgcgccaacactcactcgtaagacgatagatctcagtagtgacgttgaattccagtcccgcttgagcgttacatcgccgctaaagtggccggccgtccacgtcagtgaacgtaaaaagtgcgtgcgcgttcatgttaccgttacaacagtacgcggtcgcacggtcccataataatcttatcgcgaatacaatcttactactaacatcacgagaacctgagaagatcgatacgngatgagtatgataccgttcgctagcttacgttaactaacataattaattgctagacctagggcacttttgctataacgagacataatagagtagcgcgtacgcccgagagctagggggcgcgccacccatatatacggatctaacgtgggaggaggagggcacgaacaagggggtcgggcacttggatccaaatacttattaggctaaactaccctgactcgatatcgcactagtaaaccgacagagtgggacnccgaggaacactaagagggtttggcagactaggacacattcgtaagacaaggatgggtctacaccgtacccaacagatcacagtacccaaaggactcccacatgccacatacaaacaagcggaaatttccatgtgtgaccccttatctagacacttggtgcataactataagacccactttggcgataccaagtgtgggcagtgccacctaggatccaggacaattg

SEQ ID NO: 648691 - DNA, 199 bp, Homo sapiens
atttccacaacggaacaattctagacctgtaggcctgtcacccaatcgaaatctgtcagaagcgaagtcggcttaatacattgccattgccaaagaacagcatgggtacaacatggaacaggctcttgggatgcgcttctggcataaacataatatcgacaagtcattggctactgtgaccaactttacccctttccca

SEQ ID NO: 648692 - DNA, 122 bp, Homo sapiens
ttcgactctaaggatccgagaacgctctaagcctgtccacgagctcaattagggaagcctgtgactgactacagactttgcgaacgctacgccatggtttatggatactaatgctgcctata

SEQ ID NO: 648693 - DNA, 101 bp, Homo sapiens
actcaactgggagaacagtaaatgtgtgttactgtggacttctaatacatgatactttctgcactaaaaaaacaaaaccaacaacaacccaaaacaaacac

SEQ ID NO: 648694 - DNA, 614 bp, Homo sapiens
  misc_feature (141)..(141): n is a, c, g, or t
agtaagacccctttttttggtgaccctaatggggtttccaagagaagggttcacattattacaattcccagaagagttgttgtttggggtccaagataagaagaaagaaaaacccccagcctttttccattttgacaggcnaccagtggtttaagtttttaaagggtttcccaaatgctgaaggcaaggggggggggcaaaagcccttatgtttcgggatattttaaactttgttaaagagcagcctttgaaaatccccaatttggtttgggtttttgccctttttttcccttttcaggggaatttttgggggccaaacgaaagcatttccaagctttagagttttttgaattccggggccttcctgaggggagccctgagggtttttttaagcagttttcccaagggtcccgttggtctttctgggttttttgttaatggggggcaaaagcaatttcccccccccgggcattccattttttatgttggggaaagtttttcccttttttttttgagggggggggggtgggggggtcagcatgattatattttaatgtaaaaaatgggacatttggaaataaaatgaaaaaaaatgtttaattaaagggccctta

SEQ ID NO: 648695 - DNA, 1295 bp, Homo sapiens
gactgcgcggatgcacagaggtcgcgggagagcgttctgggtccgagggttcactgtagggtcttgagtccaccatctgaccggaagctgcgattcagtgtcggcctgcgtgtctggtcgaggtcgacctacttggagtcgcatgtacatccgaggtgtgatattgaaggtaggtggagcttgaattgatttagagcccgagaagctagccgatgagcgcggacgtctgggcgcgtgcctatgttccttgacggagcagccaagaacgaataggtgtctgggtgaaggatcaaggtgagcgcgtagagagggaggatggtagggggcgaaaaccagttaggaattaagttctaaggcgccatcgttccgaagggagcgtagcttgcctgaaaatgttggccagggccagccccctggccttgcgtattacgacaaccacagcttgtgcaacatcgcttggctagcatctatctaggggtcggatcttgggcctgctggtcattcgtttccttggcgtgcgctcgccctgattgggctcgataaaactccggttgacagaaggcgcaccgactggttatgatcaggcggacggcgctttcctgaggcgtcaaggcacccgttggggtatgggacaacaaacggcgggaggccgcgtcatcaccgccattcgggtcgggacctttcaagggcctttctccaagagggccaacggtgaataggccgggaaggccgaaatcgcttggcgcccgtgggtccttgcgaacacggggcgcggagttcttcggcaaatataagcccctggacggccttctgtcccttgaagaagaggtttgtacaaggggggccctttttggatgggcaatgggcgcgagtcatcacattagggaccaaccacacagggaagaacccctaggaaaaaggggacatttaaggtggtcacggcttccaagagaaccttgtagcttagtgtctgtggcagagaattccggaaggcgcccctgaacactcttgtggtgcttccgacgagaggaaagagccaagttaagtcgggcaccacggtacattcgtttatggtccaaactatccgttgacgttacaggcacgaacagagagacaagtcacgttccagtgtgtccacatatccttgggcaccccactttaacgctccccccaaagcattatacccggcggggttgagaatgaagacccaattcgcagatgacctacctaccaacatacgagtagatttggaacacaccttggtgcgttcacacacaaacgggttgcaaacgtgg

SEQ ID NO: 648696 - DNA, 401 bp, Homo sapiens
  misc_feature (281)..(282): n is a, c, g, or t
  misc_feature (344)..(344): n is a, c, g, or t
tagcattgatgcacctattctttttttaaaaaggaagggtctccgaaaaccttaaaaaaaaaaaaaccccccctgatcctgggaaaaaaaaaggtttttaaatttggggggaacctttttgaaaaatttttgccccccttttttgttccaaaaaaaccaccctctttttttttgtgtagaaaaaaaaaaaaaaaaatttttctcccacaacctttttttgtaaaaaaaaacaaaaaaaaggggggggggggggggggggtgttttttttaaataaaaaaannccccccaccccctttttttttctttgtgggagagggagatcatttcttccccccccaccctnttttttttgcgccccccccccccccactgttttttttccccccccccttcttttttt

SEQ ID NO: 648697 - DNA, 298 bp, Homo sapiens
  misc_feature (69)..(69): n is a, c, g, or t
  misc_feature (234)..(234): n is a, c, g, or t
  misc_feature (267)..(267): n is a, c, g, or t
gctagtacgcgaattgggagaaaaagttcaagtgggaagcatgtcgtctttatcgctcaggtatctgtnctactgttgcagcacgtttctgtttgtgaattttgctaaaattgcttgtatttagactgcattggtagttggagtcatgaaaacaatctttttatgaatccaattgggtagaaagataaagtacaggcagagcgccgtgcttaggcctgtaatcccagcacgggnaggtggaggcgggtggatcactgtagagaccancctgggcaacatggtaagaccctgtctacaa

SEQ ID NO: 648698 - DNA, 153 bp, Homo sapiens
ttagaagctaccgcaacggctatgctttctgaagactgtttcatagagcttccaagatggtagataaaccttttaaactcaggatttggactatgtgctcaactcagaaggactgtcattagcaatagcagaaggtacccactgcagtgccac

SEQ ID NO: 648699 - DNA, 173 bp, Homo sapiens
agtaaaactcggaattagtcaggcgtggatggcgagcgcctattatcccagctactcgggaggctgaagcaggagaatcatttgaacctgggaggtggaggttacaagatgagccgagaccgtatcacttcattccagcctaggcaagagtgtgaaactgtcaaaaaaaaaaa

SEQ ID NO: 648700 - DNA, 419 bp, Homo sapiens
  misc_feature (11)..(11): n is a, c, g, or t
  misc_feature (155)..(155): n is a, c, g, or t
  misc_feature (177)..(177): n is a, c, g, or t
  misc_feature (273)..(273): n is a, c, g, or t
  misc_feature (277)..(277): n is a, c, g, or t
  misc_feature (292)..(292): n is a, c, g, or t
tcaggaggacnggtcagggaggagttagggcaggaggactggtcagggaggagttagggctggaggacgggtcagggaggagttagggcaggaggacgggtcagggaggagttagggctggaggactggtcagggaggagttagggcaggaggantggtcagggaggagttagggcnggaggactggtcagggaggagttagggcaggaggacgggtcagggaggagttagggcaggaggaccggtcagggaggagttagggcaggaggaccngtcngggaggagttagggnaggaggaccagttaggaggcagtgacttaggacttcagcagtggcactagaaaggggctggatatgaacgacattgcaaagtaaaactagagagacggccgggcacagtggcccactcccgtaccag

SEQ ID NO: 648701 - DNA, 462 bp, Homo sapiens
  misc_feature (11)..(11): n is a, c, g, or t
  misc_feature (155)..(155): n is a, c, g, or t
  misc_feature (177)..(177): n is a, c, g, or t
  misc_feature (273)..(273): n is a, c, g, or t
  misc_feature (277)..(277): n is a, c, g, or t
  misc_feature (292)..(292): n is a, c, g, or t
  misc_feature (409)..(409): n is a, c, g, or t
tcaggaggacnggtcagggaggagttagggcaggaggactggtcagggaggagttagggctggaggacgggtcagggaggagttagggcaggaggacgggtcagggaggagttagggctggaggactggtcagggaggagttagggcaggaggantggtcagggaggagttagggcnggaggactggtcagggaggagttagggcaggaggacgggtcagggaggagttagggcaggaggaccggtcagggaggagttagggcaggaggaccngtcngggaggagttagggnaggaggactggtcagggaggagttagggctggaggaccggtcagggaggagacttagggcaggaggatcggtcagggaggagttagggcaggaggactggtcagggaggagacttanggcaggaggacgggtcagggaggagttagggcagggggaccggtcagggagaa

SEQ ID NO: 648702 - DNA, 355 bp, Homo sapiens
  misc_feature (11)..(11): n is a, c, g, or t
  misc_feature (155)..(155): n is a, c, g, or t
  misc_feature (177)..(177): n is a, c, g, or t
  misc_feature (273)..(273): n is a, c, g, or t
  misc_feature (277)..(277): n is a, c, g, or t
  misc_feature (292)..(292): n is a, c, g, or t
tcaggaggacnggtcagggaggagttagggcaggaggactggtcagggaggagttagggctggaggacgggtcagggaggagttagggcaggaggacgggtcagggaggagttagggctggaggactggtcagggaggagttagggcaggaggantggtcagggaggagttagggcnggaggactggtcagggaggagttagggcaggaggacgggtcagggaggagttagggcaggaggaccggtcagggaggagttagggcaggaggaccngtcngggaggagttagggnaggaggactggtcagggaggagggggatcctcatagatgtcgaaccttgcaaggacatgcaaa

SEQ ID NO: 648703 - DNA, 490 bp, Homo sapiens
cgtggtggtctcgattcgggcctcatgatctggcccgcctgggcctcccaaagggctggggattacgaagcatgagccaccgtgtccagccgggttgggtttttttggagatgggagtctggctctgtcaccgaggctggagtgcaagggtgtaatctcagctcacggcaacctcggcctcccaggtcaagccattctccggcctcagcctcctaagtagctgggacggtaggcatgcgcaaccacgcccagctaattttggtattttaagtagagaacgcatttccaccaggtgggctaggtgggtctcgaactccgtgacctcaagtgatccacccgcctcggcctcccaaagtggctgggattacgggtgtgagccacggtaccgggccaagacatggttatcagagggagatgacagctccatacatttcactgcccctgaagaccttccagggggaccagatgtggaggggaagacagtgatatg

SEQ ID NO: 648704 - DNA, 892 bp, Homo sapiens
  misc_feature (6)..(6): n is a, c, g, or t
  misc_feature (17)..(17): n is a, c, g, or t
  misc_feature (155)..(155): n is a, c, g, or t
  misc_feature (189)..(189): n is a, c, g, or t
  misc_feature (222)..(222): n is a, c, g, or t
  misc_feature (231)..(231): n is a, c, g, or t
  misc_feature (233)..(233): n is a, c, g, or t
  misc_feature (236)..(236): n is a, c, g, or t
  misc_feature (256)..(256): n is a, c, g, or t
  misc_feature (260)..(261): n is a, c, g, or t
  misc_feature (292)..(293): n is a, c, g, or t
  misc_feature (312)..(313): n is a, c, g, or t
  misc_feature (315)..(316): n is a, c, g, or t
  misc_feature (320)..(320): n is a, c, g, or t
  misc_feature (325)..(325): n is a, c, g, or t
  misc_feature (353)..(353): n is a, c, g, or t
  misc_feature (356)..(356): n is a, c, g, or t
  misc_feature (377)..(377): n is a, c, g, or t
  misc_feature (387)..(387): n is a, c, g, or t
  misc_feature (399)..(401): n is a, c, g, or t
  misc_feature (411)..(411): n is a, c, g, or t
  misc_feature (428)..(428): n is a, c, g, or t
  misc_feature (453)..(453): n is a, c, g, or t
  misc_feature (466)..(467): n is a, c, g, or t
  misc_feature (482)..(482): n is a, c, g, or t
  misc_feature (488)..(488): n is a, c, g, or t
  misc_feature (492)..(492): n is a, c, g, or t
  misc_feature (501)..(501): n is a, c, g, or t
  misc_feature (518)..(518): n is a, c, g, or t
  misc_feature (541)..(541): n is a, c, g, or t
  misc_feature (559)..(559): n is a, c, g, or t
  misc_feature (583)..(583): n is a, c, g, or t
  misc_feature (795)..(795): n is a, c, g, or t
  misc_feature (880)..(880): n is a, c, g, or t
aatggnggacgcgtgangaggaggcgcgggcggcggagggaggccggagcgggcagcgcggcggcgccatgtccgtgaacatggacgagctcaagcaccaggtcatgatcaaccagttcgtgctgacggcgggctgcgcggccgaccaggcgaanaactgctgcaggcggcccactggcagttcgaganagccctcagcgcctttttccaggagaacaaaanaccctaaancnaanataaaaaccagatgatgtgnaaanncgcaaatacccctgctaaaccccccaacttnnctgaagctctcaccatgtnntnnagtntcaangatgtccgagagcttccaaagcggtggnagnggaagacgatggccgcgaaanaacgtaaaanacgcaaaaattnnnccatgcagcnaccagaagctctgcggncctccagctggaacaaggaggcctngaacccggggggnncaaagaaaaaaaagnaaaagnagcncctgtggantaaaaaaaaaacttatnaggcttcagaatggaaaaaattngaacaaaaaaaggataanttagaaataagggaacacactgcnatggaggcagagagataagggaggcccctcccccctcccggaggccaggaccccgtggggcgggggagaggacgtctctgcgggcccccttcaccccttttctgtctgcaccccttgttccccggagccctggaggggagagcgcggactctagccaggcagggacacgtctggtgccagaacacgcagctgcccacacgcaaggtcatggncccagcggccccggcacatggagtggttcagagcggcctgggtgcctggcggacagaacttcagagacacgcagcttccttcganacgcactgctca

SEQ ID NO: 648705 - DNA, 231 bp, Homo sapiens
atctagagatccccagcgccgagcattacaactataataaagtacaattgaacctgaccatggtttttacttagatactggctagggcattgtagtggtgcaaaaaaattaacatagttcttttcaaaatgaaactgtcctcgagtgttctacgagacctaagagggtttcaaggagatcaaatcctaaaccagtttggcgtttaatggtttttggattggagtccgatac

SEQ ID NO: 648706 - DNA, 316 bp, Homo sapiens
tgctatgtgctgcgggacacagcatgtatgactggcctgccctcgagaagcgtgtggtctatgcagtcctgagcgtggttgctcacaagaatgatgccctgtcgccctatttctcagagggtggtcctgacctgcatcacagtgagctgagttgtacgtcaatacagaaaagggtttctcaaccttggcactattgacatttggggcctgataataaccctttattgcacggggctggctgtgctttgtttagtagcatccctggcctctacctatttgttaccagcagcaccctctatgttgtaagaatcaaaaa

SEQ ID NO: 648707 - DNA, 1044 bp, Homo sapiens
taaaagggcaaaaattgacttttttgaaggaaaggggaatgaggacaactgtaaactcacagtgacccctgtggaaaaaaaaaacaacaaaggtggtgggttttgtctcggaggcctcgtgcgtgctcaagtggatttccaggagcaaggccattttgtcgcgctatccaaatttctcttaggcattatattttggaatagagtttatagccatcattgttttctaagagacttggagaccaccagacaaacgtgtttagaaactcaaactctttcaattacctcaaagaaggacccattctcagtaaaactcaaggtgaattgacagcagttttgggaactcgtgcgtgggggctcctctcccgtgtttgcacccacttgggataacttataattcgtgacaaaaactctttgagcttgaaacaggcctttgccaagaggggcgtcgagagagtgcggcaagaggaagcaggggcggattagcgacaaagacagcagggtaaattataccaattttcccccttttaaaaggttaaattattcggccaaactcgataattctcgtgaatgtgctccctatttaaagcacatgagtctgaaaacttaaaccagaaaaggccaagagttaattcctgattgtgtacaataggctttactcacaaagcaggggggttagccatattgaacctgtgtcccaacattcaaaaccaacagaattaaagggaccgtgcccaatccaccacaagggcgttaaacagcgcacccgcggttcaagaactttcccgacggcgcgcgttctcgctgaaacaaaggacacggggcacgccccagagaagtgcaagagcaatgtacaagaggcatttgccatttgctacacggtgtttggacccacaaagaaagtttacaccacttcccaatcggcttcccacggcgtgaattctcccgggacatgagcaaattggatatcgaaaaccccaaaagggccacccctttggaagtgggatataacatcaccgcttcttccgaaaagcagtatatgcatca

SEQ ID NO: 648708 - DNA, 913 bp, Homo sapiens
ggaatcaatatagtaataagatatttaaaattgttaaatcccaagttaccaccctccaagatggttttggatatggctggagcaaagtaggagaaatgaacagatgacctcattatctcttagaaacctatgattccatgaacatgatacaggttttatgcatgatctgccctgtttacctcaaaatgtctgaagtcagtgagtcagaaaaaaccaaaattgctatagaaatgccagtttggaagacatcttgttttagttagaaggattttgtggaaatatgacttaagcctttgtgtttcaaaagatgaggtgtatttccctgggaaaagactcaagaaaacccaaggaaatggcaagatttattttctattaaatactttggaaaaagacagaagtctcaatccattagtcacaaccaaatgcccagtgatgaagttcctcctcttatgactcttctggaaagattcatggctgttttaatctgacccttcctttccactctgtgactccacctccagtctgagttgtctgtttactcatgacagctcttaatagccaaccagcctgttttaagtgtctctagcttatactgctccgatccaattcttacacccctgaagccaaaagaatcctttccaggaagagctgcttaccgacctaatattcaactcaagttgtccccattgtgttctagattaagattgtgagaattgagactcccaggggatgcacgtccaattttggagtcctcaaacgcaaaaccgtgctgcactaaggctctagtgaccaattcacgaccggtcacaggggcgcaccgctggcagaggcctccagtaacccaagggaagatggtcccgggaagacttcgtcccaaaaaactgacgagatatccaaaatacgggccaagcaa

SEQ ID NO: 648709 - DNA, 276 bp, Homo sapiens
gacgtgtgatcaccaacagagagaggcaacctggatcagtttacgtggttcacgtgaaagatgccaatggaagcagctttgccactcgactttccaacatttttgttattggcaagggcgacaaaccatggatttctcttccccgaggaaagggtatccgcctcaccattgctgaagagagagacaaaagactggcggccaaacagagcagtgggtgaaatgggtccctgggtgacatgtcagatctttgtacgtgattaaaaatattgtggcagg

SEQ ID NO: 648710 - DNA, 883 bp, Homo sapiens
gggctcgagctcggggcggtgggggggtggccggaggggggggtgccctcgctcctcctcgccgcgggcgggggcgtgatccgagcgaggggccggggcccccggtgaaactgctggcgggctgggtgtgccattggagcatggaggtcccggatgttggcatggcgcgggtggatgtgcgacggcatgcgagaagccgctggttgcaagccgtatcccactgataacaggggaatccattgaattatggcgggccccggggtgtgggcccaggccgtagggccgaagggaccaagcggaagtagtggagagaagacggagcaagagtgggattaattgttcgggggacacatcgagaagtgggaaaaatttatttgcaaattgtaccattacgaggggcatgggttgtttggtgtgtccgaggagagataatgcgctgggactccaagggtgtaaccaacttggattctgtcgttgtacaaaacaacagaaggattgggggaaagaagatgtcggagggttggaccataagtggaatccccaagctttaccttattccaactttcccctacgaagggggtctcgcttccctgggttatataagaccccctggtggatataacgagctctcagcaaacactttcgcttactctacacgtggcggagctctggggtaaggcacaacacaaggaggttcacagtgagagcatacggtgagcactggcacatacacgagggaaatccgacgtgtatctccaggaagcaacttgggtcctaacacgatttttcccatctactactccgcgtgtgggtaacggtacccctaaagaggatctgccgtgggaattaatggcgcgaccagaggacgttcgtggaggaattg

SEQ ID NO: 648711 - DNA, 304 bp, Homo sapiens
attgttttaaaagggagtttcgcttttttcccccgggtggggggcaatggggggtttttggttccttgcaagttccccctcccgggtttccccctttttttttcctcaccctcccgagaaggggggataaaggggcctccccccccgcccgggtaattttttttttttttaataaaaagggggtttcccttttttagcccggagggttttttttttttgacatttttttttcccccccccccccccccaaagggttgggttttcaggggtgagcccccgggtcgggcccccgttttttgttcca

SEQ ID NO: 648712 - DNA, 408 bp, Homo sapiens
  misc_feature (117)..(117): n is a, c, g, or t
  misc_feature (335)..(335): n is a, c, g, or t
  misc_feature (356)..(356): n is a, c, g, or t
  misc_feature (398)..(398): n is a, c, g, or t
ttttttactttttgtagagatagggtttctccatgttgcccaggctggtcttgaattcctgggctcaagcagtcctcccacctcagcctcccaaagtgctgggattactggcgtgantgccatgcccaacaagttcaactttttaagactctgtatataagtgagatcatggggtatttgtctttctgtgcctggtttattttatttaatacaatgtcctctaggttcatccatgttgtcacatttgacagaatttcttttttaaagctgaatagtattccattatgttgtatataccacatttatatcccatccatcaatggacacttaggatngattccatatcttggctattntgaataatggtgtacctaacatgagaagtacagaatacctcnttgacatact

SEQ ID NO: 648713 - DNA, 210 bp, Homo sapiens
  misc_feature (105)..(105): n is a, c, g, or t
gacagagtgagatcctgtctcaaaaaaaaaaaaaaactttgcttcttgaaagacttctgggtcttacccttcttaccctttctgatttgaaggagaggtatctgntgtgacaattttcttgaagcattgctatccatttgtctgtttatttaattccatttctagggctacactgggaatagatgtgacatctgggaggtttccccgggg

SEQ ID NO: 648714 - DNA, 1073 bp, Homo sapiens
  misc_feature (77)..(77): n is a, c, g, or t
  misc_feature (146)..(146): n is a, c, g, or t
  misc_feature (148)..(148): n is a, c, g, or t
  misc_feature (177)..(177): n is a, c, g, or t
  misc_feature (197)..(197): n is a, c, g, or t
  misc_feature (201)..(201): n is a, c, g, or t
  misc_feature (203)..(205): n is a, c, g, or t
  misc_feature (208)..(211): n is a, c, g, or t
  misc_feature (217)..(217): n is a, c, g, or t
  misc_feature (234)..(234): n is a, c, g, or t
  misc_feature (239)..(239): n is a, c, g, or t
  misc_feature (243)..(243): n is a, c, g, or t
  misc_feature (246)..(246): n is a, c, g, or t
  misc_feature (289)..(289): n is a, c, g, or t
  misc_feature (297)..(297): n is a, c, g, or t
  misc_feature (314)..(314): n is a, c, g, or t
  misc_feature (316)..(316): n is a, c, g, or t
  misc_feature (337)..(337): n is a, c, g, or t
  misc_feature (348)..(348): n is a, c, g, or t
  misc_feature (438)..(438): n is a, c, g, or t
  misc_feature (549)..(549): n is a, c, g, or t
  misc_feature (551)..(551): n is a, c, g, or t
  misc_feature (793)..(793): n is a, c, g, or t
  misc_feature (899)..(899): n is a, c, g, or t
  misc_feature (907)..(907): n is a, c, g, or t
  misc_feature (998)..(998): n is a, c, g, or t
  misc_feature (1031)..(1031): n is a, c, g, or t
tatataatatagtaatatagtttgttataatataatagctaggctggttacggtccggtatattcccgggtatagcngccgccgccgccgccgccgccgccgcctccgccgcggaggaagacagcgccgcccgcgcaccgccagcnanccccgccgcagagttccaccgccacaggnctcgggccagcggcaggagnggangnnnggnnnnggggtnggggggggctcaggggngtttnaggntgngttatggggttggggcgatgtagtgagctggagtaattgaganaggaggtnggagcagctttggaacnanatctgggatgcacgaaaagantgtggggattnaacactgacttagattacagctgggctggtacctagtggtggtattaatttagatgaggacctctggtaggacccttccgtgggcacttngtaaagatctatgctatgcactgggggatcgattcaaggctgtctgtgttagcgcctcccaggatgggaagtttataatctgggaaagctataccaccaaaaaggtccatncnatctcgctgtgctcctcctgggtaatgaactgtgtctacgcgctctcagggaactttgtggcttgtggggggttggataacatttgttccatctacagctttaagacccgtgaggtcaacgtcagggtcagccgggagctgcctggccacactgggtacctgtcgtgttgccgcttcctggatgacaaccaaatcatcaccagctctggggataccacctgtgccctgtgggacattgaganaggccagcagacagtgggttttgctggacacagtggggatgtgatgtccctgtccctggcccccgatggccgcacgtttgtgtcaggcgcctgtgatgcctctatnaagctgtnggacgtgcgggattccatgtgccgacagaccttcatcggccatgaatccgacatcaatgcagtggctttcttccccaacggctacgctttnaccaccggctctgacgacgccacgtgccgcttnttcgacctgcgggccgatcaggagctctcatgtactccatga

SEQ ID NO: 648715 - DNA, 923 bp, Homo sapiens
gaagaagcattcggccgagactcgcggccagttaccgtgcgttcaacatggtctggagacggaatccgaggcagcagctgctaatgagtagggctgggcattagcaagaccttaccgaaacgctctggcagcgaccgctcggtgatctgacacaaaagtggcacatgggaggtctgttgcaggagtcggttgactggatctaggcacgcaggcgagtcgaagtcgacgcttcgatcatccgaatataaggaccgggcccttgacctggcagggttgcgcccacgaaagttaaccaccagggaactccatagggccgcaattaaaacgcgggcgagaattccaacagtgtgagagacttctaaagggccgtccaatgaagggttaataaccttggttgccaattgttcgttaaatttgaatttgtggaacggcggagaatggaagtggttgagctttttgaaaagaaatttggggccaagaattaactttatctttgcaacagagatctttactatgtagtgaagaaggggaaaacattgctgtgaacaaaaaggtgatttgaaaggctgtggggagaacacaaaagagaggtttggtccgtacaatgtttaaaccttgggaggggctaattccaaatgagaaacagagcattgggtgacattgtacgtggagaaaagcggggattggaaaattggcatagtgggacgttggcgcatataacattttggggaaaaagaagcttggtgaattcaaggacacatactgtggagaagcggggaaaaaaatgtgggccagttgcacaaaaaaaagatggcaccccaaaatggggtcgaagacttacattgggagagaccaatttactcttggaattgatgcagggtaaaggcattccaaagaaataggggagtgccacggtaacagtg

SEQ ID NO: 648716 - DNA, 567 bp, Homo sapiens
  misc_feature (16)..(16): n is a, c, g, or t
  misc_feature (18)..(18): n is a, c, g, or t
  misc_feature (28)..(28): n is a, c, g, or t
  misc_feature (73)..(73): n is a, c, g, or t
  misc_feature (83)..(83): n is a, c, g, or t
  misc_feature (98)..(98): n is a, c, g, or t
  misc_feature (100)..(100): n is a, c, g, or t
  misc_feature (117)..(117): n is a, c, g, or t
  misc_feature (123)..(123): n is a, c, g, or t
  misc_feature (143)..(143): n is a, c, g, or t
  misc_feature (156)..(156): n is a, c, g, or t
  misc_feature (170)..(170): n is a, c, g, or t
  misc_feature (179)..(179): n is a, c, g, or t
  misc_feature (231)..(231): n is a, c, g, or t
  misc_feature (247)..(247): n is a, c, g, or t
  misc_feature (268)..(268): n is a, c, g, or t
  misc_feature (319)..(319): n is a, c, g, or t
  misc_feature (323)..(323): n is a, c, g, or t
  misc_feature (352)..(352): n is a, c, g, or t
  misc_feature (559)..(559): n is a, c, g, or t
gggttggtttgtgtananaggcgtgacnagcccgttgtccggagtgcacccgccgcccgttccgtcccccccnggagcccccnccgccgtcgccgtcnantcgccaaggaagtgcanaaaaangcacagcgcatcaagacccngtcggtgtggaanatgtatcactcccncatgcagcncggtggcctgcggctgcaccggaaacagcagctgtcgctggtcatgcgcacncccgggagccctaccncccggccaaggtggaggcccncgagcccgaggtgtcgttgccggccgccctcccccctgacccccgcctgcncccnccccgaaaagccgagtccacggccgaaanaacgacccccgacggtgaacccccgtttccggagccaatggacacgcaggaggcgccgacaaccgaggagacctccgcctgctgtgccccgcgccccgccaaaatcaaccgcaaacgacgcagcacagcctgagcgacggcggggaagctggactggtcccgaacaaaaaaccccgtctggaacaaaaagaaaaagaggagagagcntatccgca

SEQ ID NO: 648717 - DNA, 767 bp, Homo sapiens
tagaccatgtaccctaccagcggcctctcagccctccctaatgacctccggcctagccatgtgatttcacttccactccataacgtctcctccatactaggcctactaaccaacacactaaccatatcccaatgatggcgcgactgtaacacgagaaagacacataccaaggcaccacacaccacctgtccaaagaggccttcgatacgggataatcctatttatgacctcagaagtttggttgcttcgcaggattattctgagccttttaccagctccagcgctagccccataccccccaaatgaggagggacactggccccaacaggcatcaccccgctaatactcccctagaagtccacaaatcgcgtaaacagcatcgcggattactcgcatcaggagtatcaatcaacctgagctcacgatagtctaatagaaaacagaccgaaacaaataattacaagcacgcttatcacaactttcacgtgggtctctattttaccctcctacgagcctcagagtacttcgaggtctcccttcaccatgtccgacggaatctacggctcaacataataagtagccacaggactaccaaggaactatcacgtcattataggtcaactttcctcactatctgcttcatcgcgccaggtacctatttcaacttaaataccaaaacatcacttttggctttcgaagccgcggctgatactggcatagcagatgtggctgactaattctgatgctccctctattgatgaggtctt

SEQ ID NO: 648718 - DNA, 843 bp, Homo sapiens
aagttctcagttaatgttatgttgcttaacctggcaagtctaaaagcctttctttaaccttgtaggaattagacttgccaggttaagcaacagccaagtttctcagtaatgtattgcctttgattatatctttatagacttatcatatttgccagcatctcaaaactcccagatcttccttgcatttatagtccttcaatcttttcatgttctgcagccaggcacagggtcaaaagcaaggcaacctcgcattcgactgtattcaactagtcccatgggctgcagcacggggcatctcttttcttccatcactcgccaatgtttgctaagcatcaccatgcatccagcacacccagcagggttagggcaattcttgcaatcaccttcaacagtgctcgcacaatcctgccagccctggtccctcaaggcaccagttaacagtttgcactcgtacacacactttcattttcaacaaaggtttattattcttttcacatttcaacatgcaacatcggggtttgcaagtgcaaccatgcattttgtttgaccatgtatcgtgcaattcacagatgcaacatgccattggtcagaatcgtagtgatggtcttctagtcgataccttcaattgtttacattattccccagtcttctgtcatgtcatctgcatagacacaacgaacaaaaacaaaactcctgctttgttcttattggaagggtttcccaggactggtgtctgctcctgagctctgtattacgtcctgtgatcctttggttgtcattgtaataaaaaaaatagcaaaaagacaacacaaaaaagggggggacaaaaaccccaaggccaca

SEQ ID NO: 648719 - DNA, 219 bp, Homo sapiens
acggcgtccccactagtgctagagccgtcgacctcgcggtgagcttcgaaatgttcagccctagagtgctggtaaaggtaactaacagtgttagggttgactatagttatattctttaacttattgaatagattgggtctctgtagtatgagccaagcatacaacctaacaactgatgcttagctcccattgggttaatacttcaggccaagcaagcta

SEQ ID NO: 648720 - DNA, 1118 bp, Homo sapiens
gggcctgctcccgccggtgggctccttgctcgtgccgtgggccgctggccatgggagaggcctgaggtgtggctggctggggtgcgccgcatggcgcacaatggtgccctggggcgaggcggccaccagcccggcggaggagacagtggtgtggagccccgaggtggaggtgtgcctcttccacgccatgctgggccacaagcccgtcggtgtgaaccgacacttccacatgatctgtattcgggacaacgttcacgccacgaacactcgcggcgcgcacggtcccatccaacggctcactctcgcgcgaaccatctgacgcaccaatgtaccgacactgcacggccgcctgcactgagtcttgaccattcttccattcccgaatccacgagaggaactccgtcccttccagcaacgagactcatctcaggaaggtccgcacgacaggcaccacgctcgaccgcactcccacgacggaccacgcacacacgacgcgaccctcgcacgcgccccacccgccacccccccacctctgctccccctgcaacacccttcaccacatctatcacacacactcacgccaccacaccccctcaccacccactccacccccaccaccaccacacaacacacccacacacacccaccacaccccacacacacgaccccaccaacacccgcaacaccgccaccccgaaccccaacgcaccacccccccgcacccacacaaccacacacacacccacaccccagacgacacacacaccgccacgacgcagacacacccaccgacaggcaacgacccgcaacaaaccggcccacgaaccacgcaccaacaacgcaaacgcccacccccgagcgccaccacagcccacccaccccccaccaccacacacaacccccgcgaccccaacagactccgtccacccccgcgccggcaaccacccccccgacgccacccacacacccaccaccccaccccccacacccaaccaacccacccccgcaccccacccccacacccccccaccaccacacccccccaccaaccgaacccccacacccccacacccaccacaccttcccacacacagactcccaccaccacacccccaatg

SEQ ID NO: 648721 - DNA, 356 bp, Homo sapiens
  misc_feature (137)..(137): n is a, c, g, or t
  misc_feature (225)..(225): n is a, c, g, or t
  misc_feature (231)..(231): n is a, c, g, or t
  misc_feature (253)..(253): n is a, c, g, or t
  misc_feature (256)..(256): n is a, c, g, or t
  misc_feature (261)..(261): n is a, c, g, or t
  misc_feature (348)..(348): n is a, c, g, or t
acttcctggctgcgctctacggccccgccgagccctaccgctcccacctgcgcaggatctgcgagggcctgggccggatgctggacgagggcagcctctgaaccccggcgccgcccaagcgcgcccctcgcgccttntggggctctcctgctgggcgcgggtggggttcgtgggtttttttccacctcttttctcccgaatcggactccggccaaactcccctangacagnatggggttggaaccgtggttcntcnccttntgtgacgacggactgctgaggcatctggtagcagctggtttcaagacaccaatggtcaccttctcctccttggcccccgtgcccaantgggccgc

SEQ ID NO: 648722 - DNA, 111 bp, Homo sapiens
agctgcagattgtcaagaggattcttacaagtcatgactatcaatgattagtgtggttctcagattgccagacaaggaatatgctttcatagtacgtcagattatgtgcct

SEQ ID NO: 648723 - DNA, 578 bp, Homo sapiens
tgatttctgcaacctccagatttctttcttgacccttcaaagtggaacagtccagtgccaaaaattttagagtttgagaaggtcacagaaatcctctagttggggcctccacagtcttcattttacagaggaactcagggctaatggagttaatgcaactagatcagggttttgggtctgggttctttctaccgtcagcacctgtgtggtcaattctggacactttcccagagaagtctttgagtagagaatccctactcaaattcactgtatattttaagcattcctctcctttcccttggcctcccctggtgccttttcttcccctgaattctcctctgggcatcttcttttcccttttgggtgtaagccatgggaaaagggattaggggaggacagcttctgggtaaaacacagggcccttttttcacataaaaagaacattggctttcctgggacaaaaaggcctttaaaggaggggatggaaagcatgggaaaacgggtctgaattaattataccccatccccatgaaacaaaaacttaggggaaagggggggggggccaaccactgtttaaa

SEQ ID NO: 648724 - DNA, 203 bp, Homo sapiens
cattggatgttggagaaaatggatttgaaggagttcgacttggcctgccctgttgggctactagattacctggacaagccactgccagatgaccttctgaccacgcttggactcactacttgtactctcttttgctccctcctagatccagtgatgactaattacatgcagtccccccccaggacggctgtagacccaagttt

SEQ ID NO: 648725 - DNA, 839 bp, Homo sapiens
  misc_feature (216)..(216): n is a, c, g, or t
ggctgcgcccggaggggaagcagagcggacgggcgcgctgggaggcgcgcagagcttccgggctgcaggcgctcgtgcgcctggggaaatggggctgtgggccgaggcgggcccgggcgtgggcccttttaatccgctcggggtgggggcccccaattccgttttggggaaaaactttttttaattccaggacgggaaggtttctttcggcccaanattttccggggttcggggacaaaagagcacagcgcggcagaaaagggccaggggagaagagagacaactggggaagatactgccagccaggtagcagaaaggggcccccaccaagaggagttagctcgcctggatgacaccaggaaggggagcaggcacccccgggggagagcaatggggaagcgggggtatcgcggcgacttggtgggggcccacgaggcatgtggggcggaccccccgggaaaacacagcgggggagacggtctcggggaggcccctgtgggtgtattggtctccagagaacaccgcgccaagaggggggggagggacttcaaccacatcttatgttggaaagacgggcccccacccatttcctctagggggggatggaaacacaacttcgtggtgggcgccaactacgtgtggagaatcccacccccctatgttgatggggtgggccactctcgctttgtggggcaccccccaccgtgtggtgtgagatcatatatcaaacaagacccccccccccagcggatgggattgaatggagacgctctcaatcatcatgagaataagatattatttcttcatccatattattcaccaacaacaacacgtgtggg

SEQ ID NO: 648726 - DNA, 423 bp, Homo sapiens
ggtgtctctcacagcgggagaacttgaatttgcttggagacctaacgatatgcagtgagcttaagcccttccaggagcttaccaatcagtcgtcccttattcatccccaagcaaacgtatggtggtgttgtggtggaccattactgaatactctgccaagttacttggcgtgggacttgagctctaatccaattggctatctccctttcaccctggtatttcatccagaaaacatacataaaaacagaacatcataaaacaatggatgtccctcgtgactctcatgtttatatagatgccattggaatcccacgaggagtgccagatagatttaaggcccaaaatcaaatagctgcaagtttgaatccatgttgttctggtggtcaactctaaataaaaatgtagattgaaccggatagcttg

SEQ ID NO: 648727 - DNA, 914 bp, Homo sapiens
ggagcatgtttgagaccttcaacaccccagccatgtacgttgctatccaggctgtgctatccctgtacgcctctggccgtaccactggcatcgtgatggcactccggtgacggggtcacccacaactgtgcccatctacgaggggtatgccctcccccatgccatcctgcgtctgacctgtcttggccgggactgattgatacctcatgaagatcctcaccgagcgcggtacagtttcaccaccaaggccgaagcgggaaaatcgttgcgtgaacattaaggagaagctgtgctacgtcgccctggacttcgaagcaagagatggccacggttgcttccaagctccctcccctggagaagagctacgagctgctgagggccaggtcatcaccatggcaaatgagcggtccgttgcctgaggcattctcccagccttccttcctgggcatggagtcctgtggcatccacgaaatacttcaactccatcatgagttgtgacgtggacttccgacaaagacctgtacgccaccacagtgctgtcgtggggcaccaccatgtgaccctgatttggccgaagggatgcaacaggacgattcactggcctctggcacccacgaagcatggagatcaaggatcattggtcctcctgaagcagaaagtaaccccagggggatcgggcgctccaatccttggcccgttgtccactttcagcaatggtgtcacgacagccagtttgagatccggccctccacttgaccgggaatgtttcaggggggaatgactatttcgtcaccctttttggaactctattggcaaacaaagagtgggggacatggcggggcggctacggcgacacgacagcaggaggactgggcaccccacaatggaggagtggtactaagtaggaacacctg

SEQ ID NO: 648728 - DNA, 202 bp, Homo sapiens
gcaccgatagcctgataggagtaaacgaagtggaccctcacaccaactgcgtcatgcgagtgataggagctgagatctgctcatgtcttgctcttgtctcttgctcagggtcgtgccaccagctcagcaggtgtctgtagtcaccgctgtgtcttcatttcatgcagctgagggtctgccgtacatcttcttgaagaacact

SEQ ID NO: 648729 - DNA, 709 bp, Homo sapiens
  misc_feature (1)..(1): n is a, c, g, or t
  misc_feature (483)..(483): n is a, c, g, or t
ntattagtttggagagccaggttataaaggtctctttaagcgaaagccaaaagggggaattcctttggggcagatcttcaggttcccaaggcttaatcccgggttgtgacccgagccctaccaagaaatttgtctcgttaaggccaggtttttttcaaattgggattacgctccataaataattgaattttaattgggagagaggtccaaaagcgggcaatcccgctttattgtgaggagcaaggcggggggtttttccgaaactagtggatttagatcaatggggcccactcaacgagaatttgtatctttgcaaacaaaaaaaccaatgtcaacttcgatatttgtcttgaaacattgtttaagaattaaaaaggcaaggaaaatcttttccacctctataccacggggttctacatttcttatagttcagtgtcatatttcatatagtaaaccaagagagggctttagaaggtgggaatnttacaaggtcataaagagtgttttttaaaggttatctccaaagggggtgttcaccccttttttgaaacccgatgtggtcggttataaactttcatatagcggcaaaaggcttacgttggttgagactaagtaaatttgggggacaattatcagctaaagcatgtccgagtagcttttttgtagcagtaacgttgttttcccgccttggccataaagcaaataaggt

SEQ ID NO: 648730 - DNA, 195 bp, Homo sapiens
ccataaaattttctagaaatccccttttttccaaagtgtaggtttgggaatagattttggcatgatgaacctgtcataatggtgaatgttccttttgggtaagaaaccaaactaaaggtggttgtccccctaaaatttaattggatattgatgaaatcatgggcctggcaaaataaaacttgttgctttccccca

SEQ ID NO: 648731 - DNA, 190 bp, Homo sapiens
ctcgaatcgacggttcctgtgctaagaatatggagatgattttatgcctgggcttttctcttctcaggaggagtgaagctcagaaatactcctccatctgattttgatgcacaccagtccatgcttggctttgatgcaagttactgcgagaatacactaggcatgcctagaacagatgggctcgacttac

SEQ ID NO: 648732 - DNA, 391 bp, Homo sapiens
  misc_feature (9)..(9): n is a, c, g, or t
  misc_feature (22)..(22): n is a, c, g, or t
  misc_feature (62)..(62): n is a, c, g, or t
  misc_feature (64)..(64): n is a, c, g, or t
  misc_feature (391)..(391): n is a, c, g, or t
agctgggantacaggtgtgagngatcacacctggcttctttttttttaataaggtaacattnanaggttctagggattaggacctgatatctttgggatgttatttttctgcctaccatactgggttaccttgggcaagtgactttcatcagtgtgaacttattttcttatctgtaaaataaaaatgattatcaaatattctgtactaaattgccatgagatttaaatgaaatcttgcctgctaagcacttggaaatgggccaggtatgtagttgatgcctggtatccagaaagcattattattacgtaaacatatattttatattactattatttagtcatcttctgtgaaagggagaggatagttccttaagagtttgacctggcagan

SEQ ID NO: 648733 - DNA, 843 bp, Homo sapiens
agcgggtctctggcggcagccggagcttctggtgtagtcttcactgctctgtgtcttctgctcctagaggcccagcttctgtggcctcgttacctgcaggtatgggagatccacagctaagacgccaggacccactggaagcctagaaatggtgagagtgccgggtccgacatcccgagagagggggcggggctggttggaactggtgggaagtggctgtggcgggactctggcctccccgcagctggctccaaaatccgcggccccgagttctccttggcgcagctcggccctcagtccccttcagccataggatggcggccgggctgacagctcggaccccgggcatcctgtctcctccctgcgcagtgactgtgccttggtctggagtcctctgtgggcagctctgccccaacagccgcagctctccccgattgtgcagggatcactggacggtcgtcaggggagaatactgactcaggatgcagagttcatgaatgggaagagctttggtctgcggggttcccagtcccctttttttctattaaaaatttgtggaagtctccgcagaaatattaagaattaattaaagaggtacttcacgaattggtagagcacccagctatgttggtaagtgggtttatggaagggctgaagaaaacactttattaaggtgctgataacgaagcaaatccatatggtaggtaagtttgggcttctaatgtcaacagggggaattccgccgtaaggcagtcatggagtaaaggtacgtaatttttccccggttctaaaactcccgtattcgcggacccggagcccctaggggcattacaacgaaaccta

SEQ ID NO: 648734 - DNA, 377 bp, Homo sapiens
  misc_feature (26)..(26): n is a, c, g, or t
ctctcttcatgtcgcgcttcacaatntgagatctttcaagggtccaacgttcgacagcagagagccagcgtcaccagaatcaggccattaagtgagacacatcaattccaatctgtgtgagtgtgacccaattattcttaaagtatcagaacttctgccaaagccacttggtaagtccacggcgtcactattcttccagatcttgctgtatcgatattaactgcaagatccggatctactttcggtaacctgtttccttgcacagctttagcatagttaagccccgatacacgcacttgagaacattatagactttaatccggtacccgcgtagtgtcagaatctgtacagctgattcacaccacacaatatctgag

SEQ ID NO: 648735 - DNA, 158 bp, Homo sapiens
ttatgagcgaagtagctggcgtgagttcgtgtgaggcgaggcgaggcggccgtttcccttccggagctcttaggctctaattgtttatcttttgtgtataatcccaaaatattgaattttggaatatttccacccattatgtgaacaaaaaaacaccc

SEQ ID NO: 648736 - DNA, 298 bp, Homo sapiens
aatgcttatctaattgcctcctttggagaggctcatcagaaactcaaaataatgcaaccatttgactctcacctacctgtgacctggaagatccctctctgcttgagttgtcctgcttttctggatggaaccaatgttcatcttacatatattgattgatgtctcatgtctccctaaaatgtataaaaccaagctgtgccctgacccccttgggcacatgtcgtcaggacctcctgaggctgtgccacaggcatgcagcctcaaccttggcaaaataaactttttaaattggctgaga

SEQ ID NO: 648737 - DNA, 930 bp, Homo sapiens
  misc_feature (492)..(492): n is a, c, g, or t
tatagtttgggccctccaaggcactgcgagcatgagtataaatgctataaaccttatgaaaaacatgagtttgaaagtttttatgttttgttttgtttgtttttaaagagatgggggtcttactgcgttgtccaggctggagtgcagtggcttttcacaggtgcaatcattgtggcacgtcactgcatgcctagaacttcctggtctcaagccatcctctagcctcaggcacacaatgtatgctgggactacaagtgcaattggcagctgtctcctgaatattaagcttttaattttttgtattcggtcactcgttgatagcagacattgactgaaacagaaaattaaaagctttattattcaaaatgttgcaaaatgaagctgggtgtggtggtgcacgcctatagtcccagctacttgggaggctgaggctggtaggatgtgcttgtaggtcaagtattgggaggctgtgagtgtacctagtgatggtgncgtatagggaataggtattggagatccaagctggaaaatcgttatcaagagccatttcttagaaaaatgcctgttgacctggcaagaacatggggtggggatagtgataaggcggtaaatccagtaaacccgggaaggccgagctgcgcacgacagcgtggacgggcaagattgcagagcacactagggcagcacaagggtggccctgcgcggtggacaacagcagcacacaacgggggaaaggggacagtcgattgcatatcccccactcgggggaaacggcggatgctcgaaacccggcggcgacaaaggtaggaaaaacatgacatccgggtgaagtgctcactgaaacaagtaacgatgggagcggctatacaaacaagcgcgcatagcaaacgcacaacgctatgatcgataccatactgccatcgagaggga

SEQ ID NO: 648738 - DNA, 520 bp, Homo sapiens
cagcgcctgtatcattgcaggcggcatatggcaataggtggaggcgctggccttgcctatgcactgggcctcgcgtgaggttacgcgctggatcatcggctggaacgtacgcgcctgggactacctgctgctggcaggatggatagatggcgcgctcaagccgggcccagatccagcggcgtgcgtgccagcaggacgatggcgctgtggcgattctgacgctcgtggtgatcgcggcgctggccagcctgggctctatcgtggcagagttgtccgtggccaaggatttcaccggggcggctcgcatggcgcacatcgccctggcgggcggcaccatcctgtcgtcctgggcgttcacgcaggtgatgttcgcgctgcactatgcgcacgactttaattcggcacggcgccagtggcagccaggcgggttgcagttccccgacacgcccgaaccggactacctggaatttctatactttgctgccgtgatcggaacatcgggacagacggccgacgtgtc

SEQ ID NO: 648739 - DNA, 154 bp, Homo sapiens
ctcgacgtcggacatagctcgcgacgctgatgcaacacgacgtgctcagtggtcgagaggcaccgggcacgtccggtagtttcgctgtcaacgttgggagcgatgcgccaacgtcgagcaagcaggtcctacgtcactgagatgcgcccagatt

SEQ ID NO: 648740 - DNA, 641 bp, Homo sapiens
agcggaggggtccacccggactacgaccatgtaggggtatagtgggtcgggtggccgctgctccgagacctccgagggaccttgcggagactcaccccttcagcagtcgcatgaaccccagaccgtcagcatcatatacatgcagggccgacgatccggacgggcgggtccagtccgcatgatcaggtgactagtgcggacgacaacacactcgtccgtatcgcgcaaaaaggcaggacgcacgaacaccagggacgcaatcgaagggacggacaatagggcagacagatggaatggaacggtccagaattaagactgcaggggaacataacgcacacaacatcacgtaccaaaatgaccacatgaggaagatgacaaaggacaagaggaaagcacccgaggaccatggaatacacggagcagcggatggcacccacacaactataggagaatggaggagaccaccaaggataacgggcacatcattggccgtactgagcactgggtcaccagcacagggcactaggaacagcagaagagaccccagacaagatacatgggaacttctgggatggcacacaagtcaaaacataacctgcatagagatccgtgaagacctaaggaggcagacagtcatgcaa

SEQ ID NO: 648741 - DNA, 370 bp, Homo sapiens
  misc_feature (20)..(20): n is a, c, g, or t
  misc_feature (28)..(28): n is a, c, g, or t
  misc_feature (61)..(61): n is a, c, g, or t
  misc_feature (70)..(70): n is a, c, g, or t
accaagctgcatggatgccnaaaccgtnccctggtggaaaaaggccgcggtgcctgcgggnccgctgtgnctggctgccaggcctgctgcatgctggccatcttcctgagcatgctggtctcctaacctgccgccggaacaaggcaaggaaggccccacatctcctacacacatgtccgacccatctcaactggaggcctgagactacctaagaccagaatttaggagaaattggttctaatcttgattctaaatctaactcactgtgtagcatgatgcaagtgatttctccgccttggacctgcttcctcatctgtaaaataagggcattgaacttgattcaataaatgctagttgagtatctactcta

SEQ ID NO: 648742 - DNA, 165 bp, Homo sapiens
ccggtaggcgtaccaggctttggtagtcttgggagaatggtacaacgggatgattttccatatggtcccgtggctcttgttgaactacctgcaaaattacttgcaataccatcaccgggttcacctgttaacctctgcttaacaaactgacccttaactggcaag

SEQ ID NO: 648743 - DNA, 355 bp, Homo sapiens
aacgaagcccacgttctggactggcctgggttcactcacactgtagtcttctcgggggaactagctggaaacgcacctgtacccacaggaaccgtgcgaggccaaggcacaatgggtctcttgcgttgttccaggaacaaagggaacccatgctcatgtccttcagggccttaaattatccagccacttctcttggcttatggcttatccttcaggggctcgggacctggtgctgcctccttccaggaagcctacccgcagaatagatgctccctgggacctaactctgtgggcttgccatccccaaaccttaagtctggtcaccaggtggtcctggtcctatccctaagccaag

SEQ ID NO: 648744 - DNA, 227 bp, Homo sapiens
  misc_feature (8)..(9): n is a, c, g, or t
  misc_feature (30)..(30): n is a, c, g, or t
  misc_feature (46)..(46): n is a, c, g, or t
  misc_feature (148)..(149): n is a, c, g, or t
  misc_feature (189)..(189): n is a, c, g, or t
  misc_feature (226)..(226): n is a, c, g, or t
ctgcaggnntgaagaaaactggtgttagtntttctttaaatatttnttagaattcagctgtgcagcgatcgattcctggctgtctctttgttgggagactttttattattaccttgatcttattacttgttattggtctgttcaagtnnttctatttcttcctgactcaatcgtggtaggttgcatgtntccgggaatttattcatttcccccagtctttccagtnt

SEQ ID NO: 648745 - DNA, 404 bp, Homo sapiens
tgcgggtgatctagaggatcctgaagtcacccgcgtacgctgagtcgataatggcgagcaccgcggtgcgctcggtcatcaggcggccgctggtgatttgcaggctgcccaggtcgccggagtcgatagccacggccaccagcgagaagggaataccgttcaggcctggcaaatattgcacgtcgctcaacatgagtttgtgatccttgggcagcggctggatcgacggcaactcaatattccccgggtttaccagcagcagtggctgtttgtcgggggcggcaatgctcagcacggattcgcggttgcccaacatgttctggaacagctctggcttggtcttgatcaggtccagggtattgctgtcgttgagcaggttgcgtaactggtccacccgggatatc

SEQ ID NO: 648746 - DNA, 130 bp, Homo sapiens
gggatgatgaagtttcaaaggatgctaacccaaaaaaaaatttttttcttttttgagacttgctctttttttgagtcttgctcttttgcccaggctggagtgcaatggtgcgctattggctcatgggagg

SEQ ID NO: 648747 - DNA, 1014 bp, Homo sapiens
ggtttcaagccaaccccatggcctccatgactttttcaaaaaaaaaaaaaaaaaaaaaaaaaaaatttttcaaaaaaaaaaaaaaaaaaaaaaaaaaaattggggggggccggggacccaagaaaagtttctaacaccccattcggtggggcgggcggcggggcgccccagagtaggtaatgagtaagcaacagtgcgcccaaaggctgcgtcccaagggaaaaacccggtcgccaagaagaggggggtgggggtctcttcccaccaaaataaaaaaacgcgcgcggggggggacccaccgaagcggcgtctgagaccacacctcaaggagggggctcggggcgggcaaacaccgcggcctcttaccaacacgggcggcctccaacggcgaggcgccgcgaaattaacaaaaattacgcccccccggcggggggggagacatcacaaaaaccagaagacacaaacacatacatgaacagacagacaacccagacaagagtagaaggagcaaggaaaaagcagagtaagatagaacagggatacaaaggacgaacaccgaaccgagtaccacaaacacacatacagccagacggacgaataacaagtccaagagcgaagccaagcaacaatcgagacaagctagtcaggactgaaacaaaaaagcaggccaacaaacgaatagacacaagacagagaacaaacgaaaacaaaagaaaacacgaagtaaacacaacaacacaaatatgcgtgatccagcaacggacaacaacaacagccgacaataaaagcgcgaataccgaaacactgacaacaaaaaagagagaaaaaaaccggaagccaaaaaccacgggacacacacacgaagaaacacacagacatggctacaacacggggagaagcagaacaacacaacacaccgcaacgccaaatgagcaaaacaagcagcacaaacagagaaaaagaacacaggctacacgaatcacaacacaaacgcaccaaaaaaacacaggcgta

SEQ ID NO: 648748 - DNA, 492 bp, Homo sapiens
taccctatactgcagtgtcgtccctctgttgtgtctgtgtcctcatctcctcttcttatgagatgtcttactccatctcaggctgctgtcacagaataccagaggctgggcggcttagaacaaaacgcattgattctcccacagccctggaggctggaggtctgagatccaggtgtgggcagggctggttcctcctgaggcccctctcctgggcttggagacgccgtcttctccctgtgccctcacagggtcgtccctctgtgcgtgtctgtgtcctcgtctcttcttatgagatggcttagtccatctcaggctgctgtcacagaataccagaggctgggcggcttagaaacaaaacactgattctcccacagccctggaggctggaggtctgagatccaggtgtgggcagtgctggttcctcctgaggccactctcctgggcttggagacgccgtcttctccctgtgtcctcacagggtcgtccctctgt

SEQ ID NO: 648749 - DNA, 441 bp, Homo sapiens
tgagaacattgattgatgagaggactgtctatagtaaatggggctgcatcaatgtatgatcacgtgatcgatcaaaaataaaagtacagactatcataaaccagacgcaaaaatcaactcaaaatggattaaagacttaaatgtaaggcctacaactctgaaactactagaaggaaacattggggaaacactacaggacagtggtctgaacaaagattttttgagtaagacctcaaaagcacaggcaacaaaagcaaaaaattaacaaagtgaagagacaaccttcagaatgggagaaaatatttgcaaaatatttggatatttgaccctcaaaagcctcatgttgaaattgaccccagtgttgcaggtggagcctaattggaaggtccacttccaatgggttataggggcagatccctgatgaatggcttggtgttgacc

SEQ ID NO: 648750 - DNA, 241 bp, Homo sapiens
gaaaaacctcaaaatatgatggtggttggacagtcagcatttgcagactttgatggagatggacacattggatcatttactgccaggctgtaaagataaaaattgccaaaagagtaccatctacttagtagatctgggatgaagcagtgggttccagtcccacaagttttcagcataagggcacacttggggcttttcccattttgggagcacacacccattaatacatttcattacctta

SEQ ID NO: 648751 - DNA, 409 bp, Homo sapiens
  misc_feature (47)..(47): n is a, c, g, or t
  misc_feature (68)..(68): n is a, c, g, or t
  misc_feature (83)..(83): n is a, c, g, or t
  misc_feature (108)..(109): n is a, c, g, or t
  misc_feature (144)..(144): n is a, c, g, or t
  misc_feature (152)..(152): n is a, c, g, or t
  misc_feature (189)..(189): n is a, c, g, or t
  misc_feature (198)..(199): n is a, c, g, or t
  misc_feature (228)..(228): n is a, c, g, or t
  misc_feature (269)..(269): n is a, c, g, or t
  misc_feature (273)..(273): n is a, c, g, or t
  misc_feature (275)..(275): n is a, c, g, or t
  misc_feature (277)..(277): n is a, c, g, or t
  misc_feature (282)..(282): n is a, c, g, or t
  misc_feature (284)..(284): n is a, c, g, or t
  misc_feature (286)..(287): n is a, c, g, or t
  misc_feature (291)..(291): n is a, c, g, or t
  misc_feature (309)..(309): n is a, c, g, or t
  misc_feature (312)..(314): n is a, c, g, or t
  misc_feature (317)..(317): n is a, c, g, or t
  misc_feature (319)..(319): n is a, c, g, or t
  misc_feature (323)..(323): n is a, c, g, or t
  misc_feature (326)..(326): n is a, c, g, or t
  misc_feature (360)..(360): n is a, c, g, or t
  misc_feature (366)..(366): n is a, c, g, or t
  misc_feature (373)..(373): n is a, c, g, or t
  misc_feature (376)..(377): n is a, c, g, or t
  misc_feature (387)..(388): n is a, c, g, or t
  misc_feature (392)..(393): n is a, c, g, or t
  misc_feature (396)..(396): n is a, c, g, or t
  misc_feature (402)..(402): n is a, c, g, or t
gtcacggggggggggacggggacggggcaacagcgcaggggccacanggagaagaagagatcgataanctaggggtttgtgtngtaaatcttacaaagtgtataaagnntctcgtgtttctctacattaacaaaaaccaaatgntacaagancggttgtatatacaaaatcacggagatattgcttcanttgcaaacnngttccagaccagatggggagacgagacanatgagggggacagggagggccgagagggcgcgttgcgtgcnggcnangnggggngngnngggngggggggggaggggcttntannnttnanaagncgnttgctaatttaacttgggtatgtctgatgataantaaaantctgatnaannaaaaacaaanngttnnttnagtggntgggata

SEQ ID NO: 648752 - DNA, 960 bp, Homo sapiens
  misc_feature (399)..(399): n is a, c, g, or t
  misc_feature (960)..(960): n is a, c, g, or t
gtgctgcatgcctgtagtcctagctactcgggagcctgaggcaggagaatcccttgaacccggagggcagaggctgcagtgagccgggatcgtgccactgcacttcagcctggtgacagcgagactctacctcaaaaaataataataatgataataatatgacctggctaggcatgagtcattacgggctcacacctgtaattccagcactttggtgttgaggcaggcagattgcttgagcctaccaggaggttgagaccagcctgggcaacatctacaaaaaatacaaaaaactaaccaggtgtcattggttgccttgccttgtgttcccaatcatactcaggaggctgaggtaggatcgcctgagcctgggacattgaggctgcagtgagccacgantgcaccactgcactgcagcctgggtgacagagcaaagccctgtggaacaaaaaaaaaggtgcctcaagagggctttaaagatccattctgccctgggtcctttcttcccggcgtggttcagttctccccaattctggtgacctttgtgcgaggtgccaggctgcagtgccgtggttgcctgaccagggttccccaaccaggttttgcgccacaggaatcctcatgcttcccagggcacccaggcgaatttcctttcttgtggccttgagtaataataccgtgagcgtgccccaggtgccggggctcatgacaattgttgaacccacgtgtctcatagaggccagcagccacctgggagtagtgtggggtccttgtccccggttgaactctaattgttctctacaattgtcttaactgagttttcgaatacagtctggtttcaccaaaaaaaaaaactcgggctttgtcgggggcaagggtagaatggcatggcataggtcggcccgtgtgaaggggatgcggcgccatgggtatcacaccgtctactataaaaaaaaaacn

SEQ ID NO: 648753 - DNA, 303 bp, Homo sapiens
aagctgcaggaggagattcagttgcacggaagaagcagagaccactttggctgccgtcggagcggacgtggatgcagctactctagctcgacattgacctggagcgcagaattgaatctctcaccgaggagatcgcgttccttcaagaaagtgcatgcaagaggcagcatccgtgcagctgcaaggctccagcttcagagaacagggaggtcccaggtggcagcatggacatgtctcaagcctagcacctccactgcctgcccctccagggcatcatcctggcgctccagtcatgcagcacca

SEQ ID NO: 648754 - DNA, 761 bp, Homo sapiens
  misc_feature (145)..(145): n is a, c, g, or t
  misc_feature (150)..(150): n is a, c, g, or t
  misc_feature (180)..(180): n is a, c, g, or t
atccaattattgaccaaatcccaaggtaatttttaatttacatttttaataaaagcaacttgttgaaaccaagagagggtgagattacctttttgttaaagtattttcccagtcaaagacaggaagagatcagagtgaatgtgcnttctnaaccagagctacagaatttagtgaataatnaaagtacaaactgctttgacctccttgaacttttccaagcaatttctctgtacttctatatatgaatgtcttagccaattttctgctactataacagaatacgacagactgggtaatttaaaaagaaaagaaatttattttcttcctagttctggaggctgggaaggcgaagggcatggcactgacatctgccttgtaactgatgagaaccttcttactgcatgataacaaagcagcaaggcaagcaaaagcgtaagatgaagagagaggaaatgaagccaaacacatcctttcatcagaagcccattccctctataaggcgttactacatttatgagaatggagtcctcatgacctaatcgtgaccttaaaggcccctcccaacactgttacaatggcaattaaatttcaacaaaggttccagaggtgacattcgaatcagcaatgaaattttcatagttaaatttggtattcgtggggaaagaaatgaccatttcccttgtatttttataattaaatcagcaaaatattgtaataaagaaatctttcctgtgaagataccatgaccccaaaaaaaaaaa

SEQ ID NO: 648755 - DNA, 212 bp, Homo sapiens
ggagtaggcacagatgatctgaaggggtcatctatttaaaatgtctgcaattctcagttcaactggacagtcttaaacactgtcaggcactgtaccccaatgagaaaattaggcccagagaagaaaacctcaggcttgagagccctgtacccctcctcaatcgctgccacctgggaccagtgccatgtgtggcatcgataaacaccgtggag

SEQ ID NO: 648756 - DNA, 383 bp, Homo sapiens
atctactgtaatttatagaaaccagtgttccatatctgcaagtgaaagtgaacctcaaattaaacaattataagaaaaaggtaatgttctagctctgaaactttccgaggacaatgaataaaataactggaaattcaagttggggccgaagtttaaagactttagtttgggccgggcgcggaggctcacgcttgtaatcccagcacttggggaggcgaggcgggcggatcacgaggtcaggagatcgagaccatcctggctaacacggtgaaaccccgtctctactaaaaaaaatacaaaaaaattagccgggcgtgatggtgggcgcctgtagtcctagctagtcgggaggctgaggcaggagaatggcgtgaacccgggag

SEQ ID NO: 648757 - DNA, 489 bp, Homo sapiens
gttaaccacctactgtcagagtttataatcaagagaaaatagatgaacctgcctaggctcaagtcactcttctgtgaattgcaccatgaaagcaatatatacaaagtgctcaggcgataaatatatcagagtgattaattctgccctggaaaattacagaggagatatgtgagcagaccccgaagggtaaaaagatttcctcattttttcaacaaatatttattgattgcctaatgagctaggccctggggaaataacagaaaacaagacaccagtcctctcttttggagccctgcatcttaagacaaataagtacacctcaggtcgctttaagcactatggggaactcaaagcagggtgatgggcgagagtggttgcttggggtgtgtgcatgggcatgttatctttaggggagtcagagaaggcctctctaagaaggcaacctgagggaggagaggacaatgttaaaaaagagccagtcacagctca

SEQ ID NO: 648758 - DNA, 195 bp, Homo sapiens
tttgagttactcatcattgatgtttctcctgtgtgattagcgttatgtatgttaataaactctgtattcctcttgttaatctgcttgtccaattcgcagggccccagtcagagcacttaggaaagtaaaggaaaaaaagtatagtatttccctagaatccacactaaggtgcccctcaacacctaataaaagggc

SEQ ID NO: 648759 - DNA, 321 bp, Homo sapiens
ttctcaatgaactctccttctttgggtctggctgaaactgatgatctcttactctctatgccacggaattaacccgagcatgcatggaggcctctgctatcacctcatcagcagtgaacagttttgccaaagtggtctgggtggcctctggctctggcgtagtttttgcccctggccaggattgctacagttgtgatttgacagagcagccaagatgatgtccgtggcggacattgccaatggtggtggagttttgcctctggcagccttgtggctactctgcaatcactgggagcaactggactctccggatttaccaat

SEQ ID NO: 648760 - DNA, 678 bp, Homo sapiens
  misc_feature (76)..(77): n is a, c, g, or t
  misc_feature (81)..(81): n is a, c, g, or t
  misc_feature (87)..(88): n is a, c, g, or t
  misc_feature (92)..(92): n is a, c, g, or t
  misc_feature (104)..(104): n is a, c, g, or t
  misc_feature (106)..(106): n is a, c, g, or t
  misc_feature (119)..(119): n is a, c, g, or t
  misc_feature (128)..(128): n is a, c, g, or t
  misc_feature (135)..(135): n is a, c, g, or t
  misc_feature (140)..(140): n is a, c, g, or t
  misc_feature (142)..(144): n is a, c, g, or t
  misc_feature (148)..(148): n is a, c, g, or t
  misc_feature (151)..(152): n is a, c, g, or t
  misc_feature (154)..(154): n is a, c, g, or t
  misc_feature (156)..(157): n is a, c, g, or t
  misc_feature (169)..(169): n is a, c, g, or t
  misc_feature (176)..(176): n is a, c, g, or t
  misc_feature (180)..(180): n is a, c, g, or t
  misc_feature (184)..(184): n is a, c, g, or t
  misc_feature (193)..(193): n is a, c, g, or t
  misc_feature (200)..(201): n is a, c, g, or t
  misc_feature (213)..(213): n is a, c, g, or t
  misc_feature (217)..(217): n is a, c, g, or t
  misc_feature (227)..(227): n is a, c, g, or t
  misc_feature (309)..(309): n is a, c, g, or t
  misc_feature (311)..(311): n is a, c, g, or t
  misc_feature (319)..(319): n is a, c, g, or t
  misc_feature (326)..(326): n is a, c, g, or t
  misc_feature (330)..(330): n is a, c, g, or t
  misc_feature (345)..(345): n is a, c, g, or t
  misc_feature (350)..(350): n is a, c, g, or t
  misc_feature (353)..(353): n is a, c, g, or t
  misc_feature (357)..(357): n is a, c, g, or t
  misc_feature (359)..(359): n is a, c, g, or t
  misc_feature (371)..(371): n is a, c, g, or t
  misc_feature (383)..(383): n is a, c, g, or t
  misc_feature (397)..(398): n is a, c, g, or t
  misc_feature (402)..(402): n is a, c, g, or t
  misc_feature (432)..(432): n is a, c, g, or t
  misc_feature (438)..(438): n is a, c, g, or t
  misc_feature (448)..(448): n is a, c, g, or t
  misc_feature (470)..(470): n is a, c, g, or t
  misc_feature (474)..(474): n is a, c, g, or t
  misc_feature (481)..(481): n is a, c, g, or t
  misc_feature (490)..(490): n is a, c, g, or t
  misc_feature (492)..(492): n is a, c, g, or t
  misc_feature (495)..(495): n is a, c, g, or t
  misc_feature (497)..(497): n is a, c, g, or t
  misc_feature (519)..(519): n is a, c, g, or t
  misc_feature (526)..(527): n is a, c, g, or t
  misc_feature (529)..(529): n is a, c, g, or t
  misc_feature (547)..(548): n is a, c, g, or t
  misc_feature (552)..(552): n is a, c, g, or t
  misc_feature (564)..(564): n is a, c, g, or t
  misc_feature (591)..(591): n is a, c, g, or t
  misc_feature (638)..(638): n is a, c, g, or t
  misc_feature (647)..(647): n is a, c, g, or t
  misc_feature (667)..(667): n is a, c, g, or t
cccaaaccatctgctgcatttgatccaagctgtaagagcctcctgggccgctaatgggcagttaattgcaggcctnncgtnctgtgnncaanagctgactcttnangcgtccgcctggnacttgcggnctcactntagtntnnnctcntgnncncnntgtggtggtctnagtatangcgnctgnatacatgcnttatctnnagggcaagtgcntgcntcacaagccntgctagacaggaaaaagaagcaagatagcacactggggtttatgacatagctccgacctatcctcatattttaaatagccanancctggacncatcctncatncctgtcagcataagnatagnttntaananttgtgatattcncacaatagaatnctactcagcaagannaagnagtatgtttctaacacacatcatggataantctcanaagcatggtnagcaagataagttagatataanatanaatgtgnagttctagnanagncnaaatttctggtggtaaaaatcncaatagnnantacctttgaatggtgaanncagncaagacagcatnaggaaggaacttttctagagtggcaanaatgttctgtatactgattgggagtggtgtttacatgagtataaacntttgacaanaaagtttaccaggcaaggtngggtgtacttg

SEQ ID NO: 648761 - DNA, 620 bp, Homo sapiens
  misc_feature (23)..(23): n is a, c, g, or t
  misc_feature (41)..(41): n is a, c, g, or t
  misc_feature (82)..(83): n is a, c, g, or t
  misc_feature (87)..(87): n is a, c, g, or t
  misc_feature (93)..(94): n is a, c, g, or t
  misc_feature (98)..(98): n is a, c, g, or t
  misc_feature (110)..(110): n is a, c, g, or t
  misc_feature (112)..(112): n is a, c, g, or t
  misc_feature (125)..(125): n is a, c, g, or t
  misc_feature (134)..(134): n is a, c, g, or t
  misc_feature (141)..(141): n is a, c, g, or t
  misc_feature (146)..(146): n is a, c, g, or t
  misc_feature (148)..(150): n is a, c, g, or t
  misc_feature (154)..(154): n is a, c, g, or t
  misc_feature (157)..(158): n is a, c, g, or t
  misc_feature (160)..(160): n is a, c, g, or t
  misc_feature (162)..(163): n is a, c, g, or t
  misc_feature (175)..(175): n is a, c, g, or t
  misc_feature (182)..(182): n is a, c, g, or t
  misc_feature (186)..(186): n is a, c, g, or t
  misc_feature (190)..(190): n is a, c, g, or t
  misc_feature (199)..(199): n is a, c, g, or t
  misc_feature (206)..(207): n is a, c, g, or t
  misc_feature (219)..(219): n is a, c, g, or t
  misc_feature (223)..(223): n is a, c, g, or t
  misc_feature (233)..(233): n is a, c, g, or t
  misc_feature (251)..(251): n is a, c, g, or t
  misc_feature (253)..(253): n is a, c, g, or t
  misc_feature (261)..(261): n is a, c, g, or t
  misc_feature (268)..(268): n is a, c, g, or t
  misc_feature (272)..(272): n is a, c, g, or t
  misc_feature (287)..(287): n is a, c, g, or t
  misc_feature (292)..(292): n is a, c, g, or t
  misc_feature (295)..(295): n is a, c, g, or t
  misc_feature (299)..(299): n is a, c, g, or t
  misc_feature (301)..(301): n is a, c, g, or t
  misc_feature (313)..(313): n is a, c, g, or t
  misc_feature (325)..(325): n is a, c, g, or t
  misc_feature (339)..(340): n is a, c, g, or t
  misc_feature (344)..(344): n is a, c, g, or t
  misc_feature (374)..(374): n is a, c, g, or t
  misc_feature (380)..(380): n is a, c, g, or t
  misc_feature (390)..(390): n is a, c, g, or t
  misc_feature (412)..(412): n is a, c, g, or t
  misc_feature (416)..(416): n is a, c, g, or t
  misc_feature (423)..(423): n is a, c, g, or t
  misc_feature (432)..(432): n is a, c, g, or t
  misc_feature (434)..(434): n is a, c, g, or t
  misc_feature (437)..(437): n is a, c, g, or t
  misc_feature (439)..(439): n is a, c, g, or t
  misc_feature (461)..(461): n is a, c, g, or t
  misc_feature (468)..(469): n is a, c, g, or t
  misc_feature (471)..(471): n is a, c, g, or t
  misc_feature (489)..(490): n is a, c, g, or t
  misc_feature (494)..(494): n is a, c, g, or t
  misc_feature (506)..(506): n is a, c, g, or t
  misc_feature (533)..(533): n is a, c, g, or t
  misc_feature (580)..(580): n is a, c, g, or t
  misc_feature (589)..(589): n is a, c, g, or t
  misc_feature (609)..(609): n is a, c, g, or t
ggggttccccgaagctctcgtcnctagtgtagctcttgatntcctttctgtaaaggagtctttcagtttaattgcaggcctnncgtnctgtgnncaanagctgactcttnangcgtccgcctggnacttgcggnctcactntagtntnnnctcntgnncncnntgtggtggtctnagtatangcgnctgnatacatgcnttatctnnagggcaagtgcntgcntcacaagccntgctagacagatagccanancctggacncatcctncatncctgtcagcataagnatagnttntaananttgtgatattcncacaatagaatnctactcagcaagannaagnagtatgtttctaacacacatcatggataantctcanaagcatggtnagcaagataagttagatataanatanaatgtgnagttctagnanagncnaaatttctggtggtaaaaatcncaatagnnantacctttgaatggtgaanncagncaagacagcatnaggaaggaacttttctagagtggcaanaatgttctgtatactgattgggagtggtgtttacatgagtataaacntttgacaanaaagtttaccaggcaaggtngggtgtacttg

SEQ ID NO: 648762 - DNA, 139 bp, Homo sapiens
gttagtctttattacttacatttaaatttcttattgccaaaagaacggttttatggggggaacaaacttttgaaggcagtcatgtcatgccttgcacaaaagtgatgaaatctggacaggtttgttcaccccttttatt

SEQ ID NO: 648763 - DNA, 814 bp, Homo sapiens
tctatgactggaatatattcacagtttctctaggcgttctaggataagaacttcctatccttcatggtcctctttaaacctgcgagaatgaagttgagtacagataccagtagtagcatctgaaaaagaaagccacatcacatttaacgttctatcagtcggacgtccaagcagacctgcgtacactcgagcagttgagctttatcccagaggatgattcggtaggcgactgcatcactcttcaggtacgcaaccctaatgtcatgtgcatgtcccagagcgtgacccatcagtccatcgttcatttgcatctttttcatcattgcctctgacgggaacaggacgttcaagcatcagtgtaataggagcttgtcgtatatccacaaaggtattctcaataatccaagtgtcttactttaaaagatctgagaggaaatcagtggtgttacaggggtgaattgtgcgcagacgtaaattgaatatttcatcgtcctcattttgagttgtgaaaagagggagcttgaaaatgcatgaagatgcttgtcgtttgttggtccaaggatcaacttcacccaggttaaaatttggcaagagcagaacggcacggcgcgacttaacgaacaatggggttattggcgacaaaccaaaccaaggcagaaatcccagctcctggtcaagtacagtaacgctggtcttggcctttagggcaaacggggtttccacccgctcttgtgggcttcagtttccttggtcccttaaattgcccttacgaattaagactttcttcaaggaaattggcgggacagaactatta

SEQ ID NO: 648764 - DNA, 1433 bp, Homo sapiens
cggacggcgtggtgcgatggcatggcacccatgatgagctctgcaggcttcccaagggtgtgctgcagagcagtgggggtcccatctgtgccccgttcagcggacaatgtgcgtctgtcgatgcgggagaggacgggcgcgtgacgctacctgcgtgcccttcgctgctccgccgttgcccccgcggtggccatcctgcctggccttatgtgggagccacgcggggctacaagagcgcatgatcgacatcaccaacggcaccatccgaccatgggttggctgagagaaggcgtgacagcgcataggactcgagggtgcctcgcgatgaccgtgaagagcgcggtggcacccttgcaacagatgacagaggagagcacaaagcaagcgccttagtgccgcggagcataccgggatcacataggaaaccgccatgacgccctggtagccacagattgcctagggcggtctgggcgccacacggatactttccttcttgtactcttcgatgctggcggcgtatggcttaagtgtgggccaaggagctaggcgccgttggcaggggcactagttagcacagaatacgaggcccaattggggggcacatgggcatatctggccccgggcgggccggccccttcgtttggtgtggggttggtgagtcgtccccaacgacagcccgttagaacccggcctcttgtggccgcgttacgttgcagatcggggggcggacagagcagacggagcccccaccgggggggaaacacacatagccaaaacaccgagaacggggggcaaattgccggacaccagaatacacgagagagatagggagagtcgggccccggggtcagggaccaccaaggcggaaggcagttggaggcggacgagcagagagagaaattcaccccaggcacgatgggatcaggaagcgagaatccccccactgggggagccctaagggagatgaaggatagctttgaagcaaaagggctgaaggccgccgccatccacaccggtagggcgcactgcactccgattgagcgactctgggggtttgaaagcagccccagggcagacttttaaagcaaacgcaccgataacatgccccgggatgggatcgtgaagagaatcaccggtagcggccgtgcaaccgaacaagagatggagacacaccagtgggcgaaccgcagaatggcaaacactcacactgagaaccacccggcggtgaacgccacacagcagccacccaactatacccagcgcggtcacaccctaatcgcgccacgcacataaatcaccaaaagaaagcagagaacagcgacgaaggagacgccccaaccggggagcgccggtcgacaaacaccatggggcggcggaacaagcaccgcgacaagtcagacccacgtcacgcatcgtcgcacccacaaaccccg

SEQ ID NO: 648765 - DNA, 104 bp, Homo sapiens
  misc_feature (1)..(1): n is a, c, g, or t
ngaagagaccactagaatctggaattgagggcttaaaagacaaccttcttgcttatgggacatccagcctgacagccaccaaacagttgcatcgtccgagcgga

SEQ ID NO: 648766 - DNA, 186 bp, Homo sapiens
  misc_feature (118)..(118): n is a, c, g, or t
cccgatacaatcacttgatcccaactcatctctcatttatttcggctcttttatccaggattaagtgtagtgtaacattttcatttcttttcgcttttattctgctttggtaaaagcngtatttggagatggacattgcctcttcatggtatttttacgtggttagatatggggagtagtgtgatg

SEQ ID NO: 648767 - DNA, 353 bp, Homo sapiens
  misc_feature (8)..(8): n is a, c, g, or t
  misc_feature (85)..(85): n is a, c, g, or t
  misc_feature (114)..(114): n is a, c, g, or t
  misc_feature (127)..(127): n is a, c, g, or t
  misc_feature (212)..(212): n is a, c, g, or t
ggagggcnagcccttgaagccagcatttgtgttgctatggctacatgaaaacccatttacaagattggtgcagtagctcatgtcnaataatctcagcattttgggaggctgaantgggaggattccntgaggccaggagtttgagaccagcctgagcaacatagcaagaccctgtctccaccaaaaaataaaaaataaaaaaaatagcccanctggtgctgatgcctgtagtagtccccagctgtgcaggagactgaggtaaaaggattatttgagcccaggagttccaggctgcggtgagctataatcatgacactgcacttcagcctgggtgacagagtgagatcctgtct

SEQ ID NO: 648768 - DNA, 812 bp, Homo sapiens
  misc_feature (1)..(1): n is a, c, g, or t
  misc_feature (376)..(376): n is a, c, g, or t
  misc_feature (744)..(744): n is a, c, g, or t
ntgcaggacagcacatactttgctgcacatagaaattcgtaatatctcctgtgctgtccaggcacccagaagacctctcaacattttgtctatatcacaccaaatatgaagtctaatcaccactactgtcatgtgtttactgcctttgttgtgaccgatgaaggggccccaaatagcctcggggacagggatgcgggaggacagcgaggaagatctctttgtctctccatgagcctcctctggatgtaatgagagtcttgatggacacttttactccctctgggtgggcagtgatcacttactggatactgactataggctggacagctcagccgcaccaaggacacattccttaacaaatgattagagcttggtnaatatctgtggtgatgttcaatatccatgattgccttgaagaaaccacagaaaatataagctgacctgcatatgttcagctagcacaagaaaagtgagtttgcatcccttgattgccttatgatgtatctttatgatacaggggtgtcttaggctcctgattatgtgagagtgtttttatgtgcaaatcaaaatccgcgggcatggcacagtggatcatgtcgtttatccatgcaacgtcagagagagcccagtattgtggatccctttagggtatggacttattgacaatcctggaacgacactgggaaggcccttttattaatcgaaaataaaaagaggtctggtggggattggggaccaatgcgngaggatccatctggagcgtggatcgttaatacggcaactgccgtatacttcccttagtataaacgccg

SEQ ID NO: 648769 - DNA, 288 bp, Homo sapiens
  misc_feature (74)..(74): n is a, c, g, or t
  misc_feature (77)..(77): n is a, c, g, or t
cacctcggagatagctacggtttcctctggtggagatggtgaggatgaaggctggagagtgagggaggaggctntgntggtcgctgagaacacagggatgggagggtccacttctttctgtcgccttcagggccacatagctggctcataacacttagagggcaactctttgtccctacagtacccttactttgttttatcttatattagtggcctttctggagctggtttcagcaatatccgagtgggtttgtcactgttttattccttgtgttggacctgtctttt

SEQ ID NO: 648770 - DNA, 426 bp, Homo sapiens
  misc_feature (207)..(207): n is a, c, g, or t
gggtttatcgatgccacaacatatagtgtggcatgtataggaatttcattcctttttatgctgaataatattccatggtatgtatatcccacattctgcttatccattcatctgtgatggatgctgtttcttcctttggtttattgtgagtagtgctgctgtgaatgttgacgtaaagtgtctgtttggatccttgtcatttctttngggtgtatacctaggaatggaattgctgagttatatataaatctatgtttaactttttgagaaaccaccaaactgtttggtggctgcatcattttacattcccaccagcagtgtacgagagttctaatttcttcacatactggacacttgctccactttcttctttgattgtagccatcctaatggatgtgaagtggcatcgataaacaccgggtaccg

SEQ ID NO: 648771 - DNA, 150 bp, Homo sapiens
aacatcagggccagatgttgggattagttgattgccttggcaatatctattggagatgatcatatgtctcccatttctagtgcggcagtatggaggttatcaatacagtaatatggtaaacatttgattataattactgctgtatggcaa

SEQ ID NO: 648772 - DNA, 305 bp, Homo sapiens
agctgtaatggtaatcacaagaaggttgtgccgtccgcatctaactccaggatggtgtgtagcccagtgactgtgaggatcgccctcctgacagaatatataatcgcgtactgcgataacagagcagataatacagctcaacactgtcctcaccatcaagtaacgccccagacccatgtgccaaggagacagtactgagtgcgctcaaagagaaggagaagatttatacagtggaggaagaagaccaaatattccttgatggccaggaaaataaaagaaggcgccatgatagcagtggcaagtgg

SEQ ID NO: 648773 - DNA, 320 bp, Homo sapiens
taaaaggcaacccaaagcaacatacctcccttcacgcgctaacaggagttggcgtgaagaaggtaccgtactgatagacttagggttccactggcaaccgtgggaggggggaggaggggggtacggcacggtgaaggtcatgaacacgcctcaaagaaggaaacgacgcccggaagcgttgtcgtggttagcatcggccaccgtcgagcggagcttttgccttgaccatacaccgtgaccctaatgcatctgacactaaagatagggaaggaggaagccgtcggctttacccacaccgtcaagagggaagaccccaagtt

SEQ ID NO: 648774 - DNA, 660 bp, Homo sapiens
  misc_feature (67)..(67): n is a, c, g, or t
gattcagccggacacagatagaacaagaggacacatagtggacgtatgatttttgttcgggatccangatagagttgggtttatagaaaagcaaacggggccaatgtccacaccatcattcttgatctaggaccaccaatgtcatagggcgcaatatctacaataggtagtctcacagccttgcgtgtacgatattcaagagactgtgttgctccattccccagtgtgtgacgttaatccatgatacagaactgtgtaggtgaatttgctatttccttcagccttgaattcaccttcatttgaccccatcagcttcagggccttctttacatttccactggcctgatccatgtatgcaatgctatttttgcagtgatatgtgatgttctgggaagctcggctggagagaagtcgaaggaatgccagctgcacatcaaggacatcttcaggaagttcaggattgccgtagctaaactgaaaaccaccatccatggactctccaaaccaaacgtgtttcttctcagcactagaatctgtccaccagtgtttccgtggaccattcaaaggattggcacttatgcatgtttccccagtttccatattacagaataccttgatagcatccaatttgcatcttggttagggtcaaccagtatctcc

SEQ ID NO: 648775 - DNA, 156 bp, Homo sapiens
agcgcccattaggcagctttcctactcttaactgatacattagtccaattaaagcgagtatagatggatagattcttcccgcagtcaggtctatggggatgcaagatcaatgcagcttttccctgcagtagaagctcacatgatgctaggagaggg

SEQ ID NO: 648776 - DNA, 165 bp, Homo sapiens
accggactatgtctgacagagatatatttatctatgggctagaactaggaagaataatatattataagaacacagacactaatatcccaccatccccttcattggggtagtcacagacaactgtaataagcagtgcttattacagttttactgggtagtcacaga

SEQ ID NO: 648777 - DNA, 622 bp, Homo sapiens
aacggctaggtacgaggctgggtttaactccgccgccatggagcagcgccgcgtaaccgacttcttcgcgcgccgccgccccgggcccgctccgaatagaaccgcccaaactagggctagccgacactacatgcctacacataccaaattaaccaaaaaaaagtaataataaaacaaaaagacgcagacacgcaaagatcacgcacaagaacaggacactaccaaaccaaaaagaccaacaaaaacaacgcccaacaaaaaagccaatacagaaaaagaaaaaacagagaaaacaaccaccaaaataaccaacacacaacacactacacccaaaacaaaacataaacagacacaaagaacaaccacaataatatgacacctgaatagtaaataagagtttacacctcaataaatatcacaaaagcaaataacaaaaacaaacaaataaaaaaaaccaacaaaaaaattaacactaatcaacccaccaccaataaaacatcacacaaacacacaccaccacaaaactacgtcaccacaaaaaataaacaaactacccatataccaaacaaaataaataactcaagcacacaaacaccacaaccataattcaaattacacaacc

SEQ ID NO: 648778 - DNA, 744 bp, Homo sapiens
  misc_feature (174)..(174): n is a, c, g, or t
taaccactcattcatcgagctcgtcaacccaatccaatcatctccgctatgatgaaacttcggatcacctcctgggcagccatgccctgactccatccaaactcaccacaggagtattccatagtccagtacatgtactctaccagtacgcctcaaacgccattttcaatcaantcgtcacaaattctactccagagacgtagaattatggctgagatctatccgtatacctgtcacggcaaataggccgtcactcaattattctttatctgactctcttacctactacatcgaggatgaaggccatatattacggatcatttctctacatcagaaacctgaaagatcggcattgatcctcgtgcttgcaagtatagcgaacagaccgttgcataggctatgtcctcccgtgaggccaaatatcatactgaggggccacagataattagcaaacttattatccggcatcccatacatgggacagaactagtgtcaatgaatcgtgaggaggactactcagatagacaggtcccagccctcaaagaattgctttacctattcacggtcatctatgcagttgattatccgcgagaccctatgacagcacatccaactcctatgcttgcacgaaaggggatctacacaaggcccctaggaatcacctccgagtgccgataaaatcgaccttccgacccttaacaataaaatataaattcccctaaaaatcaagaagtagggcccgaa

SEQ ID NO: 648779 - DNA, 119 bp, Homo sapiens
agaaaaaatgaaaaaaaaaggaaaaaaagttaaaaggcaaaccccagtttgaacacaaaggctctatggaagaaatgcctctatgtaggtgaatgaaatcttaaaaaaagaaccaatga

SEQ ID NO: 648780 - DNA, 133 bp, Homo sapiens
actctctgtaatgcaaaattttttgactcttcgtcttactacttaactattttgtcttattttgaatgatgagccttcgtgcccccccttcccccttatttgtcccccaagttgagatgtatgaaggcttttg

SEQ ID NO: 648781 - DNA, 143 bp, Homo sapiens
cagacagtacagacatccaggttggtccggcacactagtcaaattactcttatttataaatgatatgaggccaggcatggtggctcacacctgtaatcccagcactttgggaggccaaggcaggtggatcacttgaggtcagg

SEQ ID NO: 648782 - DNA, 128 bp, Homo sapiens
tcaatcttaactaattatatcatcaaaaccggttgttccaaattaaggtcacattctgaggtcatgggtgcacatgaatttgagggacccttcgtctgctgcagggagccctgttgtagcccagccta

SEQ ID NO: 648783 - DNA, 244 bp, Homo sapiens
aacacctgtttctgggacatctccggtgtcatggcccaccagctcaaggccggccgcacccgtaccggaaaaacggtgtccatgatcggcgacgccgtcgagggtgcccgccgcaactggcgcgtcttcgtcatcgacccgaaacgcatcgagtacctgggcctgcgggagtggcccaacatcgagatggtcgccactaccgtccccgaccaggtcgccctcatccactggctgtggtctctca

SEQ ID NO: 648784 - DNA, 292 bp, Homo sapiens
cggactctggcgagaccagatctgagcatactggacgcatgttaactagactgcctgcgtgtcaccgaacatgtcatggatagaatacacacatctctggaatggcgtttcaccatggcacggtggattcaactgcatggtgaccacatcagatgtctgaactctcatgtgccggaagcatagatagcttgctcactatatgagagacttgcgccgacccgcatacagtggagagccgtctttacacttgctaaccctgccatatcctatcgacatgcagattgattctgtg

SEQ ID NO: 648785 - DNA, 84 bp, Homo sapiens
ctcatgacctggcatagtagatcctcaacaaatatctgaggaacgaacagaaacataagtgaacggacttctcagatccattcg

SEQ ID NO: 648786 - DNA, 297 bp, Homo sapiens
  misc_feature (50)..(50): n is a, c, g, or t
aaattcgcgtgccgtcgactctatctctacaaaaaaatttaaaaattcgngcgggcgcagtggctcacgcctgtaatcccagcactttaggaggctgaggcgggcggatcacctgaggtcaggagttcgagaccagcctgaccaacatggagaaaccctgtctttactaaagatacaaaattagccgggcgtggtggcacatgcctgtagtcccagctattcgggaggctgaacagaacgcttgaacccgggagcagaggttgcggtgaccgagattgtgccattgcagtccagcct

SEQ ID NO: 648787 - DNA, 493 bp, Homo sapiens
aactatacattcctgccactcggattattttattgtgctttactatctgtagtttatagttttaaaacaagaattatacggactctactttttaaaaagtatacctctccattagagattctaatatctcaagtctcctagggatgtgaaggccgggcatgatggctcacacctgtaatcccagcactttaggaagccgagatgggcagatcacaaggtcaggagttcaaaaccagcctggccaacatggtgaaaccccatctctactaaaattacaaaaattagctgggcgtggtggccggcgcctgtaatcccagctactcgggaggttgagacaggagaatcgcttgaaccccagaagcagaggttgcagtgagccaagattgtgccactgcactccagcctgggcaacacagcaagactccatctcaaaagcaaaacaaaacaaacaaaacaaaggaaatactcattggagcagttcggattttggctt

SEQ ID NO: 648788 - DNA, 469 bp, Homo sapiens
  misc_feature (447)..(447): n is a, c, g, or t
cacgaggtaaggaaagcgcaggtcgtagcagatcgtcatgcctagaacgccccacggcgtctctgccagcaccgttctctcgcccggcttgaaggtcgaggattcgcgatagctctcgccgccggcgagctggacgtcgaacatgtggatcttgtcgtagctcgccacgatgccgccggccgaatcgatcaggtaggagcggttgcggatctgctcctcgccgggcacgcggacatggatcgagcccagcaggaaccacgcgccggtctcgcgcgcgctcgcccgggccgccgccagcatggcgtggctctcctcggtctcggccttcgccagcgtctcggcgcggttggcgccgatcaggcccgtgttctccggcgtcatgacgaaatcggcgccggcgtcgcgcgccagccgcgcctgctcgcgcacgtaggccacgttctcggncatctcgttgctgacgttggtc

SEQ ID NO: 648789 - DNA, 235 bp, Homo sapiens
  misc_feature (23)..(23): n is a, c, g, or t
ccttttttttgagacagggtttnggtctgtcacccaggctggaatgggacgtcacaatcacagctcactatagcctggaactcctgagatgaagcaatcctcctaccttagcttcctgggtagctgggactacagatatgcactaccaagttcagctaattttttactatttttgtagagatggaatctcactatattgcccaggttagtctcaaactcctgggctcaagcgatc

SEQ ID NO: 648790 - DNA, 150 bp, Homo sapiens
  misc_feature (27)..(27): n is a, c, g, or t
ctcagatgagaaacctgagactcacanacacaaagtggtaactggtttaagaacaggaatccaggccaatctcactctaaaacggggggggggtgtaatacaccaattttcatcttaattctcaatgagaataaaaatgtacaaaatatc

SEQ ID NO: 648791 - DNA, 876 bp, Homo sapiens
  misc_feature (190)..(190): n is a, c, g, or t
  misc_feature (193)..(193): n is a, c, g, or t
  misc_feature (200)..(200): n is a, c, g, or t
  misc_feature (230)..(230): n is a, c, g, or t
  misc_feature (241)..(243): n is a, c, g, or t
  misc_feature (247)..(247): n is a, c, g, or t
  misc_feature (254)..(256): n is a, c, g, or t
  misc_feature (264)..(264): n is a, c, g, or t
  misc_feature (286)..(286): n is a, c, g, or t
  misc_feature (315)..(315): n is a, c, g, or t
  misc_feature (320)..(320): n is a, c, g, or t
  misc_feature (330)..(330): n is a, c, g, or t
  misc_feature (332)..(332): n is a, c, g, or t
  misc_feature (338)..(338): n is a, c, g, or t
  misc_feature (343)..(343): n is a, c, g, or t
  misc_feature (350)..(350): n is a, c, g, or t
  misc_feature (353)..(354): n is a, c, g, or t
  misc_feature (365)..(365): n is a, c, g, or t
  misc_feature (369)..(369): n is a, c, g, or t
  misc_feature (378)..(378): n is a, c, g, or t
  misc_feature (387)..(387): n is a, c, g, or t
  misc_feature (392)..(392): n is a, c, g, or t
  misc_feature (395)..(395): n is a, c, g, or t
  misc_feature (402)..(402): n is a, c, g, or t
  misc_feature (434)..(434): n is a, c, g, or t
  misc_feature (454)..(454): n is a, c, g, or t
  misc_feature (456)..(456): n is a, c, g, or t
  misc_feature (463)..(463): n is a, c, g, or t
  misc_feature (475)..(475): n is a, c, g, or t
  misc_feature (495)..(495): n is a, c, g, or t
  misc_feature (508)..(508): n is a, c, g, or t
  misc_feature (512)..(512): n is a, c, g, or t
  misc_feature (523)..(524): n is a, c, g, or t
  misc_feature (529)..(529): n is a, c, g, or t
  misc_feature (548)..(548): n is a, c, g, or t
  misc_feature (554)..(554): n is a, c, g, or t
  misc_feature (568)..(568): n is a, c, g, or t
  misc_feature (570)..(570): n is a, c, g, or t
  misc_feature (582)..(582): n is a, c, g, or t
  misc_feature (584)..(584): n is a, c, g, or t
  misc_feature (604)..(604): n is a, c, g, or t
  misc_feature (610)..(610): n is a, c, g, or t
  misc_feature (618)..(618): n is a, c, g, or t
  misc_feature (623)..(623): n is a, c, g, or t
  misc_feature (650)..(650): n is a, c, g, or t
  misc_feature (664)..(664): n is a, c, g, or t
  misc_feature (673)..(673): n is a, c, g, or t
gacgatggagatgaacagattccggctgattgggccactttcccactccatcctaactgaagcaataaaagctgcttctgtccacactgtgggagaggacacagaggagacacctcaccgctggtggatagaaacctgtaagaaacctgacagcgtttcccttcattgcagacaagaagccattttcganttnttgggangaataacatcaccagcagaaattccggcangtactattctnnnactnacatttnnngatcctcnaataaatttgccccaaaataantccaaagcttttcccaatccataaaaatnccaanataattatananttatanatctncttcttnatnnttttccttttnaatntacgcatanctttatctngaacnaanatatctntaatattttcacagataataaaatctcggatnaggatttaaaccggatgatnantgaattnctggtgcctggntcacagcttattttaggtcnccattaatccaanatanctatacttttnnttcancagccaggaaaagtgattngtgaanatcgactaggctgntnaagttgctgggntntcctactcccaaatggctgnggcatngctttctngattncatttatttatctaggtgtgatattcntatggttgaaatantctgcagtncattctcattataataggtctcctaatgtcccaggcgattttccagactgccctgccgggatgctgtttgcggaagagcaagctaagaatcttcttgaaaagtacaaaagacgccctcctgcaaaacggcccaactacgttaagcttggcactctggcacctttctgctgtccctgggagcagttaactcaagactgggagtc

SEQ ID NO: 648792 - DNA, 391 bp, Homo sapiens
  misc_feature (2)..(2): n is a, c, g, or t
  misc_feature (54)..(54): n is a, c, g, or t
  misc_feature (111)..(111): n is a, c, g, or t
  misc_feature (158)..(158): n is a, c, g, or t
angtgccaaatgatgctgtatataattgtcctataggtggttatcctattaagngataatatgagagaaaaaataagctattgaaacttatatgactactatggcaggtcngtgaatgaaagttttgccatctagaaaaatattgtgttttctcctcngtttctttgcccgaaggtacactttatcattgtagtttattactaagacttggaattccaactccggaccctttccttctctacagaaatgccagtttgaattgtttatagtttgaattgttttgtgtgcttatagttatgtcagggttttttttgagattattagattttatgtcaaattaatatataatttaagtcctaataaaataactacaaagttacctgtaataatc

SEQ ID NO: 648793 - DNA, 326 bp, Homo sapiens
ctgtgagtaccgcacctggcctagttcatatttttgaaaaaaatgaaacagtgttgacataggctgcaaagttttatcgaatgaaatgaagattttgtctgtagaagtttgactatgtcatggtggaaaataaatcattgctaattagcacttgagttatatatttgttaccttattcaaaggttggcctggaactaattttcttagcagtatttgcagcagaggaagctcctgtttgatgagcatccaatttatgcccagaaatgctgttgctgggagggtaggaagcattgtttcaattaactcccttgtcaatccccggtcga

SEQ ID NO: 648794 - DNA, 758 bp, Homo sapiens
  misc_feature (75)..(75): n is a, c, g, or t
  misc_feature (232)..(232): n is a, c, g, or t
  misc_feature (237)..(237): n is a, c, g, or t
  misc_feature (239)..(239): n is a, c, g, or t
  misc_feature (246)..(246): n is a, c, g, or t
  misc_feature (376)..(376): n is a, c, g, or t
  misc_feature (413)..(413): n is a, c, g, or t
  misc_feature (431)..(431): n is a, c, g, or t
  misc_feature (538)..(538): n is a, c, g, or t
  misc_feature (551)..(552): n is a, c, g, or t
  misc_feature (592)..(592): n is a, c, g, or t
  misc_feature (599)..(599): n is a, c, g, or t
  misc_feature (603)..(603): n is a, c, g, or t
  misc_feature (618)..(618): n is a, c, g, or t
  misc_feature (625)..(625): n is a, c, g, or t
  misc_feature (631)..(632): n is a, c, g, or t
  misc_feature (635)..(636): n is a, c, g, or t
  misc_feature (641)..(642): n is a, c, g, or t
  misc_feature (644)..(644): n is a, c, g, or t
  misc_feature (646)..(646): n is a, c, g, or t
  misc_feature (648)..(648): n is a, c, g, or t
  misc_feature (657)..(657): n is a, c, g, or t
  misc_feature (660)..(660): n is a, c, g, or t
  misc_feature (663)..(663): n is a, c, g, or t
  misc_feature (684)..(684): n is a, c, g, or t
  misc_feature (689)..(689): n is a, c, g, or t
  misc_feature (696)..(697): n is a, c, g, or t
  misc_feature (699)..(699): n is a, c, g, or t
  misc_feature (705)..(705): n is a, c, g, or t
  misc_feature (711)..(711): n is a, c, g, or t
  misc_feature (722)..(722): n is a, c, g, or t
  misc_feature (724)..(725): n is a, c, g, or t
  misc_feature (727)..(729): n is a, c, g, or t
  misc_feature (731)..(731): n is a, c, g, or t
gccagaagccctggagcaggatgtcacgtctgaaaagcctattgatgtttaccaaatttaatttgcagattattntagtctgtcatccagaaaatgtgtcagcatgcatagtgctaagaaagcaagccaattggaaacttggttagtgacaaaattgaccagagagtgggggtgatgatgaccaggaattacaagtagaatggcagctggaatttaaggagggacagaatcnatggntnagcgtgngtggagaagatccaaacagaaaagtgcaaagttattccccatcttccaaggttgaattctgaggaagaagacacattcctagttccccgtgaacttcctttgacttattgtccccactaaaacaaaacanaaaacttttaatgccttccacattaattagattttcntgcagtttttttatggcntttttttaaagatgccctaagtgttgaagaagagtttgcaaatgcaacaaaatatttaattaccggttgttaaaactggtttagcacaatttatattttccctctcntgcctttcttatnngcaataaaaggtattgagccattttttaaatgacattatngataaantatntttgtactagttgangaaggantttttnntannctgannananantttgcaaanaanacnaaattatttgtataataaaanaccanattcatnnanagcaanatcacngatcaataaantnnannnantatccaataaaattttaaaacattaga

SEQ ID NO: 648795 - DNA, 248 bp, Homo sapiens
  misc_feature (51)..(51): n is a, c, g, or t
  misc_feature (64)..(64): n is a, c, g, or t
  misc_feature (72)..(72): n is a, c, g, or t
  misc_feature (81)..(81): n is a, c, g, or t
  misc_feature (95)..(96): n is a, c, g, or t
  misc_feature (101)..(101): n is a, c, g, or t
  misc_feature (109)..(109): n is a, c, g, or t
  misc_feature (117)..(117): n is a, c, g, or t
  misc_feature (169)..(169): n is a, c, g, or t
  misc_feature (195)..(195): n is a, c, g, or t
  misc_feature (199)..(199): n is a, c, g, or t
  misc_feature (207)..(207): n is a, c, g, or t
  misc_feature (227)..(228): n is a, c, g, or t
gtcagtgcgaaatccgctgctgccaaagaaaaaagcgacaacagcagcacnaaggaagcacaanaaaaaaancataaaagnaataaaaaaaaaannaaacncccaaaanaaaaaaanaaaaaaacaaaaaaaaaaagttaaaaaaacaaacataaggaaaaaggaaaancaggaattcgaaaacccaacataaancaanacataatnccccacaaataaaaaatcannaaaaaaaccacacccttccc

SEQ ID NO: 648796 - DNA, 788 bp, Homo sapiens
taggtctagacaaagctgccctacaaagtacgccgacataggcctaggctagcctaggggacgcaaggccctggacattgctagagaacgagatagccgggcctagatagcgtatagcgggagcggtactacggcctaccaagccactagaagggcgcccgcatacgctagagctagcctagcacatagaccgtaggagaacggacgtacctacataatagagaccctacgtacacacctaggagtagacatagaggtagcaaggtagagtaccagactagcaaacatactatactaccaacccagagcaccatagcaggacgggctagccaatatagccaagggctaggcatatacccgggtagtaatagcctaggaaaagagggcgaacacggaacagaagggagtaacctagatagggtagccatatagcagacgaggaaccctagataactatacaaaggaacggggagacccccctacaagaccatagaatatactagggaaacgaaacagagagagaggcgaaaaccttacgagcgcagaacgctaacgattaccaaacaaccaaaaggtaacccacggacgaggtcttatacttatgcccagggccattacccgggaggggacactacttacctaggcagggcaggaactgcaacagacctgagggggttaccaaccaaaacactactaacctaaagaattagaataggcccaatgggggattaccttacaaagggtggccttagccattcgaatagttacaatagactaccggacaagca

SEQ ID NO: 648797 - DNA, 144 bp, Homo sapiens
gcccctcggagccttcggagatccagcctgctttgggggcaggatggacaggatttgagcccagagcggacttggctttaacaacttcccgtactcaagataacagccacggaggacaagcaaggctgggctcatggacagact

SEQ ID NO: 648798 - DNA, 512 bp, Homo sapiens
ctcatcatttattaattgaagcaccgcgaaaagaggctttattatgaatgaagtttatgttgtttagacaagggggtggtttttctccaccgaaaaagaagaacagctgaataagctgctgatcatcattatctttctgttattatcatggtgggctgctatgctgctaaatgaggtgttgtaagcctaaggcagcttgacttgtagcaacaagttgtttaccatcctcgtcaaagcaggtatacttattatcagccgtgtagcagtactttactaaagctgctaagtcatccatcacagcattcagcagctgttttgttgccgtgggctggtggtgcacaagatgatcaagagcagcaggttgcttgatgagtctctccttctcagaaagagggcatctattttcatggtaggtgaatgatgcagcattaaactatttgggaacgtctgttgcatcgtcttctagaactgctgagcatggtcgcctgttgaccaccgatgatgctctgcat

SEQ ID NO: 648799 - DNA, 135 bp, Homo sapiens
ggcgattggtgaccagctgtaaggggtccacgacatccactaggggctccttaatggacacatctttgatgcacgacatgtcgaagccatacacgttctcccaccagtggatctagtagtctttgtaccgacgtg

SEQ ID NO: 648800 - DNA, 242 bp, Homo sapiens
atctcctaagtccatggcgagagtggaattactatgaattaaacttctggtcaccatgtaccggattttggctatgttgactttacttaattggtcctttttggttcccaaggtacatggtgctaggtaggtgtcaagccattactctcattggcttgtcctacatgctaacattttgctaaatataaatctaccagtatcacagctgcatatatttctgaagtcctatcaaaagacggggt

SEQ ID NO: 648801 - DNA, 182 bp, Homo sapiens
  misc_feature (23)..(23): n is a, c, g, or t
  misc_feature (28)..(28): n is a, c, g, or t
  misc_feature (70)..(70): n is a, c, g, or t
  misc_feature (151)..(151): n is a, c, g, or t
  misc_feature (170)..(170): n is a, c, g, or t
gccaccgcgcccggccggaaatntgctnctttagaggaaagcaccgttgatcccacctccttgatctggnttctgggacctcatgcaggctgggcccgttggtctttgctccctgatgctgtctggtgccatctggtctcactccttcctncccatcttgttcattcatnggttcactcatt

SEQ ID NO: 648802 - DNA, 304 bp, Homo sapiens
ggccgtgctgagcggctcaggaggtagatctactctgagctcacacccacccggaactggaagccttagaaaccagtagcagttatgtctgacctgaaccctagaccataggatacaaacttcactttcagaatgctaacctcaccacagactcctaatcggctaataaacagatgaatacacctatttgactgtttcctcactcacaaggaagcagtctttgtgatggttatgctcttacttttaactttagttaccagatttatttctgccttcctttattttctctagtaattgagaccgc

SEQ ID NO: 648803 - DNA, 306 bp, Homo sapiens
accgtactgattagacatttggcagctcttactgaagttaaacatagtcttaccatatgattctgcagtcatgctcttaggtatttccccaaatcagttgaaaacatgtccacacaaaaaccagcacttgaatgtctatagcagctttattcatagttgccaaaactggaagcaaccaagatgtttttcagtgggtgaatgaataaataaactgtggtatatccaaataatggaatattattcagcagtaagaagaaatgggctgtcaagctacaaaaatgacataaatgggtctaaatgcaatca

SEQ ID NO: 648804 - DNA, 181 bp, Homo sapiens
attacatattataccagatcactagcccactataagcctctgcattcatcaacaagaatagagttactaataaagatgcaggcacatcgatctgtccttcagctataaacacaaactgcttcaatctataaatgtatttcaatatgtatcgagaaaacagaataaagttaagtgaatgtat

SEQ ID NO: 648805 - DNA, 532 bp, Homo sapiens
taaaagcaaaccatggtttgtgtagtgttaagttaccttttggggctatgggtctcttggccagccctcccctttcccaatgaaagccaggtcaaattaatcacgggatggactggcggttcactcttttaatttttaatgaagggtgtcccagggtggtaaacgcaataagattggagatgaacactatggaaacttcgctttggccgtaaaacaatagcagtggatctagttattcaaaaaaacatagaaagatttagtcaaaaggatgggccctttctccaccgggactttaaaaattcaatggtgcctctattaggggttcatctggtctttagaccccaggtttcgtggtctaacacaaattcctgactttaaccttcccccgctgaggcaggtcgcgcgatacagatgactccggagctgtcacctaaaagtactcctttttccctgtagggcggggggccaggggtaacctgaccctattcgagggtaggggcactcttaatcctcactggtttctcaagagacc

SEQ ID NO: 648806 - DNA, 171 bp, Homo sapiens
  misc_feature (161)..(161): n is a, c, g, or t
acttagaggatccctgacggaagcactagcgattaggagggagcaggaattgtactatcatgggagtgatgagaagtgacgtttagaatgcccagttaatacatatgccatgaaactggaaatttatttttctttagctcatgggaaagtattttcagacnaacagtattt

SEQ ID NO: 648807 - DNA, 116 bp, Homo sapiens
cccccccccccctttttaaatcccttataaaaaattgggggttttgcaggtcagggggggatcccggtcccccccctttgtggtgtccccccccccagccccgctgttaatttcca

SEQ ID NO: 648808 - DNA, 192 bp, Homo sapiens
ctacgtggatgcgccaagatacttaaatgtactcatctgtcgaaccacctatattatagcctcacccctgacatggtcggaaatcttcgttatcaggtcagaccagcctggggtctgtgggtaaatcagccctactcccaggcctgtgcacacaccccttcagcactccctatgcgcgcgcactagggacta

SEQ ID NO: 648809 - DNA, 292 bp, Homo sapiens
  misc_feature (11)..(11): n is a, c, g, or t
  misc_feature (21)..(21): n is a, c, g, or t
  misc_feature (26)..(26): n is a, c, g, or t
  misc_feature (32)..(32): n is a, c, g, or t
  misc_feature (69)..(70): n is a, c, g, or t
  misc_feature (80)..(80): n is a, c, g, or t
  misc_feature (85)..(85): n is a, c, g, or t
  misc_feature (88)..(89): n is a, c, g, or t
  misc_feature (107)..(107): n is a, c, g, or t
  misc_feature (161)..(161): n is a, c, g, or t
tcgttactgtnaatgccagcngtctntcgacnaggttcatcgcaaatgttgttttacccatcgacgganncgcggcgacnatganaannccgacggctgcaagccancggtttttttgttgagatcgtcataaccggtgtttaccccggtaacgccatcgngtggctgctgaaacaactgctcaatacgcgccacggttgcgtcgagcacatcggcgatgttcttcggcccttcgtctttgttcgcacgactttcggcaatttgaaagacgcggcattaacagtaacgaaag

SEQ ID NO: 648810 - DNA, 1241 bp, Homo sapiens
ggcctcatctatgctctcccactccgttgtatacggggttttctctccttcgctggttaatagggggtgtgctcacatctgtgggaaagtactctttctggtgggggagtcaccccctggtttgtttttgtttgtggggcttttggggggtgtgtgtgagcgcccactattggctccacggggaatgttgatctttggggggcccccccgccaggtggtcgcccaccaaccatggtgggtgagaggatgccccgtctgcgccacggtaggggcgcggcggttgtctttttgtcgcgagcgcattgtgggcgcctggtggctgttcagggggcccgcgcgatggccgcactacggggggttagccaacgagggttttgttctgtgggggctggtcccccctgtgtatgacggtgctcccccccctgaggggcccccccctgttctcccccagcttgtgtgtcccccccgcccccgcggtagacctctctcactgtcccccacttgggggagcccccctcgcggggactctcggcgtttctcttttcgtgtgcacacaccctctggggaccaccacggagcccccagagcccccacggttcgcggggacccacccgccacagatggtgaccccacaaatgcgacacgcacatagtgcccccccttgcgtggcgccccaaaggtgttttcccacagtctgtgggcacacaccacagggcgcgcggtgagagggtctcccacacggggaagtgggggccccccaaaggtcttttagacacacgtgtttctcccgctgttctctcgagacactttcactcaccctcacgccctctccacaccacccacacggggctttcccccaagacccctataggggctccacttggagccgcaggtaattgggaaggccacacacgcggaagaaagggatataaccctatacacccccgagacccccgcgctgtgacacacaagctgagctcgtcctctcttctccctcccacgccctcttggccctctggctctttttatgccctattttgcccgcacggctgagaccacctctttttcccctttctcccacgcactcaccctcccccaaggagaagagagcccacatgttttccaccccacgtaaatcccttttgccgagacccctatgttccctttgctccaggcccagacttgttatccagactttcagggccctgggtccaccaatagaattaaaggtagtaattaga

SEQ ID NO: 648811 - DNA, 106 bp, Homo sapiens
gggaggtcagtgaaagagggaagcaggattgcggcactgataggagagtgagagcatgtgaggggtagatgggatggtggggtaccagccactggaaggggtcatc

SEQ ID NO: 648812 - DNA, 122 bp, Homo sapiens
gcggccgcctactactactactgctcgaattcaagcttctaacgatgtacggggacatggtgtcttgtaggaccatatcgatgttacctgtcaagtaaataaataataaaacacacaaaaaa

SEQ ID NO: 648813 - DNA, 122 bp, Homo sapiens
ttaataaaccctccagatgtacagtgattgggtgctacagaaacagaaaagaatgctttctatcatatatatgcacaagacagagacaggaccttggacaatcatctactagaataagacaa

SEQ ID NO: 648814 - DNA, 126 bp, Homo sapiens
accgggctaatgttgctaggcattttaatcttagagcgaaagctataatcactgcgcccgctcataaggggatggcatggctaggtttatagatagttgggtggttatagtagtgtgcatggttat

SEQ ID NO: 648815 - DNA, 770 bp, Homo sapiens
gtcaggcgctgtccccttcgctgcagatgccgtgtggagaacctggaggagggagggtctggccaagaatccccgacttgcgtatcgtgcagctgcgcttcctgctcatgcctgtccctgatgcaccgcgtgagacgctgcctgtgacgcgacgagctgatggcggcgcgaccgcgataaccgaacgagtggctccttactatgaaggccttgtgtcaaatccctcgactgtgcagatagacgtggacctactcagataagaatgaagaaggccaagtgaagatgagttgacagcgttcggatgaggagctggaagatgcagagaatgaactcgtaggagagagcgaaattcgcgatgccatgtgatggcaatatggccgaggtacctctgccggataggtgacaaagagggagctctgacagtcctttcgcaagtacatatgacataaagtgtggccctgggtcaccgatcggatatcgtattctatctccttaggattggcttattgtatatggataatgatctcatcagcacgaagacacagaaaaggccaaaagcttaagtagaagaaggaggagactgggacaggagaaaccggctacaagtgtatcagggtctttattgtgtggctattcgtgatttcaaacaggcagcgtgaaactcttccttgacactgtgtcaacatttacatcctatgaactcatggattataaaacatttgtgacttatactgtctatgtcagtcatgattgccttagaaatgaccaga

SEQ ID NO: 648816 - DNA, 97 bp, Homo sapiens
tgatattgtttaaaatccggttttggtatcttggggcaagcctgcaaccttttttatatctttggggtattttaagccctttgcccccaatgttcat

SEQ ID NO: 648817 - DNA, 122 bp, Homo sapiens
cgatctctggcctgataaccttcctttactcccatcactggatccaggctcaaggtcacagcacacggacacagttgggctgtagtctgggtgatactgaactgctgtcttcgcaggcgtga

SEQ ID NO: 648818 - DNA, 475 bp, Homo sapiens
ctacaagggaaactacaaaacactaatgaaagaagtaaacaaatggaaggacattccatgtgcatgaatcagaagaattaatatcattaaaatgtttacccaaagtaaacttgattcaaagcaatctctatcaaaatactattgtcatttgtcacagaaattgaaaacaaaaataccaaagttcatatgaaatcaaaaaagaatcagaatagccaaggcaaccctgagcaaagaagaaagagctggaggcatcacgctacttgacttcaaaacattacagggctatggtagcccaaagagcgtggtattgatataaacggacacgcggaccaatggaacagaatagaaaacccagaggtaaatacatatatttaccaccaactgattttcaccaaaggtgccaagaatgtgtatcagggaagggataccctcttcgatgaagggtactgagaaaactgaatattcatctgcagga

SEQ ID NO: 648819 - DNA, 1076 bp, Homo sapiens
gtgagcaggaagcccagggccgtgttcctcatcaataacttcaggagaagtcagtgggagaagatgacatgaacaaggctggttgaaaatcattataaccatcagttactgggtttcagttgacacaagatatagtaatggtgtatacagctgtcagtagtgcatgacctacagataatatatattttgtatgtctgaataaagaacatttgtggattgctggatactgggtacaatgagccatgtaccagcgtactgctatgcaccgtgcaactcactggaggcatgagcactacatatatctgtgtaacaagtcaggatttgagctagcattggcatcaccagatgcagcaagtgtaagcagggcgtattctgtggagcagtgtagtaataatggttgtaacaagaggtgatgaggagagtatccaaatacatgtggacacaccttaggtgtaagtagaaatataagtttaacaggttcaaaaaataggcagaacaacaccaatcatgacacataaaacatcaacacaaacacaagcactggcccaggccggcccgtacgcctgaaatcaccagcggacacgcgccacggctgacacgcagcgaggacacagcaagaaaccccgggccaggcgcgagagtacgacacgccgcagccaacagcgaacagccaaccaactgaaaacatacacaggacgctggagagcaacaagcgcacaaaatccaatacacagaacgagcacacacccagcactggagtaacaagaaggaagacgaagacataacgcacaggggagcacaagacacacgacccgactccgaccacacaccgacaaccacaaccacacccacgacgtgacacaagaacaagcgaaaagcgcgaacggaagcaacagaaacgataccacctacagagacgaaacaacaactaacagagagcgcacacaccacacacacacgcgcagcacagcccacacccacacacacgcaccagccgcacacgcggccaaacgggcaccgaaagacaaaaacaacaaaaaaggcgacaacccacaacaccccaggcccgcacataa

SEQ ID NO: 648820 - DNA, 730 bp, Homo sapiens
gggccccccgaaccaagaggtcttgttttgaatatggataacccaccgtccacatttttgttggagcaacaaaagctcagtaaaaataggtgaggggccacagcggcggtagaaaaaggggtattttaaaaccgggttgggtcctcgtgtgcagggggccgtggttttccactttcgtacggtttgttgcaaacacactagcccctccccccagggggcaccagctgaagagaaattgctccaggtaagaccagttttagttgcccatcaaatttgaatttaaatcaaacgtccggactctccgaaaatctaataggcttctggagcacagctaacgctttcggaagcttctcggatgggagagagatactttctgcatgtgggcaaaacaaacctttcggccggcctgaagctcacctctatggtctgaatcttgatgtcttccctctctcttatatgatgaagcctatccccctcagtgagcgtcttgagaaatcggacctttggggaagtgattaactcacagagtgctctgctctcgcgaatgggtgtcattccataaaaagcactaggagacctctgataaagtctctaaagtgtgcaggggctcgttttttccggtacaatttgggaggcgttcttgtgaccctcagcaagccctaactcgaccaggtgcattgatctaggaaaaatcagaaagcacaaataggaaaattaaatttatataaaa

SEQ ID NO: 648821 - DNA, 1091 bp, Homo sapiens
ggtcaccacctcccgcaagtgccagagccgagcggactgcgcggaggctgtggagccggcggccgcgtgaggctgatccctgctggtgtccctggtggcggtggacgtgtggtgatgccgctgaaggcccccgcactgatgtgtccgccgctgcctgggcgctccccttccccgcctggggctgggcgccagttgctggggtgaggcccgtgtagaccgctggacgtcggggcgggcagcctgccatggtgatgtctcggcccttgctcgtcagacagcgggtagacctgtgcaccaagtataccacacactgtgaacttgcgccccggcacggtgagaccccgtctgccaacgtacttatcggctgccccatcgggtagctttggggccctagctgtccttgtgtgccgggtgggggggcccacaccaacaagcacccaccgagggggcccaccaacaaggggatatattcttcccatcctttgaagcggacgatgaattggccttggaaccccaaagtacattgggcggggcagcactacagaaaccctggagcaagcggaacattttttcacccactgacataattgcttggccaatggcgaaagcctgtgtcgtaacactcatgacggtactggcgtggcactatccagtttgttgtcacacacagggtatcgtatcgaaccccgtgtggcaacaccaacggtggaattggcgtgctcaccccgactattcggaacgttggtctcccctccgttgtgaaggacaacttcccccacacacaacaaggcaacggctttctatcccgagggcaacagcccatccgtgtgggcaggcccaactttttccccaaagttccgtccggcggcaatatgtgtcaatagaccagcagcgttactttggacaggcaaaaacaacactctttctgtcggtgcacaaccaacctgaaccagctttgagacagcacccggtcatcttccacgtgctgcaacgaccaaatatgtgtgaccccaccacatttgcaggaaacacctgatggtatcccaactagcagaacactgttggccgggggccacgcaacagaccgcaac

SEQ ID NO: 648822 - DNA, 170 bp, Homo sapiens
tcctagcccactctggcaactcaagagcatgcagagtcctcacagtctagcaggaggccagccaggcggacacgagccagtaacagtccttagcttctgtgctctgggaatgagcggaaggagcacgagtaaccggcttctaagaacaaggggagctcttttatctagca

SEQ ID NO: 648823 - DNA, 392 bp, Homo sapiens
  misc_feature (302)..(302): n is a, c, g, or t
ccttccttggggtgctgcggggcggggccctccagggagggcaggacgagagcgtgaggcctcgggcaggaaggaggggcctggcaggcgctggggcaggataataaagcctttgagagccggtgggttccgaggggccgtgcgcctctgaagttgcttctgacacggctttccggcctcctctgcttcctgcctggccccgggtgggaaaggacctgctaggggcctgcctgaactgaggccgcttggaggtctcggccccctgggctgctgtgctggggccaaggcggcacagtccctgnccaggggtctgggtgaggaagggcccggcaggcctcggagcagggctcagggagccccagagggaccaggccctcagctggaggcggccg

SEQ ID NO: 648824 - DNA, 318 bp, Homo sapiens
agtgtggcgattgttagagtgagtatggtccttgaagtatagaacatagatgcctgcctaaaggtctactacaacagtaacccctatgacctttagtccttattcggtcgcgtgacaccacgccaccggagaaggaccacgccaccgagaagggatacttcgagctccgtccccgtaaggcactgaagaggctggcacaagccctcaggatcggaagacgtgcacggctcggatcacgtactgccggcagatgggacactcgttcatgcgcttgccacacttggtacaggtcaccccttctccggtggcgtggccgca

SEQ ID NO: 648825 - DNA, 244 bp, Homo sapiens
tcgacaaaaaaggaatcttggtcaggtgtggtggtgcacgcctgtaatcccagaacttatggaggccaaggcgggtggatcaattgagctctggagttcaagacaagcctaggcaacatggcaaaaccccatctttacaaaaaatacaaaaattagccgggcctcgtggcgcgtgcctgtaatcccagctacttgggaggctgaggcaggagaatcgcttagaatctaggtcgacgcggccgcg

SEQ ID NO: 648826 - DNA, 93 bp, Homo sapiens
aaagcttaaaaaaaaaatttccttttttttttttgcccccccttttttaaaaaaaaaaaaaaaaaaattcctttaaaaaaaatttgggcccca

SEQ ID NO: 648827 - DNA, 112 bp, Homo sapiens
gagtcggtagccctcggcttcaccctcgtcttccgtcctcgggggctgatgcgtggcggccccgcccggctcggctctttactccattcacagccgtgcacgcgctcaagcc

SEQ ID NO: 648828 - DNA, 94 bp, Homo sapiens
ctttctagccacatgatcaccagatactaatacagaatactctttcttatgcgaagcatttatatcctctggtgttttcctccaaaaaaaaaaa

SEQ ID NO: 648829 - DNA, 312 bp, Homo sapiens
  misc_feature (25)..(25): n is a, c, g, or t
  misc_feature (70)..(70): n is a, c, g, or t
  misc_feature (84)..(84): n is a, c, g, or t
  misc_feature (88)..(88): n is a, c, g, or t
  misc_feature (91)..(91): n is a, c, g, or t
  misc_feature (99)..(101): n is a, c, g, or t
  misc_feature (104)..(104): n is a, c, g, or t
  misc_feature (112)..(113): n is a, c, g, or t
  misc_feature (117)..(117): n is a, c, g, or t
  misc_feature (120)..(121): n is a, c, g, or t
  misc_feature (123)..(123): n is a, c, g, or t
  misc_feature (125)..(125): n is a, c, g, or t
  misc_feature (132)..(132): n is a, c, g, or t
  misc_feature (134)..(134): n is a, c, g, or t
  misc_feature (136)..(137): n is a, c, g, or t
  misc_feature (140)..(141): n is a, c, g, or t
  misc_feature (144)..(147): n is a, c, g, or t
  misc_feature (152)..(152): n is a, c, g, or t
  misc_feature (158)..(158): n is a, c, g, or t
  misc_feature (161)..(162): n is a, c, g, or t
  misc_feature (164)..(164): n is a, c, g, or t
  misc_feature (166)..(166): n is a, c, g, or t
  misc_feature (168)..(169): n is a, c, g, or t
  misc_feature (171)..(171): n is a, c, g, or t
  misc_feature (174)..(174): n is a, c, g, or t
  misc_feature (176)..(177): n is a, c, g, or t
  misc_feature (179)..(179): n is a, c, g, or t
  misc_feature (182)..(182): n is a, c, g, or t
  misc_feature (184)..(186): n is a, c, g, or t
  misc_feature (189)..(189): n is a, c, g, or t
  misc_feature (191)..(193): n is a, c, g, or t
  misc_feature (198)..(199): n is a, c, g, or t
  misc_feature (205)..(205): n is a, c, g, or t
  misc_feature (208)..(209): n is a, c, g, or t
  misc_feature (212)..(212): n is a, c, g, or t
  misc_feature (214)..(219): n is a, c, g, or t
  misc_feature (221)..(222): n is a, c, g, or t
  misc_feature (228)..(228): n is a, c, g, or t
  misc_feature (231)..(231): n is a, c, g, or t
  misc_feature (235)..(236): n is a, c, g, or t
  misc_feature (239)..(240): n is a, c, g, or t
  misc_feature (246)..(246): n is a, c, g, or t
  misc_feature (250)..(253): n is a, c, g, or t
  misc_feature (255)..(255): n is a, c, g, or t
  misc_feature (258)..(259): n is a, c, g, or t
  misc_feature (266)..(266): n is a, c, g, or t
  misc_feature (271)..(272): n is a, c, g, or t
  misc_feature (276)..(276): n is a, c, g, or t
  misc_feature (279)..(279): n is a, c, g, or t
  misc_feature (281)..(281): n is a, c, g, or t
  misc_feature (289)..(290): n is a, c, g, or t
  misc_feature (295)..(295): n is a, c, g, or t
tggctactaagggaacttgggaggntcccacctcagccttcgtgactagtgaggtgcgcaaacgcccganttttccctggtgcncggnttncgcctttnnngtnccctccanncttnctnntntnttatccncntnnttnncannnnttttnttcctnttnngnananntngtntnntnctntnnnttntnnnttttnngttttnttnncangnnnnnntnngttttnttntttnnttnntttttnttannnntnttnnttttttntattnnggcngtncnttgccatnnttagnttgttgtggcattttta

SEQ ID NO: 648830 - DNA, 690 bp, Homo sapiens
agcttcaccaacaggaactatgacctcgatacgactcggtgcagccgtatttctactgcgacgaggaggagaacttcgtacctagcagcaagcgagcgaagagcgagctgcagcccccgtgcgcccagcgaggatatctggaagaaattcgagctgctgcccactccccggcccatgtcccctagtccgccggctccgggcttctgcttcgcccgtcctacgtcgcgggtcacacccttctcccttcggggaagacaactgacggcggtggacgggaggttctccgacggccgaaccagtctggaattggatggtgaccgagctgctgggaggagacttggtgaaccagagtttcatctgcgacccggtcgacgagaccttcattctaaaatcatcatcactccaggactgtatgtggagacggttctcgtgcagacgccaagttcgtctcagagaagctggcgtcctagcaggacttgcgcgcgaagacagcggcagcccgaaccccgaccaagatcagagaagtttgatcgaactccagatttgttactgcagggatctgagcgccgccggctcacaagtgcgtcgaccctcagggtatttcccataccctttaaagacaggaggtcgccagttcctgggctcgaagaactcggggccttcttccggccgaatttttgaaccactcgg

SEQ ID NO: 648831 - DNA, 697 bp, Homo sapiens
ggtggtgtgagcagaggtccacaggtgggaatacatatggtgagtaggctgaaatagcgtcttgggggcagtctgccttgtgcaggactcctgagaagcaggcagcgtctgactgtggagggcactaggggaagcccttcttagtcagtcccgcatttcccaaagtgcctttcacagactgttagtcccaagtgatgctctatgaaaacagatcagtaatttacaagtttgggaaatgctgcgtatgttccccctttggcagattcccaatgcatgttggcttattaaagcatctttgaagtcctgcagagaaaaagccctctttaacactaagtgcaacaatttccaaatgtatttgacacctatgaacagctgcagacataacttattccacaaaacacaccttgtgtgcggcagcgcagtgggaaccagtgacacggtgtttaacgggagtgtagttcttccggtgtgtcacgcagtaccaattcccttatgtcagcacgagagcatgcatgtggagtctacacagatgtgcccaaaacctgctggcaccagttgatcccgctctgctgtcctggggcaccagagtacgttgtgctggtaagctgaacccacgctgccctcgcattccttagcactgacagcatgtattcgcccttggccattacctcgccttcagcctatattgccaccacac

SEQ ID NO: 648832 - DNA, 183 bp, Homo sapiens
gtatgtccggctgctgatgatcgggcatccggggtgggcccgacctgactagctgtgccgcttcaccgacaacgagttccactacctcgcacatctaccaccatcggtgtagactttaagatgaagaccatagcaggtagacggcatcaaagttgtggataacagatctagggacactagcag

SEQ ID NO: 648833 - DNA, 332 bp, Homo sapiens
accagctattttctgccctggtttgacaacaaggtaaatgttataatctctctcacacagttaatgagagacactgattcaaaatttccttgctactttaaagaacttgatcaaacatagcattgatattgtctttaatcacacttactggaccacgaaatcctggagggccaatgtcccctttctgtccctacagtgaaagacatttacaaattgtgaatatggtcacccaaagtatttacatataaaaagcaagatgtacagttaaaatgaacaatatattgatatgtagatgtcatgtacaaaccaaattaaagttaaagagacactga

SEQ ID NO: 648834 - DNA, 514 bp, Homo sapiens
  misc_feature (287)..(287): n is a, c, g, or t
  misc_feature (382)..(382): n is a, c, g, or t
  misc_feature (438)..(438): n is a, c, g, or t
  misc_feature (451)..(451): n is a, c, g, or t
  misc_feature (476)..(476): n is a, c, g, or t
  misc_feature (485)..(485): n is a, c, g, or t
  misc_feature (502)..(502): n is a, c, g, or t
tgagatggagtcttgttctatcacccaggctggagtgcagtggtgcaatcttggtacactgtagcttctgcctcccaggttccagtgattctcctgcctcagcctcctgagtagctgggattatagttgtgcaccaccaagcccggctaatttttgtatttttagtaaagacggggtttcactgtgttggtcagactggtctcgaactcctgacctcaggtgatccacctgcctcagcctcccaaaatgctgggattacagacctgagccatcgtgccctgccaatnaacaaagttttgatgagcgtttttctcttctctccttctagtgaatccagttttgggaggttcagggtcataatgttggggatcctgcccagctntctccataatcccctgtgtgtattattgggaaatgccctttttaattaagggggcncaaggttattccnttagtgaggggttaattttaggttnggaattggncttcggttttaaaagtngtgaattgggga

SEQ ID NO: 648835 - DNA, 153 bp, Homo sapiens
tcccagctactcaggtggctgaggaaagagtattgtttcagccgagttcaaggctgcagtgagccatgattgtaccactgtactccagccaggacaacagagtgagactcttgtctttaaaatgaaaaaataaatgtttaatgagaaaagtga

SEQ ID NO: 648836 - DNA, 765 bp, Homo sapiens
tctggaaacctagggctctttatttccatggtggataattcaaacaaagtcattcagtagtcttggtccaatttttttttaaaaaacaaaaaaccctcaaataaaaaatctggggcttaaaagaactctatcacaggagccgtggtgggaggatccctagttttatatacatgagaaatagaagtgcagagtttctcgtgaagaggtgttctaaagaaggaagtggatagctgtgagggggcttattctcccaggctcaaagtgattataggggtgggtgtcacaggtgctacggatatagggcggagtagggacagatgactcacggccagaggggcctgggaacgggactctggctggtcacacaatggcagggtacacaagagagggggacaacaaaaagtacatcaagggcgccaaccaacatctctgggatcagacgcattcatcatataacgtccaaaagggtggtacggcataggggagggtgggggtagaggtgcctaacagcggtcagccaggggacacagcctgcagaaattccccgaagcctgggcgctctgggggcgtgaagccagcaatcttatggtacccccttggggtcgcgaaggtcaatcttcatgtgcccatgggggtctccacaaagaacagggggctccggaaagccaggccttaggtacttgcaaaggttcaccagggtgcggacccaggacaacctcgcgataggacttgcggccgcaaagagtatcacaaacgtcgaagcac

SEQ ID NO: 648837 - DNA, 1395 bp, Homo sapiens
ctcacgagactagtccctgtgtttactagcatgtatactttagcgcacagagctacaaccaatttgtaagaattgcactctacttatgtatcactacacaacttaaacaaaactatgtctaatgtatattaatacattccaaaaaggtgcccgcgactaccagtacatcaggtatttgtcatctgatatattgattggtatgatgtaccttttgaaattggtacatgtgctcgcgactcacacatgcaatcatgtcattgatgattgcctactagtaactgtgtccttatcgctatgtcactctagatgtgtccccatttctttgtgtatccaggcattaaagttaaccagctacaatcttgaggcctcgagattttatgtccttgataagtctttcttgggtgaacgtggcacaccttggtcatggtgcctgaccgtgtgtgagtgcaactcttccagcactctcacgagaagtgtcctaacaagaagagtgccaccccgtggacagccctgtcagaggggacacccatagttcaaggcactgtcacgacataaccttagcagagaagacgctgctagtgtaactgaggtcgaagttataatacatggggccatcaaaatcagttgccatcaaacactatatataacataccgttgggagatctacctcgtagaacagaagtttggcccccaatcccatgtgtcttccaccgagaggtgatttaacacgaaggggtgctaaaccccagttgggggttctacaccccttgttgtgtaccaccccgaagcatcttataacgagagtggttacaaaaggacctacaaccccccggtgatatccctctgtgggagagaacaaacccacgaaagttggttccgacgatacatctatagcagaaacgacaacaatcaaggggacaaagtccaaggatctcacccatataagggtctagccacatcttattgctttcgtgggtgccacaacatatcactactgtactccgtgtggagtaaacactctctactagaggtcccccattcccacatctctcgggtgtcaacggccataagttaaccccccccacaaaacggggattatctttacggcatcccacaaacaaaaaagctttgtcatatacaggccagctttccatattccaaattctaaaaggggtccaaaatttaaagccactttcaacatctcacactgcgtggggcctccactctgacactaattttgccccctaaggtccacaataagacttgacccatacaacctgtcgatgggtctaccacggctcatataagtacagttgcgtgactcatcgacgttgtagactatatcttcgtcaagtgaccaacacgtggacactacaaaacgctgtgcatcccata

SEQ ID NO: 648838 - DNA, 130 bp, Homo sapiens
  misc_feature (2)..(2): n is a, c, g, or t
gntgagcaaggctgggcagcttccagcctcagtcacaggcttccggttggccatcgaggcacagcagcgcaaagtctggccagcttcaaatccttagcccatgccgtcattggttatttccatcagtgtt

SEQ ID NO: 648839 - DNA, 114 bp, Homo sapiens
atatctctcatcgtaaagccacacttatccccacctggctatcatcacccgatgaggcaaggcagccagaacgcctgaacgcaggccatacttcctattctacaccctagatag

SEQ ID NO: 648840 - DNA, 156 bp, Homo sapiens
tccgagcaggaagggttgctggatgcctgctcaaacacgtgcttctctgtctgtaccagtcacatatctcgtcatcatgcacccagtctttcttcaccactttcataggcgtaacattttggtcattcttcttcaaccgcaaccaggagaaccttt

SEQ ID NO: 648841 - DNA, 360 bp, Homo sapiens
  misc_feature (7)..(7): n is a, c, g, or t
tgcattngatttacttaattgttcaatcctagtatgtagttgaccctagaacaacacaggggttaggagcacctatgccccacacaggcaaaaatccatgtagaacttttgcctcctcaaaaactaaactacaaggagcctactgttgagcagaatctgactgataacagtcaattaacacgtatcttgtatgctgtatgtattatatactgtgtccttacaataaagtaagctagagaaaagtcaatgttattaagaaaattataagaaaaagaaaatatatttactattcattaagtgaaaatggatcatcctaaaagtcttcatcctcaccatcctcacattgggtaggatgcagag

SEQ ID NO: 648842 - DNA, 168 bp, Homo sapiens
aagacgttctggggaatctcgcttctggcctgggatgttttagctcacttggaaagtgctagagacccaagtgagcagatcccgtaaacagtctgaagagctgcgagagcgtgcagtgcccaggtaaggtgctctatggaaccaaagattctgtaaactacaggcgtc

SEQ ID NO: 648843 - DNA, 212 bp, Homo sapiens
ttcaaatgggcacagaaattcacggtcatatactgtactactttcaccaagatcacacagttttgcaaagacttgtcatatgtacaatgctatatatcacatgagaaaagctgtaagctattatatacgccaaataaatgtcgctatttacagttcgtcaggagacattataaatcatctatacattatatttctgtgcccatttcaagggc

SEQ ID NO: 648844 - DNA, 447 bp, Homo sapiens
  misc_feature (235)..(235): n is a, c, g, or t
  misc_feature (376)..(376): n is a, c, g, or t
ggcctatggcatgaagagatgaaaaaccagattattgcatgcaatggctctattcagagcataccagaaattcctgatgacctgaagcaactttataaaactgtgtgggaaatctctcagaaaactgttctcaagatggcagccgagagaggtgctttcatgatcaaagccaatcttgaacatccacatgctgagccactatggcaaactcacgtagtatgcaccttcctacggncctggaagcaggggaagacgtgggatgtattcatttacaggacgagaccagcaggctaatccaatccagttcactctaaataaggagaagctaaaagataaagaaaaggtatcaaaaagaggaagaagagaaggagagganacagcaccatgtgtctcttggagatagagtgaattctaatttgggtcctgagaaagctggaagagacacat

SEQ ID NO: 648845 - DNA, 398 bp, Homo sapiens
  misc_feature (267)..(267): n is a, c, g, or t
  misc_feature (320)..(320): n is a, c, g, or t
  misc_feature (355)..(355): n is a, c, g, or t
  misc_feature (371)..(371): n is a, c, g, or t
  misc_feature (382)..(382): n is a, c, g, or t
tgagacagagtctcgctctgttgccagggtggagtgcagtggcgcaatctcggctcactgcaagctccgcctcccagcttcaagtgattctcctgcctcagcctcccgagtagctgggattataggcactggccaccacgcccggctttttttgtatttttagcagagacagggtttcaccgtgttagccaggatggtttcgatcccctgacctcgtgatccacccgcctcggcctcccaaagtgctgggattacaggcgtgacacncgcgcctgggcaagggactttggtctttcttgcttggggctgggatgagtgtntcctgtgtgagaagaaggaggcacaaggcagattngggtgggccacagctnttaaccggganccacagagcgggcttt

SEQ ID NO: 648846 - DNA, 572 bp, Homo sapiens
  misc_feature (235)..(235): n is a, c, g, or t
  misc_feature (398)..(398): n is a, c, g, or t
ggcctatggcatgaagagatgaaaaaccagattattgcatgcaatggctctattcagagcataccagaaattcctgatgacctgaagcaactttataaaactgtgtgggaaatctctcagaaaactgttctcaagatggcagccgagagaggtgctttcatgatcaaagccaatcttgaacatccacatgctgagccactatggcaaactcacgtagtatgcaccttcctacggncctggaagcaggggggggggggggcttgcttcgtggaagacgtgggatgtattcatttacaggacgagaccagcaggctaatccaatccagttcactctaaataaggagaagctaaaagataaagaaaaggtatcaaaaagaggaagaagagaaggagagganacacaggcagcccatggtggtgctcttttggggagaaataggagatgaatggtctggaatggtgtggattccctgagggaaaggacttggaagagaccagcatgtcttcagtagccaaactacttcttgagcatagataggtatagtgggtttgcttgaggtggtaaggctttg

SEQ ID NO: 648847 - DNA, 552 bp, Homo sapiens
gcgaattcactagtgattgtgagctgagatcgcacccggtccaagcactggctttgagataagcaatattaaaaacattttcagcttcatcagatgctgactaactgacctccaaccactgttccaccagccataactacagctttggttggacaagtgactgatttcagtaactttttcctgacaaggtgactacccatcatggactggttctggctggcttacagagctcctgcacttgcatgtctttgtgtcctgaaaaggccttttgccatatagggcctaattataatacatttaaatgttaagtctccaccccaaagtgaccatgggttgtatgttgcatgcatgtttgttcaatatgcatgtgtcagaaccactttcatgaatattcatagctcctcatgtaacctgttgaatgtgtatgtttagtcaatccattgagcatgaagctcctaccctaaaccctccttctttgaagttgctgtctctcgtcttggctggagacatgcttccccgcaggtctcactccctttctgaagctggagcgca

SEQ ID NO: 648848 - DNA, 378 bp, Homo sapiens
  misc_feature (1)..(1): n is a, c, g, or t
  misc_feature (104)..(104): n is a, c, g, or t
nattgacccacttggtgaaaccctcctgccagaagaattgtttgagggaccagaagtttccattttccattgaaaaagttgtttcagggccctggctccggttntcacgcctgtaatccccagtgctttgggaggccgaggcgggcagatcatgatgtcaagagattgagaccatcctggtcaacaaggtgaagacctgtctttactaaaaatacaaaaattagctgggcatggtgccacatgcctgtagtcccagctactcgggagactgaggcaggagaatcgcttgaacctgggaggcggaggttgcggtgagtggagatcgcatcactgcactccagcctgggtgacagagcgagacttcatctcaaaaaaaaa

SEQ ID NO: 648849 - DNA, 445 bp, Homo sapiens
gggccgtcccagcagtccactagcagtgttgtccctgtagtcctggcatcatgaaggatgtatatgtgaaggggttgtggaattctctaaggagagctactgaggccgggcaacatgtggcagggcagttcccacaggaaggccctgagaggccattgcacgaagcagaagtaaagcctgggctgtcagagatcccaggtggtaggggtgtgagagtagaggtgcctgctgggaactgctggcaggaagtggaatcagcttaaaagatgtatctggccaggcatggtggtgcgcacctttaatcccagcactcgggaggcagaggcaggcagatttctgagtttgaggccagtctagtctacaaagtgagttccaggaaaccctgtctcgaaaacaaacaaaaaaagatgtatctggaagtcagcaaactggactgctgggaccg

SEQ ID NO: 648850 - DNA, 292 bp, Homo sapiens
acaggcctgcacagaaaatggcaggtcacagcaaaggagcagacatgtagtgaatcagcccaagaatatgtacatgcttggtgagaactctttggttaccacagaggctggcccatgaggtagggggtgactcgagtgaatgtcactggtcaaaatgtcccggatcatagtagagagataaggcgcccgacagacaaagcactcatcccgagtagggctgggagggtggcggcaacacaagatggtgctgggtcttcacagcaatactcccggacacaggacatctgcggcc

SEQ ID NO: 648851 - DNA, 256 bp, Homo sapiens
  misc_feature (7)..(7): n is a, c, g, or t
  misc_feature (248)..(248): n is a, c, g, or t
  misc_feature (251)..(251): n is a, c, g, or t
aaatcgntagccttttgaccatgcggatccttccattttcaccgtgctgactgccaaatccctccgacctggggtggctattgctgactttgtcatctatccacctcggtggggagttgcagataaaaccttcagacctccttattaccacaggaactgcatgagtgagttcatgggcctcatcaaaggtcactatgaggcaaagcaaggtggattcctgccagggggcggcagcctgcacagtgccnttnccctc

SEQ ID NO: 648852 - DNA, 417 bp, Homo sapiens
  misc_feature (21)..(21): n is a, c, g, or t
  misc_feature (170)..(170): n is a, c, g, or t
  misc_feature (229)..(229): n is a, c, g, or t
cccccccaaaaaaaaaaaaancccctttattttgggggtaaattttccaaaaaccaaagtgggcgtctcctcccccccccgggttaaaaaacacctcttaacctccgcgttaagaaaatgaccaaaagggaaaacccgggattttaacccttttaaattaaacacccccnggggccctttttcccccccttccgccccgggcccccgccagggtcccttgttgtcttcncaaaggtcactgggctcctgttttatgtaatgactgaccagacgatctcgcccactcagcaatgtgaacagacacccttgcatggtgccggtggtgggtgcggttgtttctggatgtcatggaaaaggctggggcataccagggctttccccaattgtgcctaaaataaattggctcttgggaggtta

SEQ ID NO: 648853 - DNA, 968 bp, Homo sapiens
cttctttttccccgtttttgtgggcccccccgtcggtggttggcttttttcctggcaggctccccgtgtgtggttgtgttgtcttgcctcctgttggtacgtttcattgaggctttgggttgtgagtgctgctatctagctctctagccgccgttcccgcgctttctccgtcgcttatatttgtgttgtgagtagagtggggggtcgctgcatcttttctcttagtttctccccccctctcccgcggtgtggttttttctcgtcgcgctccgtgatgcgcgcggtgttgctcctctctctgttcgctcccgcgacctctcgtggctctccctctcccccgcggggagagacagccccgcgcgctccactttataaatatatcctccgcctccttcccctctctctctctctcttgagacacactcctctctcccaccgcgcgccgcataatgtgtttggggcaccccgcggcgccccctccgcccgcgcgcgtgcgcgccccccccccccccctttcctccccctctcctccccccacagagacacaccaccccacacacacacaccacaccctggccctctgacccttaacacacctcctccacacacacccccactcaccacccacgcaacacacactctcccgcgcggccacccacgagccgcgctcttttgggagggacagcgcgcactcccccctcccccccccccccccccccccccgcgacacccccccccctctccccctctttcccccccccccgcgcagccccccccccccccccgacaccccccccgcggggcgccccacccccccccgcgcgcacccccccacacaaagaccacacccccgggtccccccctggagagtttctcaccacccccttttaaaccaaattcccccctccccccccccccccccctttttccccccccccaccccattaaatttttttcccccccccaca

SEQ ID NO: 648854 - DNA, 684 bp, Homo sapiens
tgtctctccggtgcgtgctttcaaaatgagccaaatactagaaagaacaaaggtacatgctgaataggggcgtggctcgagcagtgctgtctattacctgtggcacataagtgtgcccgatgattgcccaacggacatggcccttcagaaatcccagtcatactgaataccaatagggtggaacggcacgcaagtccgttgcgaccggtaggctactttatgtgaagagcgaagtcgatcattctgactcgcacttaatgcttgcgatacccggtcgcatggtcccttgtcgaagggctaagaatccaactcgttgtcgatgtgtgggctagtttgacccgtgataggtagtctaggcgacctaggaagctcggtcaatgcctccgtagcggacacggaacagcctacaagcgtctcgaatgcccagaggcataggaaggtctgggagggaagtcagcgatcgacgcgaatactggagactctccaggtctcgtgtatgcatcgtaatttcatccaaaagaacgcgaacggcacactttaactcagtcttggaatgtatagcaaataaacaaagggaaattagatggcttactttcttttaacacaatgtcaaaaaaaaacaaaacaatctatccagccgaacacacaaaccccttctggtcgggcccctttgcacccctccaa

SEQ ID NO: 648855 - DNA, 120 bp, Homo sapiens
gttgtagacagcggcctagaagaaccagccctcaaaatcgagtaggaatatctacatcgaggccactcagctccaaggtaccgatgatgcatccatgtcagtcctcttgttcgaaggaca

SEQ ID NO: 648856 - DNA, 108 bp, Homo sapiens
gagataatgaatggcctagtactagataatatatgggcccacaggcttttgactttttatcctcggggaaagccattttgttaacaacactagtgagatttacataat

SEQ ID NO: 648857 - DNA, 407 bp, Homo sapiens
gctgccaagaaagccacccgttaccttggccgaaaggggcgagctgcgcaagtccattttctcgtgagtcccggaagcccagggtgtccatcatggagccgggggagaccgggcggaacagctaccccggggccgagacgggccttttttcacggtccaggtccggctcagaggaggtgctgtgcgattcttgcatcggcaacaagcagagggcggtcaagtccggccgggtgtgccaggcctccttcggcgagctgcatctcaagcccgaccgggggggcgccgctttccgagaccaccagtggctcgaagcccatcggggcatgggaggcttgggcgcctccatgcaggggcaggaagcagaggtgagtcagggtgcacaggcaagtggcggcagccaaggaagg

SEQ ID NO: 648858 - DNA, 356 bp, Homo sapiens
aagtctgaaggagagacttacgagaaagagaatgagagatatttttctttacaaacttttgttcctctggggctcccattacaaatttcagggtgaatcaaaccattccagcaaaacccatagagtactttttttctttttctttttcttttcttttcttttttttttttttttttgggaaaaaaattttattcctttttgcccaggcggggggccaaggaaaaattttaagttaattgaaccctcggcttggggggtaaaaggaattttctttaaaatttggggacccggcctaaaattcgaaataagggcaatggtttttcccggggggaaaaaaaggccccccaaagaaaaaa

SEQ ID NO: 648859 - DNA, 595 bp, Homo sapiens
agaagccctgggtggacatgttccaaaacaagggcatggttttactcagcacctttgaatctttgatgactccaggctctggtaggagccaggaggagatgtcaggtctgaagctgaacccgtgtggtcgtggcagctctccccacgtgggtttcccaaggcgctcaggctctgagttgttcttccagtctgtaatgtggtacaaaggtaggaggcatctcaaaggatgaactagaagtaatgtaataagcccttagcctgaggcccggcacgtagcgggcaagctgtgaactccgactgcgccaccgtattccggacatgctgtgatcgtcgggtgggggcggatgttgaagcatcagtggcctctgtctggttagcgacgctgcacctcctgacccctttctactccctcaggcttggtccttccctgggccccgttagcttcactgtgagtgcctcccattcatccaggcatccgtgtcccacgcagaggtccccatgacagtgaggacttacgtcttttaaactgcagttcccgtagtccctggagcggtgcctggcatgtcgtgggctcaataaataatcattgaataga
